United States Patent 11,931,406 (FLAVIVIRUS VACCINE) - sequence listing, part 70

SEQ ID NO: 24266 - RNA, 9879 nt, Artificial Sequence
  derived and/or modified CDS sequence (opt11) from DENV-1__FJ882541__SS-prME
agcguuacgaugcugcucauguuaauccccaccgcauuagcauuccaccucaccacccggggcggggagccccauaugauagugucuaagcaagagcggggcaaaagccuucuguucaagaccagugcgggggugaacaugugcacgcucaucgccauggaccugggugagcuaugcgaggauaccaugacguauaagugcccucggaucaccgagguggagcccgacgacgucgacugcuggugcaacaccacggauacuugggugaccuacgguaccuguucccagacgggagagcaucgacgcgacaagcggagcguggcccuugcaccccauguugggcuugggcucgagacccgcgccgaaaccuggaugagcucagagggcgcguggaagcagauacagaagguggagacaugggcccuccggcaccccggauucaccgugaucgcccuguucuuggcccacgcgaucgguaccagcaucacccagaagggaaucaucuucauccuccucaugcuggucacaccauccauggccaugaggugcgugggcaucggcagccgggacuucguggaggggcucuccggagccaccugggucgaugugguacuggagcacgguaguugugucaccaccauggcuaaggacaagccaacccuggacaucgagcuccugaagacggagguaaccaacccagccguucuucgcaagcucugcaucgaggcuaagaucuccaacacuaccacggacagccggugcccaacccagggugaggccacucugguugaggagcaggaugccaauuucguuugccgccggaccuuuguggaccgcggcuggggcaacggcugcggccuguucggcaaaggauccuuaaucacgugcgccaaguucaagugcguaaccaaguuagagggaaagaucguacaguacgaaaaccugaaguacagcgugaucgugacuguacacaccggcgaccagcaccaggucggcaacgaguccacggagcacgggacuaccgccaccaucacgccccaagcgcccacgagcgagauucaacucacugacuauggagcccuaacccuggacugcagcccacggacaggccuugacuucaacgagauggugcugcugacgaugaaggggaaauccuggcuuguucauaagcagugguuucuagaccugcccuugcccuggaccuccggggcaaguacuagccaggagaccuggaaucgccaggaucugcuggucacauucaaaaccgcacacgccaaaaagcaggagguggugguccucgguagccaagagggagcgaugcacacagcccugaccggcgcgacggaaauccagacuagcgggacaaccacuaucuucgccggacacuugaagugcaggcucaagauggacaagcugacacugaagggcauguccuacgugaugugcacgggaucauuuaaguuagagaaggagguugccgaaacccagcacggcacgguccugguucagaucaaguacgaggggaccgaugcgccgugcaagauuccauucuccacccaggacgagaaaggcgugacucagaacgggcgccucaucacagcgaauccaaucgucacggacaaggagaagccugugaacaucgaggccgaaccgcccuucggugagucauauauuguuaucggggccggggagaaggcucugaagcucucaugguucaaaaaggguagcuccaucgggaagauguucgaagccacugcccggggcgcucgccggauggccauacugggggauaccgcgugggacuucggcagcaucggcggggucuucacguccguaggaaagcuggugcaccagauauucgguacugccuacggcguucucuucagcggggugucguggaccaugaagauuggaaucggcgugcuacugacauggcuugggcugaacagccgcuccacgucgcuguccaugaccugcaucgcggucggccuggugaccuuauaccugggggugaugguucaggccgacagcggcugcguaaucaacuggaaggggcgugaguuaaagugcggcagcggcaucuuugugacgaacgagguccacacguggaccgagcaguauaaguuccaggcggacuccccgaagcgacugagcgcggccaucgggaaggccugggaagagggcgugugcgguauucgcagcgccacccggcuugagaacaucauguggagacagaucucaaacgaacucaaccauaucuuacuggagaacgacaugaaguucacugucgucgucggcgacgugguggggauccucgcccagggcaaaaagaugauacgcccucagccaauggagcacaaguacagcuggaaguccuggggcaaggcgaagaucauaggcgcagaugugcagaacacgacuuucaucauagacggccccaacaccccggagugcccggacgaucaaagagcguggaacaucugggagguggaggacuacggguucgggaucuucaccaccaacauauggcugaagcugcgggacuccuacacccagguuugcgaccaccgccuuaugagcgccgcgaucaaggacuccaaggccgugcacgcagacaugggcuacuggaucgagagcgagaagaacgagaccuggaagcuagcccgugccucguucaucgaggugaagacguguaucuggcccaagagccacacccuuugguccaacgggguccucgagagcgagaugauuauccccaaaauuuacggcgggccgaucucccagcacaauuaccgcccaggauauuucacgcagacagccggacccuggcaccuaggcaagcuggaacuagacuucgaucugugcgagggcaccaccgucguggucgacgagcacugugggaaccggggcccgucucugcguacgaccaccguuacugggaaaauuauccacgaguggugcugucgauccugcacccugccgcccuuacgcuuuaagggggaggacgguugcugguacggcauggagauccgaccgguaaaggagaaggaagaaaaccuggugaagucaauggugagcgccggaagcggggagguagacuccuucucccucgggcugcugugcaucuccauaaugaucgaggaggucaugcgcucccgguggagccgcaaaaugcucaugaccgggacccucgccguguucuuccugcucaucaugggccaacugacuuggaaugaccugauucgguccugcauaauggugggggccaaugcgagcgaccgcauggggaugggcacgacuuaucucgcccugauggcuaccuucaagaugcgcccgauguucgccgucgggcuccuuuucaggcgccugacauccagggaagugcuccuccuuacuaucggacuuucacucguggccaguguggaacuaccuaacagccuggaggagcucggggauggacuggcuaugggcaucaugauucugaaauuacuuacugauuuucaauccuaucagcugugggcuaccuugcugagcuugaccuucaucaagacgacguuuucccuccacuaugccuggaagacaauggccaugguccugagcaucguaucccuacucccccugugcuuaagcaccacaucccaaaagaccaccugguuacccgugcuguuggggucgcucggcugcaagccccugaccauguucuuaauagcugaaaacaagaucugggggcgcaagagcuggccccucaacgaaggcaucauggccguggggaucgucuccauauuacugagcuccuuguuaaagaacgacgugccucuugccgggccccucaucgccggcgggaugcugaucgccuguuacgugauaagcggcuccucggcugaccugucccucgagaaagcggccgaggugagcugggaagaggaagccgagcacucgggcgccucucacaacauccuggucgaagugcaggacgacggcacgaugaaaaucaaagacgaggagagagacgacacccugaccauacuccugaaagccacucugcucgcggucuccggggucuacccgcugagcaucccggccacucuauucgugugguauuucuggcagaagaagaagcagagaucgggcguccucugggacacccccucaccgcccgagguggagagggccgugcucgaugacgggaucuaccgcaucaugcagcgggguuuacugggacgaucccaggucggcguuggcguguuccaggaaaacgucuuccacaccauguggcacgugacccgcggggccgugcucauguaucagggcaagcgacuagagcccucuugggccuccguaaaaaaggaucugaucagcuauggcgggggauggcggcuccagggauccuggaauaccggcgaggaggugcaggugaucgcaguggagcccgggaagaaccccaagaacguucagacggccccugguaccuucaagacccccgaaggcgaggugggggcgauagcccuggacuucaagcccggcacgagugggagccccaucgucaaucgcgagggaaaaaucgugggccuuuacgggaacggcgucguuacgaccucggggaccuacguguccgccaucgcgcaggcaaaggccucacaggagggcccgcucccugagauugaggacgagguguuccggaagcgcaauuugaccaucauggaucugcaccccgggagcggcaaaacucggcgcuacuuaccggccauaguaagggaggcgaucaagagaaagcuucggacacugauacucgcucccacccgcguuguggccuccgagauggccgaggcccucaaaggcaugcccauccguuaccaaacgacggcgguuaagagcgaacacaccgggcgggagaucguggaccugaugugucacgcaaccuucaccaugagacuccugucccccgugcggguccccaauuacaauaugauaauaauggacgaggcacauuucacggacccuagcucaaucgccgcgcgaggcuacauuuccacccgggugggcaugggugaagcggccgccaucuucaugaccgccacgccgcccggguccguggaggccuucccgcaguccaacgcgguuauacaggaugaagagcgcgauauccccgaaagauccuggaacagcggcuacgaguggauaacggacuuucccggaaagacaguuugguucgugcccuccaucaagagcgggaacgauaucgccaacugccugagaaagaacgggaagcggguaauccaacucucucggaagaccuucgacacggaguaccagaaaacuaagaauaacgacugggacuacgugguuacgacagacaucagcgagaugggcgcuaacuuccgggcagacagggucaucgacccacgucgcugccuuaagccggugauccuuaaagacggccccgagcgagucauccucgccgggccaaugccggugacuguggcauccgccgcacagaggaggggccgcaucgggcggaaccauaacaaggagggcgaccaguacaucuauaugggccaaccccugaacaacgacgaggaucaugcccacuggacggaggcuaaaaugcugcucgacaauauaaacacgcccgaagggauaauccccgcccuguuugagccagaacgcgagaaauccgccgcuaucgacggagaguaccgccugcgaggagaagcuagaaaaaccuucgucgaacucaugcggcgcggagaucugccuguguggcugagcuacaagguggcgucggagggcuuccaguauagcgaucggcgcuggugcuuugacggagagcgaaauaaucagguccucgaggagaacauggacguggagaucuggaccaaggagggggagcgcaagaaacugcggccgcgcugguuagaugcccggacguauuccgauccccucgcccugcgcgaguucaaggaguucgccgccgggcggaggagcguguccggggaucugauccucgagauuggaaagcucccgcagcaccuuacccagagggcacagaaugcuuuggacaacuuagucaugcugcacaacagugagcagggcgggcgcgccuaccgucacgccauggaggaguuacccgacacuauugagacccugaugcuucucgcgcuaaucgcgguguuaaccggcggggugacccuguucuuccuauccgggcgcgggcugggcaaaaccaguauugggcuucugugcgugauggcguccagcgcccugcucuggauggccuccguugagccccacuggauagcggccagcaucauccuggaauucuuccuaauggugcuccugauacccgagccggaccggcagcgcacaccucaggacaaccaacuggccuacgucguaauaggccuccuguucaugauccugaccguggccgccaaugagaugggucuucuggagacgaccaagaaggaccuagguauaggacacgucgcgguggagaaccaccaccaugccacaaugcucgacguggaccugcaccccgccucggcguggacccuguacgcuguagcgacgaccaucaucacaccgaugaugcgacacacuaucgaaaacaccacugcuaauaucagccucacggccauugccaaccaagcagcgauccugaugggacuagauaagggcuggcccauuucuaaaauggauaucggggugccgcuccuggcccuuggcugcuacucacagguuaacccccucaccuugaccgcagcggugcugaugcucguggcgcacuacgccaucauagggccgggccugcaggccaaggccacccgcgaggcccagaaacggaccgccgccgggaucaugaagaacccaaccguggaugggauugucgccauugaucuugaccccgugguguacgaugcaaaguucgagaagcagcucggccagaucaugcuucugaucuuguguacgucccagauacugcugaugagaacaaccugggcucuuugcgaguccaucacccuggccaccgggccccugaccacccucugggagggcuccccuggcaaguucuggaacaccacgaucgcugucaguauggcaaacauuuuccgcggcagcuaccucgccggagccgggcucgcguucucccuuaugaagucccugggcggaggccggcgcgggaccggugcccagggcgagacccugggagagaaguggaaacggcagcucaaccagcugucaaagagcgaguuuaacacguacaagcgauccggcaucauggagguggaccguuccgaggcgaaggagggacugcgacguggggagacgaccaagcacgccguaucccgcgggaccgcaaaacuacggugguucgucgagagaaauuuagugaagcccgaggguaaggugaucgaccuugguugugggcggggcggguggucguacuacugcgcgggcuugaagaagguaacugaagugaaaggguacacaaaggggggccccgggcaugaggaaccaaucccgauggccaccuacggauggaaccucgugaagcuccauucgggaaaggacgucuucuuuaucccucccgagaagugugacacccugcucugcgacaucggcgaaagcucgcccaacccuaccauagaagaggggcgcacccugcggguacugaaaaugguugagcccuggcucagaggcaaccaguucugcaucaaaauccugaaccccuauaugccgagcgucguggagacccuggagcagaugcagcggaagcacggcggaaugcuuguacgcaacccgcuguccaggaacaguacacacgagauguacugggucagcuguggaacugguaacauugugucggcagugaacaugacuucucgcaugcugcucaaccguuucaccauggcccaucggaagccaaccuacgagcgcgacgucgaccugggcgcgggaacacgccacgucgcaguggagcccgagguugccaacuuggacauaaucgggcagcgcaucgagaacauaaagcacgaacacaagagcaccuggcacuacgacgaggauaaccccuacaagacaugggccuaucacggcagcuaugaagugaagccgagcgguucggcaaguagcaugguuaacgggguggugaaacugcugaccaagcccugggacgucauuccaauggugacccaaauugcaaugaccgauacaacacccuucgggcagcagcggguguucaaggagaagguggacacacgcacccccaaggcuaagcggggcaccgcccaaauaauggaggucaccgcucgcuggcuguggggcuuccucucccgcaacaagaagccacgcaucugcacccgggaggaguucacacgaaaggugcggagcaacgccgcgaucggagccguauucguggacgagaaccaguggaauuccgccaaagaggcgguggaggacgagcgguucugggacuugguccaccgggaacgggaguuacauaagcaaggcaagugcgcgacguguguguacaauaugauggggaagcgggagaagaagcucggcgaguucgggaaggcuaagggcagccgggcuaucugguacauguggcugggggcccgguuucuggaguucgaggcucuaggcuucaugaacgaagaccauugguucucccgugagaacagucuaaguggcguggagggggaaggccugcacaagcucggguacauccuccgggacauaagcaagauccccgguggaaacauguacgccgacgacaccgcugggugggacacccgcauaacugaagacgacuugcagaacgaggccaaaaucacggacauaauggagccugaacacgcccuccuggcaaccuccaucuucaagcucaccuaccaaaacaagguaguacgcgugcagcggcccgcgcguaacggaaccgucauggaugugaucagccggcgcgaccagaggggauccggccaggugggaacguacgguuugaacacguuuacaaacauggaggcccagcugauccgacaaauggagagugagggcauuuuuagcccaucugagcuggagacccccaaucucgccgagcgcgugcuggacuggcuggagaagcacgggguggagcgccucaaacggauggcuaucaguggcgacgauugcgucguaaagccgaucgacgauagguucgcuacggcccugucugcccugaacgacauggggaaggugcggaaggacaucccccagugggagcccagcaagggcuggaacgacuggcagcagguccccuucugcucccaccacuuucaccagcugauuaugaaagacggccgggagaucgucguuccgugcagaaaucaggacgagcugguagggcgcgcccggguaucccaaggagccggguggucucugcgcgagacggcuugccuuggaaagucauacgcgcagauguggcaacugauguacuuucaucggcgugaccugcggcuugcagccaaugcaaucugcagcgcagugcccguggacuggguccccaccagccguaccacguggucaauacacgcccaccaccaguggaugacgaccgaggacaugcugagcguguggaaccggguguggauugaggagaaccccuggauggaggacaagacccacaucagcagcuggggcgaugucccuuaccugggcaagcgggaggaccaguggugcggcucccuaaucggucugacggcccgugccaccugggccaccaacauucagguggcgaucaaccaagugcggcggcugaucgguaacgagaacuauuuggacuacaugacuagcaugaagcgguucaagaacgaauccgaccccgaaggggcccugugguga

SEQ ID NO: 24267 - RNA, 9879 nt, Artificial Sequence
  derived and/or modified CDS sequence (opt11) from DENV-1__FJ882542__SS-prME
ucggugacaaugcugcucaugcugaugcccaccgcgcuggcauuccaucuuaccaccaggggaggcgaaccccacaugaucgugacuaaacaggaacgggggaagucccugcucuuuaaaaccagcgcgggagugaauaugugcacucucaucgccauggaccugggcgagcugugcgaggacaccaugaccuacaagugcccccggaucacugaggccgagcccgacgacguugauugcuggugcaacgcaaccgacaccugggugaccuacgggacuugcagucagacaggcgaacaccggcgcgacaagcgaagcguggcccucgcaccccacgugggucuagggcucgagaccaggaccgagaccuggauguccagcgagggggccuggaagcaaauccagagaguggagacgugggcccuccgccaccccggguucacagugauugcccuguuccuggcgcacgccaucggcacuuccaucacccagaaggggaucaucuuuauccuccugaugcuaguaacgccuagcauggccaugaggugcguaggcaucggcucucgcgauuucguggaggggcucagcggcgccaccuggguggacgucgugcucgaacacgguuccugcgugaccacuauggccaaggacaagcccacguuagauaucgagcuccugaagaccgaggucaccaauccugcggugcugcgcaagcuauguaucgaggccaagauuagcaacaccacgaccgacucacgcugccccacccagggcgaggccacccugauggaggagcaggacgccaauuuugugugccggcgcacguuugucgaccgugggugggggaacgggugcgggcuguucggcaaggggucucucauuacgugcgcgaaauucaagugcguaaccaagcuggagggcaagaucgugcaguacgagaacuugaaguacuccguuaucgugaccgugcacacgggcgaccagcaccaggucgggaaugagagcacugaacacggcacaaccgcgacaaucacgccccaggcuccaaccuccgagauccaacuaacugacuacggggcccugacccuggacugcagcccccgcacaggcuuagacuucaacgagaugguccuucuaacuaugaaggagaaguccuggcucgugcacaagcagugguuucuggaccucccgcuccccuggaccagcggggccucaaccucccaggagacguggaaucggcaggaccugcuagugacguucaaaacugcccacgccaagaagcaggaggucgucguccucggcagccaggagggagcaaugcacaccgcccugacgggggccaccgagauucagacgaguggcaccacgacuaucuucgcuggacaccucaagugccgucuaaagauggacaagcugacacugaagggcaugagcuacgugaugugcacagggucauucaagcucgagaaggaagucgcagagacgcagcacgggaccgugcucguccaaaucaaauacgagggcaccgaugcccccugcaagauccccuucagcacccaggacgagaagggggucacgcagaacggccggcugauuaccgccaacccgaucgugaccgacaaagaaaagcccgugaacaucgaggccgagccgcccuuuggggagucuuacaucgucaucggcgcuggggagaaggcccugaagcucagcugguucaagaagggguccagcaucggcaagauguuugaggcgacggcucgcggggccagacgcauggccauccugggcgacacagccugggacuucggcucagugggcggcguguucaccagugucgggaagcuggugcaccagauauuuggcacugccuauggcguacuguucucuggaguaagcuggaccaugaagaucgggaucgggguguugcugacguggcucggcuugaacucuagaucgaccucucuguccaugaccuguaucgccguagggcucgucacccuguaccugggcgugaugguacaggccgacuccgggugcgucaucaacuggaagggacgggagcuaaagugcgggagcggcaucuuugugacgaacgaggugcacacauggaccgagcaguauaaguuccaggcggauagccccaagcgccuguccgcugcuaucggcaaggccugggaagagggggucugcgguauacggagcgccaccagacuggagaacaucauguggaaacagaucucuaacgagcucaaccacaucuugcuggagaacgacaugaaguucaccgugguggugggagacguggugggcauccuugcgcaagggaagaagaugauccggccccagcccauggaacacaaauacagcuggaaguccuggggcaaggcgaaaaucaucggggccgauguccagaacacgaccuucaucaucgacgggcccagcacaccggagugccccgacgaccagcgcgccuggaauaucugggagguggaggacuacggcuucgggauuuucaccaccaacaucuggcugaaauuacgggacaguuacacccaagugugcgaccacagacucaugagcgcggccaucaaggacuccaaggcuguccacgcugacaugggcuacuggauugaaagcgagaagaacgagacguggaagcuggcccgcgcguccuucaucgaggugaagaccugcaucuggccaaaaagccacacccugugguccaacggcguguuagagagcgagaugaucauuccaaagauauacgggggcccgauuucccaacacaacuaccgccccgguuauuuuacccagaccgccggccccuggcaccuggggaagcuggaguuggacuucgauuuaugcgagggcaccacggucgugguggacgagcauugcggcaaccgggggccuucgcugcgcaccaccaccgucacgggcaagauuauccacgaguggugcugucggagcugcacccugccgcccuuacgcuucaagggggaggacggaugcugguacgggauggaaauccggcccgucaaagagaaggaggagaaccuggugaaguccauggucagcgccggcuccggcgaaguggacagcuucucccuugggcugcugugcauaagcaucaugauagaggaggugaugcgcucccgguggagccgcaagaugcucaugaccggcaccuuagccguauuccugcuccugauuaugggccaacugacguggaacgaccucauccggcugugcauuauggugggcgccaacgcguccgaccgcauggggaugggcacuaccuaucuggcccugauggccacguucaagaugagaccgauguucgccgucggccuguuguuccggcgucucacuagccgggagguccugcugcucacgaucgggcucucccugguggccagcgucgaacuccccaacagccuggaggagcugggugacggucucgcgaugggaauaaugauccugaaguugcucaccgacuuccagagccaccagcugugggccacacugcucucccugaccuucaucaagaccacccugagucuccacuacgccuggaaaaccauggcgaugguacuguccaucgcgucgcuguucccccucugccuguccacgacaagccagaagaccaccuggcugcccguacugcugggcucucucgggugcaagccgcucacaauguucuugaucaccgagacaaagaucuggggccgcaagaguuggccccugaacgaggggauuauggccgucggaguggugagcauccuccuguccagccugcucaagaaugacgucccccuggcugggccccuuaucgccggcgggaugcugaucgcuugcuaugugaucuccgggucaagugcggaccucagccuggaaaaagccgcugaggucuccugggaggaggaggccgagcacagcggcgccucccacaacauccucgucguggugcaggacgaugggaccaugaagauuaaggacgaggagcgugacgacacccugacgauccugcucaaggccacccugcuggccguuagcggcguguacccucucuccauccccgccaccuuauucgugugguacuucuggcagaagaagaagcagcgcagcgggguucugugggauacccccagcccgcccgagguggagcgggccgugcuugacgauggcaucuacaggaucaugcagcggggcuuacuggggcgcagccaggucggcguggguguguuccaggagaaugucuuccacacgauguggcacgugacgaggggcgccgugcuuauguaccagggaaagcgacucgagccuuccugggcuagcgucaaaaaggaccugaucuccuacggcggaggguggcggcugcagggcagcuggaacaccggugaagaaguccagguaauugccgucgagccaggaaagaaccccaagaaugugcagaccgcacccgggacuuucaagacacccgagggcgaagugggcgccauagcgcucgacuucaagcccggcaccuccggcagcccuaucguuaaccgcgaggggaaaaucguaggccuguacggcaacgggguggucacgacgagcggcacauacguguccgcgauugcacaggccaaggccagccaggaggggccccuacccgagaucgaggacgagguguuccggaaaaggaaccuuaccauaauggaccugcacccaggcuccgggaagacccggcgcuaccugccggcaaucguccgagaggccaucaagcgcaagcuccggacgcugauucuggcccccacccgcguaguggcuagcgagauggccgaggcgcucaagggcaugcccauccgcuaccagaccaccgccgucaagagcgagcauacgggcaaggagaucguagaccugaugugccacgccaccuuuaccaugcggcugcucagccccguccgagucccgaacuacaacaugauuauuauggacgaggcacacuucaccgaccccaguagcaucgccgcccggggguacaucucaacgcgcguaggcaugggggaggccgccgcaaucuucaugaccgccacaccucccggcagcguggaagcguucccgcaauccaacgcggucauacaggacgaggaacgggacauccccgagcgcagcuggaacucaggguacgaguggaucacugauuucccaggcaagacggugugguucgugcccagcauuaaaagcggcaacgacaucgccaauugucugcggaagaacgggaagcgcgucauccagcugagccggaagacguuugauaccgaguaccaaaagacaaagaacaacgauugggacuacgucguaacaacugacaucuccgagaugggcgcgaacuuccgcgcggaccgggucaucgauccgagacggugccugaagcccgugauacugaaggacggcccagagcgggucauacuggcgggccccaugccggucaccguggccagcgccgcacagcgucgcgggcggaucggccgcaaccacaacaaggagggcgaccaguacaucuacauggggcagccccucaacaaugacgaggaccaugcgcauuggacggaagccaagauguugcuggacaacauuaacacgcccgaaggcaucaucccugcccucuucgagccggaacgggagaaguccgcggccaucgacggggaguaccgccugcgcggcgaggcgcggaagacuuucgucgagcugaugcgccgcggggaccuucccguguggcucaguuacaagguggccucagagggcuuucaguacuccgaucgccguuggugcuucgacggcgagcguaacaaccagguccucgaggagaauauggauguggagaucuggaccaaggagggggagcguaaaaagcuccgcccccgguggcuggacgcccgcaccuacagcgauccgcuggcacuccgggaguucaaggaguucgccgcgggccgccggucaguuagcggggaccucauccuggaaaucggcaagcucccgcagcaccugacacagcgcgcucagaacgcccuggacaaccucgucaugcugcacaacuccgaacagggcgggcgggccuaccgccaugcgauggaggagcugcccgacaccaucgagacucucaugcugcuggcucucaucgccgugcugaccggcgggaugacacuuuucuucuugagcggcagaggucugggcaagacguccaucgggcugcucugcgucauggccagcuccguacugcuuuggauggccagcguggaaccccacuggaucgcggccucgaucauccucgaguucuuucugaugguucugcucauccccgaaccggaccgccaacggacgccccaggacaaccaacuggccuacgucgugaucggccuccuauucaugauccugaccguugccgccaacgagaugggccugcucgagaccacaaagaaggaucuggggaucggccacgucgccguggagaaccaccaccacgcgaccaugcuggauguggaccuacaccccgccagcgccuggacccuguacgccgucgcgaccacgaucauaaccccgaugaugcgccacaccaucgaaaacacaacggccaacaucucccugaccgccauagccaaccaagccgcgauccucauggggcuggacaagggcuggcccauaucuaaaauggacaucggagugccccugcucgcgcuggggugcuauucccagguuaacccccugacccucacugccgccguccugaugcugguugcgcacuaugccaucauaggaccgggcuuacaagccaaggccacgcgggaagcccagaagcgcaccgcggccggcaucaugaaaaaccccacaguggacgggaucguggccauugaccuggacccuguggucuacgacgccaaguucgagaagcagcugggucaaaucaugcuccugauccuaugcaccagccagauccuccucaugcggacuaccugggcccugugcgagucuauuacucuugcgaccggcccccugacaacccugugggaggguagcccgggcaaguucuggaauaccacgauagccguuuccauggccaacaucuuccgggggucuuaccucgccggcgccggccuggcguucagccuaaugaagucccucgggggcgggcgccguggcacuggggcccaaggcgagacccuaggugagaaguggaagcgccagcugaaccagcucucuaagagcgaguucaacaucuacaagaggagcgggaucauggaaguggauagaucagaggccaaggagggccuuaagcgcggcgagaccacccgccacgcugucucccggggaacggcgaagcuacgcugguucgucgagcggaaccuggugaagcccgaggggaaggugaucgaccucggcugcggucgcgggggcugguccuacuacugcgccgggcuuaagaaggucacagagguuaagggcuauacaaagggcgggccuggccacgaggagccaaucccaauggccaccuacggcuggaaccuggugaagcuccacagcggcaaggacgucuucuucacgccgcccgagaaaugcgacacccugcugugcgacaucggggaguccagccccaacccgaccaucgaggagggccggacccuccgcguccugaagaugguggagcccuggcugcggggcaaccaauucuguaucaagauccucaaccccuacaugcccucggucguggagacccuagagcagaugcagcgcaagcacggcggcaugcuuguccggaacccacucuccagaaauuccacgcaugagauguacugggucucaugcgggaccggcaacaucgugagugccgugaacaugaccagccggaugcugcugaaccgcuucaccauggcccaccgcaagcccacauaugagcgggacgucgaccucggggcgggcacacgacacguggcaguggagccagaggucgccaaccuggacaucaucgggcagcggaucgaaaacaucaagcaugaacacaaguccaccuggcacuacgacgaggacaacccauacaagaccugggccuaccacgggagcuacgagguaaagccaaguggcagcgccagcuccauggugaacgggguggugaagcugcuuacuaagcccugggaugucauccccaugguuacccagaucgcgaugaccgacacgacgcccuucggccaacagcgcguguucaaggagaaggucgacacccggaccccgaaggccaagcgcgggacugcccagaucauggagguaacggcccgguggcugugggguuuccugagccggaauaagaagccacggaucugcacccgcgaagaguucacccguaaggugcgcuccaacgcugcgaucggcgccgucuucguggacgagaaccaguggaacagcgccaaggaggccguggaggacgagcgguucugggaccuuguacagaaggagcgcgaacugcacaagcagggaaaaugcgcgaccugcguguacaacaugaugggcaagcgggagaaaaagcugggggaguucggcaaggccaagggaucccgcgccaucugguacauguggcucggcgccagguucuuggaguucgaggcccugggcuucaugaacgaggaucacugguucagccgcgaaaacucccucucugggguggagggagaagggcugcauaagcugggcuauauccucagagacaucagcaagauccccggcggcaacauguacgcugacgacacggcaggcugggacacccgcaucacagaagacgaccuacaaaacgaggcgaagaucaccgacaucauggagccggaacaugcccugcuggccacgagcauuuucaagcugacauaccagaauaagguaguacgcguacagcgcccagcaaagaaugggaccgugauggacgugaucucccgccgggaccagcgcggcagcggccaagugggcaccuauggccugaacacauucaccaauauggaggcccaguugauccggcagauggaauccgaagggaucuuccugcccagugagcuggagacccccaaccuagccgagaggguccuggacuggcuggagaaguacggcguggaacggcucaagcgcauggccaucucuggggacgacugcguggucaagccgaucgaugauagauucgccaccgcgcugacggcccugaacgauaugggcaaggugcgcaaggacaucccccagugggagcccagcaagggguggaacgacuggcagcaaguccccuucuguucccaccacuuccaccaacugaucaugaaggacggucgggagaucgucgugccgugccgcaaccaagacgagcuggugggccgggcccgcgucagccagggggccggcuggagccuuagagagacugccugccucgguaaauccuacgcgcagauguggcaacugauguacuuccacagacgugaucugcgccuugccgccaacgccaucugcucugcagugcccguggacuggguccccaccucucggaccacgugguccauacacgcgcaccaccaguggaugacuaccgaggacaugcuuuccguguggaaucgcguguggaucgaggagaacccguggauggaagacaagacccacgucagcuccuggggcgacgucccguaccuggggaagcgggaagaccaguggugcggcucccucaucggacuaaccgcccgcgccacuugggccuccaacauucagguggcgaucaaucagguccgccggcugaucgggaacgagaauuaccucgacuauaugaccagcaugaagcgcuucaagaacgagggagaccccgagggggcccuaugguga

SEQ ID NO: 24268 - RNA, 9879 nt, Artificial Sequence
  derived and/or modified CDS sequence (opt11) from DENV-1__FJ882543__SS-prME
agcgugacuaugcugcucauguugaugccgaccgcguuggccuuucaccucaccacgcgcggcggggagccccauaugauugucacuaagcaggaaagaggcaagagucuguuauucaaaaccagcgcagggguaaacaugugcacguuaaucgccauggacuugggggagcugugcgaggacaccaugaccuauaaaugcccccggauuaccgaggccgaacccgacgacguggacugcuggugcaacgccacggacaccugggugacguacgggaccuguagccagacgggcgagcaccggcgagacaagcggagcguggcccucgcgccccacguggggcugggucucgaaacccgcaccgaaaccuggauguccucagagggcgccuggaagcagauccagcgggucgagaccugggcccuccgccacccgggguucaccgugaucgcccuuuuccuggcgcacgcgaucggaacguccaucacccagaaggggaucaucuucauccugcugaugcugguaacacccuccauggccaugcggugugucggcaucgggucgcgcgacuucguggagggacuaucuggagccaccugggucgacgucgugcuggagcauggcuccugcguaaccaccauggcaaaggauaagcccacgcuggauauagagcuacugaagaccgaagucaccaacccugcgguacuacggaagcucugcauagaggccaagaucucgaacaccacuaccgauucccgcuguccgacacagggugaggcgacccuaauggaggaacaggaugcuaacuucgugugccggcggacguucgucgacagaggcugggggaacggcugcgggcucuucgggaaggggucgcucauuacgugcgccaaguuuaagugcgugaccaaacuagaaggcaagaucgugcaguacgaaaaccugaaguauuccgucauagugaccgugcacaccggcgaccagcaccagguaggaaaugagagcaccgagcacggcaccaccgcgacuaucacgccccaagcacccacgucggagauccaguugaccgacuacggggcccugacccuagacugcuccccccgcacgggccucgacuucaaugagauggugcuacugacaaugaaagaaaaguccuggcucguccacaaacaaugguuccuggaccucccgcuccccuggaccagcggugccucuaccucccaggagacguggaaccggcaggaccugcugguaaccuucaaaaccgcccacgcaaagaagcaggagguaguagugcucggcagccaagaaggcgccaugcacaccgcccugacaggagccaccgaaauccaaaccaguggcaccaccaccauauucgcggggcaccugaagugccgccucaagauggacaagcugacguugaagggcaugucauaugugaugugcacuggguccuucaagcucgagaaagaggucgcugagacccagcacgggaccgugcuggugcagaucaaguacgagggaaccgacgcgcccugcaagauccccuuuagcacccaggacgagaagggggucacucaaaacggccggcugauaaccgcaaauccgaucgugaccgauaaagagaagccugugaacaucgaggccgagccacccuuuggugaguccuauaucguaaucggcgcgggugaaaaggcguuaaagcuuucgugguuuaagaagggguccaguaucggcaagauguucgaggccaccgcccgcggggcccggcgcauggcgauccucggcgacacagccugggacuucggguccaucggcggcguauucacgagcauagggaagcuggugcaucagaucuucggcacagcuuacgggguccuauucuccggcgugagcuggaccaugaagaucgggauuggcguguugcugacguggcucggccugaauucacgcagcaccucccugagcaugacaugcauagccguugggcucgucacacucuaccugggcgugauggugcaggccgacagugggugugugaucaacuggaagggucgagaacucaaguguggaucuggcaucuuugugacgaaugagguucacaccuggaccgagcaguacaaauuccaggcagauagcccgaagcgccuguccgccgccaucggcaaagccugggaagagggggugugcggaauccggagcgccacuagguuagagaauaucauguggaagcagaucuccaacgaguuaaaccauauccugcuggagaacgacaugaaauucaccgucgucgugggggacgugguuggcauccucgcgcaagggaaaaagaugauccggccccagcccauggagcacaaguauuccuggaaguccugggguaaggcaaagauuaucggagccgauguccagaacacgaccuucaucauugacgggcccaacacucccgagugcccggacgaccagcgcgccuggaacaucugggaaguggaggacuacggcuucgggaucuucaccacgaacaucuggcugaaaaugcgggacuccuacacacaggugugcgaccaccguuuaauguccgcggcgauaaaagacagcaaggccgugcacgccgacaugggcuauuggaucgaguccgagaagaacgagaccuggaagcucgcccgcgcgagcuuuaucgaaguuaagaccugcaucuggcccaagucccacacccuuugguccaacggcguccuggaguccgagaugaucauacccaagaucuacgggggcccuaucucacagcacaaucaccgccccggauacuucacccagaccgcaggacccuggcaccucgguaagcuugagcuggauuuugaucugugugagggcaccacaguggucgucgacgagcacugcggaaaccgggggccgucccugaggaccacgaccgugacgggcaagauuauucacgaguggugcugucgcaguugcacgcugccgccccugcgcuucaagggggaggacggcugcugguaugggauggagauacgucccguuaaggagaaggaggagaaccuggucaaguccaugguaagcgccggcagcggcgagguggacuccuucagcuugggauugcugugcaucucuaucaugaucgaggaggugaugaggagccgguggucccgcaaaaugcugaugaccggcacccucgccguuuuucuguuguugaucaugggacagcugacguggaacgaccugauccggcucugcauaauggugggcgccaaugcgagcgaccgaauggggaugggaaccacguaucuggcccugauggccaccuucaagaugagaccgauguuugccgucggccuccuguuucgccgcuuaacgucccgggaggugcuacuguugaccaucgggcucagcuuaguggccuccgucgagcugcccaacagcuuagaggaacugggcgaugggcuggcgauggggaucaugauucucaagcuguuaacugacuuccagucgcaccagcucugggccgcucuacugagccucacguucaucaaaacgacccugucacuacacuaugcguggaagaccauggcgauggugcucagcauagucucucuaaucccccugugcuugagcaccacaucacagaagaccaccuggcugcccgugcugcuuggcagccuggggugcaagccauugacgauguuccuaauugccgagaacaagaucugggggcgcaagagcuggccgcugaacgagggaaucauggcagucggcgucguuagcauccuauugagcucccugcugaagaacgacgugcccuuagcugggcccuuaaucgccggcggcauguuaaucgcuugcuauguaaucagcgggucaagcgcagaccugucacuggaaaaggcugcagaggugagcugggaggaggaggccgagcacuccggcgccagccacaacauccugguggagguccaggacgaugggacgaugaagauaaaggaugaggagcgggaugacaccuugaccauccuguuaaaagcaaccuuacuagccguguccggcguguacccccugagcauucccgccacccuuuucgucugguacuucuggcagaagaagaaacagagauccggggugcugugggauacgccaagcccgcccgagguggagcgagccgugcuggaugacggcauauaccgcaucaugcagcggggccugcucgggcgcucccagguggguguggggguuuuccaggagaacguuuuucacaccauguggcaugugacccggggagccguccugauguaccaggguaaacgacuggagccguccugggccuccgucaaaaaggaccuuaucagcuacggcggcggauggcgguuacagggauccuggaacaccggggaagaggugcaagugauugccguggagcccggaaagaaccccaaaaacgugcaaacggcaccggggaccuucaagaccccagagggcgaggucggcgccaucgcgcuggacuucaagccggggaccucaggcucccccaucgucaaccgcgagggcaagauugugggccuguauggcaacggggucgucacgaccagcggcaccuacgugucggccaucgcccaggccaaagcgucccaggaagggccacugcccgagauugaggaugaggucuucaggaaacgcaaccucaccauaauggacuugcacccgggcagcggaaagacucggcgcuaccugccggccauugugcgggaagccaucaagcggaaacugcggacccucauccuggcccccacccgaguugucgcguccgagauggcggaggcccuaaaaggcaugccuauccgcuaccaaaccacggcugucaagucggagcacacaggcaaggaaaucguggaccucaugugucacgccaccuucaccaugcggcugcuguccccagucagggugccgaauuacaauaugaucauuauggacgaagcgcacuucacggacccgagcuccaucgcggcucggggguacaucagcacgcgggugggcaugggagaagccgccgccauuuucaugacggcgacgccucccggcuccgucgaggccuucccgcaaagcaacgccgucauccaggacgaggaacgggacauacccgagcgcucuuggaauagugguuacgaguggaucacggacuuccucggcaagaccguaugguuuguccccuccaucaagagcggcaacgacauagccaacugccugcggaagaacgggaagcgcgugauccaguuaucccggaagacuuucgacacggaguaccagaaaacuaagaacaacgacugggacuaugugguuaccaccgacaucagugagaugggcgcuaacuuccgcgccgacagaguuaucgacccccgccggugucucaagcccgugauccugaaagacgggcccgaacgcgucauucuggccggccccaugcccgugacagucgcaucggccgcucagcggcgcgggcggaucggccgcaaccacaauaaggagggcgaccaguacaucuacauggggcagccgcucaacaacgacgaggaccaugcccacuggacggaggccaagaugcuguuggacaauaucaauacucccgaggggaucauccccgcgcucuucgaaccggagcgggaaaagucagccgcgaucgacggggaauaccgccugaggggcgaagcccggaagaccuucguggagcugaugagacgcggggacuuaccggucugguuguccuacaagguugcuagcgagggguuccaguacagcgaccgccgguggugcuucgacggggaacgcaauaaucagguacuggaggagaacauggauguggagaucuggaccaaggagggagagaggaagaaacucaggccccgguggcuggacgcacgcacguacucugacccccuggcgcuccgggaguuuaaggaguucgcugccggccgccggagcgucucaggugaccugauccuugagaucggcaaguugccccagcaucuaacccagcgcgcccagaacgccuuggacaaccucgugauguugcacaacagcgagcaaggcggccgggccuaccgccacgccauggaggagcugccggauacgaucgagacccugaugcugcuggcccucaucgccgugcugacaggcggggucaccuuauuuuuccucagcggucgaggcuuaggcaaaaccucgaucggccugcucugcgugauggccuccucgguacugcuguggauggcuuccguggaaccccacuggauugccgccucuauaauccucgaguucuuucugaugguucugcugaucccagagccugaccggcagagaacaccgcaggacaaccagcuggccuauguggucaucgggcugcucuucaugauccugaccguggccgcaaaugagaugggccugcuugagacgaccaaaaaggaccuggggauuggccacguggcuguagagaaccaccaucacgcgaccaugcuggacguugaccuccaucccgcauccgccuggacccuauacgcgguggccacgaccaucaucacccccaugaugcgccacaccaucgagaacacgacggccaauauuagcuugaccgccaucgccaaccaggcggccauucucauggggcuggacaagggcuggccgaucuccaagauggacaucggcgucccccugcucgccuuagggugcuacagccaggugaacccacucacccucacggccgcgguccugaugcuggucgcccacuacgccaucaucggccccggucuccaggcuaaggccacgcgggaggcgcagaagcgcaccgccgccggcaucaugaagaacccgaccguggauggaaucgucgccaucgaccuggaccccgucguguacgacgcgaaguucgagaagcaacugggacaaaucaugcuccugauccuuugcacgagccagauccuccugaugcgcaccacuugggcucugugugagucuauuacccuagccacggguccccugaccacccugugggaggggucccccgguaaguucuggaacaccacaauugccguuagcauggccaacaucuucagagggucguaucucgccggcgcagggcuggccuucagccugaugaagucgcucgggggcgggcggcggggcaccggggcccaaggcgagacccugggcgagaaguggaagcgccagcugaaucagcucuccaagagcgaguuuaacaucuacaagcgguccggcauuauggaggucgaccgcagcgaggcuaaggagggccugaagcgaggugagaccaccagacacgcggugucgcgcgggacggccaaacuccgcugguuuguugaacggaaccugguaaagccggaggggaaggucaucgaccuuggcugcggccgcgggggguggagcuacuacugugccgggcuaaagaaggugaccgaggucaagggauacaccaagggcgggcccggccacgaggaacccaucccgauggccacguacggcuggaaccuggugaagcuccacuccgguaaggauguguucuucaccccgcccgagaagugcgauacccugcugugcgauaucggagagagcuccccuaaccccaccauugaggaaggccggacgcuccgcguucugaagaugguugagccuugguuacgggggaaccaguucugcaucaaaauccucaaucccuacaugcccagcgugguugagacccuggagcaaaugcaaagaaagcacggcggcaugcugguacgcaacccccucucccgcaacucgacucacgagauguauuggguguccugcgggaccgggaacaucguuagugccgugaacaugaccuccagaaugcugcugaacagguucaccauggcgcauaggaagccgaccuacgagaaggacguggaccucggggcagggacacggcauguagcaguggagcccgagguagccaaccucgacaucauaggccagcgcaucgaaaacauuaagcacgagcacaagagcaccuggcacuacgacgaggacaaccccuacaagaccugggcauaccacggguccuacgaggucaagcccuccggcucggcgucuuccauggucaacgguguggugaagcuccucaccaagccgugggacgugauccccauggucacccagauugccaugaccgacacgacgccauuuggccagcagaggguguucaaggaaaaaguggacacccgcacccccaaggcuaagcgugggacgguccagaucauggaggugacagcgcgcuggcugugggguuuccugucgcggaacaaaaagccgcggaucuguacccgugaagaauuuacacggaaagugaggagcaacgccgcgaucggcgcagucuucguugaugagaaccaguggaacuccgcgaaagaggccguggaggacgagcgcuuuugggaucucgucaaaaaggagagggagcugcacaagcaggggaaaugugccacgugugucuacaacaugaugggaaagcgcgaaaagaaacugggggaauuuggcaaggccaaggggucgagggccauaugguacauguggcucggcgcccguuuccuggaauucgaggcccuuggauuuaugaaugaggaccacugguucucccgggagaacagccuuuccgggguagagggcgaaggucugcacaagcuaggauacauccuacgcgacaucagcaaaauucccggcggcaacauguacgcggaugacacugccgggugggacacccgcaucacugaagacgaccugcagaacgaggccaagauaacggacaucauggagcccgaacacgcacugcucgccaccaguaucuuuaagcuaaccuaccagaacaaggucgugcgugugcagcguccggcaaagaaugguacuguuauggacgugauuagccgccgcgaucaacgcggcuccggucagguuggcacguacgguuugaauaccuucacuaauauggaggcccaacucauccgccagauggagagcgaggggaucuuccugcccucugaacuugaaacgcccaaccuggcggagcggguccuggacuggcuggagaaguacggcguggaacgccucaagcggauggcaauaagcggggacgacugcguuguaaagcccaucgacgaccgcuuugcuacggcgcugaccgcuuugaacgacaugggcaaggugcggaaggacaucccgcagugggaacccuccaagggguggaacgacuggcagcagguccccuucugcagccaccacuuccaccagcucaucaugaaggacggacgcgagaucgucgugcccugccggaaccaggacgagcugguuggcagagcccgggucucacagggggccggcuggagccugcgcgagaccgcgugucucgggaagagcuacgcgcaaauguggcagcucauguacuuccaccggcgcgaccuacgucucgccgccaacgccaucugcagcgcggugccaguagacugggugcccaccagccgaacgacguggucgauccacgcucaccaccaguggaugacgaccgaggacaugcugucuguguggaaucggguuuggaucgaggaaaaccccuggauggaagacaagacgcacgucuccagcugggaagacgugcccuaccugggcaagagggaagaccaauggugcgggucccuuaucgggcugaccgcucgggccaccugggccagcaacauacaaguagcgaucaaccagguccgccgccuaaucggcaacgagaacuaccucgacuacaugaccucaaugaagcgguuuaaaaacgagggggacccggagggcgcacuuugguga

SEQ ID NO: 24269 - RNA, 9879 nt, Artificial Sequence
  derived and/or modified CDS sequence (opt11) from DENV-1__FJ882544__SS-prME
agcgugaccauguugcucaugcugaugcccaccgcccuggccuuccaccucaccacccgcggcggggagccccacaugaucgugucaaagcaggagcggggcaagagccugcuguucaagacguccgccggugugaacaugugcacgcucaucgccauggaucugggcgagcugugcgaagacacuaugaccuacaagugcccccggaucaccgagaccgagcccgacgacguggacugcuggugcaacgccacggacaccuggguuaccuacgggacaugcagccagacgggcgagcaccggcgcgauaagcgguccguggcacucgcgccccaugugggccuggggcuagagacccgcacggagacguggaugagcuccgaaggcgcguggaagcagauccagagggucgagacaugggcucuccgccaccccggguucaccgugaucgcccuuuuccuggcacacgcgauuggcacgagcaucacgcagaaggggaucauauucauccuacuaaugcuggugacgcccuccauggcaaugcggugcguuggcaucggcaaucgcgacuucguggaagggcuuagcggcgccaccuggguagacgucgugcuugagcacggguccugcgugaccaccauggccaaggacaagcccacgcuugacauugagcuccugaagaccgaagucaccaaccccgccguacugcggaaacucugcaucgaggcgaagauaagcaacacuacgaccgauucccgcugcccgacccagggcgaagcuaccuuaguggaggaacaagacgccaacuucgucugccggcgcacguucguggaccggggcugggggaacggcugcgggcuguuuggaaagggcagccucaucacgugcgccaaguucaagugugugaccaagcuggagggcaagaucguccaauacgaaaaccugaaguacuccgugaucgugaccguccacacaggcgaccagcaccagguggguaacgaaagcaccgagcacggcaccaccgccaccaucacgccccaggcccccaccaccgagauccagcucaccgacuacggggcccuaacacucgacuguucgccccggaccggccucgacuucaacgagaugguccugcugaccaugaaggagaaguccugguuggugcacaagcagugguuccuggaucugccccuccccuggaccuccggggccagcacgagccaggagaccuggaaucggcaggaccuguuggugaccuuuaaaaccgcccacgccaagaaacaggaggucguggugcuuggcucgcaggaaggcgcgaugcacacggcccugaccggugccaccgagauccaaacgucggguacgaccaccaucuucgccgggcaucugaagugccgccucaagauggacaaacugacccugaagggcaugucguacgucaugugcacggggagcuucaagcucgagaaggagguggccgagacccagcacggcacagugcucguccagaucaaguacgagggcaccgacgcgcccugcaagauccccuucuccacgcaggacgaaaaaggggugacacaaaacggccgccugaucaccgccaacccgauugugaccgacaagggcaagccggucaacaucgaggccgagccgcccuucggcgagaguuauaucgugaucggcgccggggagaaggcgcuuaagcucuccugguucaagaagggaucuuccauugggaagauguucgaggccacggcccgcggcgccaggcgcauggcaauccugggggacaccgcgugggacuucgggucgaucggcgggguuuucaccucagucggcaagcugguucaccagaucuucgggaccgccuacggggugcuguucagcggcgucuccuggacgaugaagaucggcaucggcgugcugcugaccuggcucgggcugaacagccgcuccaccagccugucgaugacaugcaucgcagugggacucgucacgcuguaucugggggucaugguccaggcggacagcggcugcgucauuaacuggaaggggcgggagcucaagugcgguucuggcaucuucgucaccaaugaggugcacaccuggaccgagcaguauaaguuccaggccgacagccccaaacgccugagcgcugccaucgggaaagccugggaggagggcgucugcgggauccgguccgccacccgcuuagagaacaucauguggaagcagaucucaaacgagcucaaccacauacugcuggaaaacgacaugaaguucacgguuguggucggagacguggccgggauccucgcgcagggcaagaagaugauacggccccagcccauggaguacaaauacuccuggaagucauggggcaaggcgaaaaucaucggggcggacgugcagaacaccaccuucaucaucgacggccccaacacgccggagugccccgacgaccaacgagcuuggaacauuugggaagucgaggacuacggauuugguaucuucacgaccaacauauggcugaagcugcgggacuccuacacccagguuugcgaccaccgccucaugagcgcggccaucaaggacuccaaggccgugcacgccgacauggguuacuggaucgagagugaaaagaacgagacuuggaagcuggcccgggcguccuucaucgaggucaaaacgugcaucuggccaaagagccacacccuguggaguaacggaguucucgaaagcgagaugaucauccccaagaucuacggcgggccgaucucccagcacaauuaccgccccggcuacuuuacucagaccgccgggcccuggcaccugggcaagcuggagcucgacuucgaccuuugcgagggcacgacuguggucguggacgaacacugcgggaaucggggccccagcuuacgaacaaccacggugaccggaaagaucauccacgagugguguugccgguccuguacccugccgccccuccgcuuuagaggcgaggacgggugcugguacggcauggagauccgacccgucaaagagaaggaggagaaccugguuaagagcaugguaucugccgggagcggugaggucgacagcuuuagccucggccugcugugcaucagcaucaugaucgaggaggugaugcgcagucguuggagccggaagaugcucaugaccgggacgcuagcgguguucuuccugcuuaucaugggucaguuaaccuggaacgaccucauuagacucugcauuauggucggcgcaaacgcauccgaucgcaugggcaugggcaccaccuaccuggcccugauggcuacguucaagaugcgaccgauguucgccguggggcuccuguuucgccggcugaccagcagagaggugcuccugcugaccaucggccucucccuggucgccagcguggaacugcccaauuccuuggaggagcucggcgacggacuggcgauggggaucaugauccugaaacugcugaccgacuuccagagccaccagcucugggccaccuuacugucccucaccuucaucaagaccaccuucagccugcauuacgccuggaagacgauggccaugguguuaaguaucgugagccucuucccgcugugccugucaaccacgagccagaaaaccacguggcuucccgugcugcuggggucccucggcugcaagccgcugaccauguuccugaucgcggagaacaagaucugggggcggcgcucauggccccucaacgagggcaucauggcgguugggauuguuuccauccugcugagcucacuccugaagaacgacgugccgcuggccgggccccucaucgccggcggaaugcugauagccugcuaugugauuuccggcagcuccgcggaccugagccucgagaaggccgccgagguauccugggaagaggaggcggagcacagcggagccagucauaauauccugguggagguccaggacgacggaaccaugaagaucaaggaugaggagcgggacgacaccuuaacaauccuccugaaggcaacgcugcucgcagugagcgggguguacccgcuguccauccccgccacccuguucgucugguacuucuggcagaagaagaagcagcggagcggcgugcucugggacacccccagcccgcccgaggugggacgcgccguauuagacgacgggaucuaccggaucaugcagcggggacuguuggggcgcagccaggugggcgugggggucuuccaggagaacguguuccacaccauguggcacgugacgcggggagccguccucauguaccagggcaagcgccuggagcccucaugggcgagcgugaagaaggaccugaucuccuacgggggcgguuggcggcuccagggcagcuggaacaccggggaagagguacaggucaucgcgguggagcccggcaaaaaccccaagaacgugcagaccgcccccgguaccuucaagacgcccgagggggaggucggcgccauugcccuggacuucaagcccgggaccuccggcagccccaucgugaaucgcgagggcaagaucguggggcuguacggcaauggggucgugaccaccuccggcacuuacgugagcgcaaucgcccaggccaaggccagccaggaggggccgcuccccgagaucgaggacgaggucuuccggaagagaaaccugaccaucauggaccugcaccccggcuccggaaaaacccgacgcuaccuacccgcgaucgugcgggaagccaucaagcgcaagcuccgcacccucauucucgcccccacgcggguggucgccagcgagauggccgaggcgcugaagggcaugcccaucagguaucagacaaccgccguuaaguccgagcacaccggcaaagagaucguggaccugaugugccaugccacguucaccaugcggcuccugagcccgguccgcgugccgaacuauaauaugauaaucauggacgaggcccacuuuaccgaccccuccagcaucgccgcgcggggguacaucuccacccgcgugggcaugggggaagccgccgccauuuucaugacggccacgccacccggcagcgucgaggcguucccgcagucgaacgcggugauucaggaugaggagcgggacauccccgagcgcagcuggaauagcggcuacgaguggaucacggauuuccccgggaagaccgugugguuuguccccucgaucaaguccggcaacgacaucgccaacugccugcggaagaacggcaagcgcgugauccagcucagccggaagacguucgacaccgaguaccagaagaccaagaauaacgacugggacuacguggucaccacagacaucuccgagaugggagcuaacuuccgcgcggaccgggugaucgauccgcgccggugccugaagcccgugauacugaaggacgggccggagagagucauccucgccggcccuaugccggugacaguugcgagcgcggcacagaggcgcggccggaucgggcgcaaccacaacaaagagggcgaucaauauaucuacauggggcagccccugaacaaugacgaagaccacgcgcacuggacagaggccaagaugcugcucgacaacaucaacacccccgaggguaucauccccgcccuguucgagccggaacgcgaaaaguccgcugccaucgauggcgaguaccgucugagaggcgaggcgcggaagacguucguggaguuaaugcgcagaggcgaccugcccguuuggcugaguuauaaggucgccuccgagggguuccaauacagcgaccgccgcuggugcuuugacggugaaagaaacaaccaggugcucgaggagaacauggacguggagaucuggaccaaggagggggagcggaagaaguuacgcccccgguggcuugacgcccgcaccuacagcgacccucucgcccugcgggaguucaaggaguucgccgcgggccgccgguccgucagcggcgaucuaauccucgagaucgggaagcugccgcagcaccugacccagcgcgcccagaacgcccucgacaaccuggugaugcugcacaacuccgagcagggcgggcgggccuaccgccacgcgauggaggagcuccccgacacgaucgagacccugaugcugcucgcccugaucgccgugcuuaccgguggugucacccucuucuuucugagcggccggggccuggggaagaccuccauuggucuccuguguguaauggccuccuccguccugcucuggauggccagcgucgagccccacuggaucgcggccuccaucauacuggaguucuuccugauggugcuccugauccccgagccggacaggcagcggacgccccaggacaaccagcuggccuauguugucaucgggcuccuguucaugauccugaccguagcugccaacgagaugggccuccuggagacgaccaagaaggaccugggaaucggccacguggccgucgagaaccaccaccaugcagcuaugcucgacguggaccugcaccccgcaagcgccuggacccuguaugcgguggccaccacaaucaucacgccaaugaugcgccauacgauagagaacaccaccgccaacaucagucucaccgccaucgccaaccaagcggcgauccugaugggucuggacaagggauggccgaucagcaagauggacaucggggucccccuccuggcccuggggugcuauucccaggugaacccccucacgcugaccgccgcgguacugaugcucguggcucacuacgccaucaucggcccggggcuacaagccaaggcaacccgcgaggcgcaaaagcggaccgcagccggcaucaugaagaaccccacaguagacggcauaguggccaucgaccuggaccccgucguguacgacgccaaguucgagaagcagcuggggcagaucaugcugcugauccucugcaccagccagauccugcugaugcgcaccaccugggcgcucugcgaguccaucacucuggccaccggcccccugacaacccucugggaagggagcccgggcaaguucuggaacacgaccaucgccguguccauggcaaacaucuuccggggcucguaccuggcuggagcgggcuuggccuucucccucaugaagucccucgggggcgggcgccggggaaccggcgcacagggggagacccugggcgagaaguggaagcgccagcucaaccagcugagcaaguccgaguucaacacguauaagcggagcgggauuauggaggucgaccgcuccgaggccaaagaaggccugaagagaggcgagacuacuaagcacgccgugagccguggcaccgccaagcugagaugguuuguggagcgcaaccuggugaagcccgaaggcaaggugaucgacuuggguugcggacgcgggggcugguccuacuacugcgccgggcugaaaaaggugacggaagucaagggcuacaccaagggcgggcccggccaugaggagccgaucccgauggccaccuacggguggaaucucgugaagcugcacagcggcaaagacguguucuucaucccgccagagaagugcgacacccugcucugugacaucggggaguccagucccaacccaacgaucgaggagggacgcacccugcggguccugaagauggucgagcccuggcuccgcggcaaccaguucugcaucaagauccugaaccccuacaugcccuccguggucgagacccuggagcagaugcagcguaagcacgggggcaugcucguccgcaacccacugagcagaaauuccacacaugaaauguacugggugagcugcgggaccggcaacauugucuccgcaguaaacaugacgucccgcaugcugcucaaccgcuucaccauggcgcaccguaaacccacauacgagcgcgacguggaucugggagccgggacccggcacgucgccguggagcccgagguagccaaucuggauauaaucggccagcgcaucgagaacaucaagcacgagcacaaguccaccuggcacuacgaugaggacaaucccuacaagacaugggccuaccacgggagcuaugaggucaagccguccggcagcgcguccagcauggugaauggggucgugaagcuccugacuaagcccugggacgugauccccauggucacccagaucgccaugacugacaccacccccuucggccagcagcggguguucaaggagaagguggacacgcgcacaccgaaggccaagcggggcaccgcccagaucauggaggucacagccaaauggcuguggggguucuugagccgcaacaagaagccccggaucugcacccgcgaggaguucacgcggaagguucgcuccaacgcggccaucggcgccguguuuguagacgagaaccaguggaacagcgcaaaggaggcgguggaggacgagcgguucugggaccuggugcaccgcgagcgggagcugcacaagcaggggaagugcgcgaccugcgucuacaacaugauggggaagcgcgaaaagaagcucggugaguucggcaaggcaaagggcucccgggccauuugguacauguggcugggggccagauuccuggaguucgaggcguugggcuucaugaacgaggaccacugguucucaagggagaacucccuaagugggguggagggagaggggcugcacaagcucggcuacauccugcgugacaucaguaauauccccggcgggaauauguacgccgacgacaccgccggcugggacacccggaucacggaggacgaccugcagaacgaggcacgcaucaccgacaucauggaaccggagcacgcccuccuggccaagagcaucuucaaacugaccuaccagaacaaggugguccgcgugcagcggcccgccaagaacgggaccgugauggacgucaucucccgccgggaccaacgcgguagcggccaggugggcacguacggccucaacaccuuuaccaacauggaggcccagcugauccggcagauggaguccgaggggaucuucagccccuccgagcuggagacccccaaccucgccgagcgcguucuggacuggcuggagaaguacggcgucgagcggcucaagcgcauggccaucucaggggacgacugcguggugaagcccauugacgacagguucgcaacggcccugacugcccugaacgacaugggcaagguacgcaaggacaucccccagugggagcccucaaagggcuggaacgacuggcagcaggucccguuuugcagccaccacuuccaccagcucaucaugaaggacggccgggagaucguagucccgugccgcaaccaggacgagcuggugggccgggcccgcgugucccagggggccggcuggagccugcgggagacugcuugccuaggcaagagcuacgcccagauguggcagcugauguacuuucaccgccgggaccugcgccuggccgccaacgcgaucugcuccgccguccccguggauuggauccccaccagccggacgaccugguccauacaugcccaccaccaguggaugaccacggaggauaugcugagcguuuggaaccgcgucuggaucgaagagaaccccuggauggaggacaagacgcacauauccagcuggggcgacgugccguaccugggcaagcgcgaggaucaguggugugggucccucauuggccugacggcccgggccaccugggcgaccaacauccagguggccaucaaccagguccgccggcugaucgggaacgagaacuaccucgacuacaugaccagcaugaagcgauucaagaacgaauccgaccccgagggcgcccugugguga

SEQ ID NO: 24270 - RNA, 9879 nt, Artificial Sequence
  derived and/or modified CDS sequence (opt11) from DENV-1__FJ898371__SS-prME
agcgugaccaugcucuuaaugcuuaugcccaccgcccucgccuuccaccucaccacaaggggaggggaaccccacaugaucgugaccaaacaggaacggggcaagagcuuguuguuuaaaacgagcgcagggguuaacaugugcacccucaucgccauggauuuaggcgaacucugcgaggacaccaugacuuacaaauguccccggaucaccgaagccgaacccgacgacguggacugcuggugcaacgccacagacacgugggugaccuauggcacgugcucccagacaggcgagcaucggcgagacaaacgguccguggccuuggcgccccauguuggccuggggcuagagacaagaacugagacguggaugucaagcgagggggccuggaagcagauccagagaguagagacgugggcccuccgucacccgggguucaccgugaucgcccucuuucuggcccacgccaucggcacuuccauaacccagaaagguaucaucuucauucuccucaugcuugugacacccucuauggcuaugcgaugcgucggcaucggcucccgcgacuuugucgagggccucagcggcgccacauggguggacgucgugcuggagcacggguccuguguaacgaccauggccaaagacaaacccacauuagacauagaacugcugaaaaccgaggucacgaaccccgcagugcugcggaaguuaugcauugaggcuaagauuucgaacaccacgacagacucccgcugccccacccaaggcgaggcuacucugauggaggagcaggacgcgaacuuugugugucgacgcacguucgucgaccggggcugggggaacggcugugggcuguucggcaaggggagccuuaucacgugcgcaaaguuuaagugcgugaccaagcuggagggcaagaucgugcaguacgagaaccugaaguacuccgucaucgugaccgugcacaccggggaccagcaccaggugggcaacgagagcacugaacacggcaccaccgcgaccauaacaccgcaggcccccacaagugagauccagcugaccgacuacggggccuuaacccuggacuguucgccccgcacgggccuggacuucaacgagauggugcuccugaccaugaaggagaaguccugguugguccacaaacagugguucuuggaccuuccacuacccuggaccagcggugccaguaccucccaagagaccuggaaccggcaggaccugcuugugaccuucaagacugcacacgcgaagaaacaagaagucguaguacuugggucccaggaaggcgccaugcacaccgcucugacgggugccaccgagauacagaccaguggcaccacgaccaucuucgccgggcaucucaagugucgacucaagauggauaaguugacacugaaggguaugagcuacgugaugugcacagguuccuucaaacucgaaaaggaagucgcggagacgcagcacggcacugugcuggugcagauaaaauacgaggggacagacgccccgugcaagauucccuucuugacccaggaugagaagggggugacacaaaacggacggcugaucaccgccaacccaaucgugaccgauaaggagaagcccgugaacaucgaggcugaaccgcccuucggugagaguuacauugucauuggagcgggugaaaaggcccucaaacucucgugguuuaaaaaggggucuuccaucggcaagauguucgaggccacagccagaggggcccggcgcauggcaauccugggugacaccgccugggacuuugggagcaucggcggcguguucacauccgucggaaaguuaguccaucagaucuuuggaacagccuaugggguacucuucagcggagugagcuggaccaugaagaucgggaucggcgugcuucuuacguggcuaggcuuaaacagccgaaguaccagccucuccaugaccugcaucgccgucgggcuugucacccuguacuuaggcgucauggugcaagccgacagcgggugugugaucaacuggaagggccgggaacugaagugcggaagcggcaucuuugucacaaacgaaguccacaccuggaccgagcaauauaaguuccaggcggacagcccgaagcgccugagcgccgccauaggcaaagcgugggaggaagggguaugugggauccggucagccaccagacucgagaauaucauguggaaacagaucucgaacgagcugaaccacauauuacuagagaacgacaugaaguucacugucguggugggggacgucgugggcauccuagcccaggggaagaagaugauccggccccagcccauggaacauaaauacucauggaaauccugggguaaggccaagaucauaggcgcggauguacaaaacacgaccuucaucaucgacggacccaacacgccggaguguccggacgaucagcgagccuggaacauaugggagguugaagacuacggcuucgggaucuucaccacgaacauuuggcugaagcuccgugauagccacacgcagguaugcgaccaccgcuugaugagcgcggcaauuaaggacuccaaggccgugcacgccgacauggguuauuggauugaaagcgaaaagaacgagaccuggaaacucgcccgggcguccuucaucgaggugaagaccugcaucuggcccaagagccacacgcucugguccaauggcgugcuggagagcgagaugaucaucccaaagaucuacgggggcccuaucucccagcacaacuaccgucccggguacuuuacccagaccgccggccccuggcaccuggggaaguuagaacuggacuucgaccugugcgagggaaccacuguggucguggacgagcacugcggcaauagagggccgagccuccgcaccaccaccgugacgggcaagaucauacaugaauggugcugccggucaugcacccuaccgccccuucgcuucaagggugaggacggcugcugguacgggauggaaauccgcccggugaaggagaaggaagagaaccuagucaagucgaugguguccgcgggcagcggcgaggucgacagcuucagccugggguugcucuguaucagcaucaugaucgaggaggugaugcgcagcagauggucgcggaagaugcucaugaccggaacccuggcuguguuucuccugcugaucauggggcagcuuaccuggaacgaucugauccggcuguguaucauggucggcgcaaacgcauccgauagaauggguaugggcaccacguaccucgccuugauggcgacuuucaagaugcggcccauguucgccguggggcuacuguuucggcgccugacgagccgcgaaguacuguuacugacuauuggucucucccucgucgccagcgucgagcugcccaacucccuugaagaacucggcgacggauuagcgaugggcauaaugaucuuaaagcuacucacagauuuccagagccaccagcugugggcuacucuccucucccugacguucaucaagacuaccuuaaguuugcacuacgccuggaaaaccauggccaugguccuguccaucgucagcuuauuccccuuaugccugucaacaaccagccaaaagacgaccuggcugcccguauuacuggguagccucgggugcaaaccgcucacuauguuucugauagcggagaacaagauaugggggcgcaaaagcuggccccuaaacgaggggaucauggccguaggcgugguguccauccuacugagcucauugcugaagaaugacgucccccuggccggcccccucauagccgguggaauguuaauugccuguuacguuaucucuggaucguccgcugaccuaagucucgagaaagcggcugagguauccugggaggaggaggccgagcacagcggugccucccacaacauccugguggaggugcaggacgacgggaccaugaagaucaaagacgaagaaagagacgacacuuuaacuauuuugcucaaggcgacccuccuugccgugagcggggucuacccucugucuauucccgccacgcuguuuguaugguacuucuggcagaaaaagaaacagcgcaguggcguuuuaugggacaccccaagcccgcccgaggucgagcgggcaguucucgacgaugggauuuaccgcaucaugcagaggggccugcucggucgcagccaggugggcguugggguguuucaggagaauguguuccacacgauguggcacgucaccaggggcgccguguuaauguaccaggggaagcgccuugagcccuccugggcguccguaaagaaggauuuaaucuccuauggcggcggcuggcggcuccaggguagcuggaacacgggcgaagagguccaaguaauugccguggagccaggcaaaaaccccaagaacgugcagaccgccccuggcacauucaaaacccccgagggcgaggugggcgccaucgccuuagauuucaagcccgggacgucggggagccccaucgugaaccgcgaagggaagaucgucggcuuguacggaaacgggguggugaccaccagcggcacauacgucuccgcgaucgcccaggccaaggccagccaagagggcccgcucccggagaucgaggaugaaguguuccgcaagagaaaccugacgauaauggauuuacaucccggcagcgggaaaacgcggcgcuacuuaccugcaauugugcgggaggccauuaagcggaaacuucguacccuuauccucgcccccacacgagucguggccucagagauggccgaggcgcugaagggcaugccuauccgauaccagaccaccgccgugaaguccgagcacaccgggaaggagaucgucgaccugaugugccacgccaccuucacgaugcgccuccugucacccguacgcguuccgaacuacaacaugauuaucauggacgaggcucacuucaccgaccccucaagcaucgcagcgcggggguauaucagcacccgcgugggcaugggggaggccgcagccaucuucaugaccgccacgcccccuggcagcguggaggcuuuuccgcagucgaaugcugucauccaggaugaagaacgggauauaccugagcgcaguuggaacuccggguacgaguggaucaccgauuuuccgggcaagaccguuugguucgugccaagcaucaaguccggcaacgacaucgccaacugccucaggaagaacggaaagcgcgucauacaguuaagccggaagaccuucgacacagaguaccagaagacgaagaauaacgacugggacuacgucgucaccaccgauaucuccgagaugggugcgaacuucagggcggaucgggucaucgacccgcgcagaugcuuaaagcccgucauucugaaggacggucccgagcgcgugauacucgcugggcccaugccugucacgguggcuucagcagcccagcggcgcgggcggaucggcagaaaccacaacaaagagggagaccaauacaucuacaugggacaaccccugaacaacgacgaggaccaugcgcacuggacggaagccaaaaugcuguuagauaacauaaauacccccgagggcaucauccccgcccuuuucgaaccugagagggagaagucugccgcgauugacggggaguaccgguugcgcggagaggcgaggaagacauuuguggaacucaugcgccgcggugaucugcccgucuggcugucuuacaagguagccuccgagggcuuccaauauagcgacaggcgguggugcuucgauggcgagcgcaacaaccaaguucucgaggaaaauauggaugucgagaucuggacgaaggagggggagcggaagaaacugcgcccccguuggcuggaugcccgcaccuacucugacccgcucgcccuucgggaguucaaagaguucgcagcggggcgcagaagcgugucgggcgaccuuauccuggagaucggcaagcugccgcaacaucucacgcaacgcgcccaaaacgcgcucgacaaccuggucaugcugcacaacucugagcaaggagggcgagccuaccgccacgcuauggaggaauugcccgauaccaucgagacgcugaugcuccucgcacucaucgcuguucugaccggcggggugacccuauuuuuccuaagcggccgggggcugggcaagacgagcaucggccucuuaugcgugauggccucgaguguguuauuauggauggcaaguguagaaccccauuggauugcagccuccaucauccucgaguucuucuugaugguucuccuaauccccgagccugaccgccaacguacgccacaggauaaccaacuggccuaugucgugaucgggcuccuguuuaugauccucacgguugccgccaacgagaugggccuccuggaaacgaccaagaaagaccuggggaucggccaugucgcgguggagaaccaccaucacgccacgaugcucgauguggaccugcacccagccagugcguggacgcuguaugccguggcgaccacgaucaucaccccgaugaugcgccacacgaucgagaacaccaccgccaacauuagucucaccgccaucgcuaaccaagccgcgauccugauggggcuggacaaaggcuggcccaucucuaaaauggacaucggcguuccccugcuggcccuugguuguuacucucaagugaauccgcuaacucugacggccgccguccugaugcucguagcgcacuacgccaucaucggcccaggucugcaagccaaggcgacccgggaggcccagaagcgcaccgcggcgggaauaaugaagaacccuacgguggauggaaucgucgcgauagaccuggacccuguaguuuacgacgcgaaguucgaaaaacagcucggccagaucaugcuguugauccucuguacuagccagauccugcugaugcgcacaacgugggcuuugugcgaguccauuacgcuggcuaccgguccccuaaccaccuugugggaggggagcccgggcaaguucuggaacacgaccaucgccguuuccauggcaaauaucuuucgggggucuuaucuggccggcgccggacuagcauucucccuaaugaaaucccuagggggcggcaggagggggacuggggcccagggcgagacccugggggaaaaguggaagcgccagcugaaccagcuuaguaagucggaguucaauaucuauaaacgguccgggaucauggagguugaucgcuccgaggccaaagagggcuuaaagcgcggagagacaacccgccacgccgugucucggggcaccgcuaagcuacgcugguucgucgaacggaaucucgugaagcccgaggggaaggucaucgauuugggcugcggacguggagguugguccuacuauugcgccgggcuaaagaaagucacagaggugaaggguuauacgaagggcgggccaggucacgaagaacccauucccauggccaccuacggauggaauuuggugaagcuacacucagguaaggacgucuucuucacgccucccgagaagugcgacacgcugcuaugcgacaucggggagucaagucccaacccgacgaucgaggaaggucggaccuuaagggugcugaagaugguagagcccuggcuccgggggaaccaguucugcaucaagauccugaaccccuacaugcccucagucgucgagacccuggagcaaaugcaacggaagcauggcggcaugcuagugcgcaacccgcugagccgcaacagcacacacgagauguacugggucagcugugggaccggcaacaucgugucagccgucaacaugacgagcaggauguugcuuaauagauucacaauggcacaccgcaagcccaccuaugaacgcgaugucgacuugggggccggcacccgccacguggccguggagccugaggucgccaaccuggacauaauaggccagaggauugaaaacaucaagcaugaacacaaguccacguggcauuacgacgaagacaacccuuacaagaccugggcguaccacggaagcuacgaggugaaaccgucaggcucggccucaagcaugguuaauggcguagugaagcuccuuaccaagcccugggaugucauccccauggugacccagaucgcaaugacugacacaacgcccuucggacagcagagggucuucaaagagaaagucgacacaaggacgccuaaagccaaacgagggaccgcgcagaucauggaggugaccgcccgguggcuguggggcuuccucagccgcaacaagaaaccccgcaucugcacucgcgaggaguucacgcggaaggugcgcucgaacgccgcgaucggugccguguucguggacgagaaucaguggaauagcgccaaagaagcaguagaggacgagcgguucugggaccugguccagaaggagcgcgaacuacacaaacaggggaagugugcaacuugcguguauaacaugauggggaagcgggagaagaagcucggagaguucggcaaagcgaaggggucccgcgcuauuugguacaugugguugggugcccgguuccuggaguucgaggcgcuuggcuucaugaacgaagaccacugguucagccgcgaaaacucccugucugggguggagggggaaggccuacacaaguuaggcuacauccuaagagacaucuccaagaucccagggggcaauauguacgcggacgauacugccggaugggacacccgcaucacggaggacgaccugcagaacgaggccaagauuaccgacaucauggagccagagcacgcccuccuggccaccagcaucuucaagcugaccuaccagaacaaggucgugagagugcagagacccgcgaagaacgggacggucauggacgugaucuccagacgggaccagcgcggaagcggucaggugggaaccuacggccucaacaccuucaccaacauggaggcccagcuaauucggcaaauggaguccgaggggaucuuccugcccagcgaguuagagacucagaaccuggcggagcgcguccucgacuggcucgagaaguacggcguggagcggcuuaagcggauggccaucuccggggacgauuguguaguaaagccuauagaugaucguuucgccaccgcccugaccgcccugaacgacauggggaagguccgcaaggauauaccacaaugggagcccaguaagggguggaacgacuggcaacaggugcccuucugcucccaccauuuccaccagcuuaucaugaaggacgggcgggaaaucgucgugccaugccgcaaccaggacgaacuggucggccgggccagggucucgcagggggccggauggucgcuccgggagaccgcgugccugggcaagagcuacgcccagauguggcagcuaauguauuuccaucgcagagaccuuagacuggcagccaacgccaucugcagcgcaguaccaguggacugggucccuacgagccggaccaccuggucaauccacgcucaucaccaguggaugaccacugaagauauguugagcgucuggaaccgcguguggaucgaggaaaacccauggauggaaaacaaaacccacguaagcucuuggggcgacgugcccuacuuggguaagcgagaggaccagugguguggcucauuaaucggccucaccgcgcgcgccaccugggcguccaacauucagguugcgaucaaccaaguccgccgccuuaucgggaacgaaaacuaccuggacuacaugaccucaaugaagcgcuucaagaaugagggcgauccagaaggggcccugugguaa

SEQ ID NO: 24271 - RNA, 9879 nt, Artificial Sequence
  derived and/or modified CDS sequence (opt11) from DENV-1__FJ882545__SS-prME
ucagugaccaugcuguugaugcuaaugccuaccgcgcuggccuuccaccucaccacaaggggcggugaaccucauaugaucguuagcaagcaggaacggggcaagagccugcuauucaagacuagugcuggcgugaacaugugcacucucaucgccauggaucuaggggagcugugcgaagacacgaugaccuacaagugcccgcgcaucaccgaggccgagccagacgacguggacugcugguguaacgccaccgacacgugggugaccuacgggaccugcucacagacgggcgaacaccggcgcgacaagcggucugucgcacucgccccccacguaggacugggacuagagacuagaaccgagaccuggaugagcucagaaggagcauggaagcagauccagcgggucgagaccugggcccuccgccacccuggguucacggucaucgcccuguucuuggcgcacgccaucggcaccagcaucacccagaaggguaucaucuucauccucuuaaugcugguuaccccuucaauggccaugcggugcgugggcaucgggagccgcgacuuuguugagggacucuccggcgcaacguggguggacgucguacuugagcacgggagcugugugacaaccauggccaaagacaagcccacccucgacauugagcuccugaaaaccgaggugacaaaccccgcugugcugcggaagcucugcaucgaagccaaaaucucuaacacaaccacggauagcaggugcccgacccagggcgaggccacucugguggaggagcaagaugccaacuucguuugccggcggaccuucguggacaggggcuggggaaacggcugcgggcuguucggcaaagggucccucaucacgugugccaaguucaagugugugaccaagcuggagggaaagauugugcaguacgagaauuuaaaguauagcguuauugugaccguccacaccggcgaucagcaucagguggggaacgaguccacagagcacggcaccaccgcgacuauuacgccgcaggccccgacuaccgagauacagcucaccgauuacggugcccuuacccuggacugcucgcccagaacaggccucgacuucaacgagaugguucucuugaccaugaaggagaaaaguuggcucguacacaagcagugguuccuggauuugcccuuacccuggacaagcggggcaagcacgucucaggagacguggaaccggcaggaucugcuggugacauuuaagaccgcccacgcgaaaaagcaggaggucguaguucuaggcucccaggagggcgccaugcacaccgccuuaacgggggccaccgaaauccagacgaguggcaccacuaccaucuucgccgggcaccugaagugccgccuaaagauggacaagcugacccugaaaggcaugagcuacgucaugugcaccgguucauucaagcuugaaaaagagguagcggagacgcaacacggcaccgugcuggugcaaaucaaguacgaagggaccgacgcucccuguaaaauccccuucagcacacaggacgagaagggugugacgcagaacggccggcuuaucaccgcaaauccgaucguaacagacaaggagaagccggucaacauagaggcugagccuccguucggggaguccuacaucguaauuggcgcgggggagaaagcccuuaagcucagcugguuuaagaagggcuccuccaucggcaagauguucgaggccacggcccgcggagcgcggcgcauggcgauccucggugacacggccugggacuuugggucgaucggcggcguguucaccagcgucgggaagcugguccaucagauuuucggcaccgccuacggggucuuauucuccggcguuuccuggaccaugaagauuggaaucggcguucuucuuacguggcugggcuuaaauucccgauccacaucccugucuaugacaugcaucgccguggggcucgucacucuguaccuaggcgucauggugcaagccgacuccgggugugucauaaacuggaaaggccgggagcugaagugcgggucagguaucuuugugacgaacgagguccacaccuggaccgagcaguacaaguuccaggcggacuccccgaagaggcuauccgccgccaucggcaaggccugggaggaaggcgucugcggcauucggagcgccacccgccuggagaacaucauguggaagcagaucuccaaugagcucaaccacauccugcuugagaaugacaugaagcucaccgugguggucggggacguggcggguauccuggggcaaggcaagaagaugauccgcccccagcccauggaguacaaguacagcuggaaguccugggggaaggccaagaucaucggggccgaugcacagaacacgaccuucaucauugacgggcccaacacgccggagugccccgacgaccaacgcgcguggaacauaugggaaguggaggauuacggguucggcaucuucaccacuaacaucuggcuaaagcugcgggacagcuacacccaggucugcgaccaccgccugaugagugccgccauaaaggacagcaaagcggugcacgccgacauggguuauuggaucgaguccgaaaagaaugagacuuggaagcuggcgcgggccucauucaucgaggugaagacuugcaucuggcccaagucccacacgcuguggagcaaugggguccuugaguccgagaugaucauccccaaaaucuacggcgggccgaucucgcagcauaauuaccgcccaggguacuucacacagaccgccgggcccuggcaccugggcaagcucgagcuggacuucgaccugugugaggguacuacggugguggucgacgagcacugcgguaaccgaggacccucccuccgcaccaccacagugacggggaagaucauccaugaguggugcugccgguccugcacccugccgccccugcgcuucaggggcgaagaugguugcugguacggcauggagauacggcccguaaaggagaaggaggaaaaucucguaaaguccauggugagcgccgggagcggcgagguagacucguucagccucgggcugcuuuguaucuccauaaugaucgaggaaguaaugcgaucccgcuggucacggaagauguuaaugacggggacccucgccguguucuuccugcugauaaugggccaauugacguggaacgaccuaauccgccugugcaucauggucggggcgaacgccagcgaccgcaugggcaugggcacuaccuacuuggcacuuauggccaccuuuaagaugcguccaauguuugcuguuggucugcucuuccgacgucuuacgucccgcgaggugcugcuucucaccaucgggcuuagccuggucgcguccguagaguugcccaacagccuggaggaacugggggacgggcucgcuaugggcauaaugauccugaagcugcucaccgacuuccagucccaccaacuaugggcgacccugcuaagccugacguucaucaagaccacuuucagucugcacuacgcuuggaagaccauggcgaugguacucagcaucgucagucuguucccccugugccucagcacgaccucgcagaagaccacauggcucccaguacugcucgggucucugggcugcaagccgcucacgauguuccucaucgccgagaacaagauuuggggucguaagaguuggccacugaacgagggcaucauggccguggggaucguaagcauccugcuuucgucccuacugaaaaaugacguuccacucgccggaccccugaucgccggcgggaugcucauugcauguuacgugaucucgggcuccagcgccgaccucuccuuagagaaggccgccgaaguuagcugggaggaagaggccgagcacagcggggcgagccacaacauccugguggaggugcaggacgacgguaccaugaagaucaaagacgaggagcgagacgacacccucaccauccugcucaaggcuacccuccuagcuguaucggguguguacccgcuaagcauccccgccacccucuucgugugguacuuuuggcagaagaagaagcagcgguccggcgugcuaugggacacucccagcccucccgagguggagcgggccgugcuggacgacggcaucuaccggaucaugcaacgcgggcugcucggccgcucgcaggucggggugggcguguuccaggagaacgucuuccacaccauguggcaugugacccgcggggcggugcugauguaccaaggcaagcggcuggagcccagcugggcguccguaaagaaggaccucaucucauacggcgggggcuggcgucuucggggguccuggaacaccggcgaggaaguacaggugaucgccgucgagccggggaaaaaucccaaaaacgugcagacugcacccggcacuuuuaagacacccgaaggcgagguaggggccauagcgcuagacuucaagccuggcacgagcgggucacccaucguaaacagggagggaaagaucgugggcuuguacgggaacgguguggucacuaccagugggaccuaugugagcgcgaucgcccaggccaaagcgucccaggaggguccacugccagaaauugaggacgagguguuccggaagcgaaaccugacaauaauggaccuacaucccggcagcggcaagacccggcgcuaccuccccgcaaucguccgugaagccaucaaaaggaaacugagaacccucauccuggcucccacccgggugguggccuccgagauggcggaggcccugaaggguaugcccauccgcuaccagacaacggcagucaaaagcgagcauacugggaaggaaaucgucgaccucaugugccacgcaaccuucacgaugcgguugcugagucccgugcgcgucccgaacuacaacaugaucaucauggacgaggcccauuucaccgaccccagcuccaucgcggcccggggcuauaucuccacccgcguggggaugggugaggccgcagccauauucaugacagcaaccccgccaggguccguagaagccuucccgcagagcaacgcggucauccaggacgaggaacgggacauucccgagcgcucauggaacagcggcuacgaauggaucaccgacuuccccggcaaaacggucugguucguaccgucaauuaagagcgggaacgacaucgcuaauuguuuacggaagaacggcaagcgcgucauccaacugucccggaagacuuuugauacggaguaccagaagaccaagaacaacgacugggacuauguggucacuaccgacauaagugaaaugggggcgaacuuccgcgccgaccgggugauugacccaagaagaugccugaagccuguuauacucaaggacgggcccgagcgcgucauccuggccggccccaugccggucacgguggccagcgcggcgcagcggcgcggccggaucggccgcaaccacaacaaggagggugaccaguacauauacaugggccagccgcugaacaacgacgaagaccacgcccacuggacugaggccaagaugcuccuagacaacauuaacacccccgaggggauuauccccgcccuguucgagccagaacgcgagaaguccgccgccguagauggcgaguaccggcucaggggugaagcccgaaagaccuucguugagcugaugcgccggggcgaccugcccguguggcucuccuauaaggucgccagcgagggguuccaguacagcgaccgccgguggugcuucgacggggagcgcaauaaccaggugcucgaggagaacauggacguggagauuuggacgaaggagggcgagcggaaaaaacugaggccacgguggcucgacgcccgcaccuacuccgacccccuggcccuccgggaguucaaagaguuugcggccgggcgccggucagucuccggagaccucauucuggagaucggcaaacugccgcagcaccucacgcagcgcgcccagaacgcucuggauaaccuggugauguugcacaacagcgagcaaggagggcgggcguaccgccacgccauggaggagcugcccgacacgauagagacgcuuaugcuccuggccuuaaucgccguauugacgggcggagucacccuguuuuuccuuuccgggcggggucucggaaagaccagcaucgggcuacuuugcgucauggccuccucgguguugcuguggauggcgagcgucgagccucacuggaucgccgcauccaucauccuggaguucuuccucaugguucugcugauccccgagccggaccgccagcgcacgccacaggacaaccaacucgcauacgucguaauaggcuuguuauucaugauccugacuguugccgcgaacgaaauggggcugcucgagaccacgaagaaggaucucgggaucgggcacguagccgucgaaaaccaccaccacgcggccaugcuggacguggaucugcaccccgccucggcguggacccucuacgcaguggcaacgacgaucaucacgccgaugaugagacacaccaucgagaacacgacggccaacaucucucugacugcuaucgccaaccaggccgccauccugaugggucucgauaagggcuggcccaucucaaagauggacaucggggugccauugcuggcccucggcugcuacagccaggugaacccucugacccuuacggcagccguacucaugcuagucgcucacuacgccaucaucgggccgggccugcaggccaaggcgacgagggaggcucaaaaaaggacggccgccgggaucaugaagaaccccaccguggacgguaucguggccaucgaccucgaccccgucguguacgaugcgaaguucgagaagcagcuggggcagaucaugcugcucauccucugcacgucccagauccugcucaugcgaaccacuugggcccugugcgagagcaucacccuggccacggggccgcucaccacacugugggagggcucccccggcaaauucuggaacacuacuaucgcugugagcauggcaaacaucuuccggggcuccuaucuggcgggcgccggccucgccuucagccugaugaagucccuggggggggggcgacgagggaccggcgcccagggcgagacucucggggagaaguggaagaggcagcucaaccagcuguccaagagcgaauuuaauacuuacaagcgguccgguaucauggagguggaccgcagcgaggcgaaagaggggcucaagcggggcgagacaacuaagcacgccguguccagggguaccgccaagcugcgcugguucguggagcgcaaccuggucaagccggagggcaaggugauugaccugggcugcggacggggcggcuggagcuauuacugcgcaggccucaagaaggugaccgaagucaagggguacaccaagggcggccccgggcacgaagagcccauaccgauggccacguacggcuggaaccuggugaagcugcauucugggaaggacguauucuuuaucccgcccgagaagugcgauacccuccugugcgacaucggcgagagcucccccaacccgacgaucgaggagggucgcacccugcgggugcucaagaugguggagccuugguugcgcggcaaccaguucuguauuaagauccugaaccccuacaugccgagcguggucgaaacccucgagcagaugcaacggaaacacggcgggaugcugguucgcaacccgcugucgcggaacuccacccaugagauguauuggguguccugcggcaccgggaacaucgucagcgcgguuaacaugaccagucgcaugcuccugaaucgcuucaccauggcccacagaaagcccaccuacgagcgcgacguggaccugggcaccgguacccggcacgucgcgguggagcccgagguggccaaucucgacaucaucgggcagcgcauagaaaacaucaagcacgagcauaagagcacguggcacuacgacgaggacaaccccuacaaaaccugggccuaccacggguccuacgaggugaaaccuagcgguuccgcgucgagcauggugaacggcguagucaaacuguugaccaagcccugggacgugauacccauggucacccagauagcuaugacggacaccaccccuuucgggcagcagcggguguucaaggagaagguagacacccgcacgccgaaggcaaagcguggaacugcgcaaaucauggaggucaccgcccgauggcucuggggcuuccuuagucgcaauaaaaagccccgcaucugcacccgggaggaguucacgcgcaaggugcggucuaacgcggccaucggggccgucuuugucgacgagaaucaauggaacuccgccaaggaggccguggaggaugagcgcuuuugggaccugguacaccgggagagggagcuccauaagcaaggcaagugugcgaccugcguguacaacaugauggggaaacgugagaaaaagcugggcgaguucgggaaggcuaaaggcagccgcgcaaucugguacaugugguuaggagcccgguuccucgaguuugaggcgcugggguucaugaacgaagaucauugguucucaagggagaacucacuguccgggguggagggagagggccuccacaagcugggguacaucuuacgggacauaucuaagauccccggcggcaacauguacgccgacgacaccgccgggugggacacccgcaucacggaggacgaccuucaaaacgaggcaaaaaucaccgacauaauggagccagaacaugcccugcucgcgaaggccaucuucaagcucacauaccagaacaaggugguccgcgugcagcggcccgccaagaacggcacugugauggaugucaucucccgccgugaccagcgcggguccggucaagugggcaccuacggcuugaauaccuucaccaacauggaggcgcagcugauuaggcagauggagucagagggcaucuucucuccuucugagcucgagacccccaaccuggccgaacgggcgcuugauugguuggguaaguauggcguggaaaggcugaaacgcauggccaucagcggggacgacugcgucguaaagccgauugaugauagguucgccacggcgcugaccgcccucaacgacaugggaaagguccgcaaggacauaccacaaugggaacccuccaagggguggaacgacuggcagcaggugcccuucuguagccaccacuuucaccagcucaucaugaaagacggucgggagaucguugugccgugccgcaaccaggaugagcuagugggccgggcgcguguaucccaaggugccggcuggagccuacgggaaaccgccugccuggggaagucguaugcacagauguggcagcugauguacuuccaccgcagggaucuccgccuagccgccaacgccaucugcuccgccguucccguggauugggugcccaccagccggacgacguggagcauucaugcccaccaccaguggaugaccaccgaggacaugcugucuguguggaaccgcgucuggaucgaggagaauccguggauggaggacaagacccacaucuccagcugggaggacgugcccuaccucggcaaacgcgaggaccaaugguguggcucacugaucgggcugaccgcgcgggccaccugggccacgaacauccagguugccaucaaccagguccgccggcuuaucggaaacgaaaacuaccuagacuacaugaccuccaugaagcgcuucaagaacgagucggaccccgagggugccuugugguga

SEQ ID NO: 24272 - RNA, 9879 nt, Artificial Sequence
  derived and/or modified CDS sequence (opt11) from DENV-1__FJ898372__SS-prME
agcgugaccaugcugcucaugcugaugcccaccgcccuggcauuucaccucaccacgcgcgguggcgagccccacaugaucgugagcaagcaggagcggggcaaaagccugcuguucaagaccagcgcgggggugaauaugugcacccucaucgccauggaccugggcgagcucugugaggacacgaugaccuacaagugcccccggaucaccgaggccgagccggacgacguggacugcugguguaaugcgacugacacguggguuaccuacgggaccuguagccaaaccggcgaacaccggcgggacaagcggucaguggcucuugcgccgcacguaggucugggcuuggagacucgaacggagacguggaugagcuccgaaggcgccuggaagcagauacagcgggucgagaccugggcccuccgacaccccggguucacggucauugcccuguuccuggcucaugccauuggcaccucaaucacucagaaggggaucaucuucaucuugcugaugcugguaacucccuccauggccaugcggugcgugggcaucgggucccgcgacuucguggaaggguuauccggcgcgaccuggguggacgucguccucgagcacgggagcugcguuaccaccauggcccgggacaagcccacccuggauaucgagcuccugaagaccgaggucaccaaccccgcgguccugcgcaaguugugcauagaggcaaagauuuccaacacaaccacggacagccggugccccacccagggcgaggccacccuggucgaggagcaggacgccaacuuugucugccgacggacuuucguggacagggguugggggaacggcugcgggcuguucggcaaggguuccuugaucacgugugccaaauucaagugcgugacgaagcuggagggcaagaucguccaguacgagaaccugaaguacuccgugaucgugacuguccauacgggggaccagcaccaggucgggaaugaaagcacggagcacggcacaaccgccaccaucacgccacaggcccccacuacggagauccagcucaccgacuacggugcucugacccuggacugcagcccccggacggggcucgacuucaacgaaauggucuuacugacgaugaaagagaaguccuggcucgugcacaagcagugguuccuggaccugcccuugcccuggaccagcggcgccagcacuucccaggagacguggaaucgccaggaccugcuggugaccuucaagaccgcacacgcgaagaagcaggaggucguggugcucggcagccaggagggugccaugcacaccgcacugaccggggcaaccgagauccagacuucaggcaccacgaccauuuucgccgggcaccuaaagugccgccucaagauggacaaacuuacccugaagggcaugagcuacgucauguguaccgguucauucaagcucgagaaggagguggcagagacgcagcacggcacagugcugguccagaucaaguaugagggcaccgaugccccuugcaagauccccuucagcacccaggacgagaagggugugacgcaaaacggacguuuaaucaccgcaaacccgaucgugacggacaaggagaagcccgucaauaucgaagcggagccgccuuucggggaguccuacaucguuaucggcgcgggggagaaggcccucaaacuaagcugguucaagaagggguccagcaucggcaagauguucgaggccaccgcucgaggggcccgacgcauggccauccugggcgacacggcuugggacuucggguccaucggcggcguguucaccagcgugggcaagcugguccaccagaucuucggcaccgccuacggcgugcucuuuucaggcguguccuggacuaugaagaucgggaucgguguacugcugacgugguugggccugaacucccggagcaccucccugagcaugaccugcaucgccguggggcucgucacccuauaucugggggucauggugcaggccgacagugggugcgucaucaacuggaaaggccgagagcucaagugugggagcggcaucuucgucacuaacgaaguccacaccuggaccgagcaguauaaguuccaggcggacucuccgaaacggcuguccgccgccaucggcaaggcgugggaggagggcgucugcgguauccgcagcgcuaccaggcuggagaacaucauguggaaacagaucuccaaugaacuaaaccacauccuccucgagaacgacaugaaguuaaccgugguggucggggacguggccggcauccugggucagggcaagaagaugauccguccccagcccauggaguacaaguacagcuggaaguccuggggcaaggcgaaaaucauaggcgccgaugcgcagaacacuaccuucauuaucgacggacccaacaccccagagugccccgacgaccagcgcgcguggaacaucugggagguugaagacuacggguucgggaucuucacuacgaauaucuggcugaagcuccgcgacucuuacacccaggucugcgaccaccggcugauguccgccgccaucaaggacagcaaggccgugcacgcagacaugggcuacuggaucgaauccgagaagaacgagaccuggaaacuugcgcgugccagcuucaucgaggugaagaccugcaucuggcccaagucccacacgcucuggagcaacgggguccuggaguccgagaugauuauccccaagaucuacggagggccgaucagccagcacaauuaucgacccggcuacuucacccagaccgccggacccuggcaccuugguaaacucgagcuugacuuugaccuaugugaaggcaccaccgugguggucgacgagcacugcgggaacagaggcccaucccuccgaaccacaacugugacggguaagaucauccaugaguggugcugccgcagcugcaccuugccgcccuugcgguuccgcggcgaggacgggugcugguacggcauggaaauacggccagugaaggagaaggaagagaaucucguuaagagcauggugagcgccgguagcggggaggucgacuccuucagccugggccuguugugcauuuccaucaugaucgaggagguuaugcguaguagguggagucgcaagaugcugaugacgggcacccuggccguguucuuccucuugaucaugggccaacucacauggaacgaucuaauccgccugugcaucauggucggggcgaacgccagcgaucggaugggcaugggcacgacauaccuggccuugauggcuacauucaagaugcgcccgauguucgcugucggacugcuguuccgccgccucacuucccgggaggugcugcugcugacuaucggccuuagccugguggcgucuguggagcuccccaacagccuggaggaacugggagacggauuagcgaugggcaucaugauccugaaacugcucaccgacuuccaaagccaucaacugugggcgacgcuguuaagccugacguucauuaagaccaccuucucccuccacuacgccuggaaaaccauggcgaugguguuaagcaucguaagucuguucccccugugccugagcacgaccucccagaaaaccaccuggcuccccguccugcuggggucccugggcugcaagccgcugacgauguuccucaucgcugagaauaagaucugggggcgaaagucguggccccugaaugagggcaucauggccgucgggaucguaagcaucuuguugagcucccuguuaaagaaugacguaccccucgcaggcccccucaucgccgguggaaugcugaucgcgugcuacgugauuucagguuccagcgcugaccucucacuggagaaggccgcugaagucagcugggaggaagaggcugagcacuccggcgcgagccacaacauccugguugaggugcaggacgacgguaccaugaagaucaaggacgaggaacgagaugacacguuaacuauccugcucaaggccacccucuuagccgugucagggguguacccgcuuucaauccccgccacccucuucgugugguauuucuggcagaagaagaagcagcgcuccgggguucugugggacacccccaguccgccugagguggagcgggccguguuggacgacgggauuuauagaaucaugcagcgggggcugcucggccgaagccagguggggguggggguguuccaggagaacgucuuccacaccauguggcacguaacacgaggggccguucugauguaccaaggcaagcgccuagaacccucgugggccagcgucaagaaggaccucaucagcuacggcgggggcuggcggcugcgcggauccuggaacacgggcgaggaaguucaagugauugcagucgaaccugggaagaaccccaagaacguccaaacagcccccggcacuuucaaaacgccggaaggcgaggugggggcgaucgcgcuggauuucaagccagguacgagcgggucccccaucgucaaccgggaagguaagaucgucgggcuuuacgggaacggaguggucaccacuagcggcaccuacgugagcgcuaucgcccaggccaaggcgucccaggaaggaccguugcccgagaucgaggacgagguguuccgcaagcggaaccugacgaucauggaccuccauccggguagcggcaagacccgccgcuaccugccggcaaucguccgcgaagccaucaagaggaaguugcggacccuaauccuugcccccaccaggguugucgccuccgagauggccgaagcccugaagggcaugcccauccguuaccagacgaccgcagucaagagcgagcacacugguaaggaaaucguggaccucaugugucacgccaccuucacgaugcgacugcuguccccaguccgagucccaaacuacaacaugaucaucauggaugaggcccacuuuaccgaucccagcuccaucgcggcccgcggcuacaucagcacccggguggggaugggugaggccgccgccauuuucaugacugcgacgccgcccggcagcguagaggcuuucccgcaaucuaaugccgucauccaggacgaggagcgcgacauccccgagcgauccuggaacucuggcuaugaguggaucaccgacuucccugguaagaccguaugguucgugcccucuaucaaaagcgggaacgacaucgccaacugccugcgcaagaacggcaagcggguuauccagcugucccgcaagacguucgacacggaauaucagaaaaccaaaaacaacgacugggacuacgugguaaccaccgacaucagcgaaaugggcgcgaacuuccgggccgaccgugucaucgacccgcgucgaugccugaagccugugauccucaaggacggccccgagcgggugauccuggcugggcccaugccugucaccguggccuccgccgcgcaacgccgcggccgcaucggccgcaaccacaacaaggaaggggaccaguacaucuacaugggccagcccuugaauaacgacgaggaccacgcccacuggacugaggccaaaaugcuacuggacaauaucaacacacccgaggggaucauccccgcccuguucgaaccggagcgggagaaguccgccgcagucgacggcgaguaccgacuccgcggggaggcccgcaagaccuuuguggaacugaugcggcgcggcgaccuucccguguggcuauccuacaaggucgccucggaaggcuuccaauacagugaucggcgguggugcuucgauggggagcguaacaaucagguguuagaggagaacauggacguggagaucuggaccaaggaaggggagagaaagaagcugaggccccgcuggcucgacgcccguaccuauuccgauccccuggcacugcgcgaguuuaaggaguucgcagccgggcggcgcagcgucucgggcgauuugauccuggagaucggaaaacugccacagcaucucacccagcgggcccagaacgcccuggacaaccuggugaugcuccacaacagcgagcagggcgggcgggccuaccggcacgccauggaggagcugccugacacgaucgagaccuuaaugcuccuggcacugaucgccguguuaaccgggggcgucacacucuucuuccugucggggcggggccucgguaaaacuagcaucggucugcugugugugauggccagcagcgugcuccuguggauggcguccgucgagccccacuggaucgccgccagcaucauccuagaauuuuuccucauggugcuguugauccccgagccggaccggcaacggacgccucaagacaaccagcuagccuacguggucauuggacuguuauucaugauccucacgguagccgcgaaugagauggggcugcuugagacgacgaagaaggaccucggcaucgggcacguggcagucgagaaccaucaccacgccgccaugcuggacgucgaccuucaccccgccuccgcguggacccucuaugcgguagccacuacgaucauuacgccgaugaugcgccacaccaucgagaacacgaccgccaacaucagccugacugccaucgcgaaccaggccgccauacugaugggccucgacaagggcuggccuaucuccaagauggacauagggguaccccuguuagcccuugguugcuacagccaggugaacccccuaacccugacggcggccgugcucaugcuggucgcccacuacgccauuaucggccccggccugcaggccaaggcgacuagggaagcacagaaacgcaccgcagccgggaucaugaagaaccccacaguugacggcauuguggccaucgacuuagaccccgucguauacgaugcgaaguucgaaaagcaauugggccagaucaugcugcucauccugugcaccagccagauccuacuuaugcgaaccacgugggcccugugugagagcaucacccuggccacggggccccucaccacccugugggagggcucccccgggaaguucuggaacaccacgaucgccgugaguauggccaacaucuuccgcggcagcuaucuggcuggugcagggcucgccuucagccugaugaagucccugggcgggggucggcgcggaaccggcgcccaaggcgagacgcucggggaaaaguggaaacgacagcugaaccaacugaguaagagcgaguucaacaccuacaagcgguccggcaucauggaggucgaccggagcgaggcgaaggaggggcugaagagaggcgagacaaccaagcacgccguaagucggggaaccgccaagcugcggugguucguggagagaaaccuggucaagcccgaagggaaagugaucgaccugggcugugggcgcggcggguggagcuacuacugcgcuggccucaagaaggugacugaggucaagggguacaccaaaggcggucccgggcacgaggaacccaucccgauggccaccuacggauggaaccuggugaaacuucacuccgggaaggacguguucuuuaucccgcccgagaagugugacacucuccuuugcgauaucggcgagagcucccccaacccgaccaucgaggaggggaggacacugaggguccucaaaauggucgaacccuggcugcggggcaaccaguucugcauuaagauccugaaccccuacaugcccagcguugucgagacccucgagcagaugcagcgcaagcacggcggcauguuggugcggaacccgcugucccgcaauuccacccacgagauguacuggguguccugcggaaccgggaauaucgucagcgcggugaacaugaccucccgaaugcuccugaaccgguucacgauggcacaccgcaaacccaccuaugagcgggacguggaccugggcaccggcacccgccacgucgccguggagccugaaguggccaaccucgacaucaucggucagagaaucgagaauaucaaacacgagcacaagucuaccuggcacuacgacgaggauaaccccuacaagaccugggcguaccacgguucauacgaggucaagccgagcgguuccgcgagcucuaugguaaauggagucgucaagcugcuaaccaagccgugggacguaauccccauggucacccagaucgccaugacggacaccacgcccuucgggcagcagcgcgucuucaaggagaagguggacacccggacgccgaaggccaagcgcggcaccgcacaaaucauggagguaacugcgcgguggcucuggggcuucuugucccgcaacaagaaaccccggaucuguacccgcgaggaguucacgcggaagguccgcuccaacgcggccauuggggccgucuucgucgacgagaaccaguggaacuccgccaaggaggcgguggaggaugagcgguucugggauuuggugcaccgcgagcgggaauugcacaagcagggcaagugcgcgacgugcguauacaacaugauggggaagcgcgagaagaagcugggcgaguucgggaaggccaagggcagccgggcaaucugguauauguggcugggcgcgcgauuccucgaguucgaggcgcugggguuuaugaacgaggaccacugguucucccgggagaacagccucucaggcguggagggggagggccuccacaagcugggguacauccugcgcgacaucagcaaaauccccggcggcaacauguaugccgacgacaccgccgggugggauacccgcauaacggaagaugaccuccagaacgaggccaagaucaccgacaucauggagccggaacacgccuugcuggcgaaggccaucuucaaacuaaccuaccaaaauaaagugguacggguucagcgccccgccaagaacggaaccgugauggacgucaucucccggcgcgaucaaagagggagcggccaggugggcaccuacgggcugaacacauucaccaauauggaagcccagcugauccgccagauggaguccgagggcaucuucagcccaucagagcucgaaacccccaaccuggcugagcgggcgcuggacuggcucgagaaguacgggguggagcgccugaagcggauggccaucucuggcgacgacugugucgugaaaccgaucgaugaucguuucgccacugcucugaccgcccucaacgacauggggaagguacggaaggacaucccucagugggagcccuccaagggcuggaaugauuggcagcagguccccuucugcucacaucacuuccaucaguuaaucaugaaggacggucgcgagaucgucgugccgugcaggaaccaggaugagcuggucgggcgcgcgcggguaucacaaggcgccggguggucuuuacgcgagaccgccugccuggggaaaagcuacgcccagauguggcagcugauguauuuccaccggcgggaccuccgauuagcugccaacgccaucugcuccgcgguucccgucgacugggugcccaccagccgcacaaccugguccauccaugcccaucaccaguggaugaccaccgaggacaugcuuaguguguggaaccgcgucuggauugaagaaaacccguggauggaggacaaaacgcacaucagcucgugggaggauguaccguacuuggggaagcgugaggaccaguggugcggcucucuuauagguuuaaccgcgcgugccacuugggccaccaacauccagguagccauaaaccagguccggagacucaucgggaacgagaacuaccuugacuauaugacgagcaugaaacgguuuaaaaacgagucagacccagaaggagcccugugguga

SEQ ID NO: 24273 - RNA, 9879 nt, Artificial Sequence
  derived and/or modified CDS sequence (opt11) from DENV-1__FJ898373__SS-prME
agcguaaccaugcuuuugaugcucaugcccaccgcauuggccuuccaccucacgacccgaggcggugaaccucacaugaucgucucaaaacaagaacgcggcaagagcuuauuauucaaaacuagcgcaggcgucaacaugugcacgcucauagcaauggaucuuggcgaacucugcgaagacacuaugacguauaaaugcccacgaauaacugaaguugaacccgacgaugucgacugcuggugcaacacaacggauacaugggugaccuacggcacguguucccagacgggagaacaucggcgcgacaaacgcuccguggcgcucgcuccccaugugggccucgggcuagagacacgagccgaaacauggaugucaagcgagggggccuggaaacagauccaaaaaguagagacgugggcgcuacggcacccaggauucaccgucauugccuuguuucuagcccacgccauagguacaaguaucacccagaaaggaauaaucuucauucuacuuaugcuagugacuccgucgauggccaugagguguguaggaauaggaagcagggacuuuguagagggccuaagcggggccacauggguggacgucguuuuggaacacggcagcugcguuacaacaauggcuaaagacaaaccgacauuagauauagagcuauugaaaacagaaguaacaaaccccgcuguccugagaaaacucuguauagaggcgaaaauauccaacacaaccaccgauucccgcugucccacccaaggggaggcaacacugguagaagaacaggacgcgaauuuuguauguaggcggacguucguagaucgaggcuggggcaacgguugcggacuauucggcaaaggcagucuaaucacuugcgccaaauucaaaugcguuacgaaacuagaagguaaaaucguacaauacgagaaccuaaaauauagcguaauagucaccguucauacaggggaccaacaccaaguaggcaaugagagcacagagcacggcaccauagcaacaauaacaccgcaagcgcccaccucggaaauccagcuuacagacuacggugcccugacccuggacugcaguccuagaacuggacuagacuucaaugaaauggucuugcugacaaugaaagagaaauccuggcuaguacacaaacagugguuucuggaccuaccauuacccuggacauccggcgcaagcacaucucaagagacguggaaccgccaagaccugcucgucacauuuaaaacagcacaugcgaagaagcaggaggucguaguccucggaagccaggaaggcgcgaugcacacugcgcuuacgggcgcgacugaaauccagaccacgggcacaaccacaauuuucgcgggacaucucaagugccgauugaagauggacaaacugacacucaagggcaugaguuacgugaugugcacgggauccuucaaacucgaaaaagaaguagcggagacacagcacggcacaguacugguacaaaucaaauaugaaggcaccgacgcgcccuguaagauacccuuuagcacgcaagacgagaaaggagugacccaaaacggcagauuaauaaccgcuaacccaauagucacggauaaggagaagcccgugaauaucgaagcugaaccgccuuuuggugagaguuauauagucauaggggcuggggagaaagcacuuaaauuaagcugguuuaagaaaggcagcucaaucggcaaaauguucgaagccacggccaggggugcgagacggauggcuauacucggcgauaccgcaugggacuucgggucaauagggggagucuuuacaagcguagguaagcuaguccaccagauauucggcacggccuacgggguucuguucagcggagucagcuggacaaugaaaauaggcaucggaguccuacugaccugguugggacuaaacagccgguccacuucacuaagcaugacgugcauagcggucggucuuauaacacuuuaucucggagucaugguacaagcggacagcggaugcguaauaaacuggaagggacgcgaacuaaaaugcgguucggggaucuucguaacaaaugaggugcauacguggacugaacaauacaaauuccaggccgacucucccaagagacucagcgccgccguagguaaagccugggaggagggcgugugugguauccggucagccacgcgacucgaaaauaucauguggcggcaaaucuccaacgaacuaaaccacauacugcuagaaaaugacaugaaauuuacuguaguagucggggacgugguagguauauuggcacaaggaaagaaaauggucaggccgcaaccaauggaacacaaguauaguuggaaaagcuggggcaaggccaagauaauuggcgcagacgugcagaacacgacauuuauaauagacgggccaaacaccccagagugcccugacgaccaacgagcauggaacauaugggaaguggaagacuacggauucggaaucuucacaacaaauauuuggcucaaauuacgggacucguauacacaagucugcgaccacagacucaugucagccgcgaucaaagacucgaaagcggugcacgcagacaugggauacuggauagagucagagaagaacgaaacuuggaagcucgcgcgagcaaguuucauagaaguaaaaacaugcauauggccaaaaucgcacacguuauggagcaacgggguacuugaaagcgaaaugaucauuccuaaaaucuaugguggccccaucucccaacacaacuauagaccaggcuacuuuacccaaacggcgggcccguggcauuuggggaaacuggaacuagacuuugaccuuugugaaggaaccaccguaguaguagacgaacauuguggcaauagagggcccucgcuacggacgacuacugucaccggaaagaucauccacgagugguguugccgaaguuguacgcucccgccguugagguucaaaggagaagacggcuguugguauggaauggagauccguccgguaaaggagaaagaagagaaucuaguuaagagcauggugagcgcaggaucgggcgaaguugacuccuucucccucggcuugcuauguauaucuauaaugauagaagaagugaugcgaagucguuggagucgaaagaugcucaugacgggaacccuugccguguucuuccuauugauuauggggcaguugacuuggaaugaccucauacgcuccugcaucauggucggugcuaacgcaucagaccgaauggggaugggaacaaccuaccucgcauugauggccaccuuuaaaaugcggccaauguucgcggugggccuguuguuccguagacucacaucucgcgaaguucuccucuugacgauaggccuaucccuuguagccaguguagaacuaccaaacucccuggaggaauugggagacggacuagcgauggggauuaugauauugaaacuacucacugacuuucagaguuaccaacucugggcaacacugcuaagccuaaccuucauaaagacgacauucucgcuucacuacgcguggaagacaauggcaaugguccuaaguauuguaagccugcuuccccucuguuuaagcacaacuucgcaaaagaccacauggcugccaguccuccuagggagccuagggugcaagccgcucacgauguuccucaucgcggaaaauaaaauuuggggacgcaaaaguuggccacucaaugaggguaucauggccgucggaauaguaucaauacuucuuagcagucugcugaaaaacgaugugccccuagccggaccucuuaucgccggaggcauguugauagcaugcuacguaaucagcggcucaagugcugaccugucgcuagagaaggccgcggaaguaucgugggaggaagaggcggaacacagcggagcaagccauaauauacucguagagguacaagacgaugguacgaugaagaucaaagacgaagaacgcgacgacacgcugacaauacucuuaaaagcgacgcuucuggccgugagcgguguguacccccucaguauuccggcaacacuauucgugugguacuucuggcagaagaaaaagcagagaagcggcguccugugggacacacccaguccgccggaaguagaacgugcggugcuugacgacgggauuuaccgcaucaugcagaggggacugcuaggaaggucccaaguagguguaggagucuuccaggagaacguguuucacacaauguggcacgucacccgaggcgcgguacuuauguaccagggaaaaagacucgaaccaagcugggccuccguuaagaaagaucuaauauccuauggcggcggcuggcgccuucaaggaucauggaauacuggcgaagaaguacagguaaucgcagucgagccagggaagaaucccaaaaacguacaaacagcaccagggacuuucaagacaccugagggggaggugggagcaaucgcccuggauuuuaaacccggcacgagcggcucacccauugugaaccgagaaggaaaaaucgucggacuguacggcaacggcgucguaaccacuucagggaccuacgugucugcaauagcgcaggccaaggccagucaagaagggccacucccagaaaucgaagacgaggucuuccggaagcgcaaccugacgauaauggaccuacacccagggagcgguaagacaaggagguauuugccggccauaguacgggaagcaaucaagaggaaguugcggacccuuauacuagcgccaacgagggucguagcaagcgagauggcggaagcacuuaagggaaugcccauacgcuaccagacuacugcggugaagucggagcacacggggagagaaaucguagauuuaaugugccacgcgacauucacaaugcguuugcugucgcccguccgcguuccgaacuauaacaugauaauaauggacgaagcgcacuucacagaccccuccucgaucgccgcacggggauauaucuccacaagagucggaaugggagaggcagcagcgaucuucaugacagcaacgccaccgggcagcgucgaggcuuucccccaaagcaaugcagugauccaagacgaggagcgggacauaccagaacguagcuggaauagcggguacgaauggaucacagauuuuccaggaaagacggucugguuuguaccauccaucaaaucgggcaaugacauagccaacugcuugcgaaagaaugguaaaaggguuauucaacucucgcggaaaacauucgauacagaauaccagaagacgaagaacaaugauugggauuauguugucacaaccgacaucucagaaaugggggcuaacuuccgcgcagaccgcguaaucgaucccaggcgaugcuugaaaccggucaucuugaaggacggacccgaaagaguaauccuggcugguccgaugccuguuacgguggccagcgcggcacaacgacggggccgaaucgggagaaaccacaacaaagagggagaucaguacauauauaugggccagccccucaauaacgacgaagaccacgcgcauuggacagaggcgaaaaugcuccuggacaauaucaacacccccgaaggaaucaucccagcgcuguucgagccagagcgagagaaaucugcagcgaucgacggcgaauaccgccugaggggcgaggcacguaaaaccuucguugagcugaugcgcagaggcgaccucccgguguggcugucauacaaaguugcgucagaaggauuccaauacagcgaccgacgauggugcuuugauggagaacgcaacaaccagguucuggaagaaaacauggacguagagauauggacgaaggagggcgaaaggaagaaacuucguccgagauggcucgacgcacgaacguacuccgacccucucgcgcuaagagaguucaaagaguucgccgcggguagaagaucugugucgggagaccucauacucgagauaggaaaacugccgcagcaccuuacacaacgcgcacagaacgcacucgacaaucuaguaaugcuccauaacucggaacaaggagguagggcauauagacacgcaauggaagaacuaccagacacgaucgaaacccuaaugcuccuggcccugaucgccguccucacggguggcgugacacuguuuuuccucucagggcgaggccugggcaaaacauccauaggccuucuaugcgugauggcgagcagcgcacuauuauggauggcaucaguagaaccacacuggaucgcagcaagcauuauucucgaguucuucuuaaugguccuacugauuccggagccagaccgacagcguacaccccaagacaaccagcuagcguacguggucauuggacuauuauucaugauccuuaccgucgccgcaaacgagauggggcuucucgaaacaaccaagaaggaccuaggcaucggacauguagcuguugaaaaccaucaccaugccaccaugcuagauguagaccuucauccagcgucggcguggacauuauacgcgguagccacgacaaucauaacgccaaugaugcgacacacgauagaaaauaccaccgcgaacaucuccuuaacugccauagccaaccaagcagcaauacuaauggggcucgacaaagguuggccaauaucgaagauggauaucggggucccccucuuagcacugggcugcuacucgcaaguaaacccauuaacucucacggcagcuguccugaugcuaguugcccauuacgcaauaaucggcccuggccuccaagccaaagccaccagagaggcacaaaaacguacggcagccgggauaaugaagaaucccacagucgacggcauuguagcuaucgaucuagauccugugguauacgaugcgaaauuugaaaaacaacuugggcagauaaugcuucucauauuaugcacaucccaaauccugcucaugcgcacaaccugggcacuaugugaaaguauaacccucgcgacaggcccgcucaccacccuaugggaaggaagcccgggaaaauucuggaacacaacaauagcaguaucuauggcaaacauauuccgagggucauaccuagcaggcgcagggcucgcguucagccuaaugaaguccuuaggaggcggccgaagagggacaggcgcgcaaggagaaacucugggagagaaauggaaacgucaacucaaccaauuaagcaaaagugaguucaacacauauaaacgcuccggaaucauggagguagaccgcagugaggcaaaagaagggcuacgaagaggcgagacaacaaagcacgcagucagcagggggaccgcaaaauuacgaugguucguggaacguaaccugguaaagccggagggcaaagugauagaucucggaugugggcgcggaggguggagcuauuacugugcagggcugaagaaagugacggaagucaaaggauacacaaaaggagguccgggccacgaagaaccgauccccauggccaccuauggguggaaccucgucaaacugcacucagggaaagacguuuucuucauaccaccagaaaaaugcgauacgcuucuuugugauaucggcgagucguccccaaacccaacaauagaggagggaagaacccuacguguccuaaaaaugguagaaccauggcugcggggaaaucaauucugcauaaaaauucuaaacccguauaugccgucaguagucgaaacccucgagcacaugcagcgcaaacauggcgggauguuaguaaggaacccacuaucacgaaacucgacgcacgagauguacuggguaucguguggaacggggaauauaguguccgcagucaauaugacaucccgcaugcugcugaauagguuuaccauggcccaccgaaaaccaaccuacgaacgagacguugaccucggcgcgggcaccagacacgucgccguugaaccagaagucgcgaaucuggauaucauaggucagcgaauugaaaacauaaaacacgaacacaagucgacauggcacuacgacgaggacaaucccuacaagacgugggccuaccaugggagcuacgagguaaagcccaguggaagcgcuuccucgauggucaacggaguaguaaaacuguugaccaaacccugggacgugauccccauggugacgcaaauagcgaugacggacacgacaccauuugggcaacaacggguauuuaaggagaagguggauacgcguacgccuaaggcaaagcgcgggaccgcacaaauaauggaagucaccgcacgcuggcuauggggcuuccuaagucgcaacaagaaaccuagaauaugcacgagggaggaguucacgagaaaaguaagaagcaaugcggcaaucggcgcuguauuuguggacgaaaaccaauggaacucagcuaaggaagcaguagaagaugaaagguucugggaccucguucaucgggagagagagcuccacaagcaaggcaaaugcgccacgugcguauacaacaugaugggcaagagagagaagaaacucggcgaguucggcaaagcaaaagggagccgggcaauuugguacauguggcugggagcucgcuuccuggaguucgaagccuuaggcuuuaugaacgaagaucacugguucagccgggaaaacucacugucuggaguagagggagaaggauugcacaaguuaggcuacauacuacgggacaucuccaaaaucccaggaggcaauauguaugccgaugacacagcaggcugggacacacgaauaaccgaggacgacuuacagaaugaagcgaaaaucacggauaucauggagccggagcacgcacuccucgcgacgaguauauucaaacuaaccuaccaaaauaaggucguucgcguccaaaggccggccaaaaacgggaccgugauggauguaaucagccgccgcgaccaacgcgggagcggccaaguaggaacauacgggcucaauaccuucaccaacauggaggcccaacugauaaggcagauggaaagugagggcauauuuucccccucugaacuugagacaccgaauuuggcggaaagaguacuagacuggcucgagaaguacgggguggagaggcuaaagagaauggcaauaagcggggacgacuguguaguuaaacccauagacgaccgguucgcgaccgcccuuacagcacucaacgacaugggaaaggucagaaaagacaucccccaaugggaaccaucgaagggcuggaaugauuggcaacaggucccuuucugcagucaucacuuccaccagcuaaucaugaaagacgggcgcgaaauagugguaccaugccggaaccaagacgaacuggucggccgagcacgaguaagccagggcgcgggcuggagucuccgagaaaccgcgugccuagguaaaucuuacgcacagauguggcaauuaauguauuuccaccggagagaucuaagacucgcugccaaugcaaucugcagcgcggugccaguagauugggugcccaccagccguacuacguggaguauacaugcacaccaccaauggaugaccacugaagacaugcuaucaguauggaaccgggucuggauagaagagaacccauggauggaggacaaaacacauauaagcaguuggggcgacguucccuaccugggaaaaagagaagaucaguggugcgggucgcuuaucggacucaccgcgcgagcaaccugggcgacaaauauccaaguagcaaucaaccaaguccgacgauuaauagggaacgaaaacuacuuggauuacaugacgagcaugaagagauuuaagaacgaaucugauccagaaggggcacuaugguag

SEQ ID NO: 24274 - RNA, 9879 nt, Artificial Sequence
  derived and/or modified CDS sequence (opt11) from DENV-1__FJ898374__SS-prME
agcguuacgaugcugcuaaugcuuaugccgaccgcguuggccuuccaccucaccacacggggcggggagccccacaugaucgucacuaagcaagaacguggcaagucacuguuguucaaaaccagcgcaggggugaacaugugcacgcucaucgcgauggacuuaggggagcugugugaggauaccaugaccuacaagugcccccggauuacggaggccgagccggacgacguggauugcuggugcaacgccaccgauacgugggugacuuacgggaccugcucgcagaccggggagcaccggcgcgacaagcggucaguggcccucgcgccccaugugggccuggggcuagagacacgcaccgagaccuggauguccagcgaaggcgccuggaagcagauccagcggguggagacgugggcucuccgccaccccggguuuaccgugauagcccuguuccuggcgcacgccaucggcaccucgaucacccagaagggaauuaucuucaucuuacugauguuggugacgcccagcauggccaugcggugcguuggaaucggcaguagagacuucguggaagguuugagcggcgccacuuggguggacgucguccuggagcacggguccugcgugacgacaauggccaaggauaagcccacgcuggacauagaguuacugaagaccgaggucaccaacccggcuguacugcggaaacugugcauugaagccaagauaucaaacaccacgaccgacagccgcugccccacccagggcgaagccaccuuaauggaagagcaggacgcaaacuucgugugccggcgcacguucguugaucggggcugggggaacggcugcggucuguucggcaaggggagcuuaaucacgugcgccaaguucaagugcgugacgaagcucgagggcaagaucgugcaguacgagaaccugaaguacagcgucaucgugaccgugcacacgggcgaccagcaccaggucggaaacgaaagcaccgaacacgggaccacggcgaccaucacgccccaggcccccaccucggaaauccagcucacagacuacggggcccugacccuggacugcaguccccgcacggggcucgacuucaacgagaugguacugcugaccaugaaggaaaagucauggcucguccacaagcagugguuccuggaccuuccucucccguggaccagcggggccagcaccucccaagagacguggaaccggcaggaccugcuggugaccuucaagaccgcccacgcgaagaagcaggaaguugucgugcucggaagccaagagggcgccaugcacaccgcccugaccggggccaccgaaauccagaccucgggcaccacgaccaucuucgcugggcaccucaagugccgccugaaaauggacaagcugacgcuaaaaggcaugaguuacgugaugugcacaggauccuuuaaacucgagaaggaggucgcggaaacgcagcacggcaccguacuggugcagaucaaauacgaggguaccgaugccccguguaagauccccuucucaacccaggacgagaagggggugauccagaacggacggcucaucacugccaacccgaucgugaccgacaaggagaagcccguaaacaucgaggccgaaccgcccuucggggagagcuauaucgucaucggcgugggcgagaaggcgcugaaacucagcugguucaagaaaggguccagcaucggcaagauguucgaagcgacagcccgaggggcucggcgcauggcgauauuaggagacaccgcgugggacuucggguccauuggcggcguguucacgagcgucgggaaacuggugcaccagaucuucggcaccgccuacgggguccuguucuccggcgucagcuggaccaugaagaucgguaucggcgugcugcugaccuggcucggacugaauucgcgcagcacgucucugagcaugaccugcauagccguugggcucgucacucuuuaucugggcgugauggugcaagcugacucggggugcgucaucaacuggaagggcagagagcucaagugcgggagcggcaucuucgugacgaacgaagugcacacguggaccgaacaguauaaguuccaagccgacagcccgaaacgccuguccgcugccaucggcaaggccugggaggaaggugucuguggcauccgaagcgugacccgccuggagaauaucauguggaagcagaucucgaacgagcucaaccacauccugcuggagaacgauaugaaauucaccguugucguaggggacguggugggcauacucgcacaggggaagaagaugauccggccccagcccauggagcacaaguacagcuggaaguccugggggaaagccaagaucauuggcgcggacgugcagaacaccacguucaucaucgacgggcccaacaccccggagugccccgacgaccagcgcgccuggaacaucugggagguugaggacuacggauucggcauauucaccaccaacaucuggcugaagcugcgggacagcuacacgcaggccugcgaccacaggcucauguccgccgcaaucaaggacagcaaggcuguccacgccgacaugggcuauuggauagagagugagaagaacgagaccuggaaacuggcgcgggccagcuucaucgaggugaagacgugcauauggcccaagucccacacccucuggagcaacggggugcuagaguccgagauggucaucccaaagaucuacggggggccgaucagccagcacaacuaucgccccggguacuucacucagaccgcgggccccuggcaccuggggaagcuggagcucgacuucgaccugugcgagggcaccaccgugguggucgacgagcacuguggcaacagagggccgucacugcgcacgaccacggugaccggaaagauuauacacgaguggugcugccggagcugcacgcuaccuccccuccgcuucaagggggaggacggcugcugguacgggauggagauccgcccagugaaggagaaagaggagaaccuggucaagucgauggugagcgccggcagcggcgaaguggacagcuucagccucggguuacugugcaucuccaucaugaucgaggaggucaugcggagccgguggucccgcaagaugcuaaugaccggcacccuggccguguucuugcuccugaucaugggccagcugacuuggaacgaccucauccggcugugcaucauggugggcgccaacgccuccgaccgcaugggcauggguacgaccuaccuggcacucauggccaccuucaagaugcgcccgauguucgcuguaggccugcuuuuccggcgccucacuagccgggagguacugcugcucacgaucggucugagccuggucgcuuccguugagcucccuaacagccuggaagaauuaggcgaugggcucgcgaugggcaucaugauccugaaacugcucaccgacuuccagucccaccaacugugggcgacccugcucucgcugacuuuuaucaagacgacguugucccuccacuacgccuggaagacgauggccauggugcugagcauugucucccuguucccccucugccuuagcacaacgucccaaaagaccaccuggcugccggugcuccugggcagccugggguguaagccguuaacgauguuucugaucgccgagaacaagaucugggggcgcaaguccuggccccugaacgagggaaucauggcugugggcgucgugaguauccuccugagcuccuugcucaagaacgacgugccccuggccgggcccuuaaucgccggugguaugcucaucgccugcuacguuaucucuggguccagcgccgaccugucccuggagaaggcggccgaggugucaugggaggaggaggccgagcacucgggcgccagccauaauauccucguggagguccaggacgauggaacgaugaagaucaaggacgaggagcgggacgacacccuaacuauccugcucaaggccacccugcuggccgugaguggaguguacccucucagcauccccgcuacccuguucgugugguacuucuggcagaagaagaagcagagguccgggguuuugugggacacaccuaguccgcccgaaguggagagggccguccuggacgacggcaucuaccgcaucaugcagcggggccugcuggggcgcucccaggugggcgugggcgucuuccaggagaacguuuuccacaccauguggcacgugacucggggcgccgugcugauguaccaagggaagcggcucgagccaucaugggcuuccgucaagaaggacuuaaucagcuacggaggcggguggcggcugcagggguccuggaacaccggggaggaggugcaagucaucgcgguggagccaggcaagaaccccaagaacgugcagacggcccccgggaccuucaagacgcccgaaggugaagucggugccaucgcccucgacuucaaaccggguaccagcggaucccccaucguuaaccgcgaggggaagaucgugggccuguacggcaacggaguagugacaaccagcggcaccuauguaagcgcgaucgcgcaggccaaagccucgcaggaggggccacugcccgagaucgaggacgagguauuccggaagcgcaaccucaccaucauggaccugcaccccggcagcgggaagacgcggcgcuacuugccggcaaucgugcgugaggcaaucaaacgcaagcuccggacccugauucuggcccccaccagaguggucgccuccgagauggccgaggcgcucaaggggaugcccauccgcuaccagaccacggcggucaagagcgagcacaccggcaaggagaucguggaccugaugugccacgccacuuucacgaugaggcuccucucccccguccgagugccgaacuacaacaugaucaucauggacgaagcccacuucaccgaccccagcuccaucgccgcccggggcuacaucuccacccgcgugggcaugggggaggcagccgccaucuucaugaccgccacucccccgggcuccguggaggccuucccgcaaagcaacgcugugauccaggacgaggaacgggacauccccgagcgcucguggaacagcggguacgaauggaucacugacuuucccggcaaaaccguuugguuuguucccuccaucaaaagcggcaacgacaucgccaacugccugaggaaaaacgggaagcgcgugauccagcugucgcguaagaccuuugacacggaguaccagaagacgaagaacaacgacugggauuacguugucaccaccgacauuagugagaugggcgccaacuuccgcgccgacagagugaucgacccgcgccguugccucaagcccgucauauugaaggacgggcccgagcgcgucauccuagcgggccccaugccggugaccgucgcuuccgccgcccagcggcgcgggcggaucggccgcaaccacaacaaggagggggaccaguacaucuacaugggccagcccuuaaacaacgacgaggaccacgcccacuggacggaggcgaagaugcugcuggacaauaucaacacccccgagggaaucauccccgcccucuuugagccggagcgggagaaguccgcugccaucgacggugaauaccgccugcgaggcgaggcccgaaagaccuucguggagcugaugcgccgcggggaccuacccguguggcuauccuauaagguagcgucugagggcuuccaauacucugaccgccggugguguuuugauggggagcgcaacaaccaggugcuggaggagaacauggacguagagaucuggaccaaggagggggagcguaagaagcuccgcccccguuggcuagacgcccgcacguacuccgacccccuggcccuccgggaguucaaggaguuugccgcgggccgccggagcguauccggagaccugauucuggagaucggcaagcucccacagcaccugacccagcgcgcacagaaugcccuggauaaccuagugaugcuucacaacagcgagcagggggggcgggccuaccggcacgcaauggaggagcugcccgacacaaucgagacacucaugcugcuggcgcucaucgccgugcugacugguggggucacccuguucuuccucucuggaagagggcugggcaagaccagcauaggucugcucugcgugauggccaguagugugcugcuuuggauggccuccguugagccucacuggauagccgcgucaaucauacucgaguucuuucuaaugguccuucugauccccgagccggaccgccagcggacgccgcaggacaaccagcuggccuacguggucauuggccuccucuucaugauccuaaccguggcagccaacgagaugggccugcuagagacuaccaagaaggaccuggggauugggcauguggccguugagaaccaccaccacgcaaccaugcuggacguggaucuacaccccgcuuccgccuggacccuguacgccguggccacgaccaucaucaccccgaugaugcgacacacgaucgaaaacacgacggcgaacaucagccugaccgccaucgccaaccaggccgccauacugauggggcuggacaaaggcuggccgaucuccaagauggacaucggcgucccccugcucgcgcuggggugcuacagccagguuaacccucugacacucacggcggccgugcugaugcugguggcccauuacgcgaucaucggcccgggccuccaggccaaggccacccgggaggcgcaaaaacggaccgccgcugggauaaugaagaacccgaccguagacgguaucguggccaucgacuuggaccccgucguguacgacgccaaauucgagaagcagcugggccaaauuaugcuccuaauccugugcacgucccaaauccucuugaugcgcacgaccugggcccugugcgaaucgauaacgcuagccacgggcccccugaccacccugugggaagggucuccgggcaaauucuggaauaccacgaucgcggugagcauggccaacaucuuccggggguccuacuuagccggggccggccuggcguucagccugaugaagucauuggguggcgggcgccgggguaccggggcgcagggcgagacucugggggagaaguggaagcgccaguugaaucaacucucaaagagcgaguucaacaucuacaagcgguccgggaucauggaggucgaccgcagcgaggccaaggagggccugaaacgcggagagacaacgcgccacgccgugucccggggcaccgcuaaacugcgaugguucguagagcggaaccuggucaagcccgaggggaaagugaucgaccucggcugcggacgcggggguuggagcuacuacugcgcggggcugaagaaagugaccgagguuaagggcuacaccaagggcgggcccggucacgaagagccuaucccgauggccacguacggauggaaccuggugaagcuccacuccggcaaggacguguuuuucacgccacccgagaagugcgacacacugcugugcgacauaggggagagcucuccaaacccgaccauagaggagggccggacgcuccgaguccugaagaugguugagccguggcuccgggggaaccaauucuguaucaagauacuuaaccccuacaugcccagcguggucgagacccuggagcagaugcagcgcaagcacgggggcaugcugguacggaacccucucucccgcaauagcacccaugagauguacuggguguccugcgggaccggcaacaucgucagcgcugugaacaugaccucccgaaugcuauuaaaccgcuucacgauggcccaccgcaagcccaccuacgaacgggacgucgaccucggugccggcacccgccacgucgcgguggagccugagguggcgaaccuggacaucaucggucaacggauagaaaacauaaagcacgagcacaagucuaccuggcacuaugacgaggacaaccccuacaagacgugggccuaccauggauccuacgagguuaagccgagcggcuccgcuucaagcaugguaaacggcgucgugaagcugcucaccaaacccugggacguuauccccauggucacgcagaucgccaugaccgacacuacccccuuuggccagcaacgcguuuucaaggagaagguggauacccgaacaccgaaggcgaaaagagggacugcccagaucauggaagucaccgcucgguggcuguggggauuccugucccgcaacaagaagccccggaucugcacccgcgaagaauucacccggaaggugaggucaaacgccgccaucggcgcgguguucgucgacgagaaccaguggaacuccgccaaggaggccguggaggacgagcgguuuugggaucucgugcaaaaagagcgagagcugcacaagcaggguaagugcgccacgugcguauacaacaugaugggaaagcgugagaagaagcugggugaguucggcaaggcgaaagggagccgcgcuauaugguacauguggcucggcgcccgguuccucgaguucgaagcauugggcuucaugaacgaggaccauugguucucccgagagaacucccuuuccgggguagagggcgaggggcuucacaagcuaggcuacauacucagagauauaagcaagaucccagguggcaacauguacgcagacgacaccgcggguugggacacccgcaucaccgaggacgaccuucagaacgaggccaagaucacggacaucauggaaccggagcacgcccugcucgccaccuccaucuucaagcuaaccuaccaaaacaaggugguccgggugcagcggcccgccaagaacgggacggugauggacgucaucagccgccgggaccagcgcggcuccggccaggugggcacguacggacugaauacguucaccaacauggaggcacagcucauccggcagauggagagcgaggggaucuuccugcccuccgaacuggagacacccaaccucgccgagcgcgugcuggacuggcuggagaagcacggcgucgagcggcucaagcggauggccaucaguggggacgacugugugguuaagccgauugacgaccgguucgccacggcacugaccgcccugaacgacaugggcaaagugcgcaaggacauaccccaaugggagcccuccaagggguggaacgacuggcagcagguucccuucugcagccaccacuuccaccagcucauuaugaaagacggcagagagaucguagucccgugccgcaaccaggacgaguuggugggccgugcccgcgugucccagggggccggguggagccugcgggaaaccgccugccucggcaagagcuacgcccagauguggcagcuuauguacuuccaccgccgcgaccugcgccucgcggcgaacgcgauaugcucugcgguccccguggacuggguaccgaccagccggacgaccuggucaauccacgcgcaccaccaguggaugaccaccgaggacaugcugagcgucuggaauagaguguggaucgaggagaaccccuggauggaggacaagacgcaugugagcucuuggggcgaugucccguaccuugggaagcgggaggaucaguggugcgggucccucaucggucugaccgcccgcgccaccugggccagcaacauccagguggcgauaaaccaggugcgacggcugaucgggaacgagaacuaccucgacuacaugacauccaugaagcguuucaagaacgagggcgaccccgagggagcacugugguga

SEQ ID NO: 24275 - RNA, 9879 nt, Artificial Sequence
  derived and/or modified CDS sequence (opt11) from DENV-1__FJ898375__SS-prME
ucggugaccaugcugcucaugcugaugcccaccgcccuggccuuucaccucacuacccggggaggggaaccgcacaugaucgugagcaaacaggaacgugggaaaagccucuuauucaagacgucugcgggagugaacaugugcaccuuaaucgcgauggaccugggcgaguucugcgaggacacgaugaccuacaagugcccccgcaucacggaggccgagcccgacgacguggauugcuggugcaacgccaccgauacgugggugaccuacgggaccuguucacagaccggcgagcaccggcgcgacaagcgcuccguagcccuggcaccccacguggggcucgggcuggagacacguaccgagaccuggaugagcuccgagggcgccuggaagcagauccagcgugucgagacuugggcuuuacgccaccccggguucacggugauggcccucuuccuggcgcacgccauuggcaccagcaucacucagaaggggaucaucuucauccugcucaugcuggugacccccuccauggcgaugcggugcgucggcaucggcagccgugacuucguggaagggcuguccggcgccacgugggucgacgucgugcuggagcacggcagcugcgugaccacuauggcuaaggacaagccuacacuggacaucgagcuacucaagaccgaggucaccaaccccgcgguacugcggaagcugugcaucgaggcaaaaaucuccaauacuaccacggacucccgcugcccgacccagggcgaagccacccucguggaggagcaagacgccaauuucguaugcagacgcaccuucguugaucggggcugggggaacggcugcgggcuguucggcaaggggucccugaucacgugcgccaaguucaagugcgugaccaagcuagaaggcaagaccguacaguacgagaaucugaaauauagcgugaucgugaccguccacaccggcgaccaacaccagguggggaacgaauccaccgagcacggcaccacugccaccaucacgccccaagcccccagcaccgagauccagcugaccgacuacggggccuugacacuggacuguucgccccggacgggccuggacuuuaacgaaaugguccuccuuacgaugaaggaaaaauccuggcuggugcacaagcagugguuccuugaucuuccccuuccuuggaccagcggggcguccacuagccaggaaacguggaaucggaaagaucuccuggucaccuucaaaaccgcccaugcgaagaagcaggaggucguggugcucggaucccaagagggcgcuaugcacacggcgcucacgggggcgaccgagauccaaacuagcggcaccacgaccaucuuugccgggcaccugaagugccgccugaagauggacaagcucacccugaagggcauguccuaugucaugugcaccggguccuucaaauuggagaaggagguggcggagacgcagcauggcaccgugcucguccagaucaaguacgagggaacggacgcccccugcaaaauccccuucucuacccaggacgagaagggcgugacgcagaacggccggcugaucaccgccaacccaauugugaccgacaaagagaagcccguaaacaucgaagcggaaccgcccuucggugagagcuacaucgugaucggagcaggcgagaaagcccugaagcugagcugguuuaaaaagggaagcuccauuggcaagauguucgaggccacggcacgcggcgccagaagaauggcgauccucggugacacggccugggacuucgggagcaucggcggcgucuucacguccgucgggaagcuggugcaccagaucuucggcaccgccuauggggugcuguuuucuggcgucaguuggacgaugaagaucgggaucggcguccuccugacguggcugggccugaacucccgcuccaccucucuuuccaugaccugcaucgccguggggcuggucacccucuaccugggcguuauggugcaggcggacagcgggugcguaaucaacuggaaaggccgggaacucaaaugcgggaguggcaucuucgugacgaacgagguccacaccuggacggagcaguauaaguuccaggcggauuccccgaagcgccucagcgccgccaucggcaaggccugggaagaaggggucugcggcauucggucggccacucgccuggagaacaucauguggaagcagaucagcaacgagcuuaaucacauucuccuggagaacgauaugaaguucaccgugguggucggggacguagcgggcauccuggcucaaggcaagaaaaugauccggccacagcccauggaguacaaguacucauggaaauccuggggcaaggccaagaucaucggugccgacguucagaacacgaccuucauaaucgaugggcccaacaccccggagugccccgacgaccagcgcgcguggaauaucugggaggucgaggacuacggcuucgggauauucaccacaaauaucuggcucaagcuaagagacuccuacacucaggugugcgaccacagacugaugagcgccgcgaucaaggacuccaaggccgugcacgccgacaugggcuacuggaucgagagcgagaagaacgagacuuggaagcucgcgcgugccuccuucaucgaggucaagaccugcaucuggcccaagagccacacguuguggaguaauggcguauuggagagcgagaugauaauccccaagaucuacgggggcccgaucagccagcauaacuaccgccccggcuacuucacccagacagcgggccccuggcaccucggaaagcuggaauuggacuucgaccucugcgagggcaccacggucgucguggaugagcauugcggcaacagggggccgagccugcgcaccaccacaguuacgggcaagaucauccacgaauggugcugccgauccugcaccuugccaccccugcgcuucaaaggggaagacggcugcugguacgggauggagauccggcccgucaaggagaaggaggagaaccuggucaagagcauggugagcgccggcuccggcgaggucgauagcuucucccuggggcuccuguguaucucaaucaugaucgaggaagugaugcgcucacgcuggucccgaaagaugcugaugaccggaacguuggcaguauucuuccugcugauuauggggcagcucacguggaaugaccugauucgacugugcauaauggucggcgcgaacgccuccgaccgcauggggaugggcaccaccuaccucgcccuaauggccaccuucaagaugcgcccgauguucgccguaggccuccuauucaggcgccugacgucgcgggaggugcuucuacugacaaucgggcugucccuugucgcgagcguugagcugccgaacucccuggaggagcucggugacgggcuggcaaugggcauuaugauccugaaguugcugaccgacuuccagagccaccagcugugggccacccuccugucccugacuuuuaucaagaccaccuucucccuccacuacgcuuggaagaccauggcgaugguucuguccaucguuagccuguuccccuugugccugucuacgaccagccagaagaccaccuggcugccggugcuguugggcucgcucggguguaagccucucacgauguuccugaucgccgagaacaagauuuggggccgcaagagcuggccccugaacgaggggaucauggccgucggcaucguuuccauccuccugucuagccugcucaaaaacgaugugccucuggcggggccccugauagccggcggcaugcucaucgcuugcuacgucaucuccgggagcuccgccgaccugagccucgagaaggccgccgagguguccugggaggaggaggccgagcacagcggcgcuagccacaauaucuugguggaaguucaggacgacgggaccaugaagauaaaggacgaggaacgggaugacacccugaccauucugcucaaggccacccuguuggcagugucaggcguauacccgcuguccaucccggccacgcuguucgucugguacuucuggcagaagaagaagcaacgcagcgggguacugugggacaccccaaguccgcccgagguggagcgggccgugcucgacgacggcaucuaccgaaucaugcagcggggccugcucgggagaagccaggugggcgugggggucuuccaggagaacgucuuccauaccauguggcacgugacccgcggcgcgguccugauguaccaggggaagcgccucgagcccucuugggccagcgucaagaaggaucugaucuccuacggcggcggguggcgguugcagggcagcuggaacacgggggaggaagugcaagucaucgccguggagcccgguaagaaccccaagaacguccagaccgcucccgggaccuuuaagaccuccgagggcgaagucggcgccaucgcgcucgacuucaagccggggacgaguggcucuccuaucgugaaccgcgaagggaagaucgugggccuauacggcaacggggucgugaccaccuccggaaccuacgugagcgccaucgcccaggccaaggcgucccaggaggggccacugccggagaucgaggacgagguguuucggaagcggaaccucacgaucauggaucugcaccccggcagcgggaagacuaggagauaucugcccgccaucguccgcgaggccauaaaacgcaagcuccggacacugauccuggccccgacucgcgucguagccagugagauggcagaggcccucaagggcaugcccauccgcuaccagacaaccgccgucaagagcgagcacaccgguaaggagaucguggaucugaugugccaugcaaccuucacgaugcggcugcuuucacccguccgcgugcccaauuacaacaugauaaucauggacgaggcccauuucaccgacccgagcuccaucgcggcccggggguacauuagcacccgcguggguaugggggaggccgccgccaucuucaugaccgcgaccccgcccggcuccgucgaggccuucccucagagcaacgccguaauccaggacgaggaacgggacaucccggagcgcucguggaacagcggcuacgaauggaucacagacuuucccggcaagaccguuugguucguccccaguauuaagagcggcaaugauaucgccaacuguuuacggaagaacgggaaacgcgugauccaguuaucccgaaagacguucgacacggaguaccagaagaccaaaaacaacgacugggacuacguggucaccacagauaucagcgagaugggggcgaacuuccgcgccgaccggguuauagauccucgccggugccucaagccggugauccugaaggacgggcccgagcgcgucauccuggccggccccaugccggugacaguagccuccgccgcccagagacgcgggcggaucggccgcaaucacaacaaagagggcgaccaguacaucuacauggggcaaccacucaacaacgacgaagaccacgcccacuggaccgaggcgaagaugcugcuggacaacauaaauacccccgagggcauaauccccgcccuuuucgagcccgagcgggaaaaguccgccgcgaucgacggggaguaccgucugcgcggcgaggcgcgaaagacauucguugagcugaugagacgcggggaucucccggugugguugagccauaaagucgccuccgagggcuuccaguacagcgaccgucgguggugcuucgacggcgagcgcaacaaucaggugcuggaagagaauauggauguggagauuuggacgaaggagggggagcggaagaaacuacgaccccgguggcuggacgcccgaacguacuccgacccccuggcacuacgggaguucaaggaguucgccgccggccgccguagcgucuccggggaccugauucuggaaaucggaaagcucccccaacaccugacccagcgggcucagaaugcacuggacaaccucgugaugcugcacaacagcgaacagggcgggcgggcguaccgucacgcgauggaggaacugccggacaccauagagacgcugaugcuacuggcccuaaucgccguucuuaccggcggggugacccuguucuuucucuccggccgcgggcuugggaagaccagcaucggccugcucugugugauggccuccagcguguugcuuuggauggcgucgguugagccccacuggaucgccgcgagcauuauccucgaguucuuccugauggugcugcucauccccgagcccgaccgccagcggaccccacaggacaaccagcuggccuauguggucauaggacuccucuucaugauccugaccguggccgcaaacgagaugggccugcucgaaacuaccaagaaggaccuggggaucggccacguggccguagagaagcaccaccacgccgccaugcuggacguggaccuacacccagcauccgcguggacacuguacgccguggccacgacaaucaucacccccaugaugcgccacacaaucgagaacacuacagccaacauaagccugaccgccaucgcgaaucaggccgccauccucauggggcuggacaaggguuggccaaucuccaagauggacaucggcgucccccugcucgcgcugggguguuauucacaggugaauccccugacgcucacggcugccgugcugaugcugguugcccauuacgcuaucaucggccccggccuccaggccaaggcgaccagagaggcccagaagcgcaccgccgcgggcaucaugaagaacccgacgguggacgggauaguggccaucgaucuggauccggucguguacgacgcgaaguucgagaagcagcugggccagaucaugcuccugauccugugcaccucccagauccuccugaugcgcaccacuugggcccugugcgagucaauaacacucgccacuggccccuugaccacacugugggaggggucccccgguaaguucuggaacaccacuaucgcggugagcauggccaacaucuuccgagggagcuaccucgcgggggcuggccuggccuucagccugaugaagucgcucggaggcgggcgccgggggaccggggcccagggcgagacccugggcgagaaguggaagcgccagcugaaucagcucuccaaaagcgaguucaauaccuacaagcgguccgggauuauggaggucgaccgcagcgaggcgaaggaaggccucaagcgcggggagacgaccaagcacgccguaagccgcggcaccgcgaaguugcggugguucguggagcgcaaccucgucaagccggaggggaaaguaauugacuuaggcugcggccgcggcggguggagcuauuacugcgccggguuaaagaaggugaccgaggucaagggauacacgaagggcgggcccggccacgaggagcccauccccauggccacuuacggguggaaccugguuaaacuucacucaggcaaggacguguucuucauuccgcccgagaagugcgauacccugcugugcgacauuggcgagagcagucccaaccccaccaucgaggaaggccgcacgcuucggguccugaagaugguagagccguggcugcgcgggaaccaguucugcaucaagauccucaaccccuacaugcccucugucguggagacccuagagcaaaugcagcggaagcauggaggcaugcuagugcgcaacccgcucucccggaacagcacccacgagauguacugggugucuugcgggaccggcaacaucgucagcgcggugaacaugacgagcaggaugcugcugaaucguuucacgauggcccaucguaagccgaccuaugagcgcgacguggaccucggggccgggacccggcacgucgccguggagcccgaaguggccaaccuggacaucaucggucagcgcauagagaacaucaaacacgagcacaaaagcaccuggcacuacgacgaggacaaccccuacaagacgugggcguaccacgggucuuacgaggucaagcccagcgguucugcguccagcauggugaacggggucgugaagcugcucacuaagccgugggacgugauacccauggugacccagaucgccaugaccgauacgacccccuuugggcagcagcggguguuuaaagagaagguggacacccgcaccccuaaggcuaagcgggguacggcucagaucauggaggucaccgcgaaaugguuguggggcuuccugucccgcaacaagaagccucggauaugcacgcgcgaggaguucacccggaaggugaggagcaaugccgccaucggcgccguguucguugacgagaaccaauggaacuccgcgaaggaggccguagaagacgagcgauucugggaccuagugcaucgagagcgggagcugcauaagcaggggaagugcgcuacgugugucuacaacaugaugggcaagcgcgaaaagaaacugggggaguucggcaaggccaaggggagccgggccaucugguacauguggcucggggcgcgcuuccuggaguucgaggcccugggguucaugaacgaggaccacugguucucccgggagaacagccucucugggguggagggcgaaggguuacacaagcugggcuauauccuccgcgauaucagcaagauccccggagggaacauguacgccgacgacaccgccggcugggacacccggaucacugaggacgaccugcagaacgaggcuaagaucacggacauaauggagcccgagcacgcgcugcucgccaagucgauauucaagcugaccuaccagaacaaagucguccgcguccaaagaccggccaagaacgggaccgugauggacgucaucucucgucgcgaccaacggggcagcggacaaguggguaccuacggccugaacacguucacuaacauggaggcccagcucauccgccagauggagagcgagggaaucuucagucccuccgagcuggagacccccaaucuggccggccggguacucgacuggcuggagaagcacgggguugagcgucugaagcguauggcgaucaguggcgacgacugcguggugaagcccaucgaugaccgcuucgccaccgcccucacggcccucaacgauauggggaagguccggaaggacaucccgcagugggaacccucgaagggcuggaacgacuggcagcaaguccccuucugcagccaccacuuucaucagcuuaucaugaaagacggccgcgagaucgugguccccugccggaaccaggacgagcucguggggcgugcccgggugagucaaggcgccgguuggagccugcgugagaccgccugccugggcaagagcuaugcccagauguggcagcucauguacuuucaccggcgcgaccugcggcuggccgcgaaugcaaucuguucggccgucccuguggacuggguacccaccucccgcaccacguggagcauccacgcccaucaccaguggaugaccaccgaggacaugcucuccgucuggaaucggguguggaucgaagagaaccccuggauggaggauaagacccacaucagcuccuggggcgacguucccuaccugggcaagagggaggaucaguggugcggcagccugaucgggcucacggcccgugcgaccugggccaccaacauccagguagccaucaaucaggugcgccgccugaucggcaaugagaauuaccuggacuauaugaccuccaugaagcgauucaagaacgagucugauccggagggggcccucugguag

SEQ ID NO: 24276 - RNA, 9879 nt, Artificial Sequence
  derived and/or modified CDS sequence (opt11) from DENV-1__FJ898376__SS-prME
agcgugaccaugcugcucaugcugaugcccacagcauuagccuuccacuugaccacccggggcggggagccccauaugaucguaacgaagcaggagcggggaaagagcuuguuauucaagaccagcgcgggggugaauaugugcacccucaucgcgauggaccugggugagcugugugaggacaccaugacguacaagugcccccgaaucaccgaggccgaacccgacgacguggacugcuggugcaacgcuaccgacaccugggugacguacgguaccugcagccagaccggcgagcaccguagggacaagcggagcguagcccucgcgccgcacgugggccugggccuggagacccgcacagagaccuggauguccagcgagggcgccuggaaacagauccagcgggucgaaacgugggcccuucgccaccccggguucaccguuauugcccuguuccuagcgcacgugauuggcaccaguaucacccaaaaggggaucaucuuuauccuccugaugcuggucacgcccagcauggcgaugcggugcgugggcaucggcucgcgggauuucguggagggccucaguggcgccaccugggucgacgucgugcuggagcacgggucaugcgucaccaccauggccaaggauaaacccacgcuggacauagagcucuuaaaaaccgaagugaccaaucccgccgugcugcggaagcucugcaucgaggcgaaaaucuccaauaccacgaccgacaguaggugccccacccagggugaggccacccugauggaggaacaggacgccaacuucgucugucggcgcacguucguggaccggggcugggggaacggcugugggcuguucggcaaagggagccucaucacgugcgccaaguucaagugcgugacgaagcuggaaggcaaaaucgugcaguacgagaaccugaaguacuccgugaucgugaccguacacacgggcgaccagcaccaaguggggaacgagagcacggagcacggcacgacagccacaauaacaccgcaagcgcccaccuccgagauccagcucaccgacuacggggcccugacccuggacuguucaccccgcacgggccuggacuucaacgagaugguccuguugaccaugaaggagaaguccuggcucgugcacaagcagugguucuuggaccugccauuacccuggacgagcggggccagcacaucccaggagacguggaaucggcaagaccugcuggugacguucaagaccgcucacgcgaagaagcaggaggucguggugcucgggagccaggagggcgcgaugcacaccgcacugacuggggccaccgagauccagaccuccggcaccacuaccaucuucgcagggcaccucaagugccgccucaagauggacaagcugacccugaaaggcaugaguuacgugauguguaccgggucauucaagcuugagaaggagguggcagagacgcaacacggcaccgugcucguccagaucaaguacgagggcaccgacgcgcccugcaagauccccuuuagcacccaggacgagaagggggugacgcagaauggccgacugaucacggccaauccgauugugaccgacaaggagaagcccguuaacaucgaggcggaaccgcccuucggggaguccuauauugugaucggcgccggcgaaaaggcucugaaguuaucaugguuuaagaagggguccucgauagguaagauguucgaggccaccgcccgcggcgcccgucgcauggccauccuaggugacacggcgugggacuucggguccaucggcggcguguucaccagcgucgggaagcuggugcaucagaucuucgguaccgccuacgggguccuguucucaggggucagcuggaccaugaagaucgggaucggcguacugcugaccuggcucggccugaacucccgaagcaccucccugucuaugacgugcaucgcuguggggcucguaacgcuauaccugggggugauggugcaggccgacuccgggugcgucaucaacuggaagggacgggagcucaaaugugguucuggcaucuucgugacgaacgagguccacacauggacagagcaguacaaguuccaggccgacagcccgaagcgccuguccgcggccaucggcaaggccugggaagagggggucugcggcauccguucugccacccgccuggagaacaucauguggaagcagaucuccaacgagcucaaccauauccugcuggagaacgauaugaaauucacggugguggucggggacgugguuggcauccucgcccaggggaagaaaaugauacggccccagcccauggagcacaaguacucuuggaagucauggggcaaggcaaagaucaucggcgcggacguccagaacacgacuuuuauaauagacgggccgaacaccccggaaugucccgacgaccagagagccuggaauaucugggagguggaggacuacggcuucgggaucuucaccacgaacauauggcugaagcugcgggacucucacacccaggugugcgaccaccgccucaugucggccgcgaucaaggacagcaaggcuguccaugcggacauggguuacuggaucgagagugagaagaacgagaccuggaagcuggcccgggccagcuucaucgagguuaagaccuguaucuggcccaagucccacacguuauggagcaacggcgugcucgaauccgagaugaucauccccaagaucuacggcggcccgauuagccagcacaacuaccgccccggauacuucacccagacagcgggccccuggcacuuagggaagcuggagcucgacuucgaccugugcgaggggaccaccgucgugguugacgagcacugcggcaaccgggggcccucccugcgaaccaccaccgucacgggcaagaucauacacgaguggugcugucggagcugcacgcuaccaccccuucgcuucaagggggaggacggcugcugguacgggauggagauucggccugugaaggagaaggaagagaaccuggugaagaguauggucucagccggcagcggcgaaguggacuccuucagccuugggcucuuaugcaucuccauaaugauagaagaagugaugcgcagccggugguccaggaagauguugaugaccggaacucuggcagucuuucugcuccugaucaugggacaacugacguggaaugaccucauucgguugugcaucauggugggcgcaaacgcaagcgaccgcauggggauggguacaacauaccucgcguugauggccaccuucaagaugcgccccauguucgccguggggcugcuguucagacggcucacgucgcgggagguccugcugcucaccaucgggcugagccugguggccucggucgaacuccccaacucacuggaggaacugggcgacggucucgccaugggcaucaugauacugaagcugcucaccgacuuccagucucaccagcugugggcgacguuacucagccugacguuuaucaaaacaacccugucccuacacuaugccuggaagaccauggcgaugguacucagcaucgucagucuguuuccccucugccugagcacgacgucccagaaaacuacuuggcugcccguauuacugggcagccuugggugcaagccgcucgcuauguuccuaaucgcggagaacaaaaucuggggccgcaaauccuggcccuugaacgaggggauaauggccguggggguggucagcauccucuugagcuccuuacucaagaacgacgugccccuggcugguccccugaucgccgggggaaugcucaucgccugcuauguaaucucgggguccagcgcagaccugucccuggagaaggcagccgaggucagcugggaggaggaggccgagcacuccggcgccucacacaacauccucguggaggugcaggacgaugguacaaugaagaucaaagaugaggagcgcgacgauacccugaccauucugcuuaaggcuaccuugcuggccgucuccggcguguacccgcucagcauccccgccacccuguucgugugguacuucuggcagaagaaaaagcagagauccgggguccugugggacacgcccagcccucccgagguugaacgcgccgugcuugaugacgguauauacaggauaaugcagcggggccuccuggggcgcucccaggucggaguggguguguuccaggagaacgucuuccacaccauguggcacgugacccggggcgccgugcugauguaccaggggaagcgccucgagcccuccugggcguccgucaagaaggaccugaucucuuacggcgguggguggcgccugcagggcuccuggaacaccggcgaggaggugcagguaaucgccgucgagcccggcaagaaccccaagaacgugcaaacggcacccgggaccuucaagacccccgagggcgaggucggcgccaucgcccucgauuucaaacccgggacaagcggcagccccaucgucaaccgcgaggggaagauagucggccuguacggcaacgggguaguaacgacgagcggcaccuaugugucggcgaucgcucaggcuaaggccucucaggaggggccguugcccgaaauugaggacgagguguuccggaagagaaacuugaccaucauggaccuacaucccggcagcggcaagacgcggcgcuaccugccggcgauuguccgggaggccaucaagcgcaagcuccggacacugauucuggcuccgacccgcgugguggccuccgaaauggccgaggcgcucaagggcaugcccauccgcuaccagaccacggccgucaagucggagcacaccggcaaggagaucguggaccugaugugccacgccaccuucaccaugcggcuacuaucccccgucagagucccgaacuacaacaugaucaucauggacgaggcccacuuuacggaccccagcuccaucgccgcgcggggguacauaagcacgagagugggcaugggagaggcugccgccauuuucaugacggcaacuccgcccggcuccguggaggcauucccgcagagcaaugccgucauccaggacgaggagcgggauauccccgagcgcuccuggaacagcggguacgaguggaucacggacuuccccggcaagaccgugugguucgugccguccauuaagagcggaaacgauaucgcuaacugccugcggaagaauggaaagcgcguuauccagcugucacguaagaccuucgacaccgaguaccagaagacgaagaauaacgacugggacuacgugguuaccacggacaucagcgagaugggcgccaacuuccgcgcggaccgggucaucgauccgcgccggugcuugaagcccguaauccugaaggacgggcccgagcgcgugauccuagccgguccuaugccggugaccguggccuccgccgcgcagcgucgcgggagaaucggcagaaaccacaacaaggagggcgaccaguacaucuauauggggcagccccucaacaacgacgaggaccacgcucauuggacugaagccaagaugcugcuggacaacaucaauacucccgagggcaucauccccgcccucuucgagccggagcgggagaaguccgccgcuaucgauggggaguacagacugagaggcgaggcgcggaagaccuucgucgagcugaugcgccgcggagaccuccccguguggcucuccuacaagguagccagcgagggcuuccaguacagcgauaggcgguggugcuucgauggcgaacgcaacaaucagguccuggaggagaauauggacguagagaucuggaccaaggaaggggaacgcaagaagcuccgcccccgguggcuggacgcccguacguacuccgacccccuggcccuccgggaguucaaggaguuugccgccggccgacggagcguguccggggaccugaucuuggagaucggcaagcuuccgcagcaccugacccagcgcgcccagaacgcccuggacaaccucgucaugcugcacaacagcgaacagggcgggcgggccuaccgccaugcgauggaggagcugcccgacaccaucgagacccucaugcugcuggcccucauagccgugcugacgggcggggugacccuguuuuuccucuccggccggggguuaggcaagacgagcaucggccugcucugcgucauggccuccagcgugcugcuguggauggccuccguugagccccacuggauagcggccagcaucauccucgaauucuuccugaugguacugcugauucccgagccugaccgccagcggacgccccaggacaaccagcuggcauacguggugaucggccuccucuucaugauccugaccgucgccgccaacgagaugggacugcucgagaccaccaagaaggaccuugggaucggccacguggcgguggagaaccaccaccacgccaccaugcuggaugucgaccuucaccccgccuccgccuggacacuguacgccguggcgacgaccaucaucaccccgaugaugagacacaccaucgaaaacacgacggccaacaucucacugacagccauugccaaccaggccgcgauccucaugggccuggacaagggauggcccaucuccaagauggacauaggcgugccccugcucgcccuggguugcuacagccaggucaacccccuaacccucacggcugcgguccugaugcugguggcgcacuacgccaucauaggcccaggacuccaggccaaggcaacccgggaggcccagaaacguaccgcagccggcaucaugaagaaccccaccguagacgggaucguggccauugaccuggaccccguggucuacgacgccaaauucgaaaagcagcugggacagaucaugcucuugaucuuaugcacgucucagauccuccugaugcgcaccaccugggcccuuugcgagucaaucacccucgcuacgggcccccugacuacccugugggaaggguccccgggcaaguucuggaacaccacgaucgccgugagcauggcaaacauuuuccggggguccuaccuugcaggcgccggacuggcauucagccuuaugaagucccucggcggcgggcgccggggcacaggggcccagggcgaaacguuaggcgagaaguggaagcgccagcuaaaccagcucuccaagagcgaguucaacaucuacaagcguuccgggaucauggagguggaccgcagcgaggccaaggagggucugaaacgcggggagaccacgagacaugccgucagcaggggcacggcgaagcugcgcugguucgucgaacggaaccuggugaagcccgaggggaagguaaucgaccuugggugcggcagggggggauggaguuacuacugcgccgggcugaagaaggugaccgaggugaaaggguacaccaagggcgggccaggccacgaggagcccaucccaauggcuacuuacggguggaaccuggucaagcuccacuccgguaaggacgucuucuuuacgcccccggaaaagugcgacacucugcugugcgauaucggggagagcucccccaacccgaccaucgaggagggccggacgcuccgcgugcugaagaugguggagcccuggcuucggggaaaccaguuuugcaucaagauccucaacccguacaugccuucaguggucgagacccucgaacagaugcagcgcaagcacggcggaaugcuuguucgaaacccgcucucccgcaacagcacccacgagauguacuggguauccugcgggacaggcaacaucguaagcgccgucaauaugaccucccggaugcugcuuaaccgcuucacgauggcccaucgcaaacccaccuaugagcgggacguggaccucggggccggcacccgccacguggccguggagcccgaggucgccaaucuggacaucaucggccaacggaucgagaauaucaagcacgagcacaaaagcaccuggcacuaugaugaggacaaccccuauaaaacgugggccuaccacggguccuaugaggucaagcccagcgguuccgccuccagcauggugaacggugucguuaaacuacuuaccaagccgugggacguaauccccauggugacccagauugcgaugacugacacgacacccuuuggacagcagcgcgucuucaaggagaagguggauacccggaccccaaaggccaagagagggaccgcacagaucauggaggugaccgcccgguggcuguggggcuuccugucccgcaacaagaaaccacggaucugcacuagggaggaguucacccggaagguccgcagcaacgccgcuaucggagccguguucguggacgagaaccaguggaacuccgccaaggaggccgucgaggacgagcgguucugggaccucgugcagaaggaacgcgagcuucacaagcaggggaagugcgcaacgugcguguacaacaugaugggcaagcgagagaagaaacugggugaauucggcaaggccaaggggagccgcgccaucugguacauguggcucggcgcccgguuucuggaguucgaggcccuuggcuucaugaacgaggaccacugguucucccgcgagaacagccuuuccgggguagagggggagggguuacacaaauugggauacaucuuacgggacaucagcaagauacccgggggcaacauguacgccgacgauaccgccggcugggauacccgaaucaccgaggacgaccugcagaacgaagccaaaaucacggacaucauggaaccggagcacgcccugcucgccaccuccaucuucaagcugaccuaccaaaacaagguggugcggguccagcgcccggcgaagaacgggaccgugauggacgugaucagccgccgggaccagcgcggcuccgggcaggucggcaccuacggccucaacaccuucacgaacauggaagcccagcucauucggcaaauggagagcgaggggaucuuccugccauccgagcuggagacccaaaaccucgccgagcgagugcuggacuggcuggagaaguacgguguugagagauugaagcgcauggcgaucagcggugacgacugcgucgugaaaccaauagaugauagguucgcgacggcucugaccgccuuaaaugauaugggcaaggugcgcaaagacaucccgcagugggagcccagcaaaggcuggaacgacuggcagcaggucccuuucugcagucaccacuuccaccaacucaucaugaaagauggccgggagaucgugguacccugcaggaaccaggacgagcuggucggccgggcccgcguuucucagggggccggcuggagccugcgggagacggccugccucggcaagagcuacgcgcagauguggcaacugauguacuuccaucgccgggaccuacgccucgccgccaacgccaauugcagugcgguaccggucgacugggugcccaccagccggacgaccugguccauccacgcgcaccaccaauggaugacgaccgaggacaugcugagcguguggaaccgcgucuggaucgaggagaaccccuggauggaggacaagacgcaugugagcagcuggggcgacguccccuaccugggcaagcgggaggaccaguggugcggcucccuaaucggccugaccgccagagccaccugggccagcaacauucagguagcgaucaaccaagugcgcaggcuuauugggaacgagaacuacuuggacuacaugacuuccaugaagcgcuucaagaacgagggcgacccggagggggcacugugguga

SEQ ID NO: 24277 - RNA, 9879 nt, Artificial Sequence
  derived and/or modified CDS sequence (opt11) from DENV-1__FJ898379__SS-prME
agcgugacgauguugcuaaugcugaugcccaccgcccucgcguuccaccucaccacccgcggcggggaaccccacaugaucgugagcaaacaagaacgugggaagagucucuuguuuaaaacgagcgcgggcgugaacaugugcacacucaucgccauggacuugggcgaguuaugcgaggacacuaugaccuauaagugcccgcguaucaccgaaaccgaacccgacgauguggauuguuggugcaacgcuacggauacguggguaaccuacgggaccugcucgcagacgggcgagcaucggcgggacaagagguccguagcgcucgcaccccauguaggcuuaggccuggagacacgcacagagaccuggaugagcagugagggcgcguggaagcagauccaacgaguagagacaugggcccuccgccaccccggguucaccgugaucgccuuguuccuggcccacgugaucggcaccagcaucacccagaaggggaucaucuucauucuguuaauguuaguaacgcccucaauggcgaugcggugcguggguauugggagucgagacuuuguggaaggcuugucaggcgccaccugggucgacgucgugcuggagcaugggagcugcguaacuacuauggcaaaggacaagcccacccuggacaucgagcuccugaaaaccgaggugacgaaccccgcugucuuacggaagcugugcaucgaggcuaaaauaucgaacacgacuaccgacucacgcugcccgacccaaggugaggcuacccugguagaggaacaagaugcaaacuuugugugccggcgcacguucgucgaccgugguuggggaaaugggugcgggcuguucgggaaaggaucacucaucacgugcgcuaaguucaaaugugucacuaagcuggaggguaagauugugcaguacgaaaaccugaaguacagcgucauaguuaccgugcacacgggcgaccagcaccaggucgggaaugaguccaccgagcacggcacgacagccacaauaacgccucaggcccccaccaccgagauucaacugacugacuacggggcguuaacgcuggauugcucgccccguacggggcucgacuucaacgaaauggugcuccuuaccaugaaagagaaguccuggcucgugcacaaacagugguucuuggauuuaccucucccuuggaccagcggggcuucgacgucccaggagaccuggaauagacaggaucugcuggugaccuuuaagacagcccaugcaaagaagcaggaaguggugguccucggcagccaggagggcgccaugcacacggcacugaccggggccaccgagauccaaacuuccggcacgacaacaauuuuugccggccaccuaaagugcaggcuaaagauggacaaacuaacccucaagggcaugucuuacgucaugugcacgggcucguuuaagcucgaaaaagagguagccgagacgcaacacggcaccguucugguucagaucaaguaugagggaacugacgccccaugcaagauucccuuuuccacccaggacgaaaagggcguuacgcagaacggccggcugaucaccgcgaacccaauugucaccgacaaggaaaaacccguaaauaucgaggcagagccgccauucggcgaguccuacaucaucaucggugccggugagaaggcccugaaacuaagcugguucaagaaggguagcucgaucggcaagauguuugaggcuacagcaaggggcgcucgacgaauggcuauccugggagacaccgccugggauuucggcucaauuggcggcguguucacaagcguagggaaacugguucaccaaaucuucggcacggcguaugggguccuguuuuccggcguaagcuggacuaugaaaauagggauuggugugcugcugacauggcucgggcugaacuccaggucgaccucccugagcaugaccuguaucgccgugggacucgucacguuauaccuggggguaauggugcaggcugauucugggugcguuaucaauuggaaaggccgggaauuaaaaugcgguagcggaaucuucguaacaaacgaggugcacaccuggaccgagcaguacaaauuucaggccgacagcccuaaacgccuguccgccgcuaucggcaaggcaugggaggagggagucugugggauucggagcgcuacccgccucgaaaacaucauguggaaacagaucuccaacgagcucaaucauauucugcuugagaacgacaugaaauucaccgugguggucggggacguagcuggcauccucgcccagggcaaaaagaugaucaggccccaaccgauggaguacaaguacucuuggaaguccuggggaaaagcaaagaucaucggcgccgauguccagaacaccacguucauaauagacggacccaauaccccggaguguccagacgaccaaagggccuggaacauaugggaggucgaagacuacggcuucgggaucuucacgacaaacaucuggcugaaacugcgggacuccuacacccaggugugcgaccaccgccucaugagugccgcaauaaaggauagcaaggcaguacacgccgacaugggcuauuggauugaguccgagaagaaugagacuuggaagcuggcucgagccagcuucauugaagucaagacuugcauauggccuaagucgcacacccugugguccaacggcgugcuggaaucugagaugauuaucccuaagaucuauggugguccgaucucgcagcacaauuaccgccccggguacuucacccagaccgccgggcccuggcaucugggcaaacuagaacuugauuucgaccucugcgagggaacgacgguggucguagaugagcauugcgguaacagagggccgucguugcgcaccacaacgguuacaggaaagaucauacacgaauggugcugucggucuuguaccuuaccuccccucagguucagaggcgaagauggcugcugguacggaauggagauccgccccgucaaggagaaggaagagaaccugguaaaguccauggucagcgccggcucaggagaggucgauuccuucagccucggcuuacuguguauaucaaucaugauagaggaggugaugcgcagucgcuggucacggaagaugcugaugacaggcacucuggccguauucuuuuugcucaucaugggccagcuaacguggaacgaucugauccgucucugcauuaugguuggcgccaacgccagcgauaggauggggauggggaccacuuaccuugcgcugauggccacguucaaaaugcggccgauguucgccgugggccuccuguuccgccgccugaccucccgugaggugcuccuacuaaccauugggcugagcuuagucgcgucgguggagcucccuaacagcuuggaggaacugggugacgggcucgcaaugggcauuaugauacuuaaauugcugacagacuuccaaucccaucagcuuugggccacgcuguugagccucacguuuaucaagaccaccuucucgcugcacuaugcuuggaaaacgauggccaugguccugagcaucgugucccucuucccccugugccugagcacgaccagccagaagaccacguggcuuccaguauuacuaggaucacucgggugcaaaccgcugaccauguuucugauagcugaaaauaaaaucuggggccguaggaguuggccgcucaacgaggguauuauggcgguaggcauagugagcauccucuuaagcucccucuugaagaacgacgugccacucgcggggccucuaaucgcgggcggaaugcugauugccuguuaugugauuucaggcuccagcgccgaccugucacucgagaaggcggccgaggugagcugggaggaagaggccgagcauucaggugcaucacauaacauccuugucgagguucaggacgaugggaccaugaaaaucaaagacgaggaaagagacgacacccugacaauacuccugaaagcuacgcuacuggcggucucaggcguauauccacugagcauccccgcgacacuauucgucugguacuuuuggcagaagaaaaagcagcgcucaggugugcucugggauaccccuucuccgcccgaggucgaaagggccgugcuugaugacggcaucuacagaauuaugcagcgaggccuacuggggcgcucccaggugggggugggggucuuccaggagaacguauuccacacgauguggcauguuacuaggggagccguacuaauguaucaggggaagcgauuggaaccgucuugggcguccgucaaaaaggaccugaucagcuacgguggcggguggagacuccagggcuccuggaacaccggggaggaggugcaggucaucgcgguggagcccggaaagaaccccaaaaacguucagaccgccccggguaccuuuaaaacgcccgagggcgaagucggcgccaucgcucuagacuucaagccagggaccagcggauccccgaucguuaaccgggaggggaaaauaguuggccuuuacggaaauggcgucgucacuaccaguggcacguacgugagcgccauugcgcaggccaaggccucacaggaagggccgcucccggaaauagaggaugaaguuuuccggaagcgcaauuuaaccaucauggacuuacaccccggcagcgggaagacgcggcgguaccuccccgccauaguacgagaagcgaucaagcgaaaacucagaaccuugauacucgcacccacacgaguggucgcuucagaaauggccgaagcguuaaaaggcaugcccaucagauaccagacuaccgccgucaagagugagcacacgggcaaagaaaucguugaucucaugugucacgccacguucaccaugaggcuccugucaccuguccgcguaccgaauuacaacaugauaaucauggaugaagcccacuucacagaccccaguuccaucgccgcccggggguauaucaguacacgaguggggaugggugaagcggccgcaaucuucaugacagcgacgcccccgggcucuguagaagccuuuccucagucaaacgcgguaauccaagacgaggagcgcgauaucccagagcgaucuuggaacagugguuacgaguggaucacagacuuccccggcaagaccgugugguucguacccuccauaaagucaggcaaugauaucgcaaacugccugcggaaaaaugggaagcggguaauucaacugaguagaaagacauucgauaccgaguaccagaagaccaagaauaacgacugggacuacguagucacaacugacauaagcgagaugggcgccaacuuuagagccgaccggguaaucgacccccggcggugcuuaaagcccgugauucugaaggacgggcccgaacgcgucauccucgcgggccccaugccaguuaccguggccuccgcugcucaacggcgcggucgcaucggccgaaaccauaauaaagaaggcgaucaguacaucuacauggggcagccgcuaaauaacgaugaagaucacgcgcacuggaccgaagccaagaugcuacuugacaauaucaauacaccugaagggauuauccccgcguuguuugagcccgaacgcgagaagagugccgcuaucgacggugaguaccgccuacggggcgaggcccggaaaacguucguggagcucaugcggcgcggggaucugccuguguggcuauccuauaaggucgcgagcgagggcuuccaguacagcgauaggcggugguguuucgacggggagcggaacaaccagguguuagaggagaacauggacgucgaaaucuggaccaaagagggggagagaaagaaacuacgcccgcguuggcuggaugcccgcaccuacucugauccccucgcccugcgggaguucaaggaguucgccgccgggcguagaagcgucuccggagaucugauccucgaaaucgggaagcugccucaacaccugacgcagcgagcacaaaacgcgcucgauaaccuggugaugcugcauaauagcgagcagggagggcgggcguaccgacacgcgauggaggagcuccccgacacuauagagacccugaugcugcuggcccugaucgccguguuaacagguggggucacccuguucuuccuaucgggccggggacugggcaagacgucgaucggccuccuauguguaauggcuuccagcgugcuucucuggauggccucugucgagccccauuggaucgccgcgagcaucauccuggaguucuucuugaugguucucuuaauaccugagccagaucgacagagaacgccucaggauaaucagcuagccuacguagucaucgggcuccuguucaugauccuaaccguggcagcuaacgagaugggccuccuggagacuacuaagaaggaucuggggaucggccacguggccgucgagaaccaucaucacgcggccaugcucgacguggaccugcaucccgcguccgccuggacguuauacgcuguggcgacaaccauaaucaccccuaugaugcgccauaccaucgagaacaccaccgccaauaucagcuugacugccaucgccaaccaggccgcgaucuugaugggucuggacaagggcuggccgaucuccaaaauggacaucgggguuccccuccuggcacugggcugcuacucucaggugaaccccuugacgcugaccgccgcggugcugaugcucguagcgcacuacgccauaauagggccugggcugcaggccaaggcgacccgcgaagcccagaagcggacagcggcaggcauuaugaaaaauccgacaguggacgggaucguggcaaucgaccucgacccugucguguacgacgccaaguucgagaagcagcucggccaaauaaugcugcuaauacuguguacgucccagauccuguuaaugcgcacuacaugggccuugugcgaaagcaucacgcuggccacaggcccccuuaccacauugugggaaggcucucccggaaaauucuggaacacgaccaucgccgugagcauggccaacauauuccguggguccuaccuggccggcgccggccuagcguucagccuuaugaagucacucggaggcggucgaagaggaaccggagcccaaggagaaaccuuaggcgagaaguggaaacgccaacucaaccaacucagcaagucggaguuuaacacguacaaacgcuccgggaucauggaaguugaccgaagcgaggccaaggagggccuaaagcgcggggagacuacaaagcaugcugugucccgaggcacggcgaaguugcggugguuuguugagcgaaaucugguuaaacccgaggguaaggucauagaccugggaugcggccguggcggcuggucauacuacugcgccggguugaagaaaguaaccgaggucaaggguuacaccaaagguggccccgggcaugaggagcccauaccgauggcaacauauggcuggaaccucguaaaacuacacucgggcaaggacgucuucuucauaccgccggagaaaugugacacccugcucugcgacaucggggagagcaguccaaauccuacaaucgaggaaggacgcaccuugcgggugcucaagauggucgaacccuggcucagagguaaccaguuuugcaucaagauccuaaacccuuacaugccuucggugguggagacccuggagcagaugcagcggaagcacggcggcaugcucguccgcaacccgcugucccgaaacagcacccacgagauguacugggucaguugcgguacggguaacaucgucagcgccguaaacaugacgucgcgcaugcugcugaacagguuuacgauggcccaucgaaagccaacguacgagcgcgauguggacuugggggcgggaacccggcacguugcgguggaacccgagguggccaaccuggacaucauagggcaacggaucgagaacauuaagcacgaacacaagagcacguggcacuacgacgaggauaacccguacaagacgugggccuaccacggcuccuacgaagucaaaccgucuggcuccgccagcaguauggugaacggagucguaaagcucuuaaccaagccgugggacgugaucccgaugguaacgcaaaucgcgaugacggauacgaccccguucggccaacagcgcguguucaaggaaaagguggauaccagaacgccgaaagccaagcgggggacggcgcaaauuauggaagugaccgcuaaaugguuguggggcuuccucuccagaaacaaaaagccccgaauaugcacgcgcgaagaauuuacgcggaagguacgcagcaaugccgcgauuggcgcgguguucguugaugaaaaccaguggaauagcgccaaggaagcuguggaagacgagagauucugggacuuagugcaccgcgaaagggaguuacauaagcaggguaaaugcgcgacuugcguguacaauaugauggggaagcgcgaaaagaaauuaggugaauuugguaaagcaaaagggucuagagcaauuugguacauguggcugggcgcccgcuuccucgaguucgaggcucuuggguucaugaaugaggaccacugguucuccagagaaaacagcuugagcgguguagaaggugaggggcuccauaagcucggcuacauauugcgcgacaucuccaagauccccgggggcaacauguaugcggacgacaccgccgguugggacaccaggaucacggaggacgaucugcagaacgaggcccgaauuacagauauuauggagccggaacacgcccuucuggcuaaguccauauucaagcugacauaucagaauaaggugguccgcgugcagaggccugcgaagaacggaaccgugauggacgucauaagccgccgggaccagcgcggcuccggucaagucggaacauauggcuuaaauaccuucaccaacauggaggcgcagcugauucgucagauggaaagcgaaggcauauucucgccaagcgaacuggagacccccaaccuggccgagcgcgugcucgauuggcuggagaaguauggcguggaacgauugaagcgcauggccauuucuggagacgauugcgucgugaaaccgaucgacgaucgguucgccacggcccuaacagcacugaaugacaugggaaagguccgcaaggacaucccccagugggagccuagcaaagguuggaaugacuggcagcagguacccuucugcagccaucacuuccaccagcuuauuaugaaagauggucgggaaauugugguacccugucguaaucaggacgagcugguaggacgggcccgcguuagccagggggccggcuggagccugcgggagaccgcuugccucgggaaauccuacgcgcagauguggcagcugauguacuuccaccgacgugaucuacgauuagccgccaaugcaauuugcagugcggucccgguggacuggauaccgacuucccggacaaccuggagcauccacgcccaucaccaauggaugacuaccgaggacaugcugaguguguggaaccgcgucuggaucgaggagaauccauggauggaagacaagacccauaucagcucauggggcgaugugccguacuuggguaagagagaggaccaauggugcgggucgcucaucggccuuaccgcucgggcgacaugggcuacgaacauacagguagcgaucaaccagguccgccgucucaucgggaacgagaacuaccuggacuauaugacuagcaugaaacgcuucaaaaaugagucugaccccgagggcgcacuuugguaa

SEQ ID NO: 24278 - RNA, 9879 nt, Artificial Sequence
  derived and/or modified CDS sequence (opt11) from DENV-1__GQ199773__SS-prME
ucaguuaccaugcuccugaugcugaugcccaccgcccuggccuuccacuugaccacucggggcggggagccccacaugauugugagcaagcaggagcggggcaagagccugcuguucaagaccagcgccggcgugaacaugugcacccucaucgccauggaccugggcgaauucugcgaagacacgaugaccuacaagugcccccgcauuaccgaggccgagcccgacgacguggacugcuggugcaacgccaccgacaccugggugacauacggaaccugcagccagaccggcgagcacagacgcgacaaacggucuguggcccuggcgccccacgugggccucgggcucgagacgagaaccgagaccuggaugagcuccgagggugccuggaagcagauccagcggguggagacuugggcccugcgccacccuggguucacggugaucgcuuuguuccuugcgcacgccaucggcaccagcaucacccaaaaaggaaucaucuucauucugcucaugcuggugacgcccuccauggccaugcguugcgucgggaucggcagcagagacuucguggaggggcuuagcggcgccacguggguggacgucgugcucgagcacgguagcugcgugacaaccauggccaaggacaagcccacccuggacaucgaacuucucaagacugaggucaccaaccccgcggugcugcggaaacugugcaucgaggccaagaucaguaacaccacaaccgacucaagaugcccgacccaaggagaagccacccucguggaagaacaggaugccaacuucguaugccggcgcaccuuuguggaccggggcugggggaacggcugcgggcuguucggcaaggguucccucaucacgugugccaaauucaaaugugugacgaagcucgagggcaagaccguacaguacgagaaccugaaguacagugugacugugacgguccauaccggcgaccagcaucaggucgggaacgaguccaccgagcacgggaccaccgcgacgaucacgccccaggccccgagcaccgaaauccagcugaccgauuauggggcccucacgcuggacugcucgccccggaccggacuggauuuuaacgaaaugguccuccugaccaugaaggagaaguccuggcuugugcauaaacagugguuucucgaccugccgcuacccuggacaagcggcgccuccacgagccaggagaccuggaaccggaaagaccuacugguuaccuuuaagacagcccacgcgaagaagcaggaggucgugguccugggaucccaggagggcgccaugcauacggcacucaccggggcaaccgagauccagaccagcggaacgaccacgaucuuugccgggcaccugaagugccgcuugaagauggauaagcucacccugaaggggauguccuacgucauguguacggggaguuuuaagcuggaaaaggagguggcagagacccagcacggaaccgugcucguccagauuaaguacgagggcacagacgcccccugcaagauccccuucuccacgcaggacgaaaagggagugacacagaacggccggcugaucaccgccaacccgauagucaccgacaaggagaagcccgucaacauagaggccgagccgccuuucggggagagcuacaucgugauuggcgcgggcgagaaggcccuuaaauuaagcugguucaagaagggaagcaguaucggcaagauguucgaggccacggcccgcggggcccggcgcauggcgauccucggcgacaccgccugggacuucgggucgaucggcggcguguucaccagcgucgggaagcuggugcaucagaucuucggcaccgccuacgggguacuguucagcggagugucguggacgaugaagaucgggaucggcguccuccugaccuggcucggccucaacagcagauccaccagccuguccaugaccugcaucgccguggggcuggucacgcucuacuuaggcgugauggugcaggccgacucggggugcgucauaaacuggaaaggccgcgagcugaagugcgggagcggcaucuucgugaccaaugaagugcacaccuggaccgagcaguacaaguuccaggcggauuccccgaagcgccucagcgccgcuaucggcaaggccugggaagaggggguauguggcauacggucggccaccagacucgagaacauuauguggaagcagaucagcaacgagcugaaccacauccuccuggaaaacgacaugaaguucacggucguggucggggacguggcgggcauccuggcccaagggaagaagaugauccggccccaaccuauggaguacaaauacuccuggaaguccuggggcaaggccaagaucaucggcgccgacgugcagaacaccacguucaucauugacgggcccaacaccccggagugcccagacgaccagcgggcguggaacaucugggaggucgaggacuacggcuuugguauuuucacaaccaauaucuggcucaagcugcgggauuccuacacccaagugugcgaccaucgccugaugagcgccgcaaucaaggacucgaaggcugugcaugccgacaugggcuacuggaucgagucagagaaaaacgagacuuggaaauuagcgcgggccuccuucaucgaggucaagacuugcaucuggcccaagagccacacauuauggagcaacggcgugcuggaguccgagaugaucauccccaagaucuauggcggcccuauaucccagcacaacuaccgccccggguauuucacccagaccgccggccccuggcaccucgguaagcuggagcucgacuucgaccucugugagggcaccaccguggucguggacgagcacuguggcaaccgggggccaagccuacgaacaaccacggugacuggcaaaaucauccaugagugguguugccggucaugcacccugccgccgcugcgcuucaaaggggaggacgguugcugguacgggauggagauccggcccgucaaggagaaggaggaaaacuuggucaagagcauggucucggccgggucaggcgaggucgacagcuucucccuggggcuguuaugcaucagcaucaugauagaggaggugaugaggucccgguggagccgcaaaaugcugaugacaggcacgcucgccguguucuuucugcucaucauggggcaguuaaccuggaacgacuuaauucggcugugcaucauggucggcgcgaacgcgucugaccgcauggggaugggcaccaccuaucucgcacugauggcaacauucaagaugcgcccgauguuugccguggggcuccuguuucggcggcugaccagccgggagguccugcuccugaccaucggguuaucgcucgucgcgagcguggagcugcccaacagcuuagaggagcucggggacggguuagccaugggcaucaugauccugaaguugcuuacagacuuccagagccaccagcugugggccacgcuccugucccugacguuuaucaagaccacauucagccuccacuacgccuggaagaccauggcgaugguauuguccaucgugagccuguuccccuugugucugucgacuacgucacagaagacaacguggcugcccgugcugcugggcucccuggguugcaagccgcugaccauguuccugaucgccgagaacaagaucuggggccgcaagucuuggccccugaacgaggggaucauggccgucggcaucguaucgauccuccuguccagccugcucaagaacgacgugccccuggccgggccccugauagccggcggcaugcuuaucgcgugcuacgucaucucggggagcuccgccgaccugagcuuagagaaggccgccgagguguccugggaagaggaggccgagcacagcggcgcgucccauaacauccugguggaggugcaggacgacggcaccaugaagauaaaggaugaggagcgggacgacacccugaccauccugcucaaggccacgcuguuagccgugagcggcguguacccgcucuccauaccagccaccuuauucgucugguacuucuggcagaagaagaagcagcgcagcgguguguugugggauacccccagcccaccugagguggagcgggccgucuuagaugacgggaucuaccgcaucaugcagcgcggccugcuggggaggagccaggugggcguuggggucuuccaagaaaacguguuucacaccauguggcacgucacgcggggcgcuguacugauguaccaggggaagagguuagagcccuccugggcuagcguuaagaaggaucugaucucguacggcggcggguggcgccuacaagggagcuggaacaccggugaggaggugcaggucauugccguggagcccggcaagaaccccaagaacgugcagaccgcccccgggacguucaagacgagugagggcgaagucggcgcgaucgcgcucgacuucaagcccgggaccagcggcagccccaucgugaaucgcgaggggaaaaucgugggccuauacggcaacggggucgugaccaccuccggcacguacgugagcgccaucgcccaggccaaggcgagccaggaggggccccugccggagaucgaggacgaggucuuccggaagcguaaccucaccaucauggaucugcaccccgggagcgggaagacccggcgcuacuugcccgccaucgugcgggaagccaucaaacgcaaacuccggacccugauccuggcuccgacccgcgugguugccuccgagauggcggaagcccucaaaggcaugcccauccgcuaccagaccaccgcggucaaaagcgagcacaccggaaaggagaucguagaccugaugugucacgccacguucaccaugcggcugcucagccccguucgagugcccaacuacaacaugaucauuauggacgaggcccauuucaccgacccgucauccaucgcggcccguggguauauuuccaccagggugggcaugggugaggccgccgccauuuucaugacggcgacgccgcccgguuccgucgaggccuucccucagagcaaugccgugauccaggaugaggagcgggacaucccggaacgcucauggaacagcggguacgaguggaucaccgacuuucccggcaagacugugugguucguccccuccaucaagagcgguaacgacaucgcgaacugccugcggaagaaugggaagcgcgugauccagcugucacggaaaacauucgacaccgaguaccagaagaccaagaacaacgacugggacuacguggucaccacggacaucagcgagaugggugcgaacuuccgcgccgaccgggucaucgacccccgccggugccucaagccgguaauccugaaggaugggcccgaaagagucauccuggccggccccaugcccgugaccgucgccuccgccgcgcagcggcgcgggcguauuggccgaaaccacaacaaagagggggaccaguacauuuacauggggcagccguugaauaacgacgaggaccacgcucacuggaccgaagccaagaugcugcucgacaacaucaacacccccgagggcaucauccccgccuuauucgagcccgagcgggagaaguccgccgcgauagacggggaauaccgccugcgcggcgaggcccggaagacguucguagagcugaugcgccgcggggacuugccgguguggcugagcuacaagguugcuucagaaggcuuccaguacucugaccgcaggugguguuucgacggcgagcgcaacaaccaggugcuggaggagaacauggacguggagaucuggaccaaggagggggagcggaaaaagcuacgcccccgauggcuggacgcacgcacguacuccgacccgcuggcacucagagaguucaaggaguucgcagccggccgccggagcgucuccggcgaccucauccucgagaucggcaagcucccccagcaucugacccagcgcgcccaaaacgcccuggacaaccucgugaugcugcacaacucggagcaaggcgggcgcgcguaucgccacgccauggaggagcugccggacacaaucgagacccucaugcuucuagcccucauagccgugcugaccggcggggucacccuguucuuucucuccgggcgggggcuggguaagaccaguaucggccuucucugcguaauggccucgagcgugcugcuguggauggccucugucgagccacacuggaucgccgcaagcaucauccucgaguuuuuucugauggugcugcucauucccgagccugaccgccagcggacgccgcaggacaaccagcuggccuacgugguuaucggccuccuuuucaugauccugacuguggccgcaaacgagaugggccugcucgagaccaccaagaaggaccugggaaucggccacgucgccgucgagaaccaccaccacgccgcgaugcucgacguggaucuccaccccgccucggcguggacacuguacgccguggcuaccaccaucauaaccccaaugaugagacacacaaucgagaacaccacggccaacaucagcuugacagccaucgcgaaccaggcagccauacuuauggggcuggacaagggcuggccgaucagcaagauggacaucggcgucccguugcucgcauuaggcugcuacucacaagugaauccccuuacgcucacagcagcaguccucaugcugguagcccauuacgcaaucaucggccccgggcuccaggccaaggcgacccgggaagcccagaagcgcaccgccgccggcaucaugaagaacccgacgguggacgguaucgucgccauugaccuggaccccgucguguacgacgcaaaguucgaaaagcaacugggccagauaauguugcugauccuaugcaccucccagauccuccugaugcgcaccaccugggcccuuugcgaaagcaucacgcucgcuaccggucccuugaccacccugugggagggguccccuggcaaauucuggaacacgaccaucgccgucagcauggcaaacaucuuccgugggagcuaccucgcgggcgcugggcuggccuucucacugaugaagucccucgggggggggcgccggggcaccggggcacaaggcgagacccugggcgagaaguggaagcgccagcugaaccagcucuccaagagcgaguucaauacguacaagcgguccggcaucauggagguagaccgcagcgaggcgaaggagggacugaagcgcggcgagacgaccaagcacgcugugucccgcggcaccgccaagcuacgcugguucguggagaggaaccuagucaaaccggaggggaaaguaaucgaucugggcugcgggcgcggcggguggagcuacuauugcgccgggcugaagaaggugacggagguaaagggguacacaaaggggggucccggccacgaggagccuaucccaauggccaccuacggguggaaccuugugaaguugcacuccggcaaggacgucuuuuucaucccgcccgagaagugcgauacccugcucugcgacaucggugaguccucccccaaccccacgaucgaggagggucgcacccuccgggucuuaaaaauggucgagccguggcugcgcgggaaccaauuuuguaucaagauccucaaccccuacaugcccagcguggucgagacccuagagcagaugcaacguaagcacggcggcaugcuggugcgcaacccccucaguagaaacagcacccacgagauguacugggugaguugugggacgggcaacauugucucggcggugaacaugaccucccgcaugcuccugaaucgguucacuauggcccaccgcaagccgaccuacgagcgugacguugacuuaggagccggcacccggcacgucgccguggagccugaaguggccaaucuggacaucaucggucagcgcauagagaacauaaaacacgagcacaagagcacguggcacuacgacgaagacaaccccuacaagaccugggcguaccacggguccuaugaggucaagcccuccggcagcgcuuccagcauggugaacggggucgugaagcugcucaccaagccgugggacgugauuccgauggucacacagaucgccaugacggauaccacccccuucggucagcagcggguuuuuaaggagaagguggacacccgaacgcccaaggcgaagcgggggaccgcccagaucauggaggucaccgcgaaguggcugugggguuuucugucccgcaacaagaagccuagaauaugcacccgagaggaguucacgcggaagguucgcagcaacgccgcaaucggcgccguguucguagacgagaaccaguggaacucagcuaaagaggccguggaggacgagcgguuuuggaacuuagugcaucgcgagcgggagcugcacaagcagggaaagugugcgaccugcguuuauaacaugaugggcaagcgcgagaaaaagcugggugaguucggcaaggccaaggggucccgggcuaucugguacauguggcucggggcgcgguuccuggaguuugaggcccugggcuucaugaacgaggaccacugguucaguagggagaacucacucuccgggguggagggcgaggggcuucacaaacugggcuacauacucagggauaucagcaagauccccgggggcaacauguacgccgacgacacagccggcugggacacacggaucacggaggacgaccugcagaacgaagccaagaucaccgacaucauggagcccgagcaugcgcugcuagcgaaguccaucuuuaagcucacauaccagaacaaggugguccgaguccagcgaccggccaagaacggcaccguaauggaugucauaagccgccgagaccagcggggcuccggccaggugggcacuuauggccugaauaccuucaccaacauggaggcccagcucauccgccaaauggagagcgaggggaucuucucccccagcgaacuggagacccccaaccuggccggccgggugcucgacuggcuggagaagcacggcgucgaacgccugaagcggauggcgaucuccggcgacgauugcguggugaagcccaucgacgaccgcuucgccacugcccucaccgcccugaacgacauggguaaagucaggaaagacaucccgcagugggagcccagcaagggcuggaacgacuggcagcaggucccauucugcucgcaccauuuccaccagcugauaaugaaagacggcagagaaaucgugguacccugccggaaccaggacgaacucgucgggcgcgcccgcgugagucagggcgcgggguggagccugcgugagaccgccugccugggcaaguccuacgcccagauguggcagcugauguauuuccaccggcgcgaccugcgucuggccgcgaacgccauuugcagugccgucccgguagauugggugcccaccuccaggacgaccuggagcauccaugcacaccaccaguggaugaccaccgaagacaugcucuccgucuggaaccggguauggauugaagagaaccccuggauggaggacaagacacacaucagcuccuggggcgacguccccuaccucggcaagcgcgaggaucaauggugcggcagucugaucgggcucaccgcccgggcgaccugggccaccaauauccaggucgccauaaaccaggugcggcgccugaucggcaacgagaacuaucuggacuacaugaccuccaugaagcgguuuaagaacgagagcgacccagagggggcccucugguga

SEQ ID NO: 24279 - RNA, 9879 nt, Artificial Sequence
  derived and/or modified CDS sequence (opt11) from DENV-1__JF937596__SS-prME
uccgucacaaugcugcucaugcugaugccaaccgcccuggccuuccaccucacgacccggggcggggagccccauaugauugugaccaagcaagagcguggaaagagccugcuguucaaaaccagcgcggggguaaacaugugcacccucaucgccauggaccugggcgaacuaugcgaggacacuaugaccuacaaaugcccccggaucaccgaggccgagcccgacgacguggacugcuggugcaacgccacggacacaugggugaccuacggaaccugcucucagacaggcgaacaucggcgcgacaagaggagcguggcccuugcaccgcauguuggucuggggcuggagacccggacagagaccuggauguccuccgagggcgcauggaagcaaauacaacggguugagacgugggcccugcgccacccgggguucaccgugaucgcccucuuccuggcucacgcuaucggcaccuccaucacccagaagggaaucauauucauuuuacucaugcucgugacacccagcauggcgaugcggugcguaggcauaggcagccgcgacuucguagagggucucagcggcgccaccuggguggacguaguacuggagcaugggaguugcgugacgacaauggcgaaggauaagcccacacuggacaucgagcuccucaagacagaagucaccaacccggcggugcuacggaagcucuguaucgaggcgaagauaucaaacacaacgaccgacucucguugucccacccagggagaggccacccugauggaggagcaggacgccaacuucgugugccgccgaacauucguagaccgggggugggggaauggaugcggguuguuuggcaaagguagccucaucacgugugcgaaguuuaagugcgugaccaagcuagagggcaaaauuguacaauacgaaaacuugaaguacucggucaucgugacgguccauacgggugaccagcaccaggucggaaacgagagcaccgagcacggaaccaccgcgaccaucacaccccaggccccaaccucagaaauacaguugaccgacuauggcgcccugacucuugacugcagcccccgcacuggauuggacuuuaacgagauggugcugcugacuaugaaagaaaaguccuggcucguccacaagcagugguuucuggaccugccgcucccguggacuuccggggccuccaccucccaagagacguggaaccgucaggauuuauuagugaccuucaaaaccgcccaugcgaaaaagcaagagguggucguauuaggcagccaggaaggcgccaugcauaccgcccugacgggggccacagagauucaaaccuccggcaccacgaccaucuucgccggacaucuuaagugcagacuuaagauggacaagcugacccugaagggcauguccuacgugauguguaccgggagcuuuaaacuagagaaagagguagcggaaacccaacacgguaccguguugguccagaucaaguaugaggguaccgacgcaccuugcaagauccccuucagcacucaggacgagaagggagucauccagaacggccgcuuaaucacggcgaacccuaucgugaccgacaaagagaaaccugucaacauagaggccgagccacccuucggggaguccuacaucgucaucgguguaggagaaaaggcgcugaagcuaagcugguuuaagaaggguagcagcauuggcaaaauguucgaggccaccgcccggggugcgcggcgcauggcgauccugggcgacaccgcgugggauuuugggucgaucggcgggguguucacuagcgucgggaagcuggugcaccagauauucgguaccgccuacgggguccuguuuucaggcgucagcuggaccaugaagaucgggaucggcgugcuguugaccuggcucggucugaacucaagaagcacuuccuuguccaugacuugcauagcgguggggcucgucacgcuguaccugggcgugauggugcaggcugacucagggugcguuauuaacuggaaggggcgugagcucaagugcgggagcggcauauucgugacaaaugaggugcacacguggacggagcaguauaaguuccaggccgacagcccgaagcgccuguccgcugccaucggcaaagccugggaggaggggguuugugguauaaggagcgcaacaaggcuggagaauaucauguggaagcagaucuccaacgagcucaaucacauacuacuugagaacgacaugaaguucaccgugguggugggagacgugguggguauccucgcccaggggaagaaaaugauccggccccagccgauggagcauaaguacaguuggaagagcuggggaaaggcgaaaaucaucggcgccgacguacagaauacuacguucaucaucgacggaccaaacacccccgagugcccagacgaccagcgcgcauggaauaucugggaaguggaggacuacggcuucgggaucuucaccacaaauauaugguuaaagcugcgagacagcuauacgcaagcaugcgaccaccgucucaugucagcagcgaucaaggacucaaaggcagugcacgcggauaugggguacuggaucgagucugaaaagaacgaaaccuggaagcuggcccgggcguccuucaucgagguaaagaccuguaucuggccgaagucacauacacuguggagcaacggugugcuugaguccgaaaugguaauucccaaaaucuaugggggcccuaucagucagcacaauuacaggcccggguauuucacgcagaccgcagggcccuggcaucuggggaagcuggagcucgacuucgacuugugugaaggcaccaccguaguuguggaugaacauuguggaaaccgggggcccagccugcggacgaccacagucaccggcaagauaauucacgaauggugcugucggaguugcacguugccgccucuccgcuucaagggcgaggacggcuguugguacgggauggaaauccgacccgugaaggaaaaggaagagaaccucguuaaauccaugguuagcgcagguagcggcgagguggacuccuucucccucggacuacuaugcaucaguaucaugaucgaggaggugaugcgcagccgguggagucgcaagaugcucaugaccggcacccuggccguauuccuguuauugaucaugggacagcugaccuggaaugaccucauccggcugugcaucaugguaggcgccaacgcaucugaccgcauggggaugggcacgaccuaccuggcccucauggccaccuucaagaugagaccuauguucgcgguggggcuguuguuucgacggcucaccucacgggaaguccugcugcugacgaucgggcugagccuuguggcauccgucgaacuccccaacagcuuagaggaacugggagacggccucgcaaugggcaucaugauauuaaagcugcucaccgauuuccagucccaucaguuaugggcgacccugcuaucucugaccuuuauaaagacuaccuuguccuuacauuacgccuggaagacaauggccaugguacugagcaucguaucucuuuuccccuugugccugucgaccacuucccagaagacaaccuggcugcccguccuuuugggaucacuggggugcaagccgcucaccauguuccuaauagcggaaaauaagaucuggggccguaaauccuggccccuaaacgaggguaucauggcagugggcguggucucuauucuccugagcagccugcucaagaacgacgugcccuuagcggggccccucauugcgggaggcaugcucaucgccugcuaugugauaucggggagcuccgcggaccugucccuugaaaaagccgccgaagucuccugggaggaggaggcugaacacaguggcgcaagccauaacauucuaguggaggugcaggaugacgggacgaugaagauuaaggacgaggaacgggacgacacguugaccauccuccucaaagccaccuuacuagcuguaucaggcguuuacccguugagcaucccagcuacccuguucguuugguacuucuggcagaagaagaagcagcgcuccgguguucugugggacacgcccagcccgcccgagguugagcgugccguucucgaugacggcaucuaccgcaucaugcaacggggccuuuuggggcgcucacaggugggcguggggguauuccaagagaacgucuuccauacgauguggcaugugacccggggcgcuguacugauguaccaaggcaagcgacucgagcccagcugggcauccgucaagaaggaccugauuuccuacgggggcggguggagacugcagggauccuggaacacuggggaagagguccaaguaaucgccgucgaacccggcaagaaucccaaaaacgugcagacggcucccgggaccuuuaagacccccgagggugagguuggugccauugccuuggacuucaagcccgggaccaguggcucccccaucgucaaccgcgaggggaagaucguagguuuauacggcaacgggguggugacgaccagcggcaccuacgugucagcgauugcccagaccaaggcuagccaggaaggcccacuucccgagaucgaagacgagguguuccggaagcgcaaccugacaauuauggaccugcaccccggcagcgggaagaccaggcgcuaccuuccggccauagucagagaggcgauuaagaggaagcuccggacucugauccuugcccccacccgcgucgucgccagugaaauggcggaggcucucaagggcaugcccauucgcuaccagacgacugcggucaagagcgagcacaccggcaaggaaauuguggaccugaugugccacgcaacguuuacaaugcgucugcucucgccuguacgcguaccgaacuacaacaugaucauuauggaugaggcccacuuuacugaccccagcuccaucgcagcccgcggguacauaaguacgcgcgugggaaugggggaggcggcggccaucuuuaugacugccacgccgcccggcuccguggaggccuucccgcagaguaacgcgguuauccaggacgaggaacgggauauccccgaacgcucuuggaauagcggucacgaguggauuaccgacuuccccggcaagacugugugguucguccccuccaucaagagcggcaacgacauugccaauugccugcggaaaaacggaaagcgcgucauccagcucucuaggaagaccuucgacaccgaauaccaaaagaccaagaacaaugacugggacuacguggugaccaccgacaucagcgagaugggagccaacuucagagccgaccggguaaucgacccacgccggugccucaagcccgucauucugaaggaugggccagagagagucauccucgcgggccccaugcccgugacgguggcguccgcugcacagcggcgaggccggauaggccgcaaucauaacaaagaaggcgaccaguacaucuauauggggcagccccucaacaacgacgaagaccaugcccacuggacggaagcuaagaugcugcuggacaacaucaauaccccugagggaaucauccccgcccuuuucgaaccggaacgggagaaguccgcugcgauugacggagaguacagacuccgaggcgaagcccggaagacuuuugucgagcuaaugcggcgcggcgaucucccgguuuggcuguccuauaaggucgcuucagaggguuuucaguacucggaucgccgguggugcuuugacggcgaacggaacaaccaggugcuggaagagaacauggacguggagauauggaccaaagagggggagcggaagaaguuacgcccccgcuggcuggacgcccgcaccuacagugacccccuggcccuccgggaauucaaagaguuugccgcuggccgacgcagcgugaguggggaccugaucuuagaaauuggcaaacucccgcaacaucugacccagagagcccaaaacgcgcuagacaacuuagucaugcugcauaacagcgaacagggcggccgggccuacaggcaugcgauggaagagcugccggauaccaucgagacacuuaugcugcuggcgcucauugcagugcugaccggaggggugacccuauucuuccuuucuggccgggggcucgggaagaccagcauagguuugcuuugcgucauggcauccucugucuugcuguggauggcuuccguggagccccauuggaucgccgcuagcaucauucuggaguucuucuugaugguucuucucauccccgaaccggaccgccagagaacgccccaggacaaccaacuagccuacgugguaauaggccuacucuucaugauccugacgguggccgccaaugagaugggccuguuagagaccacuaaaaaggacuuggggaucggccauguggcgguggagaaccaccaccacgcgacaaugcuggacgucgaucuucaucccgcuucugccuggacauuguacgccguggccaccacgaucauuacaccgaugaugcgccacaccaucgagaacaccaccgcgaauaucucacugacggccaucgccaaucaggcagcaaucuugaugggacuggacaaggguuggcccaucuccaagauggauaucggcgugccccucuuggcgcugggguguuacagucagguaaaccccuugacccuuacagcggcugugcugaugcucguggcccauuacgcuaucaucgggcccggguugcaggccaaagccacccgggaggcccaaaagcgcacugcggcgggcaucaugaaaaacccuacagucgacggcauuguugccaucgaccuggaucccguggucuacgacgccaaauucgaaaagcagcugggccagauaaugcuccuuauucugugcaccucccaaauccuccuaaugcgaaccaccugggcgcuaugcgagagcaucacgcucgccaccggcccccugaccacacuaugggaggguuccccgggcaaguuuuggaacacgaccaucgcggugucaauggccaacaucuuccgggguuccuaucucgccggagccggguuagccuucagucucaugaagucccucgggggagggcggcgggguaccggcgcacagggcgagacgcugggugaaaaauggaagcgucagcugaaccagcucuccaaaucugaguucaacaucuacaaaagguccggcauuauggaaguugaucgcagcgaagccaaggagggccugaagcgcggggagacgacccgccacgcugucucccgaggcaccgcuaaguuacggugguucguggagcggaaccuugugaagccggagggcaaggugaucgaucucgguugugggcgcgguggcuggagcuauuauugcgcuggacugaaaaagguaacagaggugaagggcuacacgaagggcgggcccgggcacgaagagccaauacccauggccaccuacggguggaaccuggugaagcuccauuccggcaaggacguuuucuucgcaccgcccgaaaagugcgacacccuguugugugauaucggggagucaucaccaaacccgaccaucgaggagggccggacacucagaguccugaagauggucgagcccuggcugagggggaaucaguuuugcaucaagauccuuaaccccuauaugccuagcgugguggaaacccuggagcagaugcaacgcaaacauggcggaaugcuggucaggaacccgcucucgcguaacagcacccacgaaauguacugggucagcugcgggacaggcaacaucgugagcgccguaaacaugaccucccggauguugcuaaaccgcuucacuauggcucaucgcaagcccacauacgagcgcgacguggauuugggggccgggacccgucauguugcggucgagccggagguggccaauuuggacauuauaggccagagaaucgagaacauaaagcaugagcacaagucgacauggcacuacgacgaggacaacccuuauaaaacaugggcauaucacggguccuacgaggucaagccgucaggcagcgcuagcagcauggugaacgggguggucaaguugcucacgaagccuugggaugugauccccaugguaacccagauugcgaugacugacaccacuccauucggacagcagagagucuucaaggagaaaguggacacccguacaccgaaggccaagcgcgggacggcccagaucauggaagugacagcccgguggcuguggggcuuccuguccagaaacaagaagcccagaauuuguacgcgcgaagaguuuacuaggaaaguccgcucaaacgcugcgaucggcgccguguucguggaugaaaaccaguggaacagugcaaaggaggccguggaggacgagcgguucugggaccucgugcagaaggagcgggagcugcacaagcaggggaagugugcuacgugcguguacaacaugaugggcaagcgcgaaaagaagcuaggggaguuugguaaggcaaaggggagcagggcaaucugguacauguggcugggcgcccgguucuuggaauucgaagcacuggguuuuaugaacgaggaccacugguucucacgcgagaacagccucuccggggucgagggcgaaggacugcacaaguugggcuacauccuacgggacauuagcaagauccccgggggcaacauguaugcggacgacaccgccggcugggacacccgcaucacagaggaugauuugcagaacgaagcaaagaucaccgacaucauggagccggagcacgcccugcuugccaccuccaucuuuaaguugaccuaccagaacaagguggugcggguucagcgccccgcgaagaacgggaccgugauggaugucaucucacgcagagaucaaagaggcuccggucaagucggcacguacggccuaaauaccuucaccaauauggaggcucaguuaauacggcaaauggaaagcgagggcauauuccugcccuccgagcuggagacgccgaaccucgccgagagagugcuggacuggcuugagaaacacggcgucgagcggcucaagcgcauggcgaucagcggggacgacugcgucgugaaaccgaucgacgacagauucgccacugcacugaccgcccuaaacgacaugggcaaaguacgcaaggacauaccccagugggagccguccaagggguggaaugacuggcagcaggucccauucugcucgcaucacuuucaccagcuuaucaugaaggauggccgagagaucgugguuccgugcaggaaccaggacgagcuggucggccgggcccgcguaagucagggggcaggcuggagucugagggagaccgccugcuugggcaagagcuacgcucagauguggcaacugauguauuuucaccgccgggaccuuagacucgcagcuaacgccauaugcuccgcggugcccguggacugggugcccacgucacggacgaccugguccauccacgcucaccaccaauggaugacaacugaagauauguugaguguguggaaccgcgucuggaucgaggagaaccccuggauggaggacaagacgcacgugucuagcuggggcgacguaccuuaccuggggaaacgggaggaccaguggugugggagucugaucggccugaccgcccgggccacgugggccagcaauauccagguugccauaaaucaaguucgucgauuaaucgggaacgagaacuaccucgauuauaugaccuccaugaagcgcuucaaaaacgaaggagaccccgaaggcgccuuaugguga

SEQ ID NO: 24280 - RNA, 9879 nt, Artificial Sequence
  derived and/or modified CDS sequence (opt11) from DENV-1__FJ898380__SS-prME
uccgugaccaugcuccucauguugaugcccaccgcccuggcuuuucaccucaccacaaggggaggggaaccccauaugaucgugucgaagcaggaacggggcaagagccugcuguucaagaccuccgccggcgugaacaugugcacccugauugccauggauuuaggugagcucugcgaagauacaaugacauauaagugcccucguaucaccgagaccgagcccgacgacguggacugcuggugcaacgcuacggacacuugggugaccuacgggaccugcucacagacgggcgagcacaggcgagacaagagguccgucgccuuggcgccgcacguggggcuaggguuggagacacgcaccgagacguggaugucauccgagggcgcguggaagcagauacagagggucgagaccugggcucucagacaucccggguucaccguaauugcccuguuccuggcacacgcaaucggcaccucuaucacccagaagggaaucaucuucauccuccugaugcuggugacgcccaguauggcgaugcggugcguaggcauuggcagccgagacuucguugagggacucuccggcgccacuuggguggacgucguguuagagcacggaagcugcgugaccaccauggccaaggacaagcccacgcuagacaucgagcuccugaagaccgaggugaccaaccccgccguacugcggaagcucugcauugaggcgaagaucuccaauaccacgacagacagccgcugcccaacccagggagaggccacccuggucgaggagcaggacgcaaacuucgucugccggcgcacguucguagacaggggguggggcaacggcugcgggcuguucggcaaggggucuuugauuacgugugcaaaguucaagugcgugaccaagcuggagggcaagauuguccaguacgagaacuuaaaguacagcgugaucgugaccguacacacuggcgaccagcaccaggucgggaacgaaucaaccgagcacggcaccaccgcuaccaucacaccccaagcacccacgaccgagauccagcucaccgauuauggggcccugacucuggacugcucgccccgcaccggccucgacuucaaugagauggugcugcucacuaugaaggaaaagagcuggcucgugcauaagcagugguuucuggaucugccccuccccuggaccagcggagccagcacgucccaggagaccuggaaccggcaagaccugcugguaaccuucaagaccgcacacgcaaagaagcaggaggucguggugcucggcagccaggagggcgcgaugcacacggcgcugaccggggccaccgaaauccagaccuccggcacgaccacuaucuucgccggacaccuaaagugccgccucaagauggauaagcugacucugaagggcauguccuacgugaugugcacgggguccuucaaacuugagaaggaggucgccgagacccagcacgggaccgugcugguccagaucaaguacgaaggcaccgacgcgcccugcaagauccccuucagcacgcaggacgaaaagggggugacgcaaaacggccgguugaucacggccaacccgaucgugaccgacaaggagaagcccgucaacauagaggccgagcccccuuucggggaguccuacaucgugaucggcgcuggcgagaaggcacugaagcucucgugguucaagaagggcuccucgaucggcaagauguuugaggccacggccagaggggcccggcgcauggccauccugggcgacacagccugggauuuuggguccauaggcggcguguuuacuucaguaggcaagcuggugcaccagaucuucggcacggccuauggaguacucuucucuggcgucuccuggacgaugaagaucgggauugguguacuacugaccuggcucgggcugaacucucgcagcacuucucugagcaugacauguaucgcggugggucuggucacgcuauacuugggcgugauggugcaggccgauuccgggugcguuaucaacuggaagggccgggaauuaaaguguggcagcggcauauuugugacgaacgagguucacacauggacagagcaauacaaguuccaggccgacucaccuaagcgauugucugcggccauaggcaaggcgugggaggaaggugucugcggcauacggagcgccacccgucuggagaacaucauguggaagcagaucuccaacgaacucaaccacauccugcuggagaacgacaugaaguucaccguggucgucggggacguggcgggcauccuagcgcaagggaagaagaugauccggccccagccaauggaguauaaauacagcuggaagucguggggcaaggccaagauuaucggcgccgacgugcaaaacacuaccuucaucaucgacgggcccaacacaccggagugccccgaugaccagagggcguggaacauaugggaggucgaggauuacggcuuugguaucuuuacgaccaacaucuggcugaagcugcgggacagcuacacccaggugugugaccaccgccucauguccgcggccaucaaggacaguaaggccgugcacgccgacaugggcuauuggaucgaauccgaaaagaacgagacauggaaacuggcccgggcuagcuucauugaagucaagacaugcauauggcccaagucccacacacuguggagcaauggcgugcucgagucagagaugaucaucccaaagauauacggaggacccaucucccagcauaacuaccgccccggguacuucacgcaggccgccggcccuuggcaccugggcaagcuggagcucgacuucgaccuaugcgaggguacuacgguggucguggaugagcauugcggcaacagagggccgucccugcgaaccaccacaguuacgggcaagaucauacacgaguggugcugccgcagcugcacgcugccgccccuccgauucaagggggaggacggaugcugguacgggauggagauccggcccgucaaggagaaggaggagaaccuggugaagucgauggugagcgccggguccggcgaggucgacuccuucagccugggucugcugugcaucuccaucaugaucgaggaggugaugcggagccggugguccagacggauguugaugaccggcacccuggccguguuuuuccuucucauuauggggcaguugacguggaacgaucugaucaggcucugcaucauggucggcgcgaacgccagcgaccgcauggggauggguaccaccuacuuagcccucauggccaccuucaagaugcgaccgauguucgccguuggccucuuauuccgacggcugacgucccgcgaggugcuccugcugaccaucgggcucucucuuguugcguccguggagcugcccaacagccucgaggagcucggcgacgggcuggccaugggcauuaugauccucaaacugcuaaccgacuuccaaucccaccagcucugggcaaccuugcugagccucacguucauaaagaccaccuucucccugcacuaugccuggaaaacgauggcgaugguccugagcaucgugucccucuuuccccugugccucagcacuacgucccagaagaccaccuggcuccccgugcugcuggggagccuagggugcaaaccgcugacgauguuccuaaucgcagagaacaagaucuggggcaggcgcuccuggccccugaacgaggguauaauggccguuggaaucgugagcaucuuguuaagcucccuccugaagaaugacgugccucuggcugggccacucauagccggcggcaugcuuaucgcgugcuacgucaucagcgggucaucagcggaccugucgcucgaaaaggcagcugaggugagcugggaagaggaggccgagcacuccggcgcgagccauaacaucuugguggagguccaggacgacgggaccaugaagaucaaggaugaggagcgugacgacacccuuaccauccugcucaaagcgacccugcucgcgguguccggcguguauccguuguccauucccgcgacgcuauucgucugguacuucuggcagaagaagaagcagcgcuccggggugcucugggacaccccaagcccacccgagguggagcgcgccguccuggacgacggcauuuaccgcauaaugcagcggggauugcuggggcgcucacagguuggcguuggggucuuucaggagaacgucuuccacaccauguggcacgugaccaggggcgcgguccucauguaccaggggaagcgcuuagagcccagcugggcaucugugaagaaggaccugaucuccuacggcggugguuggcggcuucagggcuccuggaacacgggagaggaggugcaggucaucgcaguggaaccagguaagaaccccaaaaacgugcagacugcccccgggacuuucaagacucccgagggcgaggucggcgccaucgcgcucgacuucaaaccaggcacaagcggcucgcccauugugaaccgcgaggggaagaucgugggccuguacggcaacggggucgugaccaccagcggcaccuacgugagcgccaucgcccaggccaaggcgucccaggaggguccccucccagagauugaggaugaggucuuucgcaagagaaaccugacgaucauggaucugcacccggggagcggcaagacccggcguuaccuuccggccauaguucgggaggccauuaagcgcaaacugcggacccuuauccucgcccccacacgggucguagcauccgagauggcggaggcccugaagggcaugcccauccguuaccagacgaccgccguaaagagcgagcacacuggcaaggagaucguagaccugaugugccacgccaccuucacuaugcggcuccugucuccuguucgcgugcccaacuauaacaugauuaucauggacgaggcccacuucacugaccccagcuccauagcggccaggggguacaucaguacgcgcgugggcaugggggaggccgcggccaucuucaugaccgccacgccgcccgggagcgucgaggcuuucccgcagagcaaugccguaauccaggacgaggagcgagauauccccgagagguccuggaacagcggguaugaguggaucaccgauuucccuggaaagaccgugugguucguccccaguaucaaaucuggaaacgacaucgccaauugccugcggaaaaaugggaagcgcgugauccaacucucccggaagaccuucgacacggaguaccagaagaccaagaacaacgacugggacuacgucgucacaaccgacaucagcgagaugggggcgaacuuccgcgccgaccgggugaucgacccgcgccggugcuugaagcccgugauacucaaagacggucccgagcgugucauccucgccggcccuaugccggugacaguugccagcgccgcucaacggcgcgggcggaucggccgcaaccacaacaaggagggcgaccaauacauuuauauggggcagccucugaacaacgaugaagaccaugcucacuggacggaggcaaagaugcugcuggacaacauuaacacccccgagggcaucauucccgcccuguucgagccggagcgcgagaaguccgcggcgaucgacggggaguaccggcuacgcggggaggcgcggaaaaccuucguggagcucaugcgccgcggugaccugcccguguggcuauccuacaaggucgcgagcgagggcuuccaguacagcgaccguaggugguguuucgacggcgagcgcaacaaccaggugcuugaggagaacauggacguugaaaucuggaccaaggagggugagcgaaagaagcugcgcccacgguggcuggacgcccgcaccuacuccgacccccuggcccugcgggaguucaaggaguucgcggcaggccgcagaagcgucuccggggaccuuauccucgagaucgggaaacucccgcaacaccucacccagcgcgcccaaaaugcgcucgacaaccuagugaugcugcacaacagcgaacagggcgggcgggcuuaucgccacgcgauggaggaguugccggacaccauagagacccuaaugcugcucgcccugaucgccgugcugaccgguggggucacucuauucuuccuuucaggaagagggcugggcaagaccaguaucggcuugcugugugugauggccuccaguguacugcuuuggauggcauccgucgaaccccacuggaucgccgcaagcaucauccuggaguucuuccugauggugcuccugauccccgagccggaccgccagcggacgccgcaggacaaccagcuugcauacguggucaucgggcuccuguuuaugauccugacgguugccgcgaacgaaaugggcuuacuggagacuaccaaaaaggaccugggaaucggccacguggccgucgagaaccaccaccacgccgcuaugcucgacguugaccuacaccccgccuccgcguggacccuauacgcaguggccacgacaaucaucacgcccaugaugcgccauaccauugagaacacaaccgccaacaucagccucacggccaucgcgaaucaggccgcaauacugaugggguuagacaaggguuggcccauauccaagauggauauuggcguuccccucuuggcuuuagggugcuauagccaggugaacccccucacucugacggcugcugugcuuaugcucgucgcccacuacgccauuaucggcccggggcugcaggccaaggcuacccgcgaagcucagaagcggaccgccgccggcaucaugaagaaccccaccguggacgggaucguggccaucgaccucgacccggucguguacgacgcgaaauuugagaaacagcugggccagaucaugcugcuaauccucugcacgagucagauauuacuuaugcgcacgacgugggcccucugugagucgauuacgcuggcgacgggcccccugaccacgcucugggagggauccccgggcaaguucuggaacaccacgaucgccguaagcauggccaauaucuuucggggauccuaucuggcaggcgcaggccuagccuucagccuuaugaaaagccucggagggggacgccgggggacgggggcacagggagagacgcuaggcgagaaguggaagcgccaguuaaaccaacucuccaagagcgaguucaacaccuacaagcgguccgggaucauggaagucgaccgcagcgaggcaaaggagggccuuaagcgcggggagacgaccaagcacgcagucucccgcgguaccgcaaagcuccggugguucguggagcgcaacuuagucaagccggaggggaaggugaucgaccugggcugcgggcgaggcggguggagcuauuauugcgcgggucugaagaaagugaccgaggucaagggauacacgaaaggcggccccggccacgaggagcccaucccgauggcgaccuacggcuggaaccuagugaagcugcacucagggaaggauguguucuucaucccgccugaaaagugcgauaccuugcucugcgacaucggagagucuuccccgaauccgaccaucgaggaggggcguacucugcgcguucuaaagaugguggagccuuggcuccgugggaaccaguucuguaucaagauccugaaccccuauaugccaagcgucgucgaaacucuggaacaaaugcagagaaagcacggcggcauguuaguccgcaacccgcuuucccggaauaguacccaugagauguacuggguguccugcgggacgggaaacaucgucucggccguaaacaugaccucccgcaugcugcucaaccgcuucacgauggcccacaggaagcccacguacgaacgcgacguggaccugggggccggcacccggcacgucgcaguggagcccgagguggccaaccuggacauuauaggccaacgcaucgaaaacaucaaacaugaacauaaaagcaccuggcacuacgacgaggacaaccccuacaagaccugggcguaccauggguccuacgaggucaaaccgagcggaagcgccaguagcauggugaacggggucgugaagcuccucaccaagccgugggacgugauucccauggucacccaaauugccaugacagacacgacccccuucggucagcagcggguuuucaaggagaagguggauacccgcaccccgaaggccaagcgagggacagcacagaucauggaggucacagcgaaguggcuguggggcuuccucucucgcaacaagaaaccgaggaucuguaccagagaggaguucacccggaaagugcgcagcaacgccgccaucggagcaguguucgucgaugagaaccaguggaacuccgcgaaggaggccgucgaggacgagcgguucugggaccuuguccaccgagagcgggaacugcacaagcaggguaagugcgcuacgugcgucuacaacaugaugggcaagcgcgaaaagaagcuaggggaguuuggcaaggccaaggggagcagggccaucugguacaugugguuaggcgcacgcuuucuggaguucgaggccuuggguuucaugaacgaggaccacugguucucccgggagaauagccuguccggggucgaaggcgagggguugcacaagcugggauacaucuugcgggacaucagcaaaaucccgggcggcaauauguacgcggacgacaccgcgggcugggauacccgcaucaccgaagacgaucugcagaaugaggccaggaucacggacauuauggagccugagcacgcgcuccuggcgaaauccaucuucaaguuaaccuaccagaacaaaguaguccgcgugcaacgaccggccaagaacgggaccguuauggaugucauaucacgcagggaccaacgcgggucuggucaagugggcacguacggccuaaacacauucaccaacauggaggcccaguuaauucggcagauggaaagugaggggaucuucucuccuucugagcuggagaccccgaaccucgccgagcgcgugcuggacugguuagagaaguacggggucgagcgccucaagcgcauggcgaucaguggggaugacuguguagugaagccgaucgacgaccgguucgcuaccgcccugacggcucugaaugacaugggcaaaguccgcaaggacaucccccagugggagcccucuaagggguggaacgauuggcagcagguccccuuuugcagccaccacuuucaucaauuaaucaugaaggacggccgggagaucguagucccaugucgcaaccaggacgagcuggugggacgugcgcgcgugagccagggggcuggcuggucccugcgggaaaccgcgugccuggggaaguccuaugcccagauguggcaguugauguacuuccaccgccgggaccugagacucgcagccaacgccaucugcagcgcugugccaguggacuggauccccacaucccggaccaccuggagcauccacgcccaccaccaguggaugaccacugaggauaugcuguccguguggaaccgcgucuggauugaagagaaucccuggauggaagacaagacccacaucagcuccuggggcgacgugccguaccuggggaaacgcgaggaccaguggugcggcagccucauaggccugaccgcccgagcgaccugggccaccaacauacaggucgccaucaaucaggugcgcagacugaucgggaacgagaacuaccucgacuacaugaccagcaugaagcgguucaagaacgagucggaccccgagggcgcucugugguga

SEQ ID NO: 24281 - RNA, 9879 nt, Artificial Sequence
  derived and/or modified CDS sequence (opt11) from DENV-1__FJ898382__SS-prME
agcguaaccauguuacucaugcugaugccaaccgcacuugccuuccaccucaccacccggggcggcgaaccccacaugaucgugagcaagcaggagcgcggcaagagccugcuguucaagaccagugcgggcgugaauauguguacccucaucgccauggaucuaggcgagcugugcgaggacaccaugaccuacaagugcccccgcaucaccgagaccgagcccgacgauguggacugcuggugcaacgccacggacaccugggugacuuacgggaccugcagccaaaccggcgagcaccgcagagacaagcggaguguagcacuugcgccccacgugggccucggccuugagacccguacagagaccuggaugagcuccgagggcgcguggaagcagauacagcggguggagacgugggcccuccgccauccgggauucaccgugaucgcccuguuccuggcccacgcaaucggcaccagcauuacucagaaggggauaaucuucauccucuugaugcuggugacgccguccauggccaugcggugcgucggcaucggcagccgcgacuucguggagggguugucgggggccaccuggguggacgugguauuggagcacgguucgugcgugacuaccauggccaaggacaagcccacgcuagacaucgaacucuugaagaccgaggucaccaaccccgccguacugcggaagcucugcaucgaggcgaagauuuccaacaccacgacagacagccgcugcccgacacagggugaggccacccugguggaggagcaggacgccaauuucgucugccggcgcacauucguggaccggggcugggggaacggcugcggacuguucggcaaggggucccuuaucacgugcgcuaaguucaagugcguuaccaagcuggagggcaagaucguacaauacgagaaccucaaguacagcgugaucgugaccguccacacgggcgaucaacaccagguagggaacgagagcaccgaacacggcacgaccgccaccaucacgccccaagcgcccacaaccgagauccaguuaaccgacuacggggcccugacguuggacugcagcccccguaccggucucgacuucaacgagaugguccugcugaccaugaaggaaaaguccuggcucgugcacaagcagugguuccuggaccugccccuccccuggacgucaggggccagcacgucccaggagaccuggaaccggcaggaccugcuggugaccuucaagaccgcccacgccaagaagcaggaggucguggugcucgggagccaggagggcgcgaugcacacggcccuaaccggggccacagaaauccagaccucuggcacgaccaccaucuucgccgggcaccugaagugccgccucaagauggacaagcugacccugaagggcaugaguuacgucaugugcacuggauccuucaagcuagagaaagagguugcagagacccagcacgggaccgugcugguccagaucaaguacgagggcaccgacgcgcccuguaagaucccguuuagcacgcaggacgagaagggggugacccagaacggccggcugaucaccgccaacccgaucgugacugacaaagagaagcccgucaacaucgaggcagagccgcccuucggggaguccuacaucguaaucggcgccggggagaaggcacugaaacucagcugguucaagaaggggucgagcauugguaagauguucgaggccaccgcccgcggugcccggcgcauggccaucuuaggcgacaccgcgugggacuucggguccauaggcggcguauucaccucggucgggaagcugguccaccaaaucuuuggaaccgccuacgggguccucuucucgggcgucagcuggaccaugaagaucgggauuggcgugcugcugaccuggcucggucugaacucccgcagcaccucccugagcaugaccuguaucgccguggggcucgucacgcuguaccugggugugauggugcaggccgacucaggcugcgucaucaauuggaagggccgggaacucaagugcggcuccggcaucuucguaaccaacgaggugcacacguggaccgagcaguacaaauuccaggccgacagcccgaagcgccuguccgcggccaucggcaaggccugggaggaggggguaugcgguauccgguccgccacccgccuggaaaacaucauguggaagcagaucucaaacgagcucaaccacauccugcuggagaacgauaugaaguucacggugguggucggggacguggccggcauccucgcacaggggaagaagaugauccggccccagcccauggaguacaaguacagcuggaaguccugggguaaggccaagauaaucggcgccgacgugcagaacaccaccuucaucaucgacggaccuaacaccccggagugccccgacgaccagagggccuggaacaucugggaggucgaggacuauggcuucgggauauucacgaccaacaucuggcugaagcuacgggacagcuacacccagguuugcgaccaccgccucauguccgcggccaucaaggacuccaaggccgugcacgccgauaugggcuacuggaucgaguccgagaagaacgagaccuggaagcuagcccgggcgucuuuuaucgaagucaagacgugcaucuggcccaagucucacaccuuguggagcaacggcgugcucgaguccgagaugaucauccccaagaucuacgggggcccgaucagccagcacaacuaccgccccggguacuucacccaggccgccggccccuggcaccuggggaagcuggagcucgacuucgaucugugcgaaggcaccacgguggucguagacgaacacugcggcaaccgggggccgucccugcgcaccaccaccgugacgggcaagaucauccacgaguggugcugccggagcugcaccuuacccccccuacgcuuccgcggggaggacggcugcugguacgggauggagauccgccccgucaaggagaaagaggaaaaccuggugaaguccauggugagcgccggcagcggcgaggucgacuccuucagccucgggcugcugugcaucuccaucaugaucgaggaggugaugcggagcagauggucccggcgcauguugaugaccggcacccuagccguguucuuccugcucaucaugggccaacugacguggaacgaccuaauacgucucuguaucauggucggcgcgaacgcgucggaccggauggguaugggcacuaccuaccuggcccugauggccaccuucaagaugcgcccgauguucgccguggggcuccuguuccggcgucugacguccagagaagugcuccugcucaccaucgggcucucacuggucgcauccguagagcugcccaacagccucgaggagcugggcgacgggcuggccaugggcauaaugauccucaagcugcugaccgacuuccagucucaccagcucugggccacccugcugagccucacguuuaucaagacgaccuucucccugcacuacgccuggaagaccauggcgauggucuuaagcaucgugucccucuuuccucugugccugagcacgaccucccaaaaaaccaccuggcuacccguguuacugggcagccucgggugcaagccgcugacgauguuccugaucgcggagaauaagaucuggggcaggcggucuuggccccucaacgaggggaucauggccgucggcaucgugagcauucugcugagcagucugcugaagaacgacgugccccuagccgguccccucaucgccggcgguaugcugaucgcgugcuacguaaucucuggauccagugccgaccugucccucgagaaggccgccgaggugagcugggaggaggaggccgagcacucgggcgcgagccauaacauccugguggagguccaggacgacgggaccaugaagaucaaggacgaggagcgugaugacacccugaccauccuccuaaaggccacccugcuggccgugucaggcgucuacccgcugagcauccccgccacucuguucgucugguacuucuggcagaagaagaagcagcggucaggagugcuaugggacacccccagcccgccagagguggaacgcgccguccuggacgaugggauuuaccggaucaugcagcgcggccugcucgggcggagucaggugggugugggugucuuccaggagaacguguuccacaccauguggcacgugacgaggggcgcggucuugauguaccaggggaagcggcuggaacccaguugggccucagugaagaaggaccugaucagcuacggcggcggguggcgccugcagggcuccuggaacacgggggaagaggugcaagucaucgccguggagcccggcaagaaccccaagaacgugcagacagcccccgggaccuucaagacccccgagggcgaggucggcgccauagcgcuggacuuuaagcccgggacgucagggucucccaucgugaaccgggaggggaagaucgugggccuguacggcaacggggucgugaccaccagcggcaccuacgugagcgccaucgcccaggcgaaggcaagccaggaggggccgcugcccgagaucgaggacgaagucuuccgcaagcgcaaccugacgaucauggaccuccacccgggcagcgggaaaacccggcgguacuuaccggccaucgugcgggaggccaucaagaggaagcugcggacccugauccucgcgccaacccgcguagucgccuccgagauggcggaggcccugaagggcaugcccauccgguaccagacgacggcggucaaaagugagcacaccggcaaggagauaguggaccugaugugccacgccaccuucacgaugagacuccugagucccguucgggucccgaacuacaacaugaucauaauggacgaggcccacuucaccgaccccuucagcaucgcggcccguggguacaucucgacccggguagguaugggggaggcugcagccaucuucaugaccgccacgccgccaggcagcgucgaagccuucccccaguccaaugcagugauccaggaugaggagcgcgacauacccgagcggagcuggaacucgggguacgaguggauuacagacuucccgggcaagaccgugugguucguccccagcaucaaguccggcaacgacaucgccaacugccugcgcaagaacggcaagcggguuauccagcucagccgcaagaccuucgacacggaguaucagaagacuaagaacaaugacugggacuacguggucacaaccgacaucuccgagaugggcgcgaacuuccgggccgaucgcgugaucgacccucggcgcugccuaaagcccgugauccugaaggacggccccgagcgggucauccucgccgggcccaugcccgugacggucgccagcgccgcgcaacgccgggggcgcauagggcgcaaccacaacaaagagggcgaucaguacaucuacauggggcagccccuuaacaacgaugaggaccacgcccacuggaccgaggcgaagaugcugcucgacaacaucaacacacccgagggcaucauccccgcccuguucgagccggagcgggagaagagugccgcgaucgacggggaguaccgccugcggggcgaggcgcgcaagacuuucguagagcucaugcggcgcggcgaccugccgguguggcugagcuacaaggucgccuccgagggauuccaguacagcgaucggcgcuggugcuucgacggcgaacggaacaaccaagugcucgaagagaacauggacgucgagaucuggacgaaggagggugagcgcaaaaagcugcggccccgcuggcuggacgcccggaccuacagcgaccccuuggccuuacgagaguuuaaggaguucgcggccggccggagauccgucagcuccgaccugauccucgagaucgggaagcugccgcagcaccugacccagagagcccagaaugcccucgacaaccucgucaugcuucauaacagcgaacagggcgggcgcgcguaccgacacgccauggaggaguugcccgacaccaucgagacgcugaugcuucucgcccugauagccguauugacagggggggucacccucuucuuccuguccgggcgcggccuggggaagaccucgaucggccuccuuugcgucauggccuccagcgugcuacuguggauggcgagcgucgagccccacuggaucgccgccagcauaauccuggaauucuuccugauggugcuccugauucccgagccggaucggcagcgcacgccccaggacaaccagcuggccuacguggucauuggccuccuguucaugauccugacgguggcggcaaacgagauggggcuccuggagacuacaaagaaggaucuggguaucgggcacguggcagucgaaaaccaucaccacgccgccauguuagacguagaccugcaccccgccagugcguggaccuuauacgcgguagccacgaccaucaucaccccgaugaugagacacaccaucgaaaacacgaccgccaacaucagccucacagccaucgcgaaccaggccgccaucuugaugggccuggauaagggguggcccaucuccaagauggacaucggcgucccacuccuagcccugggcugcuacagccaagucaacccacucacgcugacggcggccgugcuaaugcucguagcccacuacgccaucaucgggccgggccugcaggccaaggcgacccgggaggcccagaagcgcaccgcggccgggaucaugaagaaccccaccguggacggcaucguggccaucgaccuggaccccgucguuuacgacgcgaaguucgagaagcagcucgggcagauaaugcugcugauccucugcacgucccagaucuuacugaugcguaccacaugggcccucugugagucgaucacccuggccacaggcccccugaccaccuugugggagggcuccccggggaaguucuggaacaccacuaucgcugugucaauggccaacaucuuucgcggauccuaccuggcgggagccgggcuugccuucagccucaugaagucccugggcgggggccggcgcggaacaggcgcucagggagagacccugggugagaaguggaagcggcagcucaaccagcuguccaagagcgaguucaacaccuacaagcgcuccggcaucauggaaguggaccgcagcgaggcgaaggaggggcugaagcgcggcgagacgacgaagcacgccgugucccggggcaccgccaagcucaggugguucguggagcgcaaucuggucaagcccgagggcaaggugauagaccuggggugcggccgcggcggguggagcuacuacugcgccggccugaagaagguuaccgaggucaagggguacacgaagggcgggcccggccacgaggagcccaucccgauggccacguacggcuggaaccuggugaagcugcacucuggcaaggacguguuuuucaucccgcccgagaagugugacacccuguugugcgacaucggcgagagcucccccaacccaaccaucgaagaagggcggacgcugcgcguccugaagaugguggagcccuggcuccgcggcaaccaguuuuguaucaagauccugaaccccuacaugcccagcguggucgagaccuuagagcagaugcagcgcaagcacgggggcaugcucgugcggaacccgcugucccgcaauagcacccaugagauguacuggguguccugcggcaccgggaacaucgucagcgcggugaauaugaccucacgcaugcuacucaaccgauucacgauggcccaccgcaagcccaccuacgagcgggacguggaucugggcgcugggacccgccacgucgcgguugagcccgagguggcuaaccuggacaucaucggccaacggaucgagaauaucaagcacgaacacaagagcaccuggcacuacgacgaggacaauccguacaagacgugggcauaccauggcucuuacgaggucaagccgagcggguccgccagcagcaugguaaacggugucgugaagcuccuaaccaaacccugggacgugauucccauggucacccagaucgccaugacggacacgacgcccuucggccagcagcggguguucaaagagaagguggacacccgaaccccgaaggccaagcgcggcacugcccagaucauggaggucacugcgaaauggcuguggggguuccucucccgaaacaagaagccccgaaucugcacccgggaggaguucacacgcaaggugcguagcaacgccgccaucggcgccguguucgucgacgagaaccaguggaacuccgcgaaggaggccguagaggacgaacgcuucugggaucuggugcaccgggagcgcgagcugcacaaacaggguaagugcgccacgugcguuuacaacaugauggggaagcgggagaagaagcucggggaguucggaaaggccaaggguagccgcgcuaucugguacauguggcugggagcgagguuccuggaguucgaggccuuaggcuuuaugaacgaggaccacugguucucccgcgagaacagccuguccggcguggagggggagggccugcacaagcucggguacauccugcgggacaucucuaagauucccggcggaaacauguacgcggaugauacugccggcugggacacccgcaucaccgaggacgaccugcagaaugaggcccgcauuacggacaucauggaacccgaacacgcgcuccucgccaaguccaucuucaagcugaccuaccagaacaaggugguccgggugcagcgccccgcgaagaacggcaccgugauggacgucaucagccggcgcgaccagcggggguccggccagguaggcaccuacggccucaacacguucaccaacauggaggcccaguugauccgccagauggaaagcgagggcaucuucucccccucagagcuggagacccccaaccucgcggaacguguccuggacuggcuggagaaguacggggucgagcggcucaaacggauggcgaucuccggcgaugauugcguggugaaaccgauagacgaccgcuucgccacugcccucacggcccugaacgauauggggaagguccggaaggacaucccccagugggagccaagcaagggcuggaacgacuggcaacaggucccauucugcucccaccacuuucaccagcucaucaugaaggacgggcgcgagauugucgucccgugccgaaaccaggacgagcuggugggccgcgcccgggugagccagggugcgggguggagccugcgugagaccgccugccucggcaaauccuacgcacagauguggcagcugauguacuuccaccggcgcgaccugcgacucgccgcgaacgccaucugcagcgccguacccguggacuggauccccaccuccagaaccacguggucuauccacgcccaccaucaguggaugacgaccgaagacaugcuguccguguggaaccgcguguggaucgaggagaaccccuggauggaggacaaaacccacauuagcuccuggggcgacgugccuuaccuaggaaagcgggaggaccaguggugcgggagccucauaggccugacagcgcgcgcgaccugggccaccaacauccagguggccaucaaccagguccggcgcuugaucgguaacgagaacuaucucgacuacaugaccuccaugaagcgauucaagaacgagagcgaucccgagggugcccugugguag

SEQ ID NO: 24282 - RNA, 9879 nt, Artificial Sequence
  derived and/or modified CDS sequence (opt11) from DENV-1__FJ898383__SS-prME
agugugaccaugcuguuaaugcugaugccaaccgcccucgcuuuccaccucaccacccggggcggggaaccccauaugauugugagcaagcaggaacggggcaagagccuccuguuuaagacgagcgcgggggugaacaugugcacccucauagccauggacuugggugaguuaugcgaggacaccaugaccuauaagugcccccgcaucaccgaaaccgaacccgaugacguggacuguuggugcaacgccacggacaccugggucacguacggaaccugcagucagacuggcgaacaucggcgugauaagcggucuguggcccucgccccgcacgugggcuugggguuagaaaccaggaccgaaacguggaugagcagcgaaggcgcguggaaacaaauccagcgcgucgagacaugggcccuccgccauccuggguucacugugauugcccuguuccuggcccaugcgauuggcaccagcaucacucagaaggggaucauauuuauucuccugaugcuggugacccccuccauggccaugcggugcgucggcaucggcagcagggacuucguggaggggcucucgggcgccaccugggucgaugucguuuuagaacacgggagcugcguaacaaccauggcuaaagacaaacccacacuggauauagaguuacugaagaccgaagucaccaacccggccguccugcggaaguugugcaucgaggcaaagauaucaaacaccacuaccgacagccggugcccuacgcagggcgaggccacccuggucgaggaacaggacgcgaacuuugucugccggcguaccuucguggaccguggcugggggaacgguugcgggcuguuuggcaaagggucacucaucacgugcgccaaguucaaaugugugacgaaacuggagggcaagauaguccaauacgagaaccugaaguacagcgugaucgugacgguccacacgggcgaccaacaccagguggggaacgagucaaccgagcacggcaccaccgccaccauaacgccacaggcgcccacuaccgagauccaacuaaccgauuacggggcccugacguuggauugcuccccaaggaccggccucgacuucaaugagaugguccugcugaccaugaaggagaaaucuuggcucgugcacaagcagugguuccuggaccugccccucccguggaccagcggggccagcacgucccaggagacauggaaucggcaggaucuacugguuacuuucaagacggcccaugccaagaagcaggaggucguggugcucggcucacaggagggcgcgaugcacacggcccuaaccggugcaaccgaaauccagaccuccggcaccaccaccaucuucgcugggcaucugaagugccgccucaagauggacaaacugacucugaagggcaugucuuauguuauguguacugggagcuucaagcucgagaaggagguggcugagacccagcacgguaccguguuaguccagaucaaguacgaaggcaccgaugcgcccugcaagauccccuucagcacgcaggacgagaaggggguaacccagaacggcagacugaucaccgccaacccgaucgugacugauaaggagaaacccaucaacauugaggccgagccaccuuucggagagucauacaucgucaucggcgccggcgagaaggcgcugaaacucagcugguucaagaagggguccagcaucggaaagauguuugaggcaaccgccagaggggcccggcgcauggccauacuaggcgacacggcgugggacuucggguccaucggagggguguucacuagcgugggcaagcugguucaccagaucuucggcacagcguacggcgugcuauucucggguguuagcuggacgaugaaaauagggaucggggucuugcugacuuggcucggacuaaauucccgcuccaccucccugagcaugaccugcaucgccguuggccucgugacgcucuaucugggggugauggugcaggcugacuccggaugcgugaucaacuggaagggucgggagcugaagugugggagcggaauauucguaaccaacgaggugcacaccuggacggagcaauacaaguuucaggccgacagcccuaagcgccucuccgccgccaucggcaaagccugggaggagggcgucuguggcauacggagcgccacccgccuggagaacaucauguggaaacagauauccaacgaguuaaaccacauccugcuggagaacgacaugaaguuuacugucguuguaggugacguggccggcauccucgcgcaaggaaagaaaaugauccggccccagccaauggaguacaaguauuccuggaagucguggggcaaagccaagaucaucggagccgacgugcagaacaccaccuuuaucauugacggccccaacaccccugaaugccccgacgaccagcgcgccuggaauaucugggagguggaggacuacgguuucgggaucuucacgaccaacaucuggcugaagcuacgggacucguacacccaggugugcgaccaccgauugauguccgcagcuaucaaggacagcaaagccgugcacgcagacaugggcuacuggauagagagcgagaagaacgagacuuggaagcuggcacgagcgucauucaucgaagugaagacgugcaucuggccaaagucccacacccuguggucgaauggggucuuagaguccgaaaugaucauccccaagauauacggggguccgaucagccagcacaauuaccguccuggguacuucacccaggccgccggccccuggcaccuggggaaauuagagcucgacuucgaucugugugaaggcacgacuguaguggucgacgagcacugcggcaaccgggggccauccuuaagaaccaccacuguaacaggcaaaaucauccacgaaugguguugccggaguugcacacugccgccccuccgcuucagaggggaagacgguugcugguacgggauggagauaagacccgugaaggagaaggaggagaaccugguaaaguccauggugucugccggcucuggcgaagucgacucauucagccucggacugcugugcaucuccaucaugaucgaggaggucaugagaagccgauggucccgccgcaugcucaugaccggcaccuuggccgucuucuucuuacuuaucauggggcaguuaacauggaacgacuugauacgccucugcaucauggugggcgcgaacgcgagcgacagaauggggaugggcacuaccuaccuggccuuaauggccacguucaagaugcgcccgauguucgccgucggguugcuauuccggaggcugacgucccgggaagugcuccugcuaaccaucgggcucagccugguggccuccgucgaacucccaaacagccucgaggaacugggcgacgggcuggccaugggcauaaugauccucaaacuucugacggauuuucagagccaccagcucugggccacccugcugagccucacauucaucaagaccaccuucucccugcauuaugccuggaagacaauggcgauggugcuaagcauugucucccucuucccccugugccugucgacgaccucccagaaaaccaccuggcuccccguccuacucggcagccuugggugcaaaccgcugacgauguuucugaucgcugaaaacaaaaucuggggccgccguuccuggccgcuaaacgaggggaucauggcagugggcaucgucagcauuuuacugagcagucuccuuaagaacgaugugccuuuagccggaccgcucaucgccggcggcaugcugaucgcgugcuaugugauaucgggguccucggccgaccugagucuagagaaggcagccgaagucuccugggaggaggaggcagagcacuccggcgcgagccacaacauccugguggagguccaagacgacgggaccaugaaaauuaaggacgaggagcgcgacgacacccugaccauccuccugaaggcuacgcugcucgccgucagcggcguguacccuuuaagcauccccgccacgcuguucguaugguacuuuuggcaaaagaagaagcagcguagugggguccucugggacaccccaucuccgcccgagguagagcgggccgugcuggacgacgguaucuaccgcaucaugcagcgcggacuacuuggcaggucccaggucggcguggguguguuccaagagaaugucuuccauacgauguggcacgugacccgcggagcggugcucauguaucaagggaagcgucuggaacccucuugggccuccgucaagaaggaccuaaucagcuacgguggcggauggcgucuccagggcuccuggaacaccggggaggaaguucaggugauugcaguugagcccggcaagaacccgaagaacgugcagaccgcucccgggaccuucaagacccccgagggcgaggugggcgcgaucgcguuagauuucaagcccgggacgagcggaucccccaucguuaaccgggaggggaaaaucguugggcuguacggaaacgggguggucaccacaagcggcaccuacguuagcgccaucgcucaggcaaaggccucccaggaggggccgcucccggagauagaggaugagguguucagaaagcggaaccugacgaucauggauuuacaccccgggagcgggaaaacccguagauaccucccggccauuguccgcgaggccauuaagaggaagcugcggacacugauacucgcucccacccgcguaguagccuccgagauggccgaggcccugaaaggcaugcccaucagauaccagacaaccgcagucaagucggagcacaccgggaaggagaucguggaccugaugugccacgccaccuucacgaugcggcuccugucccccguccgagucccuaacuacaacaugaucauaauggacgaggcucacuucacggaccccagcucaaucgcggcgagaggguacaucagcacccggguggguaugggcgaggccgcugcaaucuucaugacagcgacgccgcccggauccguggaggccuuuccgcagucaaacgccguaauccaggacgaggaacgcgauauccccgagcgguccuggaacucaggcuaugaguggaucaccgacuuccccgguaagaccgugugguuugugcccuccaucaagucuggcaacgacauugccaauugucugcgcaagaaugggaagcgggucauccaacucuccaggaagacuuucgacacggaguaccaaaagaccaaaaacaacgacugggacuacguggucaccaccgacaucagcgaaaugggcgcgaacuuccgggccgaucgcgucaucgacccgcggcgcugccugaagcccgucauucugaaagaugggcccgagcguguuauccucgccggcccgaugccggucacagucgccuccgcugcgcagcgaagagggcggaucggccgcaaccauaacaaggaaggagaccaguacaucuacauggggcagccccugaacaacgacgaggaucacgcccacuggaccgaagccaaaauguugcuggacaacaucaacacccccgaaggcaucauaccggccuuguucgagcccgagcgggagaaauccgccgcgaucgacggggaguaccgccugcgcggcgaagcgcgcaagaccuucgucgagcucaugcggagaggggacuuaccuguguggcuguccuacaagguggcauccgagggcuuccaguacagcgaccggcgcugguguuucgacggggagcggaacaaccaggugcucgaagagaacauggacguagagauauggacgaaggagggggaacgcaagaaacuucggccccgauggcuagacgcccggacauauuccgacccccucgcccugcgggaguucaaagaguuugcagccggccgacgcagcgugagcggugaucugauacucgagaucgggaagcugccccagcacuugacccagcgggcacagaacgcccucgauaaccuggucaugcugcauaacagcgagcaaggcggccgugcuuaucgacacgccauggaggagcuccccgacaccauagagacgcuaaugcugcucgcccuuaucgcugugcucacaggagggguuacucucuucuuccuguccggccgcgggcugggaaagacgagcaucggccuccuuugcgucauggccagcagcgugcugcucuggauggccuccguggagccccacuggaucgccgccucuaucauccuggaguucuuccugaugguccuccugaucccagagccugauaggcagcgcacgccccaggacaaccagcucgccuacguagugaucgggcuccuauucaugauccugacgguggccgcaaacgaaaugggcuugcuagaaaccacgaagaaagaccuaggaauaggccacgucgccguggaaaaccaccaccaugccgcuaugcucgaugucgaucugcaccccgcgucagcguggaccuuauacgccguggcaacaacgaucaucacaccgaugaugcggcauaccauugagaauacgaccgcuaacaucagccucaccgcuaucgcgaaccaagcagccaucuugauggggcuggacaagggcuggcccaucucgaaaauggauauaggcguaccucuccuggccuuagggugcuacagccaagucaacccccugacccugacagcggcagugcugaugcucguggcccacuacgccaucaucggcccuggccuacaggccaaggcgacccgggaagcccagaagcgcaccgccgccggcaucaugaagaaccccaccgucgacgggaucguggccaucgaccuggacccugugguauacgaugcgaaguucgagaaacaacucggccaaaucaugcuacugauacucugcacuucccagauccuguuaaugaggaccaccugggcccucugcgaguccauuaccuuggccacgggcccgcugacuacccuuugggaggggagcccaggcaaguucuggaauaccaccaucgcgguaucaauggccaauaucuuccgcggguccuaccuagcgggcgccggauuagcguuuucgcucaugaagucccucgggggcgggcgccgcgggaccggggcccagggcgagacccugggcgagaaguggaagaggcaauuaaaccagcuauccaagagugaguucaacaccuacaagagguccggcauuauggagguagacagaagcgaggcuaaggagggccugaagcggggcgagacgacaaagcacgcggucucccggggcaccgccaaguuacgcugguucguggaacggaaccuugucaagcccgaagggaaggucaucgaccugggcugcggucgcgggggauggagcuacuacugcgccgggcugaagaagguuacugagguuaaggguuauacgaaagggggucccggccaugaagaacccaucccuauggccaccuauggguggaaccucgucaaacugcacuccggcaaggacguguuuuucauuccacccgagaagugcgauacccuguuaugcgacaucggugagucaucccccaacccuacaaucgaggagggccggacgcuacgugugcugaagauggucgagcccuggcuccgggggaaccaguucugcauaaaaaucuuaaaccccuacaugcccucagugguggaaacccuggagcaaaugcagaggaaacacggcggaaugcucguccggaacccgcuguccaggaacagcacccacgaaauguauuggguguccugcgggacuggcaacauagugagcgcggucaauaugaccucacgcauguuacucaaucgcuucacuauggcccaccgcaagccgacuuaugaacgagacguggaccugggagccggcacccgccacguggccgucgagcccgaaguggcaaaccuggacaucauaggccaacggaucgagaacaucaagcacgagcauaagaguaccuggcauuaugacgaagacaaccccuauaagacaugggcguaccacgggucuuacgagguaaaaccuaguggcuccgccagcagcauggucaacggugucgucaagcuccucaccaagccgugggacgugaucccaauggugacccagaucgcgaugaccgacacuacccccuucggccagcagagagucuucaaggagaagguugacaccagaaccccuaaagccaagcgagggacggcucaaauaauggaggugaccgcgaaaugguuguggggauuucuaucccguaacaagaagccccguaucugcacccgggaggaguuuacaagaaagguccggucgaacgccgccauaggcgcaguuuucguggacgagaaccaguggaacucugcuaaggaggcggucgaggacgaaagguucugggaccuggugcaucgggagcgggaacugcacaaacaggggaagugcgccacuugcguuuacaacaugauggguaaacgggagaagaagcucggggaguucggaaaagccaaggguucucgcgccaucugguacauguggcugggugcucgauuccuggaauuugaggcccucggguuuaugaacgaggaccacugguuuucccgcgagaacucacuguccggugucgagggggaggggcugcauaagcucggguacauucugcgggacaucucuaagauaccagggggcaacauguacgccgaugacacagccggcugggacacucgcaucaccgaggaugaccuucagaaugaggcccgcaucacagacauuauggagccugagcacgcacuccuugccaagagcauuuucaagcugaccuaccaaaacaagguggugcggguacagcguccugcgaagaacgggaccgucauggacgucauuagccggcgcgaucaacggggcuccgggcaggucgguaccuacggccucaacacguuuacgaacauggaggcccagcugauacgccagauggagagcgagggcauuuucucccccucggaauuagagaccccaaaccuugccgagcggguguuagauuggcuggagaaauacggcguggagcgccucaagcggauggccaucucgggggacgacugcgucgucaagcccaucgaugaccgcuuugccaccgcccugacggcacugaacgacaugggcaaggugcggaaggacauuccucagugggagcccagcaagggguggaaugacuggcagcaggucccauucugcucgcaccacuuccaucagcucaucaugaaggacggccgugagaucguggugccgugccguaaucaggacgagcuggucgggcgcgcccgggugagccagggggcgggguggagccugcgcgagacagcgugccugggaaaauccuacgcucagauguggcaguugauguacuuucaccggcgcgacuuacggcuagccgcgaacgccaucuguagcgcagugcccgucgacuggauacccacauccaggaccacauggagcauucacgcccaucaccaauggaugaccacagaggacaugcuuagcgucuggaaccgcguguggauagaagaaaacccuuggauggaggacaagacccauaucucgaguuggggcgacguccccuaucuggggaagcgggaggaccaauggugcggcagccucauaggccugacggcccgcgcuaccugggccacuaacauacagguggcaauaaaccagguucggcgccugaucgggaacgagaauuaccucgacuauaugacgucaaugaagcgguucaaaaaugaaagcgaccccgagggcgcccugugguag

SEQ ID NO: 24283 - RNA, 9879 nt, Artificial Sequence
  derived and/or modified CDS sequence (opt11) from DENV-1__FJ898384__SS-prME
agcguuacuaugcugcucaugcugaugcccaccgcgcuggccuuccacuugacuaccagaggcggggagccccacaugaucgugagcaagcaggagagaggcaagagcuuacuguucaaaaccagcgccggugugaacaugugcacccucaucgccauggaccugggcgaguucugcgaggacacgaugacguauaagugcccccggaucaccgaggcagaaccagacgacguggacuguuggugcaaugccaccgacacaugggucaccuacgggaccugcagccagacaggggagcacagacgggauaagcgauccguggcgcuggcgccccacgugggacuaggccuggagacaagaacagagaccuggaugucguccgagggugccuggaagcagauccagcgcguugagaccugggcgcugaggcaccccggguucacaguuaucgccauuuuucucgcgcacgcaaucggcaccaguaucacccaaaaggggauuaucuuuauacugcugauguugguaacccccuccauggccaugcggugcgucggcaucggcagccgcgacuucguggaggggcugaguggcgccacguggguggacguuguguuggagcacgguucaugcgugaccaccauggccaaggacaagcccacccucgacauugagcugcugaagacggaggucacaaaccccgcgguucuccgaaagcuuuguaucgaggccaagaucuccaacacaaccaccgacaguagauguccaacccaaggcgaggcgacccugguggaggaacaggacgccaacuucgucuguagacggacuuucguugaucguggcuggggaaacggcuguggccuuuucggcaaggggucccugaucacuugcgccaaguucaagugcgucaccaaacuugagggaaagaucguccaguacgaaaaccucaaguacaguguaaucgugacaguucacaccggcgaucaacaccaagugggcaacgaguccacggagcauggcaccacugcgaccaucaccccacaggcuccuagcacggagauccaguuaaccgacuacggcgccuuaacuuuagacugcucaccccggacuggccuggacuucaacgaaaugguccugcucacgaugaaagagaaauccugguugguucauaaacagugguuucuggaccucccgcuccccuggaccuccggagccuccacuagccaggagaccuggaaccggcaggacuugcucgugacguucaagaccgcccacgccaagaagcaagaggucguggugcugggaucccaggaaggcgccaugcacaccgcccuuaccggggcgacugagauccagacgucaggcaccacaacuaucuucgccggucaucucaagugucgccuuaagauggauaagcugacacucaaggggaugagcuacgucaugugcacggguuccuucaagcuggagaaggagguggcagagacccagcauggcacgguguugguccagauuaaauacgaaggcaccgaugcccccugcaaaaucccauucaguacccaggacgaaaagggcgugacccagaacggcagacucauuaccgccaacccaaucgugaccgacaaggagaaaccagucaauaucgaggccgagccgccuuucggggaaagcuacaucgugaucggugcgggcgaaaaggcccugaagcuauccugguucaagaaagggagcuccauaggaaagauguuugaggcaacagcccgcggggcucggcguauggcgauacugggcgacaccgcuugggauuucgggucgaucggcgguguguuuacgucaguuggcaagcucgugcaucagaucuucggcaccgcauacgggguacuguucagcggaguauccuggaccaugaagaucgguaucggcguuuuacucaccuggcugggcuuaaacagccgcuccacgagucuauccaugaccugcauagcaguugggcuugucacccuguaccuuggagugaugguacaggcugacuccgguugcgucaucaauuggaagggacgggagcugaagugcgguagcggaauuuucgucacuaacgaggugcauacauggacggagcaguacaaguuucaggcggauucaccgaaacgccuaucugcagccaucggcaaagccugggaggagggggucugcggcauccggagcgccacccgccucgagaacaucauguggaagcagauuagcaacgaguugaaccauauacugcucgagaacgacaugaagcugaccgugguagucggcgauguugcuggcauucuggcccaagguaagaaaaugauccggccccaacccauggaauacaaauauucauggaagucauggggcaaggcgaagauuaucggcgccgacguucagaauaccacguucaucaucgaugggcccaacacccccgagugccccgacgaccaacgggcguggaauauaugggaggucgaagacuacggcuucgggauuuucacuaccaacaucuggcucaaacuacgggacuccuacacccagguuugcgaccaucggcugaugucagccgccauaaaggacucaaaggccgugcacgcggauaugggcuacuggaucgagagcgagaaaaacgaaacguggaagcucgcacgggcuuccuucauagaagucaagacaugcaucuggcccaagagccauacacugugguccaacggaguucuggagucggagaugaucauaccaaaaaucuaugggggcccaauuucccaacacaacuaccgacccggguacuucacgcagaccgccggccccuggcaccucggcaagcucgagcuggacuucgaccucugcgagggcaccaccguggucgucgacgagcacugcggcaaccggggaccgagccuacgaacgaccacagugacuggcaagaucauucacgaguggugcugccgguccuguacgcugccgccccuaagguucaagggugaagacggcuguugguaugguauggagauccggccugugaaggagaaagaggagaaccugguaaaguccaugguaagugcugggucgggagaggucgacucguucucccucggacuccuguguauuagcaucaugaucgaagaaguuaugcguucucgguggagccgcaaaaugcugaugaccgggacccucgccguguucuuccuauugauaauggggcagcuuaccuggaacgauuuaaucagguuaugcauuaugguuggcgccaacgcuuccgaccgcaugggaaugggaacgaccuaccuggcccugauggccacguucaagaugcgcccaauguucgcggucggacucuuauuccggcggcucaccagccgggagguguugcucuugacgaucgggcugucccuaguugcuagcguggaacugccgaacuccuuggaggagcugggcgacgggcuugccaugggcauuaugauacugaaguugcugaccgacuuucaaagccaucagcugugggccacgcuacugucgcugacauucauccggacgaccuucucucugcacuacgccuggaagaccauggcgaugguccuguccaucguaagccuguuuccgcucugccuuucgaccacgagccaaaagaccaccuggcuacccguacuccugggcucccuggggugcaagccccucaccauguuccugaucgcagagaacaaaaucuggggccgcaagucauggccccucaacgaggguauaauggccguaggcaucgucaguaucuugcuaucaucucugcugaaaaacgacguuccccuugccgggccgcucaucgccggcgguaugcuuauagcgugcuaugucauuuccggguccagugccgauuuaucccuggaaaaggcagcugagguguccugggaggaggaggccgagcacagcggcgccucccacaacauccucguggagguccaggacgaugggacgaugaaaaucaaggacgaggagcgcgacgauacucugaccauucugcucaaggccacccugcucgcugucaguggcgucuacccguuguccaucccggccacucuguucgucugguauuucuggcagaagaagaaacagagaagcgguguccugugggauacgcccucgccgcccgagguggagcgcgcaguccucgacgacggcaucuacaggauaaugcagcgcgguuuguuggggcguagccaggugggagugggggucuuccaagagaacguguuccauaccauguggcacgucaccaggggcgcgguucugauguaucagggcaagcggcucgagcccuccugggccucagugaaaaaagauuuaaucuccuacgguggcggauggcgacuacaggggagcuggaacaccggggaggaagugcagguuaucgccguggaacccgguaagaaccccaagaacgugcagacggcccccgggacauucaaaacuucugagggcgagguaggugccaucgcgcucgauuucaagccugggaccaguggcagccccaucguuaaccgggaggggaagaucgugggccuguacggcaacggggucgugacgaccucggggaccuacgucuccgccaucgcccaagccaaggcgucccaggaggggcccuugccggagaucgaggacgagguguuccgcaagagaaaccugacgaucauggaccugcaccccgguagcgggaagacgcgccguuaccugccugcgauuguucgcgaggccauaaagcggaggcuccgcacccugauacucgcacccacccgggucguagcauccgagauggcggaggcccucaagggaaugcccauccgcuaccagaccacagcagucaagagcgaacacaccggcaaagagauuguggaccuuaugugccaugccaccuucaccaugcggcugcucagccccguccgugugccaaacuacaacaugauuaucauggacgaggcccacuuuacggacccgucgucuaucgcggcuagagguuacaucagcacccgugugggcaugggagaggcugcagccauuuucaugaccgcgacgccgccaggcagcgucgaggccuucccccagagcaaugccguuauacaggacgaggagcgggacauuccagagcguuccuggaacuccggguacgaauggaucacggacuuccccggcaagaccgucugguuugucccauccaucaagagcggcaacgauaucgccaacugccugcggaagaacggaaagcgcgugauacaguuaucacggaaaacauucgauaccgaguaccagaaaacaaagaacaacgacugggacuacguggucaccaccgauauaagcgagaugggcgcgaacuucagagccgaccgagugauagauccccgcagaugccuaaagccggucaucuugaaagacgguccugagaggguuauucucgcgggccccaugccaguuacggucgccucugcugcgcagcggcgugggaggaucggccgcaaccacaacaaggagggcgaccaguauauuuacauggggcagccgcucaacaacgacgaggaccacgcccauuggacagaggccaagaugcuccuugacaauauaaacaccccugagggaauaauccccgcgcuguucgagcccgagcgcgagaaauccgccgcaaucgacggggaguaccgguugagaggcgaagcccggaagaccuucguagagcugaugcgccgcggagaccuccccguguggcuguccuacaaggucgcguccgagggauuccaguacucggaccgccgcugguguuucgacggcgaacggaacaaucaagugcuggaggagaacauggacguggagaucuggacuaaggagggcgagcggaagaagcuccggccccgguggcuggacgcaaggaccuacagcgacccacuggcucuccgggaguucaaggaguucgcggcaggccggcgcaguguguccggggaccucauucuggagaucggcaagcucccucagcaccugacccagcgcgcacagaacgcauuggacaaccucguaaugcuacacaacagcgagcaaggugggcgcgcguaccggcacgccauggaggaguuaccugacaccauugagacucucaugcugcuagcacucauagccguguugacgggcggggucacccuguucuuccucaguggucgggggcuggggaagacgagcaucggccugcucugcgugauggccagcagcguucuccuguggauggcgucugucgagccccacuggaucgccgccucaaucauccucgaguucuuccucauggugcuacucauaccagagccggacagacagcggaccccgcaggacaaccaacuggcauacguggucaucggccuccucuucaugauccuuaccguggccgcgaacgagaugggccuccuagagacgaccaaaaaggacuuagggaucggccacguggccgucgagaaucaccaccacgcugccaugcucgacguggaccuccaucccgccuccgcguggacccuguacgcaguggccacgacgauaauaaccccaaugaugcgccacaccaucgaaaacaccacugccaacaucucucugaccgccauagcaaaucaggccgcgauccugauggggcuggauaagggcuggccgaucaguaaaauggacaucgguguccccuugcucgcccuggguugcuacucucaggucaauccacugaccuugacagcggccgucuuaaugcugguugcccacuaugccauaaucggcccgggauugcaagccaaggcuacacgcgaggcccaaaagcggacggccgccggcauaaugaaaaaccccacugucgacggcaucguagcuaucgaccuggaccccgucguauacgaugccaaguuugagaagcaauuaggccagaucaugcuccugauucugugcaccucccagauccuucugaugcgcacgacaugggcccugugugaaagcauuacccucgccaccgggccauuaaccacccugugggagggguccccuggcaaguucuggaacaccacaauagccgugagcauggccaauauuuuccgagggagcuacuuggcgggcgccggacuggcuuucucccugaugaagucccucgggggcgggcgucggggcacgggggcccagggagaaacgcuaggcgagaaauggaagcgacagcucaaucaauuauccaagagcgaguucaacaccuacaagcggagugggaucauggaaguugaccggagcgaggcgaaggagggucugaagcgcggggaaaccacaaagcacgccguuucucgcggcacagccaagcuucggugguucguggagcgcaaccucgugaaaccugaggggaagguuaucgacuugggaugcggccgcggcggauggagcuacuacugcgccggucuuaagaaggugaccgaggucaagggguacaccaaaggcggacccggccacgaggagcccauccccauggccacauauggguggaaccucgugaaguuacacucugguaaggacguguucuucaucccgcccgagaaaugcgacacccuccuaugugacaucggggaaaguucucccaauccgacuaucgaagagggccguacucuccguguacugaagaugguagaaccgugguugcgagggaaccaauucugcaucaagauccucaaccccuauaugcccagcguggucgagacauuagagcaaaugcagcgaaagcacggugggaugcugguccgcaauccccucucccgaaacagcacccacgaaauguacuggguguccugcgggaccggcaacaucguguccgccgugaacaugaccuccagaaugcugcugaaccgcuucaccauggcgcaccggaagccaacguacgagcgcgacgucgaccucggggccggcacccggcauguagccguagagcccgagguagccaaccucgacauaauuggucaacggaucgagaacaucaagcacgagcacaaguccacguggcacuacgacgaagacaaccccuauaagaccugggcguaccacggguccuacgagguaaagccuagcgggagugccaguaguauggugaacggggucgugaagcuacugacuaagccaugggacgugaucccgauggucacgcagaucgcaaugaccgacaccacgcccuucggccagcagagaguguucaaagagaagguggauacccgcacucccaaggccaaacgugggaccgcccagauaauggaggugacggcgaaguggcuauggggcuuucugucccgcaacaaaaaaccgcgaaucuguacuagggaggaauucacucggaaagucagaagcaacgccgccaucggcgcuguguucgucgacgagaaccaauggaauuccgccaaggaggccguggaggacgagcgcuucugggaccucgugcaccgcgagcgggaguugcacaagcaggggaagugcgcaacuugcgucuacaacaugaugggcaaaagagagaaaaagcugggugaguucggcaaggccaaggggagccgggcgauuugguauauguggcuuggggcgcgcuuccuggaauucgaggcuuugggcuucaugaacgaggaccacugguucucucgagaaaauucucucuccggcguggagggggagggguugcacaagcugggcuauaucuugcgugauaucagcaagaucccggggggcaauauguacgccgaugauaccgcagggugggacacccggaucacugaagacgaccugcagaaugaggccaagaucacggacaucauggagcccgaacacgcgcugcucgcuaaguccaucuucaagcuuaccuaccagaauaaggucguccggguucagcgcccggcgaaaaacgggacggugauggacgucaucagccggcgcgaccaaaggggaucaggucaggugggcacguacggccucaauaccuucacgaacauggaagcacagcucauucgccagauggaaucugaggggauuuuuucccccagcgagcuggagacccccaaccuggccggccgcguacucgacuggcuugagaagcacggggucgagcgccugaagcgcauggcgauaaguggugaugacugcgugguaaagccaauugacgaccgcuuugccaccgcgcucaccgcccugaacgacauggguaagguccguaaggauaucccccagugggagcccagcaagggcuggaaugacuggcagcagguccccuucugcucucaucauuuucaucagcugaucaugaaggacggccgcgagaucgugguacccugccggaaccaggacgagcucguagggcgcgcuagggugucucagggcgcgggcuggagccugcgcgaaacggccugccuagggaaguccuacgcccagauguggcaguuaauguauuuccaucggcgcgaccugcgucuggcggcgaacgcgaucugcagcgccgucccgguggauugggugccaacuuccaggaccacguggagcauccaugcgcaccaccaguggaugacgaccgaagauauguugucugucuggaaccggguguggaucgaggagaaccccuggauggaggauaagacccacguuucuuccuggggcgauguccccuaucuggggaagcgcgaggaccaguggugcgggucccugaucgggcucaccgccagggcgacuugggccaccaacauucaggucgccauaaaucagguccggcgccuucuggggaaugaaaauuacuuagauuacaugaccuccaugaagcgcuuuaagaacgagucagacccggaaggggcccugugguga

SEQ ID NO: 24284 - RNA, 9879 nt, Artificial Sequence
  derived and/or modified CDS sequence (opt11) from DENV-1__FJ898385__SS-prME
agcgugaccaugcuguuaauguuaaugccaacggcccucgcuuuccaucuuacuacccggggcggggagccccacaugauuguuacgaagcaggaacggggcaaaagccugcuuuucaagaccagcgcggggguuaacauguguaccuuaauagccauggaucugggcgaacuaugcgaggacaccaugaccuauaagugcccccgcaucaccgaggcugagccugaugauguugacugcuggugcaaugccacggauaccuggguuaccuacgggaccuguucccaaacuggcgagcaccggcgugacaagcggagcguggcccucgccccacacgugggcuuggggcuggaaacaaggacugagaccuggaugucgagcgagggcgccuggaagcagauccaacggguagaaacgugggcccuccgccaccccggguucaccgugauagcccuuuuccuugcccacgccauagguacguccaucacccagaaagggauaaucuucauccucuugauguuggugacgccuagcauggcaaugcggugcgugggcauagguucccgcgacuucguggaggggcucucuggugccaccuggguggacguagugcuggagcaugggaguugcgugaccaccauggccaaggacaagcccacccuggauauugagcuccugaagaccgaggucaccaaccccgcugugcugcguaagcucugcaucgaggccaaaaucagcaacacaaccaccgacucccgcugucccacccagggugaggccacacugauggaggagcaggacgccaacuucgugugccggcgcacguucguagaccggggcugggggaauggcugcgggcuguucggcaaagggagccucauuacgugcgcgaaauucaaguguguaacaaaauuagagggcaagaucgugcaguaugagaaccugaaguacuccgucauugugaccgugcacaccggagaccagcaccaagucggcaaugaguccacagagcacgggaccaccgcgacgauuacgccccaggcccccacgagugaaauccagcucacagacuacggugcuuuaacucuggacugcagcccccggacgggccuugauuucaacgaaauggugcuucugaccaugaaggagaagucaugguugguccacaagcaaugguuuuuggacuugccgcuccccuggacguccggggcguccaccucacaagagacguggaaccggcaagaucugcuagugacuuucaagaccgcccaugcgaagaagcaggaggucgucguacucggcagccaggagggcgccaugcacaccgcccugacuggggccaccgagauccaaaccuccggcacgacgacgauuuucgccggacacuugaaaugcaggcucaagauggauaagcugacucugaagggaaugagcuacgugaugugcaccggguccuucaagcucgaaaaggaggucgcggagacgcaacacggcaccgugcuggugcagaucaaguacgaaggcaccgacgccccgugcaagauccccuucagcacgcaggacgagaaggggguaacgcagaacggccgccugauaaccgccaauccgauugugaccgacaaggaaaagccugugaauaucgaggcugagccgccguucggggaguccuacauuguuaucggggcgggggagaaggcccugaagcuuagcugguucaaaaaggggagcagcauaggaaagauguucgaggccacggcccgcggcgcacggcgcauggcgauccugggcgacacggccugggauuucggcucaaucggcggcguguucaccagcguggggaaacucguccaccagauauucggcacagccuacgggguccuguucuccggcgucagcuggaccaugaagaucgggaucggcguccugcugacguggcucggacugaacucucgcagcaccuccuuaagcaugaccuguauagcaguagggcucgugacccucuaucuaggcgucauggugcaggccgauuccggcugcgugauaaauuggaagggccgggagcucaagugcggaucaggcaucuucgucacgaacgagguccacaccuggaccgaacaguacaaauuccaagcugauagcccgaagagacuguccgcggccaucgggaaggcgugggaggagggcgugugcggaauccggagcgcuacccgccuugagaacaucauguggaagcaaaucagcaacgaguugaaccauauccuucuggaaaacgacaugaaguucaccguggucgucggcggugucguggggauccucgcacaggggaagaaaaugauccggccccagcccauggaacacaaguauagcuggaagucaugggguaaggcaaagaucaucggcgccgacgugcagaacacuaccuucaucaucgacggacccaauaccccggagugcccagacgaccagcgcgcguggaacaucugggagguggaggacuacggauuuggaaucuucaccacgaacaucuggcugaagcugcgagacucuuacacucaagugugcgaccacaggcuaauguccgcggccaucaaggacagcaaggccgugcacgccgauaugggcuacuggaucgaguccgagaagaacgagacuuggaagcuggccagggcgagcuucaucgaagucaagaccugcauauggccgaaaagucacacacuguggagcaaugggguacucgaguccgagaugaucauccccaagaucuacggcgggccaaucagccaacauaacuaccgccccggauacuucacgcagaccgcuggacccuggcaucuggguaagcuggagcucgacuucgaucuuugcgagggaacuacgguggucguagacgagcacugcgggaaccggggcccgucucuucgcaccaccaccguaacggggaagaucauccacgaauggugcugccggagcugcacccugccuccguugagguuuaagggcgaagaugggugcugguacggaauggagauccggccggucaaagagaaggaggagaaccuggugaaguccauggugagcgccggcagcggggagguugacuccuucucccucggccugcugugcaucucuaucaugauagaggagguuaugcguagccgguggagccgcaagaugcucaugaccgggacccuagccguuuuccugcuccuuaucauggggcaauugacuuggaacgaucucauucggcuguguaucauggucggggcuaacgcaagugaucgaaugggcaugggcaccaccuaucuggccuuaauggccacguucaagaugcgcccuauguuugccguagggcugcuguucagaagacucacgucccgggagguacugcugcucacuaucgggcugucacuggucgccucgguugaacuccccaacagccuugaggagcugggcgacggccucgccauggggauuaugauccuaaagcuauugacugacuuucagagucaccagcugugggcgacccugcucagccuaacguucaucaagaccacccuauccuuacacuacgccuggaaaaccauggccaugauccuaaguaucgucucccuguuuccccuuugucucagcacgaccucgcagaagaccaccuggcugccugugcuacuggggucguuaggaugcaagccgcucacgauguuccuaauagcggagaacaaaaucuggggucggaaguccuggccgcugaacgagggcauuauggcaguggggguggugagcauccuuuuaagcuccuugcuuaagaacgacguucccuuagccggaccccugaucgccggcggcaugcucaucgccugcuacgucauaagcggcucuagcgcugaccugucucuagagaaagccgccgaggugagcugggaggaagaagcagagcacuccggggccagccauaacaucuugguggaaguacaggacgauggaaccaugaagaucaaggacgaagagcgggacgacacccugacuauccugcucaaggcgacccugcuagcuguguccgggguguacccccucagcauacccgcuacgcuguucgucugguauuucuggcagaagaagaaacagcgaucgggggugcugugggacacccccuccccgcccgaaguggaacgagccguccuggacgauggcaucuaccgcaucaugcagcgggggcuacugggacgaucccaagugggugugggggucuuccaggagaacguguuccacacgauguggcacguuacccguggggcuguccugauguaucaggggaagcgauuggagccaagcugggcgucagugaagaaggaccuaauuuccuauggcgggggguggcgccugcagggguccuggaacaugggcgaggagguacaagucaucgccguggagcccgggaagaaccccaaaaacguacagacagcccccggaacuuucaagacccccgagggcgagguaggcgcgauugcucucgauuucaagccgggcaccagcgggagccccauugucaaccgugaaggcaagauuguuggucuguacgguaacggagucgugacgaccagcggaaccuaugugucggcaaucgcccaagccaaggccucccaggagggcccgcuccccgagauagaagacgaggucuuccgcaaacgcaaccucaccaucauggauuuacacccggggaguggcaagacgcggagauaucucccggcgaucgugagagaagcuaucaagcgcaagcuccggacacugauccuggcacccacccgcgugguggccuccgagauggcagaggcgcucaagggcaugcccauccgcuaccagacuacagccguaaagagcgagcacaccgguaaagaaaucguggaccugaugugccacgcaacuuucacaaugcgacugcucucccccguccgagugccgaacuacaauaugauaauaauggacgaggcccacuucacggacccuagcuccauugccgcacggggcuacauaagcacgagaguggggaugggcgaggccgccgcgaucuucaugaccgccacgccgccggggucggucgaagccuucccucagagcaaugccgugauacaagacgaggaacgugacaucccugagagguccuggaacucuggcuacgaguggaucacggacuuccccggcaagacagugugguucguccccaguaucaagagcgggaacgacaucgccaacugccugcggaaaaacggcaagagggugauccaauugucgcggaagacuuucgacacggaguaucagaagacgaagaacaacgacugggacuacguggucacgaccgacauaagcgaaaugggggcuaacuucagagcggaccgagucaucgacccgcgccgcugccuaaaaccugugaucuugaaggacgggccagagcgcgucauccuagcuggccccaugcccguaaccgucgcuagcgccgcucagcggcgcgggcggaucggccgcaaccauaacaaggagggggaucaauacaucuacaugggccaaccgcucaacaacgacgaggaccacgcgcacuggacggaagccaagaugcugcuggacaacauaaauacuccggagggcaucauucccgccuuguucgagccugagcgggagaagagugccgcuaucgauggcgaguacagguugcgcggggaggcgcggaagaccuucguggagcugaugcgccggggcgaccuccccguguggcuguccuauaagguggcuucugagggcuuucaguacucagacagacgguggugcuucgauggggagaggaacaaccagguacuggaggagaauauggacguagagaucuggaccaaggagggcgagcggaagaagcuccgcccccgcuggcuggaugcacgcacguacucugauccccuggcgcucagagaguuuaaggaguuugcagcggggaggcggucggucucaggcgaccuuauccuggagauuggcaaguugccgcagcaucugacccagcgggcccaaaacgcucuggauaaccucguuaugcuccacaacagcgagcagggcgggcgggccuaccgccaugccauggaggagcugccggacaccaucgagacccucaugcugcuggcccucaucgccgugcugaccgggggagucacccuguucuuucuuagcgggcggggccuaggcaagacgagcaucggguuauugugugugauggccuccuccgugcuccuguggauggccuccgucgagccucacuggauagcggccagcaucauacucgaguucuucuuaauggugcugcucaucccagagccggaucgccagcggacuccccaggacaaucagcucgccuacguggucaucggccuccucuucaugauacugaccgucgcugccaacgagaugggccugcucgagacgaccaagaaagaccugggcaucggccacguggcaguugagaaccaccaccacgcaaccauguuagauguggaccuccaccccgccuccgcuuggacgcuguacgccguggcgaccaccaucaucacuccgaugaugcgucacaccaucgagaacacuacugccaacaucucuuugaccgccaucgccaaucaagcugcgaucuuaaugggacucgacaaaggcuggccaaucagcaaaauggacaucggagucccccuccucgccuuagguugcuacagccagguuaacccucucacccucacggcugcggugcugaugcugguugcgcacuaugcaaucaucgggccgggcuuacaggccaaggccacgcgggaggcccagaagcggaccgcggccgggauuaugaagaaccccacgguggacggcaucguggcaauagaccuggaccccgucguguaugacgcaaaguucgaaaagcagcugggccaaaucaugcuccugauccucugcacgucccagaucuuacugaugcgcaccaccugggcgcugugugaaagcaucacccucgcgacggggccccugaccacccucugggaaggaagcccugggaaguucuggaacaccacgaucgcugugucuauggccaacaucuuccggggcucauaccucgccggcgccggacuggcuuuuagccugaugaagucccucggugggggacgccgcgggaccggcgcacagggcgagacacugggggagaaauggaagcggcagcugaaucaacucuccaaguccgaguuuaauaucuacaagcgcuccgggaucauggaaguggaccgcagcgaggcaaaggaggggcugaagagaggcgaaaccacucgccacgccgugucccgcggcaccgcgaaacugaggugguucguugagaggaacuuagucaagcccgagggcaaagugaucgaccugggaugcgggcggggcgguuggagcuacuacugcgcgggacugaagaagguaaccgaggucaaaggguacaccaaaggcggacccgggcacgaggagcccaucccgauggcgacguacggcuggaaccugguuaaguuacacuccgggaaagacguuuucuucacgccucccgagaagugcgauacacugcugugcgacauaggagagagcuccccgaacccuaccaucgaagaggggcggacacuucgcgucuugaaaaugguggagccuuggcugcgggguaaccaguucuguauuaagauccucaauccauacaugcccucggugguugaaacccuugagcagaugcagcgcaagcacggugggaugcuugugcgcaacccgcucucccgcaacucaacccacgagauguacuggguguccugcggcacaggaaacaucgugagcgccgucaacaugacgucaaggaugcugcugaaccgcuuuacgauggcucaccgcaagccaaccuaugagagggacguagaccuaggcgcgggcacccgccacgucgcggucgagcccgagguugccaaccucgacauaaucggacagcggaucgagaacaucaagcacgagcacaaaagcaccuggcauuacgacgaggacaaccccuacaagacgugggccuaccaugguucauacgagguuaaaccgagcggcuccgccagcagcauggucaacggcguagucaagcuguuaacaaagccuugggauguuauccccauggucacucagaucgcgaugacugacacgacgccauuuggacagcagcgcguauucaaggagaagguggacacccgaaccccgaaggccaaacgcggcacggcccagaucauggaagucacggcccgguggcucuggggcuuccugucccgcaacaagaagccccggauuugcacccgcgaggaguucacccggaagguccgcagcaacgcugcgaucggggcuguguuugucgacgagaaucaguggaacucugccaaggaggcuguggaggaugagcgguuuugggaccucguacagaaggagcgcgaacugcacaagcaggggaagugcgcgacgugcgucuacaauaugauggggaagcgagaaaaaaagcugggcgaauucgggaaggccaagggcucucgagccaucugguauauguggcugggcgcccgauuccuggaguuugaggccuugggguucaugaaugaagaccauugguucuccagagagaacagucuauccggcguggaaggggaaggcuuacacaagcugggguacauccuccgggacauaucuaagauccccggcggcaacauguacgcggacgacacugccgggugggacaccagaauaacggaggacgaucugcagaacgaggccaagaucacagacaucauggagccggagcacgcccuguuagccaccuccaucuuuaagcugacuuaccagaacaaggugguccggguccagcggcccgcuaagaauggcaccgugauggaugucaucagcaggcgcgaccagcgcggguccggucagguggggacguacgggcuuaacaccuucacaaauauggaggcgcagcucauucggcagauggagagcgagggcaucuucuccccaagcgagcuggaaauccccaaccuagccgagagggugcucgacuggcuggagaaguauggggucgaacggcucaagcggauggcaaucagcggugacgacugcguggugaaaccgaucgacgaucgguucgccacggcgcucacggcacugaaugauauggggaaaguacgcaaagacgucccucagugggagcccuccaagggcuggaacgacuggcagcagguccccuucugcucucaccacuuccaccaauuaauuaugaaggauggccgggagaucgucgugccgugccgcaaccaggacgagcucguggggcgggcccgcgucucccagggcgcgggauggagccugcgagagaccgcgugccuuggaaagucguacgcgcaaauguggcagcugauguacuuccacaggcgggauuuacgccuggcagccaacgccaucugcagcgcggugccuguagauuggguucccaccagccggacaacguggucuauccacgcccaccaccaauggaugaccacggaggacaugcuguccguguggaaccgcguguggaucgaagaaaaucccuggauggaggauaagacccaugugagcuccuggggcgacguuccuuaccugggcaagcgggaggaccaguggugcggcagccucaucgggcucacugcccgcgccacaugggccuccaacauccaaguggcuauaaaccagguacgacgguugaucggcaacgagaauuauuuagacuacaugacauccaugaagcgcuucaagaacgaaggggacccggagggcgcccucugguga

SEQ ID NO: 24285 - RNA, 9879 nt, Artificial Sequence
  derived and/or modified CDS sequence (opt11) from DENV-1__GQ868608__SS-prME
ucggugacgaugcugcugauguugaugcccaccgcauuggccuuccaccucaccacccggggcggggagccccauaugaucgucucaaaacaagaacggggcaaaagccugcuguucaaaaccuccgcgggagugaacaugugcacgcucaucgcgauggaccugggcgaguucugcgaggacacaaugaccuacaagugcccccgcaucaccgaggccgagcccgacgaugucgacugcuggugcaacgccaccgacacuugggucaccuacgguaccuguagccaaacuggugagcaccgucgggacaagcgguccguggcccucgcgccucacguugggcucgggcuagagacgcgaaccgagaccuggaugagcuccgagggggccuggaaacagauccagcgcgucgagaccugggcccugcgccaccccggguuuacggugaucgcccucuuccuugcgcacgccaucggcacuaguaucacccagaaagggaucaucuucauucuccucaugcugguuacacccuccauggccaugcgaugcguaggcaucggcagccgcgauuucguggaagggcuguccggcgccacuuggguggacguagugcucgagcacgggagcugcgugaccaccauggccaaggacaagcccacccuagacaucgagcugcucaagacagaggucaccaauccugcggugcugcggaagcugugcauagaagccaagaucuccaauacuaccacggacagcaggugccccacccagggcgaagccacccuuguggaggagcaggacgccaacuucgucugcagacgaaccuucguggaucggggcuggggcaacggcugcgggcuguucggcaaggggucguugaucacgugcgccaaguucaagugcgugaccaagcucgagggcaagaccguccaguacgagaaccugaaguacagcguuauaguuaccguccacacuggcgaccagcaccagguagguaacgagucgaccgagcacggcaccacugcgacuaucacgccccaggcccccagcacagaaauccagcucaccgacuacggggcccucacucuagauuguagccccagaacgggccuggacuucaaugagaugguccuccucacgaugaaggagaaggccuggcuggugcacaagcaaugguuuuuagaccugccgcugcccuggaccagcggggcgagcaccagccaggagacguggaaccguaaggaucuccuggugaccuucaagaccgcgcacgccaaaaagcaggaagucguggugcuggguagccaggaaggcgccaugcacaccgcgcucaccggggcuacugagauccagaccuccggcacaaccacuaucuucgcugggcaccugaaaugccgccucaagauggacaagcucacccugaagggcaugucuuaugucaugugcaccggguccuuuaagcuggagaaggagguggccgagacgcaacauggcaccguacucguccagaucaaguacgaggguaccgaugcccccuguaaaauacccuucagcacgcaggaugagaagggggugacacagaacggucggcucaucacugccaaccccauugugaccgacaaggagaaacccgucaacaucgaggccgagcccccguucggggagucuuacaucgugaucggcgccggcgagaaggcccugaagcugagcugguuuaaaaagggguccuccauuggcaaaauguucgaggccacugcuaggggugcgcggcgcauggccauccucggcgacacagccugggacuucggauccaucggaggagucuucaccagcgucgggaaacuugugcaccagaucuucgguacggccuacgggguacuguucuccggcgucuccuggaccaugaaaaucggaauuggcguccuccugacgugguuaggccucaacucccgaucaaccucccugucgaugacgugcaucgccguggggcuagucacccuguaccuuggcgucauggugcaagcugacucagggugcgucauaaacuggaagggccgggagcugaagugcgggucgggcaucuucgugacgaaugaggugcacaccuggaccgaacaguauaaguuucaggcggacagcccuaagcgccucucggcagccaucggcaaggccuggaaggagggggucugcggcaucaggagcgccacgaggcucgagaauauaauguggaagcagauuuccaacgagcugaaccacauacuccuggagaacgacaugaaguucaccgucguuguuggggacguggcaggcauccuggcucaggggaagaagaugauccggccccagccgauggaguacaaguauagcuggaaguccugggguaaagccaagaucaucggugccgacgugcaaaacgcuaccuucaucaucgacgggcccaacaccccggaaugcccggacgaucagcgagccuggaauaucugggaggucgaagauuacggcuuugggaucuucaccaccaacauauggcucaaacugcgggauucuuauacucaggugugcgaccaucgccugauguccgcagcgaucaaggauucuaaagcgguucacgcagauaugggcuacuggaucgaauccgagaaaaacgagacguggaagcuugcucgcgccagcuuuaucgaggucaagaccugcauuuggccgaagucccacacccuguggagcaacggcgugcuagaauccgagaugaucauacccaagaucuaugggggcccgaucagccaacacaacuaucgccccggguacuucacgcagaccgccggucccuggcaccucgggaagcuggaguuagacuuugaccucugcgaaggcaccacgguggucguggaugagcauugcggcaaucgggggccaagucugcgcaccaccaccgugaccggcaaaaucauccacgagugguguugccggaguugcacgcugccgccccuacgcuucaagggggaggacggcugcugguacgggauggagauccggccagucaaagagaaagaggagaaccucgugaaauccaugguuagcgcgggcagcggcgaagucgacuccuucagccuggggcuccuaugcaucuccaucaugaucgaggaggugaugcgcagccguuggucacgcaaaaugcugaugaccggcacccuggccguguucuuccugcugaucauggggcagcucacuuggaacgaucugauaagacugugcauuaugguaggcgcaaacgcaucagaccgcauggggaugggaacgacguaccucgcccugauggcaaccuucaagaugaggccgauguuugccgugggacuacuguuccgccgccugaccagucgggagguccugcuacugacgaucggguugagccucgucgccagcguggagcuacccaacagccuggaagagcucggcgacgggcuggccaugggcaucaugauccugaagcucuugaccgacuuccaaucccaccagcuuugggcgacccucuuaagccuaacguuuaucaagacaaccuuuucgcuacacuacgcuuggaaaacgauggccaugguguugaguauugugucccucuuucccuugugcuuauccacuacgucccaaaaaaccacauggcugcccguccuccugggcagucuagguuguaagccgcucacgauguuccugaucgccgagaacaaaaucuggggacguaaguccuggccccugaacgaggggauuauggcggucggcaucgugucuaucuugcugaguucccugcugaaaaacgaugugccccuugccgggccccugaucgccggcggcaugcugaucgccugcuaugucauaagcgggaguagcgccgaucugucccuggagaaggccgcggagguaaguugggaggaggaggccgaacacucaggcgccagccacaacauucucguggagguccaagacgacgggacgaugaagaucaaggacgaggagcgggacgacaugcugaccauccugcucaaggccaccuugcuggccgugucuggcguuuacccucucagcauccccgcgacccuuuucgugugguacuucuggcagaagaaaaagcagcgcuccggugugcugugggacacacccucgccucccgagguggaacgggcaguccuggaugacgguauauaccgcaucaugcagcgggggcuucuggggagaucgcagguuggcgugggggucuuccaggagaauguguuccacacgauguggcacgugaccaggggcgcuguccugauguaccaagggaagagacucgaacccagcugggcuuccgugaagaaggaccucaucucauacggcggcggguggagacugcagggcuccuggaacaccggggaagagguucaggucauugccguggagcccggcaagaaccccaagaacgugcagaccgcgccugggaccuucaagacgagcgagggagagguuggcgccaucgcgcucgacuuuaagcccgggaccuccggcucuccgaucguuaaucgcgaggggaagauugugggauuauacggcaaugggguggugaccacuagcggcacuuacguguccgccaucgcacaagcuaaggcuagucaggaggggccccugccggagaucgaggacgaagucuucagaaagcgcaauuuaaccaucauggaccugcaccccggcuccgggaagacccggcgcuaccucccugccaucgugcgggaagccaucaagcggaagcuccgaacccugauacuggcgccaacaaggguggucgccagcgagauggccgaggcccucaagggcaugcccaucagauaucagacaacugcugugaaguccgagcacacgggcaaggagaucguggaccuuaugugccaugcuacuuucacgaugcgguuacucagccccguccgggugcccaacuauaacaugauaaucauggacgaggcccacuucacagacccguccagcaucgccgcccggggguacaucuccacgcgcguggggaugggggaggccgcugcgauauucaugacggccacaccaccgggcucagucgaagccuucccacaguccaacgcggugauccaggacgaggagcgggacaucccugagcgcucuuggaacuccggguacgaguggauaaccgacuuccccggcaaaacggucugguucgucccaucgauuaaguccggcaacgauaucgccaacugucugcggaaaaaugggaaaagaguuauucaacugagcagaaagacguucgacacugaguaccagaagacaaagaacaaugacugggacuaugugguuacgacugacauauccgagaugggcgccaacuuucgagccgaucggguaaucgauccucgccggugccucaagccugugauccuuaaggacgggccugaacgcgucauccuggccggccccaugcccgucaccgucgcgagcgcagcccaacgucgcggucggaucggccggaaccacaacaaggagggcgaccaguacaucuacauggggcaaccucucaacaacgacgaagaucacgcccacuggaccgaggcuaaaaugcuccuggauaacauaaacacccccgaaggcauuauccccgcccucuucgagccugagcgagagaagucggcagcuaucgacggugaguaccgucugagaggcgaggcccggaagacauucgucgagcugaugcgccgcggggaccucccgguauggcugagcuauaaaguugccucugagggcuuccaguauagugaccgccggugguguuucgauggcgagcguaacaaccaggugcuggaggaaaacauggacguggaaaucuggacaaaggagggggaacggaaaaaguugcgaccccggugguuagacgcgcgcaccuauucagacccccuggcccuccgagaguucaaggaguucgccgcaggccggcgguccgucagcggggaccucauccuggagauuggaaagcucccccagcacuuaacgcagcgcgcgcagaacgcccuggauaaccuaguuaugcugcauaauuccgaacagggcgggcgggccuaccgccacgcgauggaggagcugccggauaccaucgagacauuaauguuacuggcccucauugcggugcugaccggcggggucacauuguucuuccucagcggccgagggcugggcaaaaccucaauaggccugcucugcgugauggcuucuuccguguuauuauggauggccagcguggagccacacuggaucgccgcuuccaucauccuugaguuuuuccugauggugcugcuaauacccgagcccgaccgccagcggacuccacaggacaaccagcuggccuacgugguaauuggucucuuauucaugauucugaccguggcugcgaacgagaugggccugcuagagaccacgaaaaaggaucuggggaucggucacguugccgucgagaaccaccaccacgccgcgaugcuggauguagaccuucaccccgccagcgcauggacgcuguacgccgucgccacgaccauaauuacucccaugaugcgccacaccaucgagaauaccaccgcgaauauuucccugacggcgaucgccaaccaggccgcgauccugaugggcuuagacaagggcuggccaauuucaaagauggacauaggugucccccugcucgcucugggguguuauucccaggugaauccucucacccucacugcugccgugcugaugcugguugcccacuacgcaaucauuggccccgggcuccaggccaaggccacccgggaagcucagaagcgcacggcggcaggcaucaugaagaacccgacaguggacgggauuguggcgauagacuuggaccccgucguguaugacaccaaauucgagaagcaacugggccaaaucaugcugcugauccugugcaccagccagauucuccugaugcgcacgaccugggcacugugcgaguccaucacccuggccacagggccgcugacgacucuaugggaggggagcccuggcaaguucuggaacaccaccaucgccgucuccauggccaauauauucagagggucauaccucgccggcgcuggucuggccuucagcuuaaugaagucgcucgggggcggucgacgagguacgggggcucagggcgagacccugggcgagaaguggaaacgccagcugaaccagcugucuaaguccgaguucaacacauauaagcggagcgggauaauggaggucgauagguccgaggccaaggaaggccugaaacgcggcgagaccacgaagcacgcagugagccgagguaccgccaaacugcggugguuuguggagcgcaaccucgucaagccggaggggaaagucauugaccugggcugcggcagggguggguggucguacuacugcgccgggcugaagaaaguuacagaggucaaaggguacacaaagggcgggcccgggcaugaggaacccauuccgauggcaacguacggguggaaccuggugaagcuacacucuggcaaggacguguuuuucaucccgcccgagaagugcgacacccugcuaugcgacaucggagaaagcagccccaaccccacaaucgaagaaggccgcaccuugcgggucuuaaagaugguggagccguggcugcgcggaaaccaauuuugcaucaagauccucaaccccuacaugcccuccgugguugaaacucuugagcagaugcagcggaagcacgggggcaugcuggugagaaacccucucagccggaacuccacacacgaaauguacugggugaguugcgggaccggcaauaucgucuccgccgugaacaugaccagccgcaugcugcugaaccgguucaccauggcucaucgcaagccgacguacgagcgagacguggaucucggggccggcacgcggcacguagcuguggagccagagguugcgaaccucgauauuaucggccagcgcaucgagaacaucaagcacgagcacaagucaaccuggcacuacgaugaggacaaccccuacaagaccugggccuaccauggguccuaugagguuaagcccuccggcagcgccagcuccaugguuaacggggucgugaagcugcucacuaagccgugggauguuauccccauggucacccagaucgccaugaccgacacgacgcccuucggccagcaacgaguguucaaggaaaagguggacacccgcaccccaaaagccaaaagggggaccgcgcagauaauggaagucacggcaaaauggcuguggggcuuucugagcaggaauaagaagccgaggaucugcacccgcgaggaguucaccagaaagguacgcucaaacgcggccaucggcgcagucuucgucgacgagaaccaguggaacagcgcuaaggaagcaguggaggacgagcgguuuugggaccucgugcacagggagcgagaguuacacaagcagggaaagugcgcgaccugcgucuauaacaugauggggaagcgcgaaaagaagcuuggggaauuugggaaggccaagggcucccgggcgauuugguauauguggcucggcgcacgcuuucuggaauucgaggcccugggcuuuaugaacgaggaccauugguuuagccgcgagaacucauuaagcggggucgagggcgagggacugcacaaacugggcuacauccuacgagacaucucgaagauaccggggggcaacauguaugccgacgacacggccgggugggacacaagaaucaccgaggacgaccugcagaacgaagcuaagaucacagacaucauggagccagagcacgcccugcucgccaagagcaucuucaaguuaaccuaccagaauaaggugguccgggugcagcggccggcgaagaacggcaccgucauggacgucaucucaagacgugaccaacgcggaagcggccaggugggcacguacggcuugaacacguucaccaacauggaagcucagcucauccgccagauggaguccgaggggaucuucagccccuccgagcuggagaccccaaacuuggcgggccgcguacucgauuggcuggagaagcacgggguugaacgccugaaacggauggccaucaguggcgaugacugcguggucaagccgaucgacgaccgcuucgccaccgcucucacugcccugaacgacaugggaaaggugcggaaggauaucccgcagugggagcccucgaagggcuggaacgacuggcaacaggucccauucuguagccaccacuuccaccaacugaucaugaaagacggccgcgagaucguaguccccugccggaaccaagacgagcucguugggcgggcgcgaguuagccagggcgccggcuggucccuucgcgagaccgccugccuuggcaagucauacgcucagauguggcagcucauguacuuccaucggcgcgaccugagacuggccgccaaugcuaucuguuccgccgugccgguggacuggguucccacgucgcgcaccacuuggucuauacacgcacaucaccaauggaugacuacugaggacaugcugucgguauggaaccggguguggauugaggagaaccccuggauggaggacaagacccacauaucuucguggggcgacgugcccuaucugggaaagcgggaagaccaaugguguggaucccucaucggccuuaccgcgcgggcuaccugggccaccaacauccagguggccauuaaccaggugcgccgccugaucgggaacgagaacuaccuggacuauaugaccagcaugaagagauucaaaaacgagaucgacccggagggggcauuaugguaa

SEQ ID NO: 24286 - RNA, 9879 nt, Artificial Sequence
  derived and/or modified CDS sequence (opt11) from DENV-1__GQ199774__SS-prME
agcguuaccaugcugcuuaugcugaugcccaccgcccuugccuuucaccucaccacccguggcggggaaccccauaugaucguuuccaagcaagaacggggcaagagccugcuguucaagacguccgccggugucaacaugugcacccugaucgccauggaccugggcgaacugugcgaggacaccaugaccuacaagugccccaggaucaccgaaguggagcccgaugaugucgacuguuggugcaacaccacugacaccugggugaccuacgggacgugcagccaaacgggcgagcaccggagggacaaacgguccguggcccucgcgccccacgucggucuggggcuggagacccgggccgagacuuggaugucauccgagggcgcguggaagcagauccagaagguggaaaccugggcccuccggcaccccggguucacggugaucgcccuuuucuuggcgcacgcgaucgggaccagcauaacccagaaggggauuauuuucauccuucugaugcuggucacccccuccauggccaugcgcugcguggguauagguaguagggauuuuguugaggggcucuccggugccacgugggucgacguggugcucgagcacgggagcugcgucacaaccauggccaaggacaagccaacccuggacauagagcuccugaagacggaggugaccaaucccgccgugcugcgcaagcucugcaucgaggcgaagauuaguaacaccaccacggauagccggugcccgacccagggggaggccacccugguagaggagcaggacgcuaauuucgugugccgccggaccuucguggaccgcggcugggggaacgguugcggccuguucggcaaggggucucucaucacaugcgcaaaauucaagugcgucaccaagcuggagggcaagauuguucaguacgagaaccugaaguauagcgugauugucacugugcacaccggcgaccagcaccaggucgggaacgaguccacggagcacgguacgaucgcaacaauuacgccacaggcgcccaccagcgagauccaacugacggacuacggugcccugaccuuggacugcagcccccggaccggccucgacuucaacgagauggugcugcugacgaugaaggagaaguccuggcucguucacaagcaaugguuccuugaccugccucuccccuggacgagcggggcgaguaccagccaagaaacuuggaacaggcaggaucuguuaguuaccuucaagacggcccacgccaaaaagcaggaagucguaguccuaggcucacaggagggcgcaaugcauaccgcccucacgggggcuaccgagauccaaacaacaggcacgaccacgaucuucgcagggcaucugaagugccggcucaagauggacaagcugaccuuaaagggcaugagcuacgugaugugcaccgggucauucaagcucgagaaggagguagccgaaacucagcacgguacgguccuggugcagaucaaauaugagggaacugaugcgcccugcaagaucccguucagcacacaggaugagaagggggugacccaaaauggccgcuugaucacugccaacccgaucgucaccgacaaggagaagccgguaaauauagaagccgagccgcccuucggggagagcuacaucgugauuggcgccggcgagaaggcgcucaagcugagcugguucaagaaggguucgagcaucgguaagauguuugaagcaaccgcccgcggugcacgccggauggcuauccuaggcgacaccgcgugggacuucggauccaucggcggaguauucacgagcguagguaagcuggugcaucagaucuucggcacugccuacgguguccuauucuccggcguuucguggaccaugaagaucgggaucggcgugcuucugaccuggcucggacugaacucccgcaguacgucccugaguaugacuugcauagccgucgggcucaucacccuguaccugggggugauggugcaggccgacagugggugcguaaucaacuggaaaggccgcgagcucaaaugcggcuccggcaucuucgugaccaacgaggugcacacguggaccgagcaguacaaguuucaggccgacagcccgaagcgucuguccgcggccaucggcaaggcgugggaggagggcgucuguggcauccgcagugcuacuaggcuggaaaacaucauguggcgccagauuuccaacgagcugaaccacauacugcuggagaacgacaugaaguucaccgugguggucggggacguggucgggauccucgcccaggggaagaagauggucaggccccagcccauggagcacaaauacagcuggaaauccugggggaaggcgaaaaucaucggugccgacguccagaacaccacguucaucaucgacggaccuaacaccccggaaugccccgacgaucagcgcgccuggaacaucugggagguggaggacuacggcuucgggaucuuuacaacuaacaucuggcucaaguuacgagauagcuacacgcaggucugcgaccaucggcugaugagcgcugcgaucaaggacagcaaggccgugcacgcggacaugggcuacuggauagagagcgagaagaacgagaccuggaaacuggcccgggcgagcuuuaucgaggucaagacuugcaucuggcccaagucccacacccuguggucaaacggagugcuugaguccgagaugaucauccccaaaaucuacgggggcccgauuucacagcauaacuaccggcccggguacuucacgcagacugcaggcccguggcaccuugggaagcuggagcucgacuucgacuugugcgagggcacuaccgucgucgucgacgagcacugcggcaaccggggaccguccuuacgcacaaccaccgugaccggcaagaucauccacgaguggugcugucggucgugcacguugccgccacuucgcuucaagggggaggacggcugcugguacgggauggaaauccggcccguuagagaaaaggaggagaaucuggucaaguccauggugucagccggcagcggcgagguagacuccuuuagccucgggcugcuuugcauauccaucaugaucgaggaggucaugcggagccgcuggagucggaagaugcucaugaccggcacccuggccguguucuuucugcucaucaugggacaguugaccuggaacgacuugauccgcaguugcaucauggugggcgccaacgccuccgaccgcaugggcaugggcacgaccuaccucgcgcugauggccacuuucaagaugcggccgauguuugcagucggguuacuguuccgcagacugacaagucgggagguucugcuccugacaauuggucugucccucguggccaguguggaauuacccaacucccuggaggagcucggcgauggguuggccaugggcaucaugauccugaagcuccugaccgacuuccagagcuaccaguuaugggcgacgcuccugucccugaccuucaucaaaacaaccuucagccuccacuacgcuuggaagaccauggccaugguguuauccauaguaagccugcuaccccugugcuuaucgacaacuagccagaaaaccacaugguuaccugugcugcuaggcagucucggcugcaagccgcugaccauguuccugaucgcagagaacaagaucuggggccggaaguccuggccccucaaugaggguauaauggcggugggcauugucucaauccugcuguccucgcucuugaagaacgacgugccccuggcagguccccucauagccggcggaaugcucaucgcaugcuaugucaucucaggcagcuccgccgaccucucucucgagaaggcggccgaggucuccugggaggaggaggccgaacacagcggcgccucacacaacauccuuguggaggugcaggacgacggaacaaugaagauuaaggacgaggagcgcgacgacacccucaccauucuccugaaggccaccuugcucgcagucucgggcguguauccgcuguccauucccgcaacccuguucgugugguauuucuggcagaagaagaagcaacggagugggguccucugggacacgccaagcccgcccgagguggagcgcgccguguuggacgacggcaucuaccggaucaugcagcggggucugcuggggcggucgcaagucggcguggggguguuccaggagaaugucuuccacaccauguggcacgugacucguggggccguucucauguaccaggggaaacggcuggagccuuccugggccagcgucaagaaggaccugaucuccuacgguggaggguggcgccuccaagguagcuggaacaccggagaagagguucaagugauagcugucgaacccgggaagaaccccaagaacguccagacugcccccgggaccuucaagacccccgagggugaagucggcgcgaucgcccuggacuuuaagcccgggaccucaggcucgcccaucgucaaucgggaggggaagauugugggccuguacggcaaugggguagucacgaccuccggcaccuacguguccgccaucgcgcaggccaaagccagccaggagggaccgcuccccgagauagaagaugagguguucaggaagcggaaccugaccaucauggaccugcacccgggauccgggaagacgcgucgguaccucccggccaucguccgcgaggcaaucaagcggaaacuccgcacccuaauccucgccccaacccgcguuguagccagcgagauggccgaggcgcugaagggcaugcccauaagguaccagaccacggccgucaaaucagagcacaccggccgcgagauuguggaccugaugugucacgccacguucacgaugcgucuccugagcccugugcgcgucccgaacuacaauaugaucauuauggacgaggcucacuucacugaccccucgagcauagccgcccggggguacaucaguacacgcgugggcaugggggaagcggcagccaucuucaugacagccacgccgccaggcucuguggaggccuucccgcaguccaacgcgguaauccaggacgaggagcgggacauccccgagcgcagcuggaacaguggguacgaguggauuacggacuuucccggcaagaccgugugguuugugcccagcaucaaguccggcaaugacaucgcaaacugcuuacggaagaacgggaagcgcgucauccaguuaagccgaaagacuuucgauaccgaauaccagaagacgaaaaacaacgacugggacuacguggugaccacugacaucuccgaaaugggcgcgaacuuccgcgccgaccgggugaucgauccacgccggugccugaagccaguaauccugaaggacgggccggagcgcgucauccucgcggggcccaugccgguaaccguugccagugccgcacagcggcgcgggcgaauaggccgcaaccacaacaaggagggcgaucaguacaucuacaugggccaaccacugaacaacgacgaggaccacgcccacuggacggaagcuaaaaugcuucuugacaacauuaauacccccgaaggcaucauucccgcccuguucgagccggaacgcgagaagucagccgcuaucgacggggaguaccgacugcguggcgaagcccggaagaccuuuguggagcucaugcgccgcggagaccuccccguguggcuuagcuacaagguggcgagcgagggcuuccaauacagugacagaagguggugcuucgacggcgaacgcaauaaucagguccucgaggagaacauggauguggagaucuggaccaaggaaggggagcggaagaagcugcgcccccggugguuagaugccaggacguauagcgaccccuuagcucugcgggaguucaaggaguucgccgccggccgccgguccgugaguggggaccugaucuuggagaucgguaaacugccgcagcaccugacgcagcgggcgcaaaacgcccuagauaaccuggucaugcugcacaacuccgagcagggcgggcgggccuaccgucacgcgauggaggaguuacccgacaccaucgaaacccugaugcugcucgccuuaauagccguguuaacgggcgggguuacccucuucuucuugagcggccgcgggcugggcaagaccuccaucggccuccugugcgucauggccagcuccgcacugcucuggauggccaguguggaaccacacuggaucgcggccuccaucaucuuggaguucuuucugaugguguugcugaucccugagccggaccgccagcggacgccccaagacaaccagcuggcguacgucgugaucggguugcuguucaugauccugaccguggccgccaacgaaaugggccucuuagagaccaccaaaaaggaccugggcaucggccacgucgcgguggagaaccaccaccacgccacgaugcucgacguggaccugcacccugccagcgccuggacacuguacgccgucgcuacgaccaucauaaccccgaugaugcgucacacgauugagaacacgaccgcgaacauaucccucacggccauagcgaaccaggccgcaauccugauggggcuggacaagggguggccgaucagcaaaauggacaucggcgugccgcuccuggcucugggaugcuauucgcaagugaauccccucacccugacagccgcugucuuaauguuaguagcgcacuacgccaucaucggaccgggucugcaggccaaggccacccgcgaagcccagaagcguacugcggcgggcauaaugaagaaccccacagucgacgggauagucgccaucgaccuugaccccgugguuuacgacgccaaauucgagaagcagcucggucagaucauguuauuaauccucugcacaucucaaauccugcucaugcgcacuaccugggcccuaugcgaguccaucacccuggcgacgggacccuugacgaccuugugggaagggagcccagguaaguucuggaauacaacuauagccguguccauggcaaacauuuuucgggggucauaccuggccggcgccgggcuagcguucagccuaaugaagucccuagggggcggucgccgggggaccggggcccagggcgagacccugggugagaaguggaagcgucagcucaaccaacugagcaaguccgaguucaauacuuauaagcgcagcgggauaauggagguggaucgcuccgaagcgaaagagggucugcgucgcggggagacgaccaagcacgccgugagccggggcacagcgaagcuccgcugguucgucgaacggaaccugguuaaacccgaggggaaggugauugaccugggcugcggccgcggggguuggucauacuacugcgccgggcugaagaaggugacagaggugaagggcuacacaaagggcggccccggccacgaggagcccauaccaauggccacguacggguggaaccucguuaagcugcacagcggcaaggacguauucuuuaucccgcccgagaagugcgacacccugcucugcgacauuggagagucaagccccaacccgaccaucgaggaggggcggacccuacgcguacugaagaugguggaacccuggcuccgggggaaccaauucugcaucaagauccugaacccauacaugcccuccgucguggaaacccuggagcacaugcaacgcaaacacggcggcaugcucguacggaauccucugagcagaaauuccacccacgaaauguacugggucagcugcgggaccggcaacaucguuagcgccgugaacaugaccucacgcaugcugcuaaacagauuuacgauggcccaccgcaagcccacuuacgagcgugacgucgaucugggggcgggcacccgccacguggcgguggagccggaagucgccaaccuggacaucaucggccagcguauagagaacaucaagcacgagcacaagucuaccuggcauuacgaugaagauaaccccuauaagacgugggccuaccaugggagcuacgaggugaaacccuccggcagcgccucuuccaugguuaacgguguaguuaagcuccugaccaagcccugggacgucauccccauggugacccagaucgcgaugaccgacacgacccccuucggccagcagcggguguucaaggagaaggucgauacccguaccccuaaagccaagagggggacggcccagaucauggaggugaccgcccgguggcuguggggcuuucucagcaggaacaagaaaccacggaucugcacccgcgaagaguucacccggaaggugcgcuccaacgcagcgaucggcgccgucuucguggacgagaaccaguggaacagcgcgaaggaggccguggaggacgaacgguucugggaccuaguccaccgagagcgggagcuacacaagcaagggaagugugcuacuugcguguauaacaugaugggcaagcgcgagaagaaacugggggaguucggcaaggccaaggggucccgggccaucugguacaugugguugggggcgcgcuuccuugaguucgaggcccucggcuuuaugaacgaggaccauugguuuucaagagaaaauucccugagcgggguugagggcgaggggcugcacaagcugggcuacauucugcgggacaucagcaagauccccgggggcaacauguacgcagacgacaccgccgguugggacacucgcauuacggaagacgaccugcagaacgaggcuaagaucacggacaucauggagcccgaacaugcccuacuggcaaccagcaucuuuaagcugaccuaucagaauaagguaguccgggugcagcgccccgcgaagaacggcaccgucauggacgucaucucgaggagagaccagcgaggcagcggccagguuggcacuuauggccucaacaccuucacuaacauggaggcccaauuaauacgccagauggaguccgaggggaucuucagcccuuccgagcuggagacucccaaccucgcagagcggguccuggauuggcuugagaaguacggaguugaacgccucaagcggauggccaucagcggcgacgauugcguggucaagccgaucgacgaccgcuucgccacggcgcucacggcccugaacgacauggggaaggugcggaaggacauuccccagugggagcccuccaaaggauggaacgauuggcaacaaguccccuuuugcagccaccacuuucaccagcucaucaugaaggacgggcgcgagaucgucgugccgugccggaaccaggaugagcuggugggccgcgcccgggugagccaaggagcugguuggucccugcgcgagaccgccugccucggcaaaaguuacgcgcagauguggcagcugauguacuuucaccggcgggauuuacggcuagcagccaacgccaucugcucugcagugccgguggacuggguccccaccagccggacgaccuggucgauccacgcccaccaccaguggaugacgaccgaggauaugcugagcguguggaaccgcgucuggaucgaggagaaccccuggauggaggacaagacgcacaucucuucuuggggcgacgugccuuacuugggaaagcgggaagaccaguggugcggcucccugaucggcuugaccgcccgcgcgaccugggccacaaacauccaaguggcaaucaaucagguccgccgucugaucgggaacgagaacuaccucgacuacaugacgucuaugaagcgcuuuaagaacgagagcgaucccgagggcgcccugugguag

SEQ ID NO: 24287 - RNA, 9879 nt, Artificial Sequence
  derived and/or modified CDS sequence (opt11) from DENV-1__GQ199775__SS-prME
agcgugacgaugcuguugauguugaugcccaccgcccuggcauuccaccucacgacgcggggcggggagccccacaugaucguguccaagcaggaacggggcaagucucugcuauucaagacauccgccggggugaacaugugcacccucauagcaauggaccugggcgaguuaugcgaagacaccaugaccuacaagugccccaggaucaccgagguggagcccgaugacgucgauugcuggugcaacaccaccgacacgugggugaccuacgggaccugcagccagacuggcgagcaucggcgcgacaaaagauccgucgcauuagcaccccacgucggccuaggguuagagacacgugccgagacauggaugucuuccgagggggccuggaagcagauacagaagguggagacgugggcccucagacacccuggguuuacggucauagccuuauuccuggcccacgcgaucgggacguccauuacgcagaagggaauuaucuucauccuccuaaugcuggucacucccucgauggcuaugagguguguggguaucggcucgagagacuucgucgaggguuuaucaggcgccacguggguugacguugugcuagagcauggcagcugcguaaccacuauggccaaggacaaaccaacccuggacauagaacuccucaagacggaggugaccaaccccgcagugcugcgcaaacucuguaucgaggcgaagaucuccaacaccaccacugauucccgaugcccaacccagggagaggccacacuggucgaagagcaggaugcgaacuucgugugccgacgaaccuucguagaccguggcugggggaacgggugcgggcuguucggcaaggggagucucauuacuugcgcuaaguucaagugugucaccaagcuugagggcaagaucgugcaguaugaaaaccugaaguacucagucauugucaccgugcacaccggcgaccagcaccaggucgggaacgaauccacagaacacggcacuaucgccaccaucacaccccaggcgcccaccagcgagauccagcucacggacuacggggcucugacccucgacugcuccccccgaaccggacuggacuucaacgagauggugcuguugaccaugaaggagaaguccuggcuggugcauaaacagugguuccuggauuugccgcuccccuggacgucuggggccuccaccagucaggagaccuggaaccgacaggaccuccuggugaccuucaagacggcccacgcaaagaagcaggagguggugguccucggaucccaggagggcgccaugcacacagcccugaccggggccaccgaaauccagacgacggggaccaccacaaucuucgccgggcauuuaaagugccgcuugaagauggacaagcugacccuuaaaggcaugagcuaugugaugugcaccggcuccuucaagcuggaaaaggagguggccgagacucagcauggcacgguccuggugcagaucaaguacgagggcacggacgcgcccugcaagauccccuuuagcacccaggacgaaaagggggugacacaaaacggacgccuaauaacggccaauccgauugucaccgacaaggagaaacccgugaacaucgaagccgagccgcccuuuggugaguccuacaucgugauuggcgccggcgagaaggcucuuaagcucagcugguucaagaaggguuccaguaucggcaagauguucgaggccacagcccgaggggcccgaagaauggccauucuaggagacaccgcgugggacuucgggaguauuggcggcgucuucacuagcguggggaagcucguacaccaaaucuuuggcacggccuacgggguccucuucagcggagugagcuggacuaugaagaucggaauuggcgugcuguugaccuggcucgggcugaauucccgcucaacgucccugagcaugaccugcauagccgucgguuugaucacucucuaccugggagucaugguccaggcagauuccgggugugucaucaauuggaaggggcgcgagcucaagugcgggagcggaaucuucguaacaaaugaaguccauacguggacagagcaguauaaauuccaggccgacagcccgaagcgacugucagcugccaucggcaaagcaugggaggagggggucugcggcauccgcagcgcaacccggcuggagaauaucauguggcggcagaucuccaacgaacucaaccauauccuauuagaaaacgacaugaaguucaccgugguggugggggacguugugggcauccucgcccaggggaagaaaauggugcggccucagccuauggagcacaaguacagcuggaaaagcugggggaaggcgaagauaaucggugcugacgugcagaacaccacauucaucaucgaugggcccaacaccccugagugccccgacgaucagcgcgccuggaacauaugggagguugaagacuacggcuucgggaucuuuacaacgaacauauggcugaagcugagagauagcuacacgcagguaugcgaucacagacucauguccgccgccauaaaggacagcaaagccgugcacgcggacaugggcuacuggaucgaauccgaaaagaacgagacguggaaacuggcccgggccagcuuuaucgaggugaagaccuguaucuggccgaagucccacaccuugugguccaacggcgucuuggaguccgagaugaucauccccaaaaucuacggcggcccgaucagccagcacaauuacaggccgggguacuucacgcagaccgcgggacccuggcaccuaggaaaacuggagcucgacuuugaccugugcgagggcacaaccguagugguagaugagcauugcggcaaucgagggccaucccugcgcacgaccaccgugaccggcaagauuauccacgaguggugcugccggagcuguacgcugccgccccuccgauucaagggggaagacggcugcugguaugggauggagauccggcccgugcgcgaaaaggaggaaaaccuugucaaguccauggugucggcgggcuccggggagguggauuccuucagccuggggcugcugugcaucagcaucaugaucgaggaggucaugcggucacgcuggucccgcaagaugcuuaugacgggaacccucgcgguguucuuccuauuaaucaugggucaacugacauggaacgaccugauccgcagcugcaucauggugggggcaaacgccucggaucguaugggcaugggcacgaccuaucucgcgcugauggccaccuucaaaaugcggcccauguucgccguuggccugcuauuccggcggcuaaccagccgcgaggugcugcuccugacuaucggguugucccucgucgccucaguugagcugcccaacucccuugaggaacucggcgacggccuggccaugggcaucaugaucuuaaagcuucugacagauuuucagucguaucagcucugggccacccuccugucccugacguucauaaaaacuaccuuuagccuccacuacgccuggaagaccauggcaauggugcugaguauugucagccugcugccgcuuugccuguccaccacgagccagaaaaccaccuggcuccccguguugcugggcucccucggauguaagccgcugaccauguucuuaauagcagaaaacaagaucuggggccggaaauccuggccgcucaacgaggggaucauggcggugggcauugucagcauacugcucuccagccuccugaagaacgaugugccucuggccggcccccucaucgccggcggcaugcugauagccugcuacgugaucuccgggagcuccgccgaccugagucucgagaaggccgccgagguguccugggaagaggaggccgagcacaguggcgccucccacaacauccugguggaaguucaagacgacgggaccaugaagaucaaggaugaagagcgggacgacacgcugacaauccuccugaaggccacucugcuggcggucagcgguguguacccacuuuccaucccagccacccucuucguuugguacuucuggcagaagaagaagcagcggagcgggguucucugggacacgcccagcccgcccgagguggagcgggccgugcuggacgaugggaucuaucggaucaugcagcgcggccugcuggggcggagccaggucggcguggggguguuccaagagaacguuuuccacacuauguggcacgugacacgcggcgccgugcucauguaccagggaaagcgccuggagcccaguugggccucagucaagaaggacuugaucuccuauggcggcggguggcgacuccagggcagcuggaauaccggugaagagguccaggugaucgcggucgagcccggcaagaacccuaagaauguucagacggcccccggaacauucaaaacgcccgaaggcgaggugggcgccaucgcccuggacuucaagcccggaacgucuggcagccccaucgucaaccgggaagggaaaauugugggccucuacggcaacgggguggucacgacuagcggaaccuauguguccgccaucgcgcaggccaaggccagccaagaggggccucuaccggagauugaagacgaaguguuccgcaagcggaaucugaccauaauggaccugcauccaggcuccgggaagacccgucgguauuugccggccaucguucgcgaagcgaucaaacggaagcugcgcacacugauccuugcucccacccgcgugguggccagcgaaauggcugaggcucugaaaggaaugcccaucagauaccagacuacggcgguuaagucagaacacaccggccgcgagaucgucgaccucaugugccacgccaccuuuaccaugcggcuccugucccccgugcgcgucccgaacuacaacaugaucaucauggaugaggcucacuucacggacccauccucgaucgccgcgcggggguacaucagcacccgcgugggcaugggugaggcagccgccaucuucaugacggcaacgccgcccgggucgguagaagcuuucccgcaguccaaugcggucauccaagacgaagaacgggacauucccgagcgcucguggaacuccggguacgaguggauaacggacuuuccaggcaaaaccgugugguucgugcccagcaucaaguccggcaaugacaucgccaacugccugcggaagaaugggaagcgcguuauccaacucagccggaagaccuucgacacagaguaccagaagacgaagaacaacgacugggacuacguggugacgaccgacauaucugagaugggagcaaacuuucgagccgaccgugucaucgauccacgcagaugccugaagccgguaauacugaaggacgggccagagcgcgucauccucgcgggcccaaugccggugaccguagcgagcgccgcccagcggcgcggucggaucggccgcaaucauaacaaggagggcgaccaguacaucuacauggggcagccucugaauaacgaugaggaccacgcccacuggacugaggcgaagauguuacucgacaauaucaacaccccggagggaaucauccccgcccuguucgaacccgaaagggagaagagugccgccaucgauggcgaauaccggcuaaggggcgaggcgcguaagacauucgucgaguuaaugcggcgcggggaucugccgguauggcugagcuacaagguggcguccgagggcuuccaguacuccgacagacgcuggugcuucgacggcgagcgcaacaaucaaguccucgaggagaacauggauguggagauuuggaccaaggagggggagcggaagaagcugagaccacgguggcuggaugcccgaacuuacagcgaccccuuagcgcugcgggaguucaaggaguucgccgcgggccgccgguccgugagcggugaccugaucuuggagaucggcaagcucccgcagcaucucacacaacgcgcgcagaaugcccucgauaaccuggucaugcugcacaauuccgagcagggcgggcgagcauaccgccacgccauggaggagcucccagacaccauugagacccugaugcuccuugcgcucauagccgugcugacgggugggguaacacucuucuuccugucaggccgggggcuagggaaaaccuccaucggccuccugugcgugauggccagcucugcccugcucuggauggccagcguggaaccccacuggaucgcggcuuccaucauccuggaguucuuccugaugguucucuuaauccccgaaccggaccgccagcggacgccccaggacaaucagcuggccuacgucguuaucggguuacuguucaugauccugacugucgcggccaaugagaugggacucuuagaaacaacuaagaaggaucuggggauaggccaugucgcgguggagaaccaccaccacgccaccaugcucgacgucgacuugcaccccgccagugccuggacauuguacgcggucgccacgaccaucaucacuccgaugaugcgccacaccauagagaauacgaccgccaacauaucccucacggccaucgccaaucaggcggcuauccucauggggcuggauaaaggguggcccauuagcaagauggacaucggcgugcccuuacuggcccuagggugcuauucgcagguaaacccccucacccugacugccgccgugcugaugcucguggcgcauuacgcaaucaucggcccugggcugcaggccaaggccacaagagaggcccagaaacggaccgcugccgguaucaugaagaacccgacgguagacgguaucgucgccaucgaccuggaccccguaguguaugaugccaaguuugaaaagcaacucggccagauuaugcugcugauacucugcacuagccaaauacugcucaugcggacaaccugggcccuaugcgaguccauaacccuggcgacuggaccucugaccacccucugggaggggucgccgggcaaguuuuggaauaccacuauugccgucuccauggccaacaucuuccgugguuccuauuuggccggcgccggguuagcguucucacucaugaaaucccucgggggcgggaggcggggaaccggggcccaaggcgagacccugggcgagaaauggaagcgccaauuaaaucaacucucaaagucagaguucaacaccuacaagcggagcgggaucauggagguggaccgcuccgaggccaaggagggccucagacgcggcgaaacgaccaaacacgcgguuaguagagggaccgccaagcucaggugguucgucgagcggaaccugguuaagcccgaggggaaagugauugaccugggcuguggucgggggggcugguccuacuacugcgcaggcuuaaagaaagucaccgaggucaaaggguacaccaaggguggacccggccacgaggagcccaucccaauggccaccuacggcuggaacuuggucaaacugcauagcggcaaggacguuuucuucauaccuccggaaaagugcgauacauuacucugcgauauaggggaguccagccccaacccgaccauagaggagggccggacccuucgcguacugaagaugguggagcccuggcuucgggggaaccaguuuugcauaaagauccugaaccccuacaugccguccgucguggagacucuggagcacaugcagcgcaagcacggcggcaugcucgugcggaacccguuaucgcgcaauuccacccacgagauguacugggucagcuguggaacugguaacaucgucuccgccguaaauaugacgagccgcaugcugcugaacagguuuacgauggcccacagaaagcccacuuaugagcgggaugucgaccugggggccggcacucgccacguggccguggagcccgaggucgcgaaccuugacaucaucggccagcggaucgagaacauaaagcaugaacacaaguccaccuggcauuacgacgaggauaaccccuauaagacuugggccuaucacggcucuuacgagguaaagcccucuggcagcgccucuuccauggucaacgggguggugaagcuuuuaaccaagcccugggacgucauccccauggugacgcagaucgcgaugaccgauacgacaccguuuggacaacagcgcguguucaaggagaaggucgauacccggaccccgaaagccaaacgcgggaccgcccagauaauggaggugaccgcccgguggcuguggggcuuccucagccgcaacaagaaaccccggaucuggacccgagaagaggucacccggaagguacgcuccaaugccggcaucggggcaggcgugggagacgagaaccaguggaacagcgcaaaaaagggcguggaggacgagcgguucugggaccuaguccacagagagcgggaguuacacaaacaagggaaaugcgcgaccugcguguauaauaugaugggaaagcgcgagaaaaagcugggagaguuugguaaggccaaggggucccgggcgaucugguacauguggcuuggagccagauuccuggaguucgaggcccucggcuucaugaacgaggaccacugguuuagccgggagaauagucugagcggcguggagggcgaaggauugcacaaguugggguacauccugcgcgacauuucaaagaucccgggagguaauauguaugcagacgacaccgcaggaugggacacgcgcaucacagaggacgaccugcagaacgaggcgaaaaucacggacauaauggagccugagcacgcccuucuagccacuagcauauucaagcugacguaccagaauaaagucgucagagugcaacgccccgcaaagaacggaaccgucauggacgugauaucccggcgagaccagcgugggucuggccaggucggcacguacggccucaacaccuucaccaauauggaggcccaguuaauacgccaaauggaguccgaaggaaucuucucacccuccgagcucgagacccccaacuuagcggaacggguguuagacuggcuggagaaguacggugucgagcgauugaagcgcauggcuaucaguggagacgacugcgugguaaagccgaucgacgaucgcuuugccacggcccuaaccgcccucaacgacauggggaaggugcggaaggacaucccacaaugggagcccuccaagggcuggaacgacuggcaacaagucccauuuugcagccaucauuuccaccaacuuaucaugaaggacgguagagagaucgucguaccgugucggaaccaggacgaguuagugggcagagcgcgggucucacaaggggccggauggucccugcgcgagaccgccugccucggcaagagcuacgcucagauguggcaacugauguacuuccaucggagagaccugcggcuagccgcgaacgcaaucuguagugcgguaccaguggacuggguccccaccucaaggacgacuugguccauccacgcccaccaccaguggaugacaaccgaggacauguuaagcguguggaaccgcguuuggaucgaggagaacccuuggauggaggauaagacgcacaucaguagcuggggcgacguacccuaccuggguaagcgggaagaucaguggugcgggucccugauaggccugacggcgcgagccacuugggcaaccaacauccagguggccauaaaccaggugcggcgacugauagggaacgagaacuaccucgacuacaugacgagcaugaagcgauucaaaaacgagucggacccggaaggggcccugugguga

SEQ ID NO: 24288 - RNA, 9876 nt, Artificial Sequence
  derived and/or modified CDS sequence (opt11) from DENV-1__FJ882546__SS-prME
agcgugaccaugcuccucaugcugaugcccaccgcccuugccuuccaccucacaacuagaggcggggagccccacaugaucgugagcaagcaggaacgggggaagagccugcuguucaagaccagcgccggggugaacaugugcacccucaucgccauggacuugggcgagcugugcgaggacaccaugaccuauaagugcccgcgaaucaccgaggccgagcccgacgacguggacuguuggugcaaugccaccgacacaugggugaccuacgggacaugcagccagaccggcgagcaccggcgugacaagcgcuccguggcccucgcgccgcacgugggucuggggcucgagacacgcacagaaacuuggaugagcuccgaaggcgccuggaaacagauccagaggguggagaccugggcccuccgccaccccggguucacggugaucgcccuguuccuggcgcacgccauaggcacaucaauaacgcagaagggcauaaucuuuauccuccugaugcuggugacccccuccauggccaugcggugcgucggcaucggcagucgcgauuucguggagggguuauccggcgccacguggguggacgucgugcuggagcacggauccugcgugaccaccauggccaaggacaagcccacccucgacauagagcugcugaagacggaggucacaaaucccgcggugcugcggaaguugugcaucgaggccaagaucucgaacacaaccacggacagccguugcccuacccagggcgaggcuacccugguggaggagcaggacgcgaauuucgucugccggaggaccuucguggaccgggguuggggcaauggcugugggcuguucggcaaggggucucucaucacgugcgccaaauuuaagugcgugaccaaacucgagggcaagaucguccaguacgagaacuuaaaguacagcgugauagugaccguacauacaggcgaccagcaccaggugggaaacgagagcacggagcacggcaccaccgcgaccaucacgccacaggccccaacgaccgagauccagcuaacagacuacggggccuugacccuggauugcagcccgcgcacuggccucgacuucaacgagaugguccugcugacgaugaaggagaaguccuggcuaguccacaagcagugguuccuggaccugccccucccguggaccagcggggccagcaccucccaggagacguggaaccggcaagaccugcuggugaccuucaagaccgcgcacgcgaagaaacaggaggucguggugcucggcagccaggagggugcgaugcacaccgcccugacgggggccaccgaaauccagacauccggcaccacgaccaucuucgcagggcaccugaagugccgccucaagauggacaagcugacccugaagggcaugaguuauguuaugugcaccgggaguuucaagcucgagaaggagguugcugagacgcaacacggcaccguacuuguccagaucaaguacgaaggcaccgacgcccccugcaagauccccuucagcacccaggaugagaaaggggugacgcagaacggaagacugaucaccgcuaacccuaucguaaccgacaaggagaaacccgucaacaucgaggcggagccgccauucggggaguccuacaucgucaucggcgccggcgagaaggcccugaagcuaucgugguuuaagaagggguccucgaucggcaagauguucgaagccaccgcccgcggggcccggcgaauggcaauacugggggacacggccugggauuucggguccaucggcgguguguucaccagcgucgguaaacugguacaccagaucuucggcacugccuacgggguccucuucuccggcgucagcuggacaaugaagaucgggaucggggugcuguuaacguggcucggccugaauucccgcagcaccagucugagcaugaccugcaucgccguggggcucgucacacucuaccugggcgugaugguacaggccgacucagguugcgucauuaacuggaaggguagagaacugaagugcgguucagguauauucgugaccaacgaggugcacaccuggaccgagcaguacaaguuccaggcggacagcccgaaaaggcuguccgccgcuaucggcaaggcgugggaggaggggguuugcggcauacggagcgccaccaggcuggagaacauuauguggaagcagauauccaacgaacucaaccacauccugcuggagaacgauaugaagcucaccgugguggucggggacguggccggcauacuggggcaggguaagaagaugauccggccccagcccauggaguauaaauacucuuggaaguccuggggcaaagccaaaaucaucggggcggaugcacagaacacgaccuucauuaucgacggccccaacaccccggagugucccgacgaucagcgcgcguggaacaucugggagguggaggacuacggguuuggcaucuucaccacgaauauuuggcugaagcuacgggauagcuacacccaggucugugaccaccgccugauguccgccgcgaucaaggacaguaaagcagugcacgccgacaugggcuacuggaucgaguccgagaagaacgaaaccuggaagcuggcgcgggccaguuucaucgaggugaagaccugcaucuggcccaagucccacacgcucuggagcaacggaguccuggaguccgagaugaucaucccgaagaucuacggcggcccgaucucgcagcacaacuaccgccccgguuacuucacccagaccgcugggcccuggcaccugggcaagcucgagcuggacuucgaccugugugaggggaccacgguggucgucgacgagcacugugguaaccggggcccgucccuccgcaccaccaccgugacagguaagaucauccacgagugguguugucggagcugcacccugccaccccugcgcuuccggggcgaggacgggugcugguauggcauggagauccgccccgugaaggagaaggaggagaaccucgucaaauccaugguuagcgcagguagcggugaggucgacuccuucagccugggccugcucugcaucucuaucaugaucgaagaggucaugcggagccgcuggucccggaagaugcugaugaccgggacucuagccguauucuuccuccugaucaugggacagcuaacguggaacgaccucauccgacuguguaucauggugggggcaaacgcuucagaucgcaugggcaugggcaccaccuaccuggcccucauggccaccuucaagaugcggccgauguucgccguagggcuguuauuccgacggcuaacgucgcgggaggugcuacugcucacuaucgggcugagccugguggcguccgucgagcuccccaacagcuuagaggaacugggggauggucucgcaaugggcaucaugauccugaagcugcucacugacuuccagucccaccagcucugggcaaccuugcucagccugacguucaucaagaccaccuucucccuacacuacgccuggaagaccauggcgauggugcucagcaucgucuccuuauuuccccugugccucagcacgaccucccagaagaccacauggcuucccgugcugcucgggagccucggcugcaagccgcugacgauguuccucaucgccgagaacaagauuugggggcggaaauccuggcccuuaaacgaaggcaucauggccguggggaucgucaguauccugcucagcucccugcugaagaacgacgugccccucgccggcccccuaaucgccggcggaaugcugaucgcaugcuacgugaucagcggcucuagcgccgaucucuccuuggagaaggccgccgaagucucaugggaggaggaggccgagcauuccggggcgagccacaacauccugguggaggugcaggacgacggcacgaugaaaaucaaggacgaagagcgcgacgauacccucaccaucuugcugaaggcuacccuccuggccgucuccgggguguacccgcugagcaucccagccacucucuucgugugguacuucuggcagaaaaaaaagcagcgauccgguguccuaugggacacuccgagcccgcccgagguggagcgcgccguguuagacgacggcauauaccggaucaugcagcgggguuugcucggccguagccaggucggcguuggcguguuucaagaaaauguuuuccacaccauguggcacgugacccguggggcggugcugauguaucagggcaagcggcuggaacccagcugggccuccgucaagaaggaccuuaucuccuacggggggggcuggcgccugaggggaucuuggaacacgggagaggagguacaggugaucgcaguggagcccgggaagaaccccaagaauguacagaccgcccccggaaccuucaagaccccugagggugaggucggggccaucgcgcucgacuucaagccgggcacgagcgggucgcccaucgucaaucgcgaaggcaagauagugggucucuaugggaacggcgugguaaccaccagcgggaccuacgugagcgccaucgcucaggccaaggcgucccaggagggcccguuaccggagaucgaggacgaaguguuccggaagcgcaaccugacgaucauggaucuccaccccgguagcggcaagacccggagauaccugccggcuaucguucgggaggccaucaagcgcaagcugcgcacccucauccuggcccccacgcgggugguugccuccgagauggcggaagcacugaaggguaugcccauucgguaccagacaaccgccguaaagagcgagcacaccgggaaggagauaguggaccucaugugccacgccaccuucacgaugcggcugcugucccccgugcgcgucccgaacuacaacaugauaaucauggacgaggcccacuuuaccgaccccagcuccaucgcggcccguggcuacaucagcacccguguggggaugggcgaggccgcugcuaucuucaugacagcgacgccuccaggguccguggaggccuucccgcaauccaacgccgugauucaggacgaggagcgggauauccccgagcgcuccuggaacagcggguacgaguggaucaccgauuuucccggcaaaacuguaugguucgugccgucuaucaaaagugggaacgacauugccaacugccuccggaagaacggaaagcgcgugauccagcugucaagaaagaccuucgacacggaguaccagaagaccaagaacaaugauugggauuauguagugaccaccgacaucagcgaaaugggggcgaacuuccgcgccgaccgggucaucgacccgcgccggugccugaagcccgugauccucaaggacggcccugagagaguaauccuggcugggcccaugccggucacgguggccuccgccgcgcaacggcgcggcaggauuggaagaaaccacaacaaggagggggaccaguacaucuauaugggacagccccugaacaacgacgaggaccaugcucacuggacugaggccaagaugcuccuggacaacaucaacaccccagagggaaucauccccgccuuguuugagccggagcgcgagaaauccgccgcggucgacggcgaauacagacuucgcggggaggcccggaagaccuucguggagcugaugcggcggggcgaccugcccguguggcuuuccuacaaagucgccagcgagggcuuccaguacucggacagacgguggugcuucgacggggagcgcaacaaccaggugcuugaggaaaauauggauguggagaucuggacgaaagagggcgagcggaagaagcugcgcccccgguggcucgacgcccgcaccuauuccgauccccuggcacuccgagaguucaaggaguucgcggccgggcguaaaagcgucuccggcgaccuuauccuggaaaucgguaaacugccgcagcaccucacccagcgggcgcagaaugcccuggacaaccuggugaugcuccacaacuccgagcaaggcgggcgcgcguacaggcacgcuauggaggagcugcccgacaccaucgagacgcugaugcuccuggcccuaaucgccgugcucaccgguggcgucacccuguucuuccugucugggcgcggccucggcaagaccucuaucgggcugcugugcgugauggccuccagcgugcuccuguggauggcaucagucgagccgcauuggaucgccgcgagcaucaucuuggaguucuuccucaugguguuacugauccccgagccggaccggcaacgcacgccccaggacaaccagcucgccuacguggucauuggcuugcuguucaugauccucacgguggcugccaacgagaugggguugcuggagaccaccaagaaggaucucggcaucgggcacguggcagucgagaaucaccaccacgccgccaugcuagacguagaccugcaccccgccuccgcguggacacucuacgccgucgcuacgaccaucaucacaccgaugaugcggcacaccauugaaaacacgaccgccaacaucagccuaaccgccauagcuaaccaggccgccauccugaugggacucgacaagggguggcccaucucaaagauggauaucggggucccccuguuggcucucggcuguuacagccaggugaacccacugacccugacggcggcagugcucaugcuugucgcccacuacgccaucaucgggcccggucugcaagccaaagcgacccgcgaagcccagaagcgcaccgccgccgggaucaugaaaaacccgaccguggacggaaucguggccaucgaccucgaccccgucguguaugacgcgaaguucgagaagcagcucggccagauaaugcugcucauccugugcacgucccagauucugcucaugcggacaaccugggcgcugugcgagagcauuacccuggccacggggccccugaccacccugugggagggcuccccggggaaguucuggaacaccacgaucgcggugagcauggccaacaucuuccggggauccuaccuggccggagccgggcucgccuucagccugaugaagucucuaggcggaggucggcgcgggaccggcgcccagggcgagacccuaggcgaaaaguggaagcggcaauugaaccaauuauccaaguccgaguucaacaccuacaagcgcuccggcaucauggaggucgaccggagcgaggcgaaggaggggcucaagcgcggugagacuaccaagcaugccgugucccgggggaccgcgaaguuacgcugguucguggagcggaaucuggucaaacccgagggcaaggugauugaccugggcugcggacgcggcggguggagcuacuacugugccgggcucaagaagguuaccgaggucaaaggguacacgaaggggggucccgggcacgaggaaccuaucccgauggccaccuauggguggaaccuggugaagcugcacucggggaaggacguguuuuucaucccgcccgagaagugcgacacacuccugugcgacaucggcgagagcucccccaacccgacuauugaagaggggcggacgcugcgcguuuugaagaugguggagcccuggcugcggggcaaccaguucugcaucaagauacugaaucccuacaugcccuccguggucgagacccuagagcagaugcaacgcaagcacggggggaugcugguucggaaccccuuaagucguaauagcacccacgagauguacuggguguccugcgggaccgggaacaucgugagcgcggucaauaugacuucccggaugcuccugaaccgcuuuacgauggcacaccgcaagcccacauacgagcgagauguggaucugggcaccggcacccgccacgucgcuguggaacccgaaguagcgaaccucgacaucaucgggcagcggauugagaacaucaagcacgagcacaagagcacguggcacuaugacgaggacaaccccuacaagaccugggccuaccacggcucauacgaggucaagccgagcggauccgccagcagcauggugaacggagucgucaaacuucuuaccaagcccugggacgugauccccauggucacccagauugcaaugaccgagcuccaccugggacagcagcgcguguucaaggagaagguggacacccggacgccccgcgccaagcggggaaccgcucagaucauggagaugacggcccgcuggcucuggggcuuccucucccgaaacaagaucccccgcaucugcacgcgggaagaguucacccguaaagugcgcagcaacgcggccauaggagccguguucgucgaugagaaccaauggaacuccgcaaaggaggcggucgaggacgagagguucugggacuuaguccaccgggagcgagagcugcacaagcagggcaagugcgccaccuguguauacaacaugauggggaagcgggagaagaagcucggugaguucgggaaggccaagggcagucgcgccaucugguauauguggcugggugccagauuccuagaguuugaggcguugggguucaugaaugaggaccacugguuuucgcgcgaaaacagccugaguggcgucgagggggagggccugcacaagcucggguacauucugcgcgauaucagcaagauucccggcggcaacauguacgccgacgacacggcggggugggacacccgcauuacagaggacgaccugcaaaaugaggccaagauuaccgacaucauggagcccgagcacgcacuccuggcgaaggccauuuuuaaacugacguaccagaacaagguggugcguguccaaaggccugccaaaaacggcaccgugauggacgugaucucccgccgugaucagcgcgggagcggccaggucgguaccuacgggcucaacaccuuuacuaacauggaggcucagcugauccggcagauggaguccgaggagauuuucagcccguccgaguuggagaccccaaaccucgccgagcgcgcgcuggacuggcuagaaaaguacggcguggagcggcuuaagcgcauggccaucagcggggacgacugcguggucaagcccaucgacgaccgguucgccaccgcacucaccgcccugaacgacauggggaaggugcgcaaggacaucccgcagugggagcccuccaagggguggaacgacuggcaacagguucccuucugcagccaccacuuccaccaguuaaucaugaaagacggcagagagaucgucgugcccugccgaaaccaagacgagcuggugggccgugcgcgcguaagucagggggccggcuggagccugcgggagacggccugccuuggcaaguccuaugcgcaaauguggcagcugauguacuuccaccgccgggaccugcgccucgcggccaacgccauuugcuccgccgugccgguggacuggguccccaccagccggacaacuugguccauacacgcccaccaccaguggaugacgaccgaggauaugcugagcguauggaaccgcguguggaucgaggagaaccccuggauggaggacaagacacacaucuccagcugggaggacguuccauacuugggcaaacgggaggaccaguggugcggguccuugaucgggcugaccgcgcgggccacgugggccaccaacauccagguggccaucaaccaggugcgccggcugaucggcaacgaaaauuacuuagacuacaugacgagcaugaagcgcuuuaaaaaugagucugauccggagggcgcccugugguga

SEQ ID NO: 24289 - RNA, 9879 nt, Artificial Sequence
  derived and/or modified CDS sequence (opt11) from DENV-1__KF921935__SS-prME
ucggugacaaugcugcugaugcugaugcccaccgcgcuggccuuccaccucaccacacggggcggggaaccgcacaugaucgucuccaaacaggaacgugggaagagucuacuguucaaaaccucagccggggugaauaugugcacccucauagccauggaccugggggaauugugcgaggauacuaugacauacaagugcccucggaucaccgagaccgagcccgacgacguggauuguugguguaacgccaccgacacaugggugaccuacgggacguguagccagacgggggagcacaggcgggacaaaagauccguggcccucgccccacacgugggacuagggcuggaaacucgcacggagaccuggaugagcuccgagggcgccuggaaacagauccagcgggucgagacgugggcccuccggcacccaggcuucacugugaucgcucuguuccuagcccacgcgaucggcacuucuauuacccaaaagggaaucaucuuuauccuccugaugcuggugacacccuccauggccaugcggugcgucggcaucggcuccagagacuucguggaagggcuguccggggccaccuggguggauguuguauuagaacaugggagcuguguuaccaccauggccaaggauaaacccacccuggauaucgagcuacugaaaaccgaagucacgaaccccgccgugcugcggaaacucugcaucgaggcaaagaucuccaauaccacgaccgacagccgcuguccgacgcagggcgaggcaacccuaguggaggagcaggacgccaauuucguuugccggcgcacguucguggaccgggggugggggaacgguugcgggcuauucggcaaggggucccucauuacgugugccaaguucaaaugcgucaccaagcuggaagggaagaucguccaguaugagaaccugaaguacucagugaucgugacaguccacacgggcgaccagcaccaggucggaaaugagucuaccgagcacggcaccaccgccaccaucacgccccaggcgccaaccaccgaaauccagcucaccgacuauggagcacugacguuggacugcagcccccgcaccggccucgacuucaacgagaugguccugcugaccaugaaagagaaguccuggcuagugcacaagcagugguuuuuagaccucccucuaccguggaccucuggagcuagcacaucucaggagacguggaaucggcaggaccugcugguaaccuuuaaaaccgcccaugcgaaaaagcaagaagucgugguacucgguucccaggagggcgccaugcacacggcccugaccggggccacugagauccagaccuccggcacgaccacaaucuucgccggacaccugaagugccgccucaaaauggacaagcuaacccugaagggcaugagcuacguuauguguacggggucauucaagcucgaaaaagagguggcugagacucagcauggcacaguguuagugcagaucaaauacgaaggaaccgacgcgcccugcaagauacccuuucugacgcaggaugagaaggggguuacccaaaacggcaggcugauaaccgccaacccgaucguuaccgacaaggaaaagccugugaauaucgaagccgagccgcccuuuggggagucuuacaucaucaucggcgccggcgagaaggcgcucaagcugaguugguuuaagaaggggucaaguauaggaaaaauguucgaggccacggcccgaggggcccggcgcauggcgauccuuggcgacaccgccugggacuucgguaguaucgggggcguguucaccagcguggggaagcucguccaccagauauucggcaccgccuacgggguuuuauucucgggcguauccuggacgaugaagauagggaucggcguccugcucaccugguugggccugaauagccgcuccaccagccuuuccaugacuuguaucgccguugggcuggugacccuuuaccucggcgugaugguccaggcagacagcgggugcgucaucaacuggaagggccgggagcugaagugcgguuccgggaucuucgucaccaaugaaguccacaccuggaccgagcaguacaaguuccaggccgacuccccgaagcgacucagcgcggcuaucggcaaggccugggaagaaggggugugcggcauccgguccgcgaccagauuggagaacaucauguggaagcagaucagcaacgagcugaaccacauccugcucgagaaugacaugaaauucaccgucguggugggagacgucgcaggaauacuggcucaggggaaggagaugauccggccucagcccauggaguacaaguacuccuggaagucguggggcaaggccaaaaucaucggggcugaugugcagaacacuacguucaucaucgacggacccaacaccccagagugcccagacgaccaacgcgccuggaacauaugggagguggaagacuacggcuucggcaucuucacgaccaacaucuggcugaagcugcgggacucccacacacagguaugcgaccaccgccugaugagcgccgccauuaaagauuccaaggcugugcacgcugacaugggcuacuggauugagucggagaagaacgagaccuggaagcuggcacgggcguccuucaucgaggucaagacgugcaucuggcccaaaagccacacccucugguccaacggcguccuggaaagcgagaugauaaucccaaagauuuacggggguccgauaucucagcacaauuaccgccccggauauuuuacccagacggcaggccccuggcacuuggggaaacucgagcuggacuucgaccugugcgaggguacaaccgugguggucgaugagcacugcggcaaccgggggccgucacuccgcacuaccaccgugaccggcaagaucauacaugaguggugcugccggucgugcacgcugccaccccuccgcuucagaggggaagauggcugcugguacgguauggagauccgcccagugaaggagaaagaagagaaucucgugaagaguauggugucggcuggcagcggagagguggacagcuucucucucggguuacuaugcaucagcaucaugaucgaggaggucaugcguucccgauggagccggaagaugcugaugacaggcacgcuugccguguucuuccuccuaauaauggggcagcucaccuggaaugaucucauacgcuuaugcaucauggugggcgccaaugcguccgaccggauggggaugggaaccaccuaucuagcccucauggcgacuuuuaagaugagacccauguucgccgucggguuacuguuucgcaggcucacaagccgcgagguccugcuacuaaccaucgggcucucccugguggccagcgucgagcuccccaauucccuugaggagcugggcgacgggcucgcuaugggcauuaugauccugaagcugcucaccgacuuccaaucccaccagcugugggccacucugcucucccugaccuuuauaaaaaccacauucucgcugcacuacgcuuggaagacgauggcuauggugcucucaaucgucucacuguucccccugugccucuccacgaccagccagaagacuacgugguuacccgugcugcucggaucccuggggugcaagccacugaccauguuccucaucgcugagaacaagaucuggggccggcgcagcuggccccugaacgagggaaucauggcugugggaaucgucagcauuuugcuaucgucacugcugaaaaacgacgugccccuugccgggccgcugaucgcaggcgggaugcucauugccugcuacgugaucuccggcagcuccgcggaucugagccuagagaaggccgccgaggucuccugggaggaggaggccgagcacagcggcgccucccauaauauccugguggagguacaagacgacgggaccaugaagaucaaggacgaagaacgggacgacacucuuaccauacugcugaaggcaacccuauuggccgucagcggaguuuacccucugaguauccccgcaacccuguucgugugguacuucuggcagaagaagaagcagcgcagcggugucuugugggacacccccucuccacccgagguggaacgggccguccuggaugacggcauauaccguaucaugcagcgaggccugcuugggcgcagccaggucggcgugggggucuuccaggagaacgucuuccacacgauguggcaugugacgagaggggccgugcugauguaucaagggaagcgccuugagcccuccugggcgucugucaagaaggaccucaucucguauggcggcgguuggaggcugcaggggagcuggaauacuggagaggagguccaagugauagccgucgagccggggaagaacccaaagaacgugcagacugcccccgggacguucaaaacgcccgagggagaagugggcgccaucgcccuggacuucaagccugggaccucgggcucuccgaucgucaaccgcgagggaaagaucguaggcuuguacggaaacgggguuguaaccaccucgggcacguacgucucagcgauugcccaggccaaagccucgcaggaggggcccuugcccgagaucgaggacgaaguuuuccggaagaggaaccugaccauuauggaccuccacccuggcucagggaagacucggcgcuaccugcccgcgauuguacgugaagccaucaagcgcaaacuucgaacccucauccuggcccccacacgggugguggccucagaaauggccgaggcgcugaaaggcaugcccaucagauaccaaaccaccgccgucaaguccgaacacaccggcaaagagaucguggacuuaaugugccaugccacguucaccaugcggcugcugagucccguucgcguccccaacuacaauaugauuauuauggacgaggcucacuucaccgaccccuccagcauugccgcgcggggcuacaucucgacucgcgugggaaugggggaggccgcggccaucuuuaugacggcgacuccgcccgggucaguggaggcuuucccgcaguccaacgccgucauacaggaugaggagcgggacauccccgaaagauccuggaacuccggguacgaauggaucacagacuucccuggcaagaccgugugguucgugcccaguaucaagagcggcaaugacaucgccaacugccuccgaaagaacgggaaacgcgucauccaacugagccggaagacguucgacacggaguaccagaagaccaagaacaacgacugggacuauguggugaccacggacaucagcgagaugggugccaacuuucgcgcggaucgggucaucgacccacgccggugucuaaagcccguaauccucaaggacggaccggagcgcgugauccuggcuggccccaugccugucaccguggcaagcgccgcucaacggcgcgggcggaucggcaggaaccacaacaaggaaggcgaccaguacauuuacauggggcagccccugaacaaugacgaagaccacgcccacuggaccgaggccaagauguuacucgacaauaucaacacccccgaaggcaucauccccgcccuguucgagcccgagagggagaaguccgccgcaaucgacggugaguauagacuccgcggggaggcgcggaagacauucgucgagcugaugcgccgcggggaccuucccguguggcucagcuacaagguggcuuccgagggcuuccaauauuccgaccgccgguggugcuucgacggcgagcgcaauaaccaggugcuggaggagaauauggacguggagaucuggacuaaggagggagagcggaagaagcugcggcccagguggcuggacgcccgcaccuauagcgaucccuuggcccugagggaguucaaggaguuugccgcgggcaggcgguccgugucgggggaucucauccuggagauuggcaagcugccgcagcaccucacucaacgagcccaaaacgcccuggacaaccuggucauguuacacaacuccgagcagggcgggcgggccuaucgucacgcgauggaggagcuucccgauaccaucgagacccucaugcuccuagcccucauugcggugcucaccggcggugugacccuguucuuccuguccggccggggccucgggaagaccaguaucgggcuccuuugcgucauggccagcagugugcugcuauggauggccagcguagagccacacuggaucgccgcuuccaucauccuggaguucuuccucauggucuuacugauccccgaacccgaucggcagaggacgccccaggauaaccagcuggcauauguggugauugggcuucuguuuaugauccucacagucgcugcaaacgagaugggacugcuugaaaccacgaagaaggaccuugguauuggccacguggcuguggagaaucaucaccaugccgccauguuggacgucgaucugcaccccgccagcgccuggacgcucuacgcaguggccacuaccaucauaaccccgaugaugaggcauacgauagagaacacuaccgccaacaucucccugaccgcuaucgcuaaucaggcggcgauccugauggggcucgacaagggcuggcccaucagcaagauggacaucggcgugccccuuuuagcccucggcugcuacucccagguaaauccccucacgcugaccgcugcgguacucaugcuaguggcccacuacgccaucauaggcccggggcugcaggcgaaggcuacccgagaagcacagaagcguacagccgccggcaucaugaagaaucccacggucgacgggauaguugcgauagaccucgacccggugguguacgacgcuaaguucgagaaacagcugggacaaauuaugcuguugaucuugugcaccagccagauccuccuaaugaggaccacgugggcgcugugcgaguccaucacgcuggccaccgggccacucacaacccugugggaggggagcccgggcaaauucuggaacacgaccauagcaguguccauggcuaacaucuuccgggggaguuauuuagccggcgcgggccucgccuucucccugaugaaaucccucggaggagggcgcagaggaacuggugcccaaggugaaacccuaggugagaaguggaaacgucaguugaaccaguuaagcaaguccgaguucaacacguacaagcggagcgguaucauggagguugaucgguccgaggcgaaggagggucucaagcgcggcgagacuacuaagcacgcgguuucuagaggcaccgccaagcugcggugguucguggagaggaacuuggugaagcccgaggggaagguuaucgacuuggguugcggacgagguggguggucguacuacugugccgggcuaaagaaaguuacggaggugaaaggguacaccaaggguggucccggccacgaggaacccauuccgauggccacguacggcuggaaccuggugaagcugcauucuggcaaggacguguuuuucaucccgcccgaaaagugcgacacucuauugugcgacauaggcgaguccagcccgaacccaacaaucgaggaagggcguacccuccgugugcucaagauggucgagcccugguugcgcgggaaucaguucugcaucaagauccuaaacccguacaugcccagcguggucgaaacccucgagcaaaugcagcgaaagcauggcggcaugcugguccgaaacccgcuaagccgaaacucgacccacgagauguacugggugagcugcgggaccggcaacauugugucagccgucaauaugaccagccguauguuacugaaucgcuucaccauggcccaccgcaagcccaccuacgaaagggauguagaccugggggccggcacuaggcacguggcugucgagcccgaaaucgccaaccucgacauaaucggccagcgcauugagaacauuaagcacgagcacaaguccaccuggcacuaugacgaggacaaccccuacaaaaccugggccuaccacgggagcuaugaggugaagccguccggaagcgcgucuuccaugguaaacggggucguaaagcugcugaccaagccaugggaugucaucccuaugguuacacagauugccaugacagacacgacgcccuucggucagcagcggguguucaaggagaagguggacacccguacgccgaaggcuaaacggggcaccgcccaaaucauggaggugaccgccaaguggcucuggggcuuccugagccgcaacaagaagcccagaaucugcacccgcgaggaguucacccggaaggugcgcuccaacgcggccaucggcgccgucuucguggacgagaaccaguggaauagcgcgaaagaagcgguggaggacgaacgguucugggaccugguccaucgcgagcgggagcugcauaagcaggggaagugcgcuaccuguguuuacaacaugaugggcaaacgcgagaagaaauuaggggaguucggcaaggccaaggggucccgggccauuugguacauguggcugggcgcccgcuuccuagaguucgaggcucucgguuucaugaacgaggaccauugguuuagccgggagaacagucugagcggggucgaaggagagggccuucauaagcuaggcuacauccugcgcgauaucuccaagauccccgggggcaacauguacgcggacgacacagccggcugggacacccguaucacggaggacgaccuccagaacgaggcccgaaucaccgacauuauggagcccgagcacgcccugcuggccaagaguaucuucaagcuaaccuaccaaaacaaggucgugcgcgugcaacggccugcuaagaacgggacggucauggacguaauaucaagacgggaccagcgcgguagcggccagguggggacguauggccucaauaccuuuaccaacauggaggcccagcuaauccgacagauggaguccgaggggaucuucagcccguccgagcuugagacucccaacuuggccgaacggguccuggacuggcuggagaaguauggcguggaaaggcuaaagcgcauggccauaucaggggacgacugcguggucaaaccgaucgacgaccgguuugcuacggcccugaccgcacucaacgacaugggcaaagugcgcaaggacaucccccagugggagcccagcaagggguggaacgacuggcagcagguccccuucuguagucaccauuuucaccaacugauaaugaaggacggacgggagaucgucgugccgugccguaaccaagacgagcuggugggccgggcucgcguuagccagggugccggcuggucgcuccgggagaccgcaugucuaggcaaaucguacgcccaaauguggcagcugauguacuuccaccgccgggaucuccgccuggccgccaacgcgaucugcuccgccgugcccguggauuggauacccacaagcaggacgacaugguccauccaugcccaccaccaauggaugaccaccgaagacaugcugucuguuuggaauaggguguggaucgaggagaaccccuggauggaggauaagacgcauaucuccagcuggggugacgucccguaccucgggaagcgagaggaccaguggugcggcucauugaucggcuugaccgcccgggcaaccugggcuaccaacauacaggucgcuauaaaccagguccgucgcuugauugggaacgagaacuauuuggacuacaugaccaguaugaagcgcuuuaagaacgaaggcgaucccgagggugcucugugguga

SEQ ID NO: 24290 - RNA, 9879 nt, Artificial Sequence
  derived and/or modified CDS sequence (opt11) from DENV-1__GQ199776__SS-prME
agcgugaccaugcugcucaugcucaugccaaccgccuuggccuuucaccucaccaccagagguggugagccccacaugauugugucaaagcaggaacgcggcaagagccuacuguucaagaccagcgccggggugaacauguguaccuugaucgccauggaccugggcgagcugugcgaggauacgaugacuuacaaguguccccgcaucaccgaaaccgagcccgacgacguggacugcuggugcaacgccacggacaccuggguaacguacggaaccugcagccagacgggcgagcaccggcgugacaagcgaucaguagcccucgcgccccaugugggccuggggcuggagaccagaaccgagacuuggaugagcuccgaaggcgcguggaagcaaauccagcggguagagacgugggcucuccgccaccccggguucacagugauugcgcuguuccuggcccacgcgaucggcaccagcaucacccagaaggggaucaucuuuaucuuacugaugcuggugacgccuuccauggccaugcggugcgucgguauaggcagcagagacuucguggaggggcucuccggagccaccuggguugaugucgugcuggagcacgggagcugcguuaccacgauggccaaggacaagcccacgcuggauaucgagcuccugaagaccgagguaaccaacccagccgugcugcggaagcucuguaucgaggccaagauuuccaacaccacgaccgacucaagauguccaacccagggcgaggccacccuggucgaagaacaggacgccaacuucgucugccggcgcacguuuguggauaggggcugggggaacggaugcggccuguuugguaaggggucucucaucacgugcgccaaauucaagugugugaccaaacucgagggcaagaucguccaguacgagaaccugaaguacucggugaucgugaccguccacacgggcgaucagcaucagguggggaaugaaaguaccgagcauggcaccacagcuaccaucacgccucaggcccccaccacggagauccagcucaccgacuauggggcccugacgcuugacuguagcccccguaccgggcucgacuucaacgagauggugcuguuaaccaugaaggagaaguccuggcucgugcacaagcagugguuccuggaccugccccuccccuggacaagcggggcuucuacaucccaggagaccuggaaucgucaggaccugcuggugacuuucaagaccgcccacgcuaagaagcaagaggucgugguccucggaucccaggagggcgcgaugcacacagcccugaccggggcgaccgagauccagaccuccggcacaaccaccaucuucgcgggucaccugaagugccgccuuaaaauggacaagcugacacuuaaggguaugagcuacgucauguguacgggguccuucaagcucgagaaggaggucgccgagacccagcacggcacuguacugguacaaaucaaguacgaagggaccgacgcgcccugcaagauccccuucagcacgcaggacgagaagggggucacccagaacggccggcugauuacugccaacccaaucgugacugacaaagagaagcccgucaacaucgaggcagaaccacccuucggagaguccuacaucgucaucggcgccggcgagaaggcgcugaaacucagcugguuuaagaagggguccucgaucggcaagauguuugaggcgacagcacgcggugcccggcgcauggccauccugggcgacaccgcgugggacuucggcuccauuggcggcgucuucaccagcgucggcaagcuggugcaccagaucuucgggacggcauacgguguacuguucuccggcgugagcuggacaaugaagauugggaucggcgugcugcugaccuggcucggucugaauucccgcagcacgucccugagcaugaccugcauagccgugggacuugucacgcuguacuuaggcgugauggugcaggcagacuccggcugcgucaucaauuggaagggccgggagcucaaaugcgggucgggcaucuucgucaccaacgagguacacaccuggaccgagcaguacaaguuccaggccgacagcccgaaacgccuguccgcggccaucggcaaggccugggaggaaggggucugcggcauccggagcgccacgcgccuggagaacauuauguggaagcagaucucaaacgaguugaaccacauccugcucgagaacgacaugaaguucacggugguggucggggacgucgccggcauccucgcgcaggggaagaagaugauacggccccagccuauggaguauaaauacagcuggaagaguuggggcaaggcuaaaauaauaggagcugacgugcagaacaccaccuucauuaucgaugguccuaacaccccagagugucccgacgaucagcgcgccuggaacauaugggaggucgaggacuacggcuucgggauauucaccacuaacaucuggcugaaacugcgggauucuuacacucagguaugugaucaccgccucauguccgcggcgaucaaggacuccaaggccgugcacgccgacaugggcuacuggauugaguccgagaagaacgagaccuggaagcuagccagagcuagcuuuaucgaagucaagacuuguaucuggccaaaaagccacaccuuguggagcaauggcgugcuggagucugagaugaucaucccuaaaaucuacgguggcccuauaagccaacacaacuauagacccggguacuuuacgcaggccgcaggccccuggcaccuggggaagcuggagcucgacuuugaucugugugagggcacaacgguugucguagacgagcacugcggcaaccgggggccgucccugcgcacuaccaccguuacgggcaagaucauccaugaguggugcugcagaagcugcacccucccgccucuccgcuuccgcggcgaagacggcugcugguacgggauggagauucgccccgugaaggaaaaagaggagaaucuggugaagaguauggugagcgcggguaguggcgaggucgacaguuucagccucggguuacugugcauuucgauaaugaucgaggaggugaugcggagccgcuggucccggcggaugcucaugacugggacccucgccguauucuuucuucuuaucauggggcagcugacauggaacgacuugauucgccucugcauuauggucggagcaaacgccagcgacagaauggggaugggcaccacauaccuggcccuuauggccacuuucaagaugcgcccgauguucgccguaggcuuacuguuccggcgcuuaacaucccgugaggugcuccuguuaaccaucgggcucagccugguugcauccguugaguuacccaacagccuugaggagcugggcgacgggcuggccauggguauaaugauucucaagcugcuaacagacuuccagucacaccagcucugggccacccuguugucacuuaccuucaucaaaaccacgcugucccugcauuacgccuggaagaccauggcuaugguccucagcauugugucccuguuccccuuaugccucagcacgaccucccagaagaccacguggcugccagugcugcucggcagucugggaugcaagccgcugaccauguuucucauagccgagaacaaaaucuggggccgccgcuccuggccacugaacgagggaaucauggccguugggauuguauccauccugcuaagcucccugcugaagaacgacgugccccucgcagggccccugaucgccggcggcaugcugauagcaugcuaugucaucagcgggucgagcgccgaccucucccuggagaaggcagcagaggugagcugggaggaagaggcggagcauuccggcgcgagccacaacaucuuaguggagguccaggacgacgguaccaugaagauuaaagacgaggagagagacgacacccucaccauccuucugaaggcuacgcuccuggccgugucaggcguguacccucuaagcaucccugcgacucucuuugucugguacuucuggcagaaaaagaagcagagauccgggguuuugugggacacacccaguccacccgagguggagcgugccgugcuggacgacggcauauaccggaucaugcagaggggccuuuugggucggucccaagugggcguuggggucuuccaggagaacguguuccacacaauguggcacgugacccgcggcgcgguucugauguaucaagggaagcgucuggagcccuccugggccucggugaaaaaggaccuaaucagcuacggaggcggguggcggcugcagggcuccuggaacacuggggaggaagugcaggucaucgccgucgagcccgguaagaaccccaagaacgugcagaccgcuccugguaccuucaagacccccgaaggcgagguaggugccauugcguuggacuucaagccuggcacuuccggcucccccaucgugaaccgggaggggaagaucguuggccucuacggcaacggggucguaaccaccucuggcacuuacguaagcgccaucgcccaagccaaggcaucccaggaggggccucugcccgagaucgaggacgaagucuuuagaaaacggaaccugacgaucauggaccuccaccccggcagcgggaagacccgacgguaccugcccgccaucgugcgcgaggccaucaaacgcaagcuucggacccucauucuggccccaaccaggguggucgccuccgaaauggcagaggcccugaaagggaugcccauacgguaccagacuacugccgucaagagcgagcacacggguaaggagauaguggaccucaugugccacgccacuuucaccaugagacugcugagucccguacgggugccgaacuacaacaugauaaucauggaugaggcucacuucaccgaccccaguuccaucgcggcacgcggcuacaucucaacccgggugggcaugggggaagccgcggccauuuucaugacggcaacuccgccagguuccgucgaggccuucccacagagcaacgcugugauacaggacgaggagagagacauccccgagcgcucguggaacagcggcuaugaguggaucaccgacuucccuggaaagaccgugugguucguaccgaguaucaagagcggcaacgacauagccaacugcuuacguaaaaaugggaagaggguuauccagcuguccaggaagacguucgacacggaauaucaaaaaaccaaaaacaacgacugggacuacguggucacuacggacauaagcgagaugggcgcuaauuuccgggccgaccgcguaaucgacccgcgccgcugccucaagccggugauacucaaggacggccccgagagggucauacuggccggccccaugccggugacggucgccuccgccgcccagcgccggggucgcaucggccggaaccacaacaaggagggcgaccaguacauuuacauggggcagccguugaacaacgacgaggaccacgcccacuggaccgaggccaagaugcucuuggacaacaucaacacccccgagggaauuauucccgcccuguuugagccggagcgggagaaauccgccgcgaucgacggggaauaccgucugcggggcgaggccagaaagaccuuuguggagcugaugaggcgcggggaccuucccguguggcucagcuacaaggucgccucagagggcuuccaguacucugaccggcgauggugcuucgacggcgagcguaacaaccagguguuagaggagaacauggauguagagauuuggaccaaagagggggagcgcaagaaguugcggccccgcuggcuagacgcacggaccuacuccgacccccuggcccuucgggaguucaaggaguucgcggcgggccggcggagcgucuccggggaccucauacuggagaucggcaagcugccgcagcacuuaacccagcgggcccagaaugcauuggacaaccuggucaugcuccacaacagcgagcagggcggacgagccuaccggcacgccauggaagagcuuccagacaccaucgagacccugaugcuuuuggcccugaucgccguucucaccggcggagucacuuuauuuuuccuguccggcagagggcucggaaagaccagcaucggccugcugugcgugauggccucgaguguacuccuguggauggccuccgucgagccccacuggauugcugcuucaauuauccuggaguucuuucucauggugcugcugaucccggagccggaccggcagcgcacgccccaggacaaccagcucgccuauguuguaaucgggcuguuauucaugauacucacgguggccgcgaacgagaugggacugcuggagaccaccaagaaggaccucgguauaggccacguugcugucgagaaccaccaccacgccgccaugcuggacguggaccugcaccccgccucagcguggacccucuacgccguggccacaaccauuaucaccccuaugaugcgccacaccaucgaaaacacgaccgccaacauaagccugacggcgaucgcgaaccaagccgccauccuuauggggcucgacaagggcuggcccaucuccaagauggacauuggcgucccccugcuggcccuggggugcuauagucagguuaaucccuugacauugacggccgccgucuuaaugcuggucgcacacuacgccaucauuggcccggggcugcaagcgaaagcgacccgggaggcucaaaagcgcaccgccgccgggaucaugaagaacccuaccguugacgggaucguagcgaucgaccucgaucccgucguuuacgaugcgaaguucgagaaacaguuaggccaaaucaugcugcucauccucugcacgucacagauacuguugaugagaaccaccugggcccugugcgaaucuaucacgcuugccacgggacccuuaaccacccugugggagggguccccggguaaguuuuggaacaccacgauagccgucuccauggccaacaucuuccgcgggucauacuuagcgggugccggccucgccuuuucccugaugaaaagccucgggggagggcggcgugggaccggcgcucagggcgagacccugggugagaaauggaagcggcaguuaaaucagcuguccaagagcgaguucaacacguacaagcgcucagggaucauggaggucgaccgguccgaggcaaaggagggccuaaagcgcggggagacgaccaagcacgccgugucacggggcaccgccaagcugcgcugguucguggagaggaaucuggucaagcccgaggggaaggugauagaccugggcugcggacgcgggggguggucguacuacugcgccgggcucaagaaggugaccgaagucaagggauacacgaagggcggccccggccacgaggagccaauucccauggccaccuacggguggaaccugguuaaguuacacuccggcaaggacguguucuucaucccacccgaaaagugcgacacgcuccugugcgacaucggggaguccuccccgaacccaacaaucgaggagggacggacccugcgcguccucaagaugguggaacccuggcugcgggguaaccaauucugcaucaagauccugaaccccuacaugccuagcguggucgagacccucgaacaaaugcagcggaagcacgggggcaugcuagugcggaacccgcuaucccgcaauucuacucaugagauguacugggugucuugcgguacagguaacaucgucuccgcgguuaauaugacuucccggaugcugcuaaaucgguucaccauggcccaucguaagcccaccuacgaacgggacguggaccugggggccggcaccagacacgucgugguggagcccgaggucgccaaccuugacaucaucggccagcgcaucgagaacaucaaacacgagcacaagagcaccuggcacuacgaugaggacaaccccuacaagacgugggccuaccauggguccuaugaggugaagccgucuggauccgcguccaguauggucaacgggguugugaagcuguugacuaagccuugggacgugauucccauggucacccagaucgccaugaccgacacgaccccauucggccagcaaagaguguucaaagagaagguagacacccgcacaccgaaggcuaaacgcgggacggcucagaucauggaggugaccgcaaaguggcucuggggcuuccugucaaggaacaagaagcccaggaucugcacccgugaggaauucacccgaaaggugcggagcaacgcggccaucggcgccgucuuuguugacgagaaucaguggaacuccgcaaaggaggcgguugaggacgagcguuucugggaccugguccaccgggagcgcgagcuccacaagcaggggaagugcgccacgugcguguauaacaugaugggcaagcgagaaaagaagcugggggaguucggcaaggccaaggggagccgcgccauuugguacauguggcugggcgcccgguuucucgaguuugaggcgcugggcuucaugaacgaagaucacugguucucccgcgagaacucgcuauccgggguggagggcgaggggcuccauaagcucggguacauccugcgggacaucaguaagaucccugggggcaacauguacgccgaugacaccgccgguugggacacccgaaucaccgaggacgaccuccagaacgaagcgcgcaucaccgauaucauggagccggagcacgcacugcuggcgaagucuauauucaaguugaccuaccagaacaaggucgugcgggugcagcgacccgcaaagaacggcaccgugauggacgugauuagccggcgcgaccagcggggcucuggccagguagguacuuauggccugaauacguucaccaacauggaggcucaguugauccgccaaauggagucugaagggaucuuuuccccuucugagcucgagacccccaaccuggccgagcggguccucgacuggcuggaaaaguacggcgucgagcgccugaagaggauggcgaucuccggggacgauugcguagucaagccgauagacgaccgcuucgcgaccgcccugacggcccuaaacgauaugggcaagguacggaaggacauuccgcagugggagcccagcaagggguggaaugacuggcagcagguuccauucuguucccaccacuuccaccaacugaucaugaaggacggcagggaaaucgucgugccaugccggaaccaggacgaauuagugggcagggcccgcguuucccagggggcuggcuggagcuugagggagaccgcgugucucgggaaguccuacgcccagauguggcaguugauguacuuccaucggcgcgaucugagauuggccgcuaacgcgaucugcagcgccgugccgguugacuggauccccaccucucgcaccacguggagcauacacgcccaucaccaguggaugaccacugaggacaugcuguccgucuggaaccgcguguggaucgaggagaaucccuggauggaggacaaaacccacaucagcuccuggggugacgugccguacuuagggaagcgggaggaccaguggugcggcagccuaauagggcugacggcccgcgccaccugggcgaccaauauccaagucgcuaucaaccagguacggcgccuaaucgggaacgagaacuaucuggacuacaugaccuccaugaagcgguuuaaaaacgagagcgaccccgagggcgcgcugugguga

SEQ ID NO: 24291 - RNA, 9879 nt, Artificial Sequence
  derived and/or modified CDS sequence (opt11) from DENV-1__GQ199777__SS-prME
agcgugaccauguuacugaugcugaugcccaccgccuuggccuuccaccucaccacacggggcggugagccucacaugaucguuagcaagcaggagcggggcaagagccuucuguucaagaccuccgcgggggugaacaugugcacccucauagccauggacuugggggagcugugcgaagacacgaugaccuacaagugcccacgcaucacagagaccgagcccgacgauguggacugcuggugcaacgccacggacaccugggugacuuaugggaccugcagccagacgggcgaacaccggcgagacaagcgguccguggcccuagcgccccacgugggccugggacuggaaacgcgcaccgagaccuggaugagcuccgagggcgcguggaagcagauccagcgcgucgagacgugggcccuccgacaccccggguucaccgugaucgcccuguuccuggcacacgugauaggcacaucaauaacccagaaggggaucaucuucauuuuacugaugcuggucacgcccaguauggcgaugcggugcgugggcaucggcagccgcgacuucguggaggggcucucuggcgccaccugggucgacguuguacuggaacauggaagcugugucaccaccauggccaaggacaaacccacgcuggacaucgaacuccugaagaccgaggugaccaaccccgcagugcuucggaaacucugcaucgaggccaagaucuccaacaccacgaccgacagccgcugcccgacucagggcgaggcgacccuggucgaggagcaggacgccaacuucgugugccgaaggacguucguggacaggggcugggggaacggaugcgggcuguucggcaaggggucccucaucacgugcgccaaguucaagugcgucaccaagcuggaggggaagaucgugcaguacgagaaccugaaguacagcgugaucguaaccgugcacaccggcgaccagcaccaggucgggaaugaguccaccgaacacggcaccaccgccaccauuacgccccaggcccccaccaccgagauccagcucaccgauuacggcgcgcugacccuggacugcuccccccgcaccggccucgacuucaacgagauggugcugcugaccaugaaggagaagagcuggcuugugcauaagcagugguuccuggaucugccccuccccuggaccagcggagcgagcacgucccaggagaccuggaaccggcaggaucugcuggucaccuucaagaccgcccacgccaagaagcaggagguuguggucuuaggcucgcaggagggcgcgaugcacacggcgcucaccggggccaccgagauccagaccuccggcacgaccaccaucuucgccgggcaccugaagugccgucucaagauggacaagcugacccugaagggcaugagcuaugugaugugcacggggcuguucaaacuggagaaggagguggccgagacccagcacggcacuguccugguucagauaaaguacgagggcaccgacgcccccuguaagauucccuucuccacgcaggacgagaagggggugacacagaacgggcggcugaucaccgcgaacccgaucgucacugacaaggagaagcccgugaacaucgaggccgagccgcccuucggggagagcuacaucaucaucggcgccggcgagaaggcccucaagcugaguugguucaagaaagggagcuccauaggaaagauguucgaggcgacggcccgcggggcgcggcgcauggcaauccucggcgacacugccugggacuucgggaguaucggcggcguguucaccagugucggcaagcucgugcaccagaucuucggcacugcguacggugugcuguucucuggcgucuccuggacgaugaagaucgggaucggcguguuacucaccuggcugggccugaacagcagauccaccagccucucgaugaccugcaucgccguggggcugguaacgcuguaccucggagugauggugcaggccgacagcggcugcgucaucaacuggaagggccgggagcugaagugcggguccggcaucuucgucacgaacgagguucacaccuggaccgagcaguacaaguuccaggccgacagcccgaagcgccugagugccgcgaucggcaaggccugggaggaagggguaugcggaauccgguccgccacccgccucgaaaacauuauguggaagcagaucagcaacgagcuaaaccacauccugcucgagaacgacaugaaguucacgguuguggucggggacguggccggcauccucgcgcaggggaaaaagaugauacggccccagcccauggaguacaaguacuccuggaaguccugggggaaggcgaagauaaucggcgccgacgugcagaacaccaccuucaucaucgacgggcccaacaccccagagugccccgaugaccaacgcgccuggaacaucugggaggucgaggacuacggcuucgggaucuucacgacuaacaucuggcugaagcuccgggacaguuacacccaggugugcgaccacagacugaugagcgccgcgaucaaggacuccaaggccgugcacgccgacaugggcuacuggaucgagagcgagaagaacgagaccuggaagcuggcccgggcaucauucaucgaggucaagacguguaucuggccgaaaagccacacccucugguccaaugguguccuggagagcgagaugaucauccccaagaucuacgggggcccgaucucccagcacaacuaccgccccggguauuucacccaaaccgcgggccccuggcaucuggggaagcucgagcuggacuucgacuugugcgaggguacgaccguggucguugacgagcacugcggcaaccgggggccgucccuucgcacuacgacggugacuggaaagaucauccacgagugguguugccgauccugcacccugccgccccugcgcuuccgcggggaggacggcuguugguacgggauggagauccgccccgucaaggagaaggaggagaaccucgucaagucaaugguguccgccgguagcggcgagguggacagcuucuccuuagggcugcucugcaucagcaucaugaucgaggaggucaugcggucccgcuggagccgaaagaugcugaugaccgggacgcuggccgucuucuuccucuuaauuauggggcagcugaccuggaacgacuugauccgccugugcaucauggucggcgccaacgccuccgaccgcauggggaugggcacuaccuaucuggcgcucauggccacguucaagaugcggccgauguucgccgugggacugcuguuuagacggcucaccagccgcgagguguuacuccucaccaucgggcugucucuggucgccagcguggagcuacccaacucccuggaggaacugggggauggccucgcuaugggcaucaugauccugaagcucuuagcggacuuucagagccaccaguugugggccacccugcucagucugacguucaucaagaccaccuucagucugcacuacgccuggaagaccauggccaugguacucuccaucgugagccuguucccccugugucucucuacgaccagccaaaagaccaccuggcugcccgugcugcugggcucccuggggugcaagccgcugacaauguuccucaucgcggagaacaagaucuggggccgucgcagcuggccccugaaugaggggaucauggccgucggcaucguguccauccuguuaagcagccugcugaagaacgacgugcccuuagccggaccccucaucgccggcggcaugcugaucgccugcuacgucauuuccgggucauccgcggaccucagccuggagaaggccgccgagguuuccugggaggaggaggccgagcacagcggcgccagccacaacauccugguggaaguccaggaugacgggaccaugaagaucaaggacgaggagcgggacgauacccucaccauccugcugaaggcgaccuuacuggcugugagcggcguguacccgcugaguauccccgccacccucuucgucugguacuuuuggcagaagaagaagcagcgcagcgggguguuaugggacacccccucuccgcccgagguggagcgggcaguccuggacgaugggaucuaccgcaucaugcagcggggccugcucgggagaagccaaguaggcgugggggucuuucaggagaacguguuccacaccauguggcaugugaccaggggcgccguccucauguaccaggggaagcgccuggagccuuccugggcgagcguaaagaaggaucucaucuccuacggugguggcuggcggcuacagggcuccuggaacacgggggaggaggugcaggucaucgccguggagcccgggaagaaccccaagaacgugcagaccgcccccgggaccuucaagacccccgagggcgaggugggggcuauugcgcuggauuucaagcccggcacguccgguagccccaucgugaaccgcgaggggaaaaucgugggccucuacggcaacggggucguaaccaccuccggcaccuaugugagcgccaucgcccaggccaaggccagccaagaggggccucugccagagaucgaagacgaggucuuccggaagcgcaaccugacgaucauggaccuccaccccgguuccgggaagacccgacgcuacuugccggcaaucgugcgggaggccaucaagcggcgccugcggacccucauccuggcccccacccgcguugucgccagcgagauggccgaggcgcugaagggcaugccaaucagguaccagacgacggccgugaagagcgagcacaccggcaaggagaucguggaucucaugugccacgccacauucacgaugcgacuguuaagcccuguccggguccccaacuacaacaugaucaucauggaugaggcccacuucaccgaccccuccagcaucgccgcgcgcggguauaucuccacgcgggugggcaugggugaggccgcagccaucuucaugaccgcgacgccgcccggcagcgucgaggcuuucccgcaguccaacgccguaauacaagacgaggagcgcgacauucccgagcggagcuggaacucaggguacgaguggaucaccgacuucccaggcaaaaccgugugguuuguucccagcaucaaguccggcaacgacauugccaacugccuccgcaagaaugggaagcgggugauucagcucagcagaaagaccuucgacacggaguaccagaagaccaagaacaacgacugggacuacgugguuacuaccgacaucuccgagaugggcgccaacuuccgggcggacagggugaucgacccgcggcgcugucuaaagccaguaauacucaaggacgggcccgagcgagucauccuggcaggccccaugccggugacggucgccagcgccgcccagcgaagagggcgcaucggccgcaaccacaacaaggagggcgaccaguacaucuacauggggcagccacugaacaacgacgaggaucacgcgcauuggaccgaggccaagaugcuccuggauaauaucaacacccccgaggguaucauccccgcccuguucgaaccggagcgggagaaguccgccgccaucgacggggaguaccgccuccgaggcgaggcgcgcaagaccuuuguagagcugaugcggcgcggugaccugcccguguggcucagcuacaaggucgccuccgagggcuuccaguauagcgaccggcguuggugcuucgacggcgaacggaacaaccagguguuagaggagaacauggacgucgagauuuggacgaaggagggggaaagaaagaaguugcggccucgcuggcucgacgcccggaccuacagcgauccccuggcccugcgugaguucaaagaguucgccgcggggcggagaagcgucucgggggaccucauccuggaaaucggcaagcugccgcagcaccucacccaacgggcucagaacgcccuggauaauuuaguaaugcuccacaacucggagcagggcgggcgcgccuauagacacgcgauggaggagcugcccgauaccaucgagacgcugaugcugcuggcccugauugcgguccucaccggcggggucacccuguucuuccugagcggcagagggcucggcaagaccuccaucggccugcugugcgugauggccagcuccgugcuccuauggauggccagcgucgagccgcauuggaucgcggccuccaucauccuggaguucuuccucauggugcugcugaucccagagcccgaccggcagaggaccccccaggacaaccagcucgcguacguagucaucgggcugcuguuuaugauccucacgguggccgccaacgagaugggccugcuggagaccaccaagaaggaccuagguaucggacacgucgcggucgagaaccaccaccacgccgccauguuagacguagaccugcaucccgcgucagccuggacccucuacgcaguggccacgaccauaaucacgccgaugaugcgccauaccaucgagaacacgaccgccaacauuucccugaccgccaucgccaaucaggcugcgauacugauggggcucgauaagggcuggcccauauccaagauggacaucggcgucccccugcuggcccuagggugcuacucccaggucaacccccugacccugacggccgcggugcucaugcuggucgcccacuaugcgaucaucggcccgggguuacaggccaaggcuacgagggaggcacagaagcgcaccgccgcuggcaucaugaagaauccgaccguggacgggauuguggccaucgacuuggaccccgucguguacgacgccaaguucgagaaacagcugggccagaucauguugcucauccucugcacgucccagauucuucucaugcggaccaccugggcgcugugugagucuaucacccuggccacgggcccccucaccacccugugggaagggagcccgggcaaguucuggaauaccacaauugccgucucuauggccaacaucuuccgcgggagcuacuuggccggcgcgggccucgccuucucccugaugaagucccucgguggcgggcggcgcgggaccggggcccagggcgagacgcucggagaaaaguggaaaaggcagcugaaccagcugagcaagagcgaguucaacaccuacaagcgcagcgggauaauggagguugaucgguccgaggccaaggaaggccucaagcgcggagaaacgaccaagcacgcggugagccguggcaccgcgaagcugcgcugguucguggagcggaaccuggucaagcccgaagggaaggugaucgaccugggaugcggucgcggggguuggagcuacuacugcgcggggcucaagaaggugaccgaggucaagggcuacacgaagggcggccccggccacgaggagccuaucccgauggccaccuacgguuggaaucuggugaagcugcacagcggcaaggacguguucuucauaccgcccgagaagugugacacccuccugugcgauaucggggaguccucacccaacccuaccaucgaggagggacggacgcugcgcguccucaagaugguggagcccuggcuucggggaaaucaauucugcaucaagauccugaaccccuacaugccguccgugguagaaacucucgagcagaugcagcgcaagcacggcggcaugcuggugcggaacccguugucgcgcaacuccacccacgagauguacugggugagcugcgggaccggcaauaucguuucugccgugaacaugaccagcaggaugcuccugaaccgguucacgauggcacaccgcaagcccacuuacgagcgggacguggaccugggggcggguacccgacacgucgccguggagcccgagguggccaaccucgacaucaucggccagcggaucgaaaauaucaagcacgagcacaaguccaccuggcacuacgacgaggacaaccccuauaagacgugggccuaucacgggagcuacgaggucaagccauccggcagcgcguccucaaugguaaacggggucgugaagcugcugaccaaaccaugggacgucauccccauggucacccaaaucgcuaugacggacacgacccccuucggccagcaacgcguguucaaggagaaaguggacacccggaccccuaaggccaagcgcgggacggcccagaucauggagguuaccgcaaaguggcucuggggcuuccugucucgaaacaagaagccccgcaucugcacccgggaggaauucacccgcaagguacgguccaacgcugccauuggcgccguguucgucgacgagaaccaguggaacagcgccaaggaagcgguggaggacgagcgcuucugggaccuggugcaucgggagcgcgagcuccauaaacaggggaagugugcgacgugcgucuacaacaugaugggcaagcgggagaagaagcugggggaguuugggaaggcaaaggggucccgcgccaucugguacauguggcuaggcgcccgguuccucgaauucgaagcgcugggcuuuaugaacgaggaccacugguucucucgcgagaacucccugucagggguugagggcgaggggcuccacaagcugggcuacauucugcgggacaucaguaagaucccagggggcaacauguacgccgacgacaccgccgguugggacacccgcaucaccgaagacgaccuccagaacgaagcccgcaucaccgacaucauggagccggaacacgcccuacuggcgaagucgaucuucaaacucaccuaccagaacaaggugguccggguccagcgccccgccaagaacgggaccgugauggaugucaucucuagacgcgaccaacggggcagcgggcagguggggaccuacggguugaacacguucacuaacauggaagcccagcugauccgccagauggagagugaggggaucuuuagccccuccgagcucgagaccccuaaccuggccgagagggugcuggacuggcucgagaaguacggcguugaacgucugaagcggauggccaucucaggcgacgacugcguggugaagccgaucgacgaccgcuucgcgaccgccuuaacggccuugaaugacaugggaaagguccggaaggacaucccccagugggagccauccaagggguggaacgacuggcagcaggucccguucugcagccaccacuuccaccagcugaucaugaaggacggccgcgagaucguggucccgugccguaaucaggacgagcuggucggccgcgcccgggugucccagggggccgguuggagccuacgcgagaccgcgugccugggcaagagcuacgcucagauguggcaacugauguacuuccaccggcgcgaucugcggcuggccgccaacgcgauaugcuccgccguccccguggacuggauccccacgagccgcaccacgugguccauacacgcccaccaccaguggaugaccaccgaggacaugcugaguguguggaaccgcgucuggauagaggagaacccuuggauggaggacaagacccacauauccagcuggggcgaugugccguaccucgggaagcgggaggaccaauggugcggcucacugauaggccugacggcccgcgccacgugggcgaccaacauccagguggccaucaaccagguccgccgccucaucggcaacgaaaacuaccuggacuacaugaccagcaugaagcgguucaagaacgaguccgaucccgagggcgcccuaugguga

SEQ ID NO: 24292 - RNA, 9879 nt, Artificial Sequence
  derived and/or modified CDS sequence (opt11) from DENV-1__GQ199778__SS-prME
agcgugaccaugcugcucaugcugaugcccaccgcccuggccuuccacuuaaccacgcggggcggcgagccccacaugaucgugagcaagcaagaacgagguaagagccugcuguuuaagaccagcgcaggggugaauaugugcacccucaucgccauggaccugggcgagcugugcgaagacaccaugaccuacaaaugcccccgaauuacugagaccgaaccagacgacguagacugcuggugcaacgccaccgacaccugggucaccuacgguaccuguucucagacgggggagcaccgcagagacaaacgguccguggccuuagcgccucacgugggccuggggcuggagacccgcacugagaccuggaugagcuccgagggcgccuggaagcagauccagcggguagagacgugggcuuuaagacacccuggguucaccgugauagcccuguuccuggcccaugccauuggcacuagcauuacccagaagggcaucaucuucauccuccugaugcuugugacgcccaguauggcaaugcggugcguuggcaucggaagccgugacuucguggagggacuaucuggagcgaccuggguggacgucguccuggagcacgggagcugcgucaccaccauggcaaaggacaagcccacguuggacauugaacuccugaagaccgaggucacgaaucccgcggugcugcggaagcucuguaucgaggcuaagaucuccaacaccacgaccgacagccgaugcccgacgcagggggaggccacauuaguagaggagcaagacgccaacuuuguaugccggcgcacuuucguggaccggggcugggggaacgguugcgggcuuuucgggaaagggucccucaucacgugugccaaguuuaagugugugaccaagcuggaagggaagaucguccaauaugagaaccugaaauacagcgugauugucacaguacauacgggugaccaacaucaaguggggaaugaguccaccgaacacggcacgaccgccaccaucacgccccaagccccgaccacggagauccaguuaacugacuauggggcacugacgcuagacugcagcccccgaaccggucuugauuucaacgagaugguccugcugaccaugaaagaaaaguccuggcucgugcauaagcagugguuccuggauuugccgcucccauggaccucaggagccucuacgagccaggaggcuuggaaccggcaagaucugcuggugaccuucaagacagcccacgccaagaagcaagaagucgugguccucggaucacaggagggugcaaugcauaccgcccugacaggggcgacagagauccagaccaguggcaccacgaccauuuucgcagggcaccucaagugccgccucaagauggacaagcugacccuaaaaggcaugagcuauguaaugugcacuggguccuucaagcucgagaaggaagucgcggagacgcagcacggcacagucuuaguccagaucaaguacgagggcaccgacgcgccauguaaaauccccuucagcacccaagacgagaaaggggucacgcagaacggccgacugaucacagcaaacccaauagucacggacaaggagaagcccguuaacaucgaggccgagccgcccuucggggaguccuacaucgugaucggagccggcgagaaggcccugaaacucucuugguuuaagaagggauccagcaucgguaagauguucgaggccaccgcccgcggggcaagacgcauggcuauccuuggcgacacggccugggacuuuggguccaucgggggcgucuucaccuccgugggcaagcugguccaccagaucuuuggcacagccuacggagugcuauucuccggcgucucguggacuaugaagauagguaucggcgugcugcuaacguggcucgggcugaacucccgcagcacgucccuguccaugaccugcaucgccguggggcucgugacccuuuauuuaggcgucauggugcaagccgacucuggaugcgucauaaauuggaagggccgggaacucaagugcggcagcggcaucuucgugacgaaugaagugcacacuuggaccgagcaauauaaguuccaggcggacagcccgaagcgccugagugccgcuaucgguaaagccugggaggaggggguaugugguauccggagcgccacccgcuuggagaauaucauguggaagcagaucuccaacgagcucaaccacauacuccuggagaacgacaugaaguucacaguggugguaggagacguggcaggaauacucgcgcaagggaagaagaugauccggccccagccaauggaguacaaguacagcuggaaguccuggggcaaagccaagaucaucggggccgacgugcagaacacgacauucauuauagacgggccgaacaccccugaaugccccgacgaccagcgcgccuggaauaucugggagguugaggacuacggcuucgguauauuuacuacgaacauuuggcucaagcugcgggacagcuacacccaagucugugaccaccggcucauguccgccgccauuaaggauagcaaggccgugcacgccgacaugggcuacuggaucgaguccgagaagaacgagaccuggaagcuggcgcgggccagcuucauagaggucaaaaccuguaucuggcccaagucccacacgcuuuggucgaacggcgugcucgaguccgagaugauuauccccaagaucuacggaggcccgaucagccagcacaacuaucgccccggauacuucacccaggcugccggucccuggcaccugggcaagcuggaauuagacuucgacuugugcgaagguaccaccguggugguggaugagcacugcggcaaccgggguccgucccugcgcacgaccacggugaccgggaagauaauccacgaguggugcugccggucuugcacgcugccgccccuccgcuuucggggggaagauggguguugguacgggauggagauucgucccauaaaggagaaggaggaaaaucuggucaaguccauggugucggccgguagcggggagguugacucuuucucacucggguuacugugcaucucaauaaugaucgaagagguaaugaggagccgcugguccaggagaaugcucaugacuggcacccuggcgguguucuuccuacucaucauggggcagcuuaccuggaaugaccugauccgccuaugcaucauggugggcgcuaaugcaagcgaucggauggggauggguacuacuuaccuggcccugauggccacauucaagaugcgccccauguucgcgguaggcuugcuuuuccggcggcugacguccagagaggugcuccugcugacaaucggucuaucucuggucgccuccgucgagcugcccaacagccuagaggaguugggcgauggacuggccaugggcauaaugauacucaagcuccugacggacuuccaaucccaccaacucugggcaacccuucugagccucaccuuuauaaagacaaccuucagcuugcauuacgccuggaagaccauggcgauggugcugagcaucgucucacuauuuccgcugugccugagcaccacgucccaaaaaaccaccuggcucccugugcugcugggcagcuuggguugcaagccgcugacuauguuucugaucgccgaaaacaagaucuggggccgccggaguuggccccucaacgaggggaucauggccgugggcauugucagcauccugcucuccagcuuacugaaaaacgaugugcccuuggccgggccucuaaucgcgggcggcaugcugaucgccugcuauguaaucagcggguccucugccgacuuaucgcucgaaaaagccgccgaggucucaugggaggaagaggcggagcacuccggcgccucacacaauauccugguggaggugcaagaugacgggaccaugaagauuaaggacgaagaacgugacgacacccuaaccauacucuuaaaagccacccugcucgccgucuccgguguuuacccucugagcauccccgccacucuguucgugugguacuucuggcaaaagaagaagcagcgaucagggguccucugggacacgcccagcccgccagaaguggagcgggcgguuuuggacgacggcaucuaccgcauuaugcagagaggccugcuggggaggucccaggucggcguugggguguuccaagagaacgucuuccacaccauguggcacguuacccgcggggccgugcuaauguaccagggaaagcgcuuagagccgagcugggccuccgucaagaaagaucugaucagcuacgggggcggguggcgccuacagggcuccuggaacaccggcgaggagguccaagugaucgccgucgagcccgggaagaaucccaagaacguacagacggcccccgggaccuuuaagacgccagagggugagguuggagcgaucgcccuggacuucaagccaggcaccagcggaucccccaucgucaaccgggaggggaagauaguuggccuguacggcaacgguguggucacgacuuccgggaccuaugugucggccaucgcccaagcgaaggccucccaagaggggccgcucccugagauugaggacgagguguuccguaagcggaaccugaccaucauggaccuucaccccggcagcgggaagacucgccgguaccucccggccaucguccgcgaggccauaaagcgcaagcugcggacacugauccucgccccaacacgcgugguggcauccgagauggccgaagcucugaaggggaugcccauccgguaucagacaacggccgucaaguccgagcacaccgguaaggagauuguggauuugaugugccacgccacguucaccaugcgacuguugucccccgugcgcguuccgaacuacaacaugauuauaauggacgaggcgcacuucacggaccccagcucaaucgccgcgcgcggguacauaagcacccgugugggcaugggagaggccgccgcgauauucaugaccgcgacgccacccggcuccgucgaggccuucccgcagagcaacgccgugauucaggacgaggagagggacauccccgagcgaucguggaauagcggguacgaguggaucacugauuuccccggcaaaaccgugugguucgugcccuccauaaaguccgguaacgacaucgcgaacugccugcgcaagaacgggaagcgugucauccagcucucccgcaaaaccuucgacacggaguaccagaaaacgaagaacaacgacugggauuacguggugaccaccgacaucagcgagaugggcgcuaacuuccgggccgaccgcgucaucgauccgcggcgcugccugaagcccgugauccugaaggacgggcccgagcgggugauccucgccggacccaugccgguuaccguagccuccgcugcccagcgccgaggccgcaucggacgcaaccacaacaaagagggcgaccaguauauuuacaugggccagccccugaacaaugacgaagaccaugcacacuggacggaggccaaaaugcugcucgacaacauuaacacccccgaaggcaucauccccgcccuguucgagccggagcgggagaaguccgcggccaucgacggugaguaccgccugaggggcgaggcgcgcaaaacauucgucgagcuaaugcggcggggagaccuucccguauggcuguccuacaaaguggcaagcgagggguuucaauacagugaucgacguuggugcuucgacggggaacggaacaaccaaguucuggaggaaaacauggacguugagaucuggaccaaggaaggggagcgcaagaaacugcguccgagguggcuggaugcccggacguacagcgacccguuggccuugcgcgaguucaaggaguucgccgccggcagacgcaguguguccggagaccugauccucgagaucggcaaacuaccgcaacaccugacucaacgugcacagaacgcacuggacaacuuagucauguuacacaacagcgagcagggcgggcgcgcguaccggcaugcaauggaggagcuucccgacaccaucgagacccugauguugcucgcacugaucgccguacuaacggggggggucacccucuucuuuuugaguggccgcggucugggcaagacaagcaucggccuccucugcgucauggccagcagcgugcugcucuggauggccagugucgagccacacuggauagcagcauccaucauccuggaguucuuccugauggugcuccugauccccgagccggaccgucagcgcacuccccaggacaaccagcuggccuacguagugaucggucuguuauucaugauccugaccguagcggcaaacgagauggggcuucuggagacgacgaagaaggaucuggggauuggccacguggccguggagaaccaccaccacgccgccaugcucgacguagaucuccaccccgcguccgccuggacccuuuacgccguggccaccacgaucaucacccccaugaugcgccacaccauugagaacacuacggcaaacaucucacucacugcgaucgcuaaccaagccgcgauacugaugggucuggacaaaggcuggcccaucuccaagauggauaucggcgugcccuuacuggcgcugggguguuacagccaggucaacccccugacccugacggccgccguacuuauguuggucgcccauuacgccaucaucggcccggggcugcaggccaaggccacucgggaggcacagaaacguaccgccgccgguaucaugaagaaccccacagucgacgggaucguggcgaucgauuuagacccaguggucuacgacgccaaauucgagaagcagcucggacagaucaugcuucugauccuuuguaccucccagauacugcugaugcggaccaccugggcccucugcgagagcauaacccucgccacagguccucugacgacucucugggaggggucccccggcaaauucuggaacaccaccaucgcggugagcauggcaaauauuuuccgcggcuccuaccucgccggugccggccuggccuucucgcugaugaagucacucggugguggucggcgcgggacgggggcgcagggagagacccugggcgagaaauggaagcggcagcuaaaccaguuguccaaaagcgaauucaacacguacaagcgcuccgggaucauggagguggaucggagcgaagcaaaggagggccuaaagcgcggcgaaaccacgaagcaugccgucuccagaggcacagccaagcuucgaugguucguggagagaaaucuggucaagccugaaggcaaggugauugaucuaggcugcggccgcgggggcuggagcuacuacugcgcugggcugaaaaaagugaccgaggugaagggguacacgaaggguggccccggccaugaggaacccaucccgauggcgacguacggguggaaccuugugaagcugcauuccggcaaggacguguucuuuauuccgccggaaaagugcgacacacuacucugugacaucggggaaucuaguccuaauccgaccaucgaggagggccggacccugcgcgugcugaagauggucgagccauggcuccgggguaaccaguuuuguaucaagauacugaauccuuacaugccgucgguagucgagacgcucgagcagaugcagcgcaagcauggugguaugcucguacggaauccgcuguccagaaacagcacccacgaaauguacuggguguccugcgggaccgggaauaucgugucagccgugaacaugaccucccgcaugcugcucaaccgguuuaccauggcucaccguaaacccaccuacgagcgagacguggaccuaggggcgggcacccgccacgucgccgucgaacccgaaguugcgaacuuagacauaaucggccaacguaucgagaacauuaagcacgagcacaaaucgacuuggcacuacgacgaggacaaucccuauaaaaccugggccuaccacggcuccuacgaggugaaaccgucuggguccgccagcagcauggugaaugggguggucaaguugcugacgaagcccugggacguuauccccauggugacccaaaucgccaugaccgacacaacgccauucgggcagcaacgcguauucaaagagaagguugauacgcgaacuccgaaggccaagcgcgggaccgcgcagaucauggaggugacugccaaguggcuguggggcuuccucucccggaacaagaagccccgcaucugcacccgggaggaguucacccgcaagguccgcuccaacgccgccaucggcgcgguguucguugacgagaaccaguggaacagugccaaggaggccgucgaagacgagcgcuucugggaucuggugcacagagagcgcgagcugcacaagcagggcaagugcgcgaccugcguguacaacaugaugggcaagcgggaaaagaaacucggggaauuuggcaaagccaaggggagcagagcuauaugguacaugugguuaggcgcgcgauucuuagaguucgaggcccucggcuucaugaacgaggaucauugguucucucgcgagaacagccuguccggggucgagggugaggggcugcacaagcucgguuauauccugcgagacauuagcaagauccccgggggaaacauguacgccgacgacacagccggcugggacacaagaaucacugaagacgaccuccagaacgaggcgcgaaucaccgacaucauggagccggagcacgccuuauuagcgaaauccaucuucaaacugaccuaucagaauaagguggugcggguccagcgccccgccaagaauggaaccguuauggacgugaucucccggagagaccagcgggguuccgggcaggucggcacguauggcuugaacaccuucacgaacauggaggcccagcugauccgucaaauggagagcgaagggaucuucucgccaagcgagcuggaaacccccaacuuggcggagcgggugcuggacuggcuggagaaguacggaguggagcgccucaagcggauggcuauauccggagacgacugcguugugaagccgaucgacgaccgguucgccaccgcuuugaccgcacugaacgacauggggaaggugcggaaggacauuccacagugggagccaagcaagggauggaaugacuggcagcagguccccuucugcucccaucacuuucaucagcugaucaugaaggauggccgggagaucguugugccgugucggaaccaggacgagcuggucggccgggcgcgcgugagccagggggccggcuggagccuuagggagacggccugccucgggaaguccuacgcccagauguggcagcugauguacuuucaccggcgcgacuugcggcucgcugccaacgccaucugcagcgccguuccagucgacuggauccccaccucccgcacaaccuggucuauccaugcucaccaucaauggaugacgacagaggauaugcuuucgguguggaaccgcguguggauugaggagaaccccuggauggaagacaagacccacaucagcuccuggggcgaugucccauacuuagggaaacgggaggaccaguggugcggcagccucauaggccugaccgcgcgcgcuacgugggccaccaacauccagguggcaaucaaucaggugcggcguuugaucggcaaugaaaauuaccucgacuacaugacauccaugaagcgguucaagaacgagagcgaccccgagggcgcacuaugguga

SEQ ID NO: 24293 - RNA, 9879 nt, Artificial Sequence
  derived and/or modified CDS sequence (opt11) from DENV-1__GQ199780__SS-prME
agcguuaccaugcugcucaugcugaugcccaccgcacucgcauuccaccucacgaccagaggaggggaaccccauaugaucgugucaaaacaggaacgggggaaaagccugcuguucaagacaagugccggggucaacaugugcacccucaucgccauggaccugggcgaguucugcgaagacacaaugaccuauaagugcccccgaaucacggaagcagagcccgaugacguagacugcuggugcaacgccaccgacacgugggugaccuacgggaccuguagccagacuggggagcaccgccgggacaagcgguccguggcguuagcgccccacguggguuuggggcuggagacgcgcacggagacguggaugagcuccgagggcgcuuggaagcagauucagcgcgucgaaacuugggcccugcgucaccccggguuuacugugaucgcccucuuccuggcccacgccaucggcacuagcauuacucagaaagguaucauuuucauccugcuuaugcuggugacccccuccauggccaugcggugcgucgguaucgguagccgcgacuucguggaggggcugucuggcgccacguggguggacguugugcuugaacacgggucaugcguuacuaccauggccaaggacaagcccacuuuagacaucgagcuguuaaagacggaaguaacgaaccccgcugugcugcgaaaauugugcaucgaggccaagauuuccaacacgacgacggacagccgcugcccgacgcagggggaggccacccucguggaggagcaggacgcaaauuucgucugccggcgcaccuucguugaccggggcugggguaacggcugcggguuguucggcaaggggucacugauuacgugcgccaaguucaagugcgugaccaaguuggagggcaagauuguccaguacgagaaccugaaauacagcgugaucguuaccguccacaccggagaccagcaccagguggguaacgaguccacggagcacggcaccacugcgacuaucacgccccaggcccccagcacggagauccagcugacagauuacggcgcccugacccuggacugcagcccccggaccgggcuggauuuuaaugaaauggucuugcugacgaugaaggagaaguccuggcuaguccacaaacaaugguucuuagaccugccucuccccuggaccagcggggccuccaccagccaggagaccuggaaccggaaggaccuccuggugacauucaaaaccgcccacgcgaagaagcaggaggucguggugcugggcucacaggaaggcgcaaugcauaccgcucucaccggggccacggagauccagaccagcggcaccaccacgaucuucgccggucaccugaagugucgucugaagauggacaagcucacccuuaagggcauguccuacgucaugugcacaggguccuucaaacuggagaaggagguggcggaaacacagcacggcacggugcuuguccaaaucaaguacgagggcaccgacgcccccuguaaaauccccuucucaacacaagacgagaagggggugacccagaacggccggcugaucacagccaacccaaucgugacagacaaggagaaaccaguuaauaucgaggccgagccucccuuuggggagucuuacaucgugaucggcgcgggcgagaaggccuuaaagcuauccugguucaagaaggggagcuccaucggcaagauguucgaagcaaccgcccgcggggccagacggauggcgauccucggcgacaccgcaugggacuucgggagcaucggcggcguguucaccucaguggguaagcuggugcaucaaaucuuuggcaccgccuacggggugcuguucagcggcguauccuggaccaugaaaauugggaucggcgugcuccugaccuggcugggucucaauucacgcucgacuucccuguccaugacgugcaucgcagucgggcuggucacuuuguaccugggcgugaugguacaagccgacagcgggugcgucaucaacuggaagggccgcgagcugaaguguggaagcgggaucuuuguuaccaacgaggugcacacguggacugagcaauacaaguuccaggcggauuccccgaagcgccucucugccgccaucggcaaggccugggaggaagggguaugcggcauccgguccgcgacccgccuggagaacaucauguggaagcagaucagcaacgagcugaaccacauuuuacuggaaaacgacaugaaguuuaccgucguggucggugacguggcgggcauccuggcccagggcaagaagaugaucagaccgcagcccauggaguacaaguacucuuggaaaucguggggcaaggcgaaaaucaucggugcagauguccagaacaccaccuucaucaucgacgggcccaacaccccggaaugccccgacgaccagcgcgcguggaacaucugggaggucgaggacuacggcuucgggaucuuuaccaccaacaucuggcucaagcugcgugacuccuauacccaagugugcgaccaccgccugaugagcgccgccauuaaggacuccaaagccgugcacgccgacaugggcuacuggaucgagagcgaaaagaacgagaccuggaagcucgcucgagcguccuuuauagaagugaagaccuguaucuggcccaagagccacacucugugguccaacgguguucuggagagcgagaugauaauccccaaaauauacggcggccccauaucccagcacaacuaccgcccuggcuacuucacgcaaaccgccggccccuggcaucucgggaaguuggagcuggauuucgaucucugugagggcaccaccguggucguggacgaacacugcggcaaccgggggccgagccugcgcacaaccaccguaaccggcaagaucauccaugaguggugcugcagaaguugcacccugccgccccuucgguucaagggagaggacggcugcugguacgguauggagauacggcccgucaaagagaaggaggagaaccuggucaagagcauggugagcgccggcuccggcgaggucgacucuuucucccugggccuccugugcaucagcaucaugaucgaggaggucaugcgcucccgguggagccguaagauguuaaugaccggcacgcucgcaguguucuuucuucugaucaugggucagcucaccuggaaugaucugaucaggcugugcaucauggugggcgcgaacgccuccgaucgcauggggaugggcacgaccuaccucgccuugauggcuaccuuuaagaugcgcccgauguuugcuguggggcuccuauuucggcgacugaccagucgggaggugcucuuguugacuaucgggcugucccucgucgcgagcguggagcugcccaauucucuagaggaacuuggcgacgggcuggcuaugggcaucaugauacugaagcuccugaccgacuuccagagccaccagcugugggcgacccuccugucgcuuaccuucaucaagacgaccuucucgcuccacuacgcauggaagaccauggcgaugguccugucgaucgugagccuguucccucucugucuguccaccacgagccagaagaccacuuggcugcccguucuccuggguucccuggggugcaagccgcucaccauguucuuaauagccgagaacaagaucuggggucgcaagagcuggccccugaacgagggaauaauggcagucgggaucgugagcauccuccuauccgcccuguugaagaacgacgugccgcuggcagggccgcuaauugcgggcgggaugcucaucgccuguuacgucaucagcggguccagcgcagaccugucccuggaaaaggcagccgaggugagcugggaggaggaggcagaacacuccggcgccagccauaacauucucguggaaguccaagacgaugggacgaugaaaauuaaagacgaggagcgggacgauacccugaccauccuguuaaaggcaacccugcuggccguguccggcguauacccgcucagcauccccgccacacuguucgucugguacuucuggcaaaagaagaagcagagguccgggguguugugggacacgcccagcccgccagagguagagcgagcgguauuggacgauggaauuuaucggaucaugcagcggggccuguuagggcguucgcaaguuggugugggggucuuccaggagaacguguuucacacaauguggcacguaacccggggugccguccugauguaccagggcaagcgccucgagcccucuugggccuccguuaaaaaggaccugaucucuuaugguggaggguggcggcugcagggcuccuggaacaccggggaggaggugcaaguaaucgcaguugaaccagguaagaaccccaagaaugugcagacggcccccgggaccuucaagaccagcgagggcgaagucggcgcgaucgcccucgauuuuaaacccgggaccuccggcagccccauaguuaacagggaggggaaaaucguggguuuauacggcaacgggguagugacuaccagcggcaccuacguguccgccaucgcgcaggcgaaggccagccaggaggggccccugccggagaucgaggacgaggucuuucggaaaaggaaccucaccaucauggaccugcaccccggcagugggaaaacgcggagguaccugcccgccaucgugcgggaggccauaaagcgcaagcugcggacccugauccuugcccccacccggguggucgcgagcgaaauggccgaggccuugaagggcaugcccauccgcuaucagacaacagccgugaagucugagcacaccggcaaggagaucgucgaucugaugugccacgccacauucaccaugcggcugcuuagccccguccgcgugccgaacuacaacaugaucaucauggaugaggcgcacuucacggacccauccucgauagcggcccggggguacauaucaacccgcgugggcaugggggaggccgcggcgauuuucaugaccgccacgccgccuggcagcguagaggccuucccccagucaaaugccgugauccaagacgaggaacgggacaucccggagcgcuccuggaauaguggguaugaguggauuacggacuuuccagggaaaacuguuugguucguacccagcauaaaguccggcaacgauaucgcgaacugccugcggaagaacgggaagcgaguaauccagcugaguagaaaaaccuucgauaccgaguaccagaagacgaaaaacaacgacugggacuauguggucaccaccgacaucucagagaugggcgcgaauuuccgcgccgaccgcgugaucgacccuaggcggugcuugaagccggugauccugaaggaugggcccgagcgcgucauccuggcaggccccaugccggugaccguugccagcgcggcccagcggagggggaggaucggacgcaaccacaacaaggagggcgaccaguauauuuacauggggcagccguugaacaaugacgaggaucaugcacacuggacggaggccaagaugcugcucgacaacauuaacacccccgaaggcauuaucccugcccucuucgagcccgagagggaaaaguccgcggccaucgacggugaguaccgccuucgcggcgaggcccgaaagaccuucgucgagcugaugcgacgcggagaccucccgguguggcugagcuauaaggucgccagcgagggcuuucaguacucagaccgccgguggugcuucgacggcgaacgcaacaaucagguguuagaggagaacauggacgucgaaaucuggaccaaagagggggagcggaagaaacuccgcccccgguggcuggacgcucgcaccuauagcgacccccuugcgcuccgggaguucaaagaguucgcugccggccgcagauccgucucuggggaccuuauccuggagaucggcaagcucccccagcaucuaacccagcgcgcacagaacgcccucgauaaccucgugauguugcauaacuccgagcaaggagggcgggccuacagacacgccauggaggagcugccggacaccauugagacgcucaugcugcuggcucucauugccguuuuaacgggcggggucacccuguuuuuccugaguggcaggggccugggcaaaacguccaucggcuuacugugcgugauggcgagcuccguguugcuguggauggccagcgucgagccccacuggaucgcugccuccauuauacucgaguucuuccuaauggugcugcucauacccgagcccgaccgccagcggaccccacaggauaaccagcuggccuacguggucaucggccuacucuucaugaucuuaaccguugcggccaacgaaauggggcucuuggaaacgaccaagaaagaccuggggaucggccacguggcgguggagaaccaccaucacgccgccaugcuggacguggaccuccaucccgcgagcgccuggacccuguacgccguggccaccacaauaaucacccccaugaugcgacauaccauagagaacaccacggccaacaucucccugaccgcgauugcgaaccaggccgcaauccucauggggcuggauaagggcuggccgaucagcaagauggacauuggcgucccucugcucgcucuggggugcuauucccaggugaacccgcugacucugaccgcggccguacugaugcugguugcccacuacgccaucaucggacccgggcuccaagcuaaggccacgcgagaagcccagaagcgcaccgccgccggcauuaugaagaacccgaccguggaugggaucguggcgaucgaccuggacccggucguuuacgaugccaaguuugagaagcagcugggucagaucaugcuucugauccucugcaccucccagauccuacugaugaggaccacuugggcauugugcgaauccaucacgcucgcaaccggcccgcugacgacccugugggagggcagccccggcaaguuuuggaauacaaccaucgcaguguccauggcgaacaucuuucgggggagcuaccucgccggcgccggcuuagccuucucacugaugaagucgcucgggggcgggagacggggcaccggggcccagggcgagacccugggugagaaguggaagcgccagcuaaaccaacucagcaaauccgaguucaacaccuacaagcgcucugggaucauggaggucgaucggucagaggccaaggagggccuuaaacgcggggagacgacgaagcacgcugugagcaggggcaccgccaagcugcggugguucguggagcggaaccucgucaagccggaggggaaggugaucgaccugggcuguggccgcggcgggugguccuacuauugcgccgggcugaagaaagucaccgaggucaagggguauaccaaaggcggccccggccaugaggagcccauucccauggcaacauacggguggaaccuagugaagcuccacagcggaaaggauguguucuucauaccacccgaaaagugugauacccugcugugcgacaucggggagucgagccccaacccuacuauagaggagggccgaacccucaggguccugaagaugguggagccguggcuucgagggaaccaguucugcaucaaaauccucaacccguauaugcccagugugguggagacgcuggagcagaugcagcggaagcacggagggaugcugguucgcaacccccucagcagaaacuccacccacgagauguauugggucaguugcgggaccggcaacauaguuuccgccgugaacaugaccagccgcaugcugcugaaccguuucaccauggcccaccggaaaccaacuuacgagcgcgauguggaccuuggugccggaacccggcacguggcuguggaacccgaaguggcgaaccuggacaucaucggccagcgcaucgagaacaucaagcacgagcacaaguccaccuggcacuacgacgaagacaacccguacaagaccugggccuaccacgggagcuacgaggucaaacccucgggcuccgccagcuccauggugaauggggucgugaagcuacugacgaagccgugggacguuauccccaugguaacccagaucgccaugacagacaccacgcccuuuggccagcagcggguauucaaggagaagguggacaccaggacccccaaggccaagcgggggacggcacagauuauggagguuacggcaaaauggcuguggggcuuucugucccgcaacaagaaaccacguaucuguacccgggaggaguucacccguaagguacgcuccaacgcggcgauaggcgcgguguucgucgacgagaaccaguggaacucugccaaggaggcuguggaggacgaacgguuuugggaccuggugcacagggaacgggagcugcacaaacaggggaagugcgcgaccugcguauacaacaugaugggcaaacgugagaagaaacugggggaguucgggaaggccaaggggucccgggccaucugguacauguggcucggcgcccgcuuccucgaguucgaggcccugggcuucaugaaugaggaucacugguucagccgggaaaauucauugagcgggguggagggcgaggggcugcauaagcugggcuacauccuccgcgacaucuccaagaucccugggggcaacauguaugccgacgacacggccggcugggacaccagaaucacagaagacgaccugcagaacgaagcgaagaucaccgacaucauggagcccgagcacgcccugcucgccaagagcauauucaagcugacguaccagaacaaagugguucgcgugcagcggccggccaaaaacggcaccguaauggauguuaucucccgccgugaucagcgggggagcggccagguaggcaccuacggacugaacacguuuacgaacauggaggcccagcucauucgccaaauggaguccgaggggaucuuuucaccauccgagcuggaaacccccaaccuagcgggucgggugcucgacuggcuggagaagcacggggucgagagacugaagcggauggccaucagcggcgacgacugcgucgugaagcccaucgacgaccgcuuugcaaccgcauugaccgcacugaacgacauggggaagguccggaaggacgugccccaaugggagcccaguaagggcuggaacgacuggcagcagguucccuuuugcucacaccacuuccaucaacugaucaugaaggacggacgugagaucguugugcccugcagaaaccaggaugagcucguggggagagcaagggucagucagggugcuggguggagucugagggaaacggccugccugggcaagagcuacgcccagauguggcaguuaauguacuuccaccgucgcgacuugcgguuagcggcaaacgccaucugcuccgccgugccuguugacugggugccuaccagccguaccacgugguccauacacgcccaccaccaguggaugacgaccgaagauaugcucagcgucuggaacaggguguggaucgaggagaaccccuggauggaggacaaaacacacaucuccagcuggggcgacgucccuuaccugggcaagagagaggaucaguggugcggcucccugauaggacucaccgcgcgggcaaccugggcuaccaacauccagguggccaucaaccagguccgccggcucaucggcaacgagaacuaccuggauuacaugaccagcaugaagcgauucaagaacgaaucugacccggagggggcccugugguaa

SEQ ID NO: 24294 - RNA, 9879 nt, Artificial Sequence
  derived and/or modified CDS sequence (opt11) from DENV-1__GQ199781__SS-prME
agcgugaccauguuacucaugcugaugccgaccgcccuggccuuucauuugacgacccggggcggcgagccacacaugaucguuacaaagcaggagcgaggcaagagcuuacuguucaagacguccgcuggggugaauaugugcacccucaucgccauggaccugggggagcugugcgaggacaccaugaccuacaaguguccgcgcaucaccgaagccgaaccggacgacguagauugcuggugcaacgccacggacaccugggucaccuacgggaccugcagccaaacaggggaacaccggcgcgacaaaagaagcguggcccucgcgccgcacgugggucuggggcuggaaacucgcaccgagaccuggauguccagugagggcgcguggaagcagauccaacgagucgagacgugggcccuccgccaccccggguucaccgugaucgcccuguuccuggcacacgcgaucggcacauccaucacacagaaagguauuaucuucauccuacugaugcuggugacacccagcauggccaugcggugcgucggcaucggcagccgcgacuucguggagggucucagcggcgccaccuggguggacgucgugcuggagcacggguccugcgugaccaccauggccaaggacaagcccacgcuggacaucgagcuccucaagacagaggucacaaacccggcuguccuucggaagcucugcauugaagccaaaaucagcaacaccacaaccgacucccgcugccccacccagggcgaagcgacccugauggaggagcaggacgccaacuucgugugcaggcgcacuuucgucgaccgaggcugggggaacggcugcgggcucuucggcaaaggaagccucauaacgugugccaaauucaagugcgugaccaaguuagagggcaagaucguucaguaugagaaccugaaauacuccguaauagugacgguucacacgggugaccaacaccagguuggcaaugaaagcaccgaacacggcaccaccgcgaccaucacuccccaggcgcccaccuccgaaauacagcucaccgacuacggggcacugacucuggacuguagcccccgcacgggacucgauuucaacgagauggugcuccugaccaugaaagagaaguccuggcucguccauaaacagugguuccuggaccugccccuccccuggaccagcggggccagcaccucccaggagacguggaaucgccaagaccuguuagugaccuucaagaccgcccaugcgaagaaacaggaagugguaguccucggcagccaagagggagccaugcacacggcccuaacgggggccacugagauccaaaccuccggcacaacaacuaucuucgcuggacaccucaaaugccgccucaagauggacaaacugacacuaaagggcaugagcuacgucaugugcacgggguccuucaagcucgagaaggagguugcggagacgcagcacggcaccgugcugguacaaauuaaguaugaaggaaccgaugcccccuguaagauccccuucagcacccaggacgaaaagggggucauccagaacggccggcugaucacggcuaaccccaucgucaccgacaaggagaagccggucaacaucgaggccgagccgcccuucggugaguccuauaucgucaucggcgugggugagaaggcguugaaguugagcugguucaagaagggcaguagcaucggcaagauguucgaggccaccgcccgcggcgcccggcgaauggccauccugggugacacggcgugggacuucggaucaaucggcggaguguucacaagcguggggaagcuugugcaccagaucuuuggcaccgcguacgggguccuguucucuggcgucagcuggaccaugaagaucgggaucggcgugcugcugaccuggcucggccugaacuccaggaguacgucccugagcaugacuuguaucgccgucggacucguuaccuuguaucugggugugauggugcaggcugacuccgggugcgucauaaacuggaaaggccgggaauuaaagugugguagcggcaucuucgugaccaaugaggugcacaccuggacagagcaguacaaguuucaagccgacuccccgaagcggcuguccgcggccaucggcaaggccugggaggaggggguuugcggcauccggagcgccaccagguuggaaaacaucauguggaagcaaauuuccaaugaacucaaccacauccugcuugagaacgacaugaaauucaccgugguggucggagacguggugggcauccucgcccaagggaaaaagaugauccggccccagccuauggagcacaaguacagcuggaagagcuggggcaaggcgaagaucauuggcgccgacgcccagaacacuacuuucauaaucgacgggccaaacaccccggagugccccgacgaccaacgcgccuggaauaucugggaggucgaagacuacggcuucgggauauucaccacgaacaucuggcugaagcugcgggacagcuacacgcaggcgugugaucaccgccucauguccgccgccaucaaggacucgaaggccguccacgcagacaugggcuacuggauugagagugaaaagaaugagacguggaaacuggcgcgggcaagcuuuaucgagguaaagacgugcaucuggcccaaaucccacacccuuuggaguaacgggguccucgaauccgagauggugaucccgaagauauacgggggcccgaucagccagcacaacuaccgccccggguacuuuacgcagacagcgggccccuggcaccuggggaaguuggagcucgacuucgaccucugcgagggcaccaccguggucguggacgagcauugcgggaacagggggccgucccugcggaccaccaccgugaccggcaagaucauccaugaguggugcugccgaagcugcacgcuccccccacuaagguucaagggagaggacggcugcugguacgggauggagauccggcccgucaaggagaaggaggaaaaccuggugaaguccauggugucggccggcagcggcgagguugacuccuucagccucgggcugcugugcaucagcaucaugauagaggaggugaugcgaucccgauggucccggaaaaugcuuaugacgggcacgcuggccguguuccugcuccucaucaugggccaacuuaccuggaacgaucucauccggcuguguaucauggucggcgcaaacgccagcgaccguaugggcaugggcacgaccuaccuggcccucauggccacauucaagaugcgcccgauguucgccgugggccugcuguuccggcgccucaccucccgggaggugcugcuacucacgaucgggcugagcuuagucgcuuccguggaacuccccaacagucuggaggagcuuggcgauggucuugcuaugggcauaaugaucuugaaguuauuaacggacuuccaaucccaccagcucugggcgacccugcuuucccugaccuuuaucaaaacaacccugucccuccacuacgcauggaagaccauggccaugguccugagcaucgugaguuuauucccgcucugcuuaagcaccacgucucagaagaccacuuggcugccggugcuccuaggcagccuggggugcaagccucucaccauguuccugaucgccgagaacaagauuuggggccguaagucauggccccuaaaugaggggauuauggccgucggcgugguaagcauccuccugagcucccugcucaagaacgacgucccccuggccgggccacugaucgccggcggaaugcucaucgcgugcuacgugaucagcggguccuccgcugaucugucccuggaaaaggccgccgaggugucaugggaagaggaggccgagcacuccggcgcaagccauaacauccucgucgaagugcaagacgacgggacgaugaaaaucaaggacgaggagcgggacgacacgcugaccauccugcuaaaggccacucuacuugccguguccggcguuuacccgcucagcauccccgccacccuguucgugugguacuuuuggcagaagaagaaacagcgcucggggguccugugggacacgccgucgccacccgaggucgagcgagccgugcuggacgacggcaucuaccgcauuaugcagcggggccuccuggggcgcucccagguaggagucgguguauuccaagagaacguguuccacacgauguggcaugucacccggggcgccgugcugauguaccaggggaagcgccucgagcccucaugggccaguguuaagaaagacuuaaucucuuacgggggcggauggcggcugcagggcucauggaacaccggggaggaggugcaggugaucgcaguggagcccggcaagaacccuaagaacguccagacggcccccgggacauucaagaccccagagggagaggucggcgccaucgcgcucgauuucaagcccgggacgagcggcucccccauugugaaccgcgaagggaagauugucggccuguacggcaacgggguggugacgaccagcggaaccuacgucagcgcgaucgcccagaccaaggcgucgcaggagggaccucugcccgagauugaagacgagguguuccggaagcgcaaccucacgauaauggaccugcaccccggcagugggaaaacgcggcgcuaccugccagcuauuauccgggaggccaucaagcgcaaguuacggacccugauacuggcgcccacucgcguggucgccuccgagauggccgaggcccucaaggggaugcccauccgcuaccagacgacagcagucaagagcgagcacacuggcaaggagaucguggaccugaugugccacgccaccuucacuaugcgguugcucucacccguccgcguuccgaacuacaacaugauaaucauggaugaggcccacuucaccgacccuagcagcaucgccgcgcggggguacauuagcacccgagugggcaugggugaggccgccgccaucuucaugaccgccacgccgcccggcuccgucgaagccuucccgcaaagcaacgccgucauacaggacgaagagcgggauaucccagagagguccuggaacaguggguacgaauggaucacggauuuuccuggcaaaacggugugguucguccccagcaucaagagcggcaaugauauugccaacugccugcggaagaacggaaagcguguuauacagcuuucccggaagacauucgacacagaauaccaaaaaaccaagaacaacgacugggacuacgucguuaccaccgacaucagcgagaugggggccaacuucagagcggaccgggugaucgacccgcgcagaugcuugaagcccgugauccugaaggacgggcccgagagagucauccuggcaggccccaugccggugacgguugcgucggccgcccagcggagagggcggaucggccgcaaccacaacaaggagggcgaucaguacaucuacaugggacagccccucaacaacgacgaggaucacgcgcacuggaccgaggccaaaaugcugcuggacaacaucaacaccccagagggcaucauccccgcccucuuugagccggagcgggagaagucagccgccaucgacggggaguaccgccugcggggcgaggcacggaagaccuucguggagcugaugcgcagaggggaccuccccguguggcuuuccuauaagguugccagcgagggcuuccaguacucugaucgcagauggugcuuugacggcgaacgcaauaaccaggugcuugaggaaaacauggacguggagaucuggaccaaggagggggagcguaaaaagcuccgcccccgguggcuggacgcccgcacuuacuccgacccccuugcccuccgcgaguucaaggaauucgcggcgggcagacggucaguuagcggggaccugauucuggagaucggcaagcucccccagcaccugacucagagagcccaaaacgcccuggacaaccucgugaugcugcacaacagugagcagggcggccgggccuaccgacacgcgauggaggaguugccagacacuaucgagacguuaaugcugcuggcgcucaucgccgugcugaccggugggguuacccuguucuuccucuccggccgggggcucggcaaaaccagcauuggcuuguugugcguuauggccagcagcguacugcuguggauggccuccgucgagccccauuggauugcggcaaguaucaucuuagaguuuuuccugauggugcugcuuaucccggaaccggaucgccagagaacgccccaggauaaccagcuggccuacguggucaucgggcuguuguucaugauucugaccguggccgcaaacgagaugggccugcucgaaacaaccaagaaggaccuggggauugggcacguagcggucgagaaucaccaccaugcuaccaugcuggauguugaccuccaccccgccuccgccuggacgcuguaugccguagcgaccaccaucaucaccccgaugaugcgacacacgauugagaacaccaccgcuaacaucagccugaccgccauagccaaucaggccgccauucucauggggcuggacaaggguuggcccauuuccaagauggauauaggugucccucugcucgcuuuggguuguuacucacaggugaacccccugacgcucaccgcagccgugcugaugcuggucgcgcauuacgccaucauaggcccggggcuccaagccaaggccacccgggaggcccaaaagcgcaccgcugccggcaucaugaagaaccccacgguagaugguaucguggccauugaccuggaccccgucguguaugacgcgaaguucgagaaacagcuuggccagauuauguuacugauccugugcacaucccagauccuccugaugcgcacuaccugggcacugugcgagucuaucacgcucgcgaccggaccccugaccacgcugugggaaggguccccuggcaaguucuggaacacuaccaucgccgugagcauggccaauaucuuccggggauccuaccucgccggcgccggccuggcuuucucucuuaugaagucccucgggggugggcgcagggggaccggggcccagggugaaacccucggcgaaaaguggaagaggcagcucaaucagcucuccaagagcgaguucaacaucuauaagcgcuccgggauuauggagguggaucgcuccgaggccaaagagggccugaagcgcggggagacgacgcggcacgccgucucccggggcacggccaaacugcgcugguucguggaacgaaaccucguuaagcccgaggggaaggugaucgaccucggcugcgggcguggggguuggagcuacuacugcgccgggcugaagaaggugaccgaggucaagggcuauaccaagggcgggccaggccaugaggagccgaucccgauggccacguacgguuggaaccuggucaagcuccacuccggcaaagacgucuucuuugccccgcccgagaagugcgacacccucuugugcgacaucggggagaguucccccaacccgacgauugaagagggucggacguugcgcgugcugaagaugguugaaccuuggcugcgggggaaucaguucugcaucaaaauacucaaucccuacaugcccagcguggucgagaccuuagagcagaugcagcgcaagcacgggggcaugcuggugagaaacccccucucccgcaacagcacccaugagauguacugggugucaugcgggaccgggaacaucgucagcgcggucaacaugaccagccggaugcugcuaaaccgcuucacgauggcucaucgcaaacccaccuacgagcgggacguggaccucggggccggcacccggcacgucgccguggagcccgaggucgccaaccuugacaucaucggccagcggauagagaacauuaagcacgagcacaagucaaccuggcacuacgacgaggacaaccccuacaagacgugggccuaccacggguccuacgaggucaagccgagcgguuccgcgagcagcauggugaacggaguggugaagcuacugaccaagcccugggacgugauccccauggucacgcagauagccaugaccgacacaacccccuucggucagcaacgcguguucaaggagaaaguggacacucguaccccgaaggcucgcagggggacugcccagaucauggaggucaccgcgcgguggcuuuggggcuuccucagccggaauaagaagccucgcaucugcacccgggaggaguucaccagaaaagugcguagcaacgcggcaauaggagccguguucgucgacgagaaccaguggaauucugcgaaggaagcgguagaggacgagcgcuucugggaccuagugcagaaggagcgggagcuacacaagcaggggaagugcgccacgugcguuuauaauaugaugggcaagagggaaaagaagcugggagaguucggcaaggccaagggaucucgggccaucugguacauguggcucggcgcccgguuccuggaguucgaggcgcugggcuucaugaacgaggaccacugguuuucccgggagaacagccucuccgggguggagggggagggccuacacaagcuuggcuacauucuccgcgacaucagcaagaucccuggcggcaacauguacgccgacgacaccgccggcugggacacccggaucaccgaggaugacuugcagaacgaggccaaaaucacggacauaauggaaccggagcacgcccugcucgccaccuccaucuucaagcugaccuaucagaacaagguggugagggugcagcgcccggcuaaaaacgguaccgugauggaugucaucagucguagggaccaacggggcuccggccaggugggcaccuauggccugaacaccuuuaccaacauggaagcccagcucauccgccagauggagagcgaggggaucuuccuucccucagagcuggagaccccuaaccucgccgagcggguguuggacuggcuggagaagcacggcgucgagcgccucaagaggauggcgauaaguggggacgacugcguggugaaaccgaucgacgaccgcuucgcgacagcccugacugccuuaaacgacaugggcaaagucaggaaggacaucccucagugggagcccuccaagggguggaacgacuggcagcagguccccuuuuguucacaccacuuccaccaacugaucaugaaagauggucgcgagaucguggucccgugucggaaccaagacgaacuggugggccgcgcacgggugucccagggggccggcuggagccuccgggagaccgcgugucucgguaagagcuaugcucagauguggcaauuaauguacuuccauagacgcgaccugcgguuggcugccaacgcaauaugcagcgccguccccguggacugggugcccacgagccgcacgaccugguccauccacgcccaccaccaguggaugacaaccgaggacaugcugagcguguggaaccggguuuggaucgaggagaacccauggauggaggacaagacccacguguccucguggggagaugucccguacuuggggaagcgcgaggaccaguggugcggcuccuuaaucggcuuaacagccagggccacgugggcgagcaacauccagguggcaaucaaucaggugcggcgccugaucgggaaugagaauuaccucgacuacaugaccuccaugaagcgguucaagaacgaaggcgaccccgagggggcccugugguga

SEQ ID NO: 24295 - RNA, 9879 nt, Artificial Sequence
  derived and/or modified CDS sequence (opt11) from DENV-1__GQ199782__SS-prME
agcgucaccaugcuacucaugcugaugcccacggcguuggcuuuccaccuuacuacacgcggcggggaaccccauaugauugugaccaagcaagagcgggguaagagucugcuguucaagaccucggcgggggugaacaugugcacacuuaucgcgauggaccugggcgaacuuugcgaggacaccaugaccuacaagugcccccggaucacggaggccgagcccgacgacgucgacugcugguguaacgcuaccgacaccugggugaccuacgggaccuguagccagacgggcgagcaccggcgcgacaaacggucaguggcccuagcgccccaugugggccugggacuggagacccggaccgagaccuggauguccucagagggcgcuuggaaacagauccagcggguugagacgugggccuuacgccaucccggguucacagugauagcccuguuucuggcacacgccaucggcaccuccauaacccaaaaggggaucauauucauccuccugauguugguaacgcccagcauggccaugcggugcgucggcaucggcucacgcgauuucguggagggccucagcggcgcaaccuggguggacgucgucuuggagcacgggagcugcgugacaaccauggccaaggauaagcccacgcuggacaucgagcuccucaagaccgaggucaccaaccccgcggugcugcggaaauuguguaucgaagccaagaucucuaacaccacgaccgacucccgcugccccacccagggcgaagcgacacugauggaggagcaggacgcuaauuucgugugucggcgcaccuucgucgaccgagguugggggaacgguugcgggcuguuuggcaagggaucccucaucacgugcgccaaguuuaagugcgugacgaagcuugaaggcaagauuguacaguacgagaauuugaaguacuccgugaucgugaccguacacacuggcgaccagcaucaagucgggaacgaaucuaccgaacauggaaccaccgcgaccaucacaccccaagcucccaccucugagauccagcugaccgauuacggggcccugacacuggauuguagcccccgaacgggguuagacuucaacgagaugguucuacugaccaugaaagagaagagcuggcucguccacaagcaaugguuccuggaccugccgcucccguggaccagcggagccucgaccucacaggaaacguggaaucggcaggaccugcuggugaccuucaagacugcucacgcgaagaaacaggaaguuguugugcucggcagccaggagggcgcuaugcacacugcccugacgggggccacugagauccagaccuccggcaccacgaccaucuucgccggacaccugaaaugccgcuugaagauggauaagcuuacccugaagggcaugucguaugugaugugcaccgguuccuucaagcuagagaaggaggucgcggagacacagcacggcaccguucuggugcagaucaaguacgagggcaccgaugcaccaugcaaaauccccuuuuccacccaggacgaaaagggggucacacaaaacggccggcuuaucaccgccaacccaaucgugacggacaaggagaagcccgugaacauugaagccgagccgccauucggugaauccuauauagucaucggagcgggcgagaaggcccugaagcucagcugguuuaagaaggggucaagcaucggcaagauguucgaggccaccgcccggggggcccggcgcauggcaauccucggcgacacagcuugggacuucggguccgugggcgguguuuucaccagcgucgggaagcugguccaucagaucuucggcaccgccuaugggguucuguucuccggcgucagcuggaccaugaaaaucgggaucggugugcugcugaccuggcucggccuaaacuccagguccaccucacugagcaugacuugcaucgccgugggccucgucacccuuuaccuaggcgugauggugcaggccgacuccgggugcgucaucaauuggaagggccgggagcucaagugcgggagcggcaucuucgugacgaaugaaguucacaccuggaccgagcaauacaaguuccaggcggacagcccgaagcgcuuauccgccgccaucggcaaagccugggaggagggggucugugguauccgaagcgccacccgacuggagaacaucauguggaaacagaucuccaacgagcucaaccacauacugcuggagaacgacaugaaauucaccgucguagucggggacguuguagggauccuugcgcaggggaagaagaugauccgaccccaacccauggaacacaaguacucauggaaaagcuggggcaaggcgaagauuauuggugccgauauucagaacacgacauuuaucaucgaugggccgaauaccccggagugccccgacgaucagcgggccuggaacaucugggaggucgaggacuacggcuucgggaucuucaccacuaauaucuggcuuagacugcgugacagcuacacccaggugugugaccaccggcugaugagugccgcaauuaaggacagcaaggccguccacgccgacaugggguacuggaucgaguccgagaagaacgagaccuggaaacuggcccgcgcgucuuucauugaggucaaaaccugcaucuggcccaagagccauacgcuguggagcaacggagugcucgaguccgagaugauaaucccgaaaaucuacgguggcccgaucagccagcacaacuaccggcccggguauuucacccagaccgccggccccuggcaccuggggaaguuagaacucgacuucgaccugugcgaggggaccacgguggucguggaugagcacugcggcaaucgugggccguccuugcggaccacaaccgugacuggcaagaucauccacgaguggugcugccgcagcugcaccuugccaccccuccgauucaaaggggaagacggcuguugguacggaauggagauccgacccgucaaagagaaggaggagaaccucgucaagucuauggugucggcuggcucuggcgaaguugauaguuuuagccucggccuccuuugcaucuccauuaugguggaggaggugaugcggagccgguggucccggaagaugcucaugaccggaacccuggcuguguuucuauuacucauaauggggcaguugacguggaaugaccucauucgccuguguauaauggucggcgcuaacgcguccgaucgcauggggaugggcaccaccuaccuggcgcucauggccaccuucaagauccgcccgauguucgccguggggcugcugguccgcaggcucacgucucgcgaggugcugcugcucaccaucgggcuaagccuggucgcauccguggagcugccgaacagccuggaggagcuuggcgacgggcuagcgauggguaucaugauccucaagcuguuaaccgacuuucagucccaccagcuaugggccacccugcucagccugacguuuauuaagaccacccugucgcuccacuacgccuggaagaccauggccauggugcuauccaucgucucccuguuucccuugugccugaguacgaccucccagaaaaccacauggcuacccgugcuccugggcagccugggaugcaagccgcucacuauguuccugaucacggagaacaaaaucugggggcggaaguccuggccgcugaacgaggggauuauggcgguggggguggugagcauccucuuaagcucccugcucaagaaugacgugcccuuggccggucccuugauugccgguggcaugcucaucgccugcuaugugauaucugggucaucagccgaccugucccuggagaaggcggcagagguaagcugggaggaggaagcggaacacuccggagcuagccacaacauucucgucgagguccaagacgaugguacaaugaagaucaaggacgaggagcgcgacgacacucugaccauccugcucaaggccacguuacucgcgguguccggcgucuacccgcucagcauccccgccacccuguuugugugguacuucuggcagaagaagaagcagcggucggggguguugugggacacccccucuccacccgagguggagcgcgcggucuuagacgacggaaucuaccggaucaugcaacggggccuccuugggcggucccaggugggggugggggucuuccaggaaaacguguuccauaccauguggcacgucacgcgcggagccguacuuauguaccagggcaaacggcucgagcccagcugggcuuccgugaagaaggaccugauuagcuacggcggcgguuggcgccugcagggcuccuggaacacgggggaagaggugcaggucaucgcgguggagcccggcaagaauccgaaaaacgugcagaccgcccccggaaccuucaagacgcccgagggcgagguaggcgccaucgcccuggacuuuaagccaggaaccagcggcucgccuaucgugaaccgggaggggaagaucgugggccuguacggcaacggggucgucacgaccuccggcacguacgugagcgcgaucgcucaggccaaggccucccaggaggggccgcuccccgagauagaggacgaaguuuuccggaagcggaaucucaccaucauggaccugcaccccggcagcgggaagaccaggcgguaucugccggccaucgugagagaggcgaucaagaggaagcuacgcacccugauacuggcacccacgcguguggucgcauccgaaauggccgaggcccuaaagggcaugcccauccgguaccagaccaccgcggucaagagcgagcacacugggaaggagaucguggacuuaaugugccacgccacauucacuaugcgccugcucucccccguccgggugccgaauuacaacaugaucauuauggacgaggcacacuucacagaccccagcuccaucgccgccagagguuacaucagcacccggguaggcaugggggaggcggccgcuaucuuuaugacggccacgccgccgggguccguagaggccuucccgcaaaguaacgcugugauccaggacgaggagcgcgacauacccgagagauccuggaauagcggcuacgaauggaucaccgauuuccccggcaagaccgugugguucguccccuccaucaagagcggcaacgauaucgccaauugucuccgcaagaacgggaagagggugauccagcugucccgaaagacguucgacaccgaguaccagaagaccaagaacaacgacugggacuacguggucacuacggacaucagcgagaugggcgccaauuucagggcggaccgcgugaucgacccgagaagaugccucaagcccgucauucuuaaggaugggcccgagcgggugauccuggccggcccuaugccggugaccguagccuccgccgcccaacggcggggucgaaucggucggaaccauaacaaggagggugaccaguacaucuacauggggcagcccuuaaauaacgacgaggaccacgcccacuggaccgaggcgaagaugcugcuugacaacaucaacacgccagaggguaucaucccggcccucuucgaacccgagcgcgagaaguccgcagccaucgacggggaguaccgcuugcggggcgaagcccgcaagacguucguggagcugaugcggcggggugaccuccccguguggcuuuccuacaaggucgcgagcgagggcuuccaguacagcgacaggcgauggugcuucgacggcgagcggaacaaccagguccuagaggagaacauggauguagagaucuggacuaaggagggggagcgcaagaagcugcggcccagguggcuggacgcaaggaccuacuccgauccccuggccuugcgagaguuuaaggaguucgccgccggccgacggagcguauccggggaccuuauccuggagaucggcaagcugccccagcaccucacgcagcgagcgcagaacgcccuggacaaccucgugaugcugcacaacucagagcagggcgggcgcgcuuaccggcacgccauggaggagcugcccgacacgaucgagacccucaugcugcuggcacugaucgccgugcugaccggcgguguaacccuauucuuccuauccggccgagggcugggcaagaccagcaucgggcuacucugcgucauggccuccagcguccugcuuuggauggccucaguagagccccacuggaucgccgcgucaaucauccucgaguucuuccugauggugcuccucauacccgagccggaccggcagcgcacgccacaggacaaccaguuggccuacgucguuauagggcuccucuuuaugauccugaccguugccgccaacgagaugggccuguuagagaccaccaagaaggacuuagggauaggccacguggccguggagaaccaccaccaugccacgaugcuugacguggaccuccauccagccuccgccuggacccuguaugcgguggccaccaccauuaucacgccgaugaugaggcacaccaucgagaacacuaccgcaaacaucagucugacggccaucgcaaaccaggcggccauccucaugggauuagacaagggcuggcccaucaguaagauggacauaggcgucccccugcucgcgcucgggugcuacagccaaguuaaucccuuaacacuaaccgccgccgugcucauguuggucgcccacuacgcgaucaucggcccggggcuacaggccaaggcgacacgcgaggcucagaaacgcacagcggcaggcaucaugaagaaucccaccguggacggaaucguggcgauugaucucgaccccgucguguacgacgccaaauucgagaaacagcugggccagaucaugcuccugaucuugugcacgucccagauuuuacugaugcggaccacgugggcccugugcgaaagcauaacgcuugccacgggcccccugaccacgcugugggagggguccccgggcaaguucuggaacaccacgaucgcgguguccauggccaauaucuuccgcggcuccuaccucgccggcgccggcuuagccuucagccuuaugaaaucccucgggggcgggcgacgcggcacgggggcgcagggugagacguuaggcgaaaaguggaagcgucagcugaaccaauuaucaaagagcgaauucaauaucuacaagcgcuccgggaucauggagguugaccggagugaagccaaggagggccuuaagcgcggggagacuacccggcacgccgugucccgcgggaccgccaaacuucggugguuuguagagcgcaaucugguuaaacccgaggggaaggugaucgacuuagguuguggucgcggcggguggagcuacuacugcgcagggcugaagaaggugacggaggugaaggguuacacaaagggagggcccggccacgaggagcccaucccaauggccaccuauggguggaaccuugugaaacugcacuccgggaaggauguuuucuucacgccgccggagaagugcgacacgcugcugugcgauaucggggagagcucacccaacccuaccaucgaggagggcaggacccuccgcgucuuaaagaugguggagccauggcugcgcgggaaccaauucuguauaaagauccucaacccuuauaugcccagcguagucgagacccuggaacagaugcaacggaagcacgguggcaugcugguccgcaacccgcucucucggaacagcacucacgagauguauuggguguccugcgggacgggcaacauugucucugcggugaacaugaccuccagaaugcugcuaaaccgcuucaccauggcccaucggaagcccaccuacgagcgcgauguggaccucggggccggcacucgacacguugcggucgagccggaaguugccaaccuggacauuauuggccagcggaucgaaaacaugaagcacgagcauaaaucaaccuggcacuacgacgaggauaauccguacaagaccugggccuaccacggaagcuacgaggugaagccgagcggcuccgccucgagcauggugaacggggucgugaagcuguuaaccaagcccugggacgugauucccaugguaacgcaaaucgccaugaccgacaccacccccuucggccagcagcggguguuuaaggagaagguggacacgcgcaccccgaaggcgaagcgggggaccgcccagaucauggaggucaccgcccgcuggcucuggggcuuccugucccggaacaaaaagccccgcaucugcacgcgggaggaguucaccaggaagguucgaagcaacgccgccauuggggcgguguuuguggacgagaaccaguggaacuccgccaaggaggccguggaagaugaacgcuucugggaucucguacagaaggagagggaacuacacaagcaggggaagugcgccaccugcguuuacaauaugaugggcaagcgcgagaagaagcugggugaguucggcaaggcaaagggcagccgggccaucugguacaugugguuaggggcccgcuuccuggaguucgaggcccugggcuucaugaacgaagaccacugguucucccgagaaaauagccucuccggggucgagggcgagggucugcacaagcugggcuacauccuccgcgacauuagcaagaucccuggcgguaauauguacgccgacgacaccgcggggugggacacacgcaucaccgaggacgaccugcagaacgaggccaagaucaccgacaucauggaaccggagcaugccuugcucgccacguccaucuucaagcugacguaccagaacaagguaguccgcgugcaaaggccagcaaagaacgggacagugauggacgucaucagccggagagaucagcggggcuccggccagguggguacuuacggccugaacaccuucacgaacauggaagcgcagcucauccgucaaauggagagcgaggggaucuuccugcccuccgaacuugagacccccaaccuggccgagcgggugcuggauugguuagagaaguacggcgucgagcgccugaagcggauggccaucagcggggaugacuguguggugaagccaaucgacgaccgcuucgccaccgcgcucaccgcgcugaacgacaugggcaagguccggaaggacauuccccagugggagcccaguaagggcuggaacgacuggcagcaaguccccuuuugcagucaccacuuccaccagcucaucaugaaggaugggcgcgagaucgugguuccgugucggaaccaagacgaguugguuggccgcgcccgggugagucaaggggccggcuggagccugcgagaaacggccugccucggaaaaagcuacgcgcagauguggcagcucauguacuuccaccggcgcgaucugcggcucgcagccaacgccaucugcucugccguacccgucgacugggugcccaccucgcgaaccaccuggagcauacacgcccaccaccaauggaugacgaccgaagacaugcuguccguauggaaccggguguggaucgaggaaaaccccuggauggaggacaagacccauguguccagcuggggcgacguuccguaccuggggaaacgcgaggaccaguggugcggguccuuaaucgguuugaccgcccgcgcaaccugggcaagcaacauacaaguagccauuaaucaggugcggcgccucaucgggaaugagaacuaccuugacuacaugacgucaaugaagcgguucaagaacgagggcgaucccgaaggugcgcugugguga

SEQ ID NO: 24296 - RNA, 9879 nt, Artificial Sequence
  derived and/or modified CDS sequence (opt11) from DENV-1__GQ199783__SS-prME
uccgugacgaugcuucucaugcugaugccuaccgcccucgcguuccaccugaccaccagaggaggggaaccccacaugauagucaccaagcaggagcgggguaagucccuccuguucaagaccagcgcaggggugaacauguguacacugaucgccauggaccuaggcgagcugugugaggacaccaugacguacaagugcccccgcauuaccgaggcggaaccugacgacguggacugcuggugcaacgccaccgacaccugggucaccuacgggaccuguucccagaccggggagcaccgccgcgacaaacgcuccguggcacucgcgccccacgugggccugggucuggagaccagaaccgagaccuggauguccagcgagggcgcuuggaagcagauccaacgggucgagacgugggcccuacgccacccggguuucaccgugaucgcccuguuccuugcccacgccauuggcacuagcaucacccagaaggguaucaucuucauccugcugaugcuggugacgcccagcauggccaugaggugcgucggcaucggcucccgcgacuucguggaagggacaucaggugcgaccuggguagacgucguccucgagcacggguccugugugacaacgauggccaaggacaagccgacguuagacaucgaguuguuaaagaccgaggucacgaaucccgcagugcuacggaagcugugcaucgaggccaaaaucuccaacacgaccaccgacucccgcugccccacgcagggcgaagccacgcucauggaggagcaggacgccaauuuuguuugccgccgcaccuucgucgaccggggcugggggaauggcuguggguuauucggcaaggggagccuaaucacgugcgccaaguucaagugcguaaccaaauuagagggcaagauagugcaguacgaaaaccugaaguacuccgucaucgugacuguacacaccggcgaccagcaccaaguagggaacgagagcacagagcacgggaccaccgccacgaucacgccccaggcuccuaccuccgagauccagcugaccgacuacggggcccucacccuggauuguagcccccgcaccggccuggacuuuaacgaaauggugcuccugaccaugaaggagaaguccuggcugguccacaagcagugguuccuggaccugccgcugccauggaccucaggugcuuccacgucucaggagaccuggaaccggcaagaccuccucguaaccuucaagacagcucacgcgaagaagcaggagguagucgugcuaggcagccaggagggcgccaugcacacagcccucaccggggccaccgagauacagaccuccggcacuaccaccaucuucgccgggcaccugaagugccgccugaagauggacaaacuuacccugaagggcaugagcuacgugaugugcacgggguccuucaaacuggagaaggagguagcggagacccagcacggcacugugcuggugcagaucaaguacgagggcaccgacgcccccugcaagauaccauucagcacacaggacgaaaagggggucacccagaacggccggcuuaucaccgccaacccgaucgugaccgacaaagaaaaacccguaaauaucgaggccgaaccacccuucggugagagcuacaucgucaucggcgcgggcgagaaagcccugaagcugucaugguuuaagaagggguccagcaucggcaagauguucgaggccacggcccgcggggcucggcgcauggcgauacugggugacacugccugggacuucggcagcgugggcggaguguucaccagcgucggaaagcuagugcaccagaucuucggcacugccuacgggguccuguucuccggggucaguuggaccaugaaaaucgggaucggcgugcuccugaccuggcugggguuaaauucucgcagcaccucccugagcaugaccuguauagcgguggggcugguaacgcucuacuuaggcgugauggugcaggcggacuccgggugugucaucaauuggaagggucgggaguuaaagugcggaagcgguaucuucgugaccaacgagguacacaccuggaccgagcaguacaaauuccaggcggacaguccgaaacgccuguccgccgccauuggcaaggccugggaggagggaguuugugggauucggagcuccacccggcuugagaacaucauguggaagcagaucagcaacgaacugaaucacauccuccuggagaacgauaugaaguucacggugguggugggggacguugugggcauccuagcgcaggggaagaagaugaucagaccccagccuauggagcacaaguauuccuggaagucguggggcaaagcgaagaucaucggcgccgauguccagaauaccaccuucauaaucgacgggcccaacacacccgaaugccccgacgaucaacgcgcauggaacaucugggagguggaggacuacggcuucgggaucuucacgacaaacaucuggcucaaacugcgggacucauacacccaggugugcgaccaccggcugaugagcgcagcgaucaaggacuccaaggccguccacgccgacaugggguacuggaucgagucggaaaagaacgaaacguggaagcucgcucgggccuccuucaucgaggugaaaacguguauuuggcccaagagccacacccuuugguccaauggagugcuggaaagcgagaugaucauucccaagaucuacgggggcccgaucucccagcacaacuaccgccccggguacuuuacccagaccgcgggccccuggcacuuggguaagcuggagcuggauuucgacuuaugcgaggggacgaccgucguggucgaugagcacugcggcaaccggggaccuagcuugcgcacaaccacgguaaccggcaagauaauccacgaguggugcugccggucuugcacccuaccgccccuacgcuuuaagggggaagacggcugcugguacgggauggagauccggcccgugaaggaaaaggaagagaaccuggucaaaagcauggucagcgcuggcuccggcgagguggacaguuuuuccuuggggcuccuaugcaucaguaucaugaucgaagaggugaugcgcucuagauggagccgcaaaaugcugaugaccgggacgcucgccgucuuccugcugcucaucauggggcagcugacauggaacgaccugauucgguuaugcaucauggugggcgccaacgccuccgacaggauggggaugggcaccaccuacuuggcgcugauggccacguucaagauucgcccgauguucgcggugggccuccuguuucggcgccucaccagucgggaaguccuccugcugacuaucggguugucccugguggccagcguagagcugcccaacucccuggaagaacugggcgaugggcuggccaugggcaucaugauccugaagcugcugaccgacuuccaaagccaccaguuaugggcgacgcuguugucucugaccuucauaaagacgacccugagcuuacaccacgccuggaagacgauggcuaugguacucucuaucgugagccuguucccguuaugccucuccaccaccucccagaagaccacguggcugcccguccugcucgguucgcugggcugcaagccccugaccauguuccucaucaccgagaacaagauuuggggccgcaagagcuggccccugaacgaggggauuauggccguugguguggucagcauacuacucuccagccugcugaagaacgaugugccgcucgccgggccacugauugccggugggaugcugauugcaugcuaugugauuagugggucauccgccgaccucagccuagaaaaagccgcggaaguuuccugggaggaggaggccgaacacuccggcgccucccacaacauacugguggaggugcaggacgacgggacgaugaagaucaaggaugaggagcgggacgacacccucacaaucuuacugaaggccacguuacuugccgucucuggaguguacccgcuguccauccccgcgacccucuucgugugguacuucuggcagaagaagaagcagcggagcgggguucugugggacaccccuucucccccggaaguggagcgggcugugcuggacgaugggaucuacaggaucaugcagcgcggccugcucgggcgcagccaagucggcguagggguguuucaggagaacgucuuucauacgauguggcauguaaccaggggcgccguguugauguaccaggggaagaggcuggagcccucuugggccagcgucaagaaggaccucaucuccuacggcggcgguuggcgucugcagggcagcuggaauaccggggaggagguucaggugaucgccguugaacccggcaagaaccccaagaacgugcagacugcgcccgggacuuucaagacccccgagggcgaagugggcgccaucgcccuggacuucaaaccaggaacuuccgggagccccaucgucaaccgcgaggguaagaucguaggccucuacggcaaugggguggucaccacgagcggaaccuacgucuccgcgauagcccagaccaaagcgagccaggagggcccccuccccgagaucgaggacgagguguuccggaagaggaaccuaacuaucauggauuugcaccccggcuccgggaaaacgcggcgcuaccugccagccauaguucgggaggccaucaagagaaagcugagaacccucauucuggcccccacccgcgugguggcgucggagauggcugaggcccugaagggcaugccaauccguuaccagaccacggcugucaaauccgagcauaccggcaaggagauuguggaccucaugugccacgccaccuucaccaugcggcugcugucccccgugcgcgucccgaacuacaacaugaucaucauggaugaggcgcacuucacggaucccucaucgauugccgcucggggguacaucuccacccgaguggggaugggggaggcugccgcgaucuucaugaccgcgacuccucccggcagcgucgaagcguucccgcagucuaacgccgucauccaagacgaggagcgggauaucccugagagaaguuggaacuccgguuacgaguggaucacggacuuucccgggaaaaccgugugguuuguccccagcauaaaguccggcaaugacaucgcaaauugccuccggaagaauggcaaacgcgucauccagcugagccggaaaacuuucgacaccgaguaccagaagacgaaaaacaacgacugggacuacguggugacuaccgacaucuccgagaugggcgccaauuuccgcgcugacagggucaucgacccacgcagaugcuuaaagcccgugauuuugaaggacgggcccgagcgcgucauacuagccggccccaugccgguuaccguggcuagcgcggcucagcggcgcgggcguaucggccgaaaucauaacaaggagggcgaucaguacaucuacauggggcaaccccugaacaacgacgaagaccacgcccauuggacagaggccaagaugcucuuagacaacauuaacaccccagagggcauuauccccgcccucuucgagccggagcgcgagaaauccgcggccaucgacggggaguaccgcuugcgcggcgaggcccggaaaaccuucgucgaacugaugcgccgcggggaccugcccguguggcucagcuacaaaguggccagcgaaggcuuccaauacuccgaucgccggugguguuuugacggcgagcguaauaaccagguccucgaggaaaacauggauguggagauauggaccaaggagggggaacggaagaagcuacgcccaagauggcucgacgccagaacguacucggacccucuggcgcugcgugaguucaaggaguucgccgcgggccgccggucggugagcggggaccucauccuggagaucggcaagcuaccgcagcaccucacucagcgcgcccaaaacgcccuggacaaccuggucaugcuccacaacuccgagcaaggcgggcgggcauaccgccacgccauggaggagcugccagauacuaucgagacucugaugcuccuggcucugaucgccguuuuaacuggcggggugacguuauucuuccucuccgggcguggucucggcaagacguccauaggccugcugugcgucauggcaagcuccguccucuuauggauggcuucuguggagccccacuggaucgcggccagcauuauccuggaguucuuccucaugguccugcugauccccgagccggaccgacagcggacgccccaggacaaucagcucgcauauguggugaucgggcugcuguucaugauacucaccgucgcggccaacgaaaugggcuuacuugagacgaccaagaaggaccuaggaauuggccacguggccguggagaaccaccaucacgcgacgaugcucgacgucgaccugcaucccgcuagcgcauggaccuuguacgcuguggccacuaccaucauaaccccuaugaugcgccauaccaucgagaacacgaccgcaaacaucucccugaccgcaaucgcaaaccaggccgccauuuuaaugggucucgacaaaggcuggcccaucagcaaaauggacaucggcgugccccugcuggccuuggggugcuacucccaggucaacccccugacccugacugccgcagucuuaaugcugguggcccauuacgcgaucaucggcccggggcugcaagccaaggcaacacgggaagcccaaaaacgcaccgccgccggcaucaugaaaaaucccacagucgacggaaucguggccaucgaccucgaccccguggucuacgacgcgaaguucgagaagcagcuuggccagaucaugcugcucauccuaugcacgucgcagauccuguuaaugcgcaccaccugggcccugugcgaguccaucacccucgccacgggcccccucacuacccugugggagggcagcccgggaaaguucuggaacacaacgauugcagugucaauggccaacaucuucagagggucguaccuggcgggcgccggacucgcuuucagccucaugaagucgcuagggggcgggcgucgggggacgggggcccagggcgagacccucggugagaaguggaaacgccagcugaaccagcugagcaaguccgaguuuaauaucuacaagcggagcgggaucauggagguugaccgcuccgaggccaaagagggccuaaagcgcggagagacgacgcgccacgccguuagccggggaacggccaagcugcgcugguucgucgagcggaaccuggugaagccugaggggaaggugaucgaccuuggcugcggccgcggcggcuggucuuauuauugcgccgggcucaagaaggugacagagguuaaggguuacaccaaggguggcccgggccacgaggagccuauacccauggccacguacggguggaaccuggucaagcuacacagcggcaaggacguguucuuuacgccgccugagaagugcgacacccuccuuugcgauaucggugaguccagccccaauccaaccaucgaggagggccggacucuucgcguccuuaaaauggucgagcccugguuacgggggaaccaguucugcauaaagauacuaaacccguacaugcccuccgugguugagacguuagagcagaugcagcgcaaacacgguggcaugcuaguccggaauccgcugagcagaaauuccacccacgagauguacugggugagcugcgguaccgguaacaucgugagugccgucaauaugacgucccggaugcuccugaaucgcuucacgauggcccaucgcaagccuaccuacgagcgggacguggaucucggggccggcacccgccacgucgccgucgaacccgaggucgccaaccucgacaucaucggucagagaaucgagaacauaaagcacgagcacaaguccaccuggcauuacgacgaagacaaccccuacaaaacaugggcauaccacgggagcuacgaggucaagccguccggcagcgccagcuccauggugaaugggguagucaaguugcugaccaagcccugggacgugaucccaauggugacccagauugccaugacagauacuaccccauucggccagcaacgcguuuucaaggaaaagguggauacgcgaaccccgaaagccaagcgcggcacggcccagaucauggaggugaccgcgcgguggcucuggggcuuccugagccgcaacaaaaagccccggauauguacucgcgaggaguucaccaggaaggugcgcagcaacgccgcaaucggugccguguucguggacgagaaccaauggaacucugccaaggaggcggucgaggacgagcgcuucugggaccuggugcaaaaggagcgcgagcuccauaagcaaggcaaaugcgccacgugcguuuacaacaugauggggaagcgcgagaagaagcugggggaguucgggaaggcuaaggggucccgcgccaucugguacauguggcuuggcgcuagauuccuugaguucgaggccuuaggcuucaugaacgaggaccauugguucagccgcgagaacucccugagcggcguagagggcgagggguuacacaagcugggcuacauccugcgggacaucuccaagauaccagggggcaacauguacgcugacgacacagcugggugggacacccgcauaaccgaggacgaucuacagaaugaagcgaaaaucaccgacaucauggagccggagcacgcgcugcuggccacgagcauauuuaagcuaacauaccagaacaagguagugcggguccaacgccccgccaaaaacgggacggugauggacgugauaucccgccgcgaucagcgcggaagcggacagguggguacguacggccugaacacguucacuaacauggaagcccagcugauccgucagauggaguccgagggaaucuucuuacccagcgagcuggagacccccaaucuggccgagcgcgugcucgauuggcuugagaaguacggcgucgaacgacugaagcgcauggcgaucuccggggacgacuguguaguaaagccgaucgacgaccgguucgcaaccgcccucaccgcccugaacgacaugggcaaggugagaaaagacauaccccagugggagccgucaaaaggcuggaacgauuggcaacagguccccuucugcagucaccauuuucaccagcuaaucaugaaggacggccgggagaucguggucccgugccggaaccaagacgagcucguuggcagggcccgcgugagccagggggcgggcuggagccugcgagagacagccugccuggggaaguccuacgcucagauguggcagcucauguacuuccaccgccgggauuugcgacucgcggccaacgcgaucuguagcgccgugcccgucgauugggugcccaccuccagaacgaccuggagcauccacgcacaccaccaauggaugaccaccgaggacaugcucuccguguggaaccgcgucuggauugaggagaacccguggauggaggacaagacccacgugagcuccuggggcgaugugccguaccuggggaagagagaggaccaauggugugguagccugaucggccucacggcccgcgcgaccugggccuccaacauacaagucgccauaaaccaaguccgccgucugaucgggaaugagaacuaccuggacuacaugaccagcaugaagcgcuucaagaaugaaggugacccagagggagcccucugguag

SEQ ID NO: 24297 - RNA, 9879 nt, Artificial Sequence
  derived and/or modified CDS sequence (opt11) from DENV-1__GQ199784__SS-prME
agcguuacuaugcugcucaugcugaugcccaccgcccucgccuuccaccucaccacucggggcggggagccccauaugauugugaccaagcaagagcgaggcaaaagccugcuguucaagacuagugcgggggugaacaugugcacauugauagcgauggaccugggcgaguugugugaggacaccaugaccuacaagugucccaggaucaccgaggcugaacccgaugacguggauugcuggugcaacgccaccgacaccuggguaacauacgggaccugcagccagaccggugagcaccggagagacaagcggucuguggcccucgccccgcacguaggccuggggcuggagacccgcaccgaaaccuggaugucgagcgaaggcgccuggaagcagauacagcgcgucgagacgugggcgcugcgccaccccggguucacugugaucgcccuguuucuggcgcacguuaucggcacuucgaucacccagaaggggaucaucuuuauccuccuaaugcuggucacgcccagcauggccaugcggugcguggggaucggaucccgcgauuucguggaggggcugagcggugccaccugggucgacguuguucuggaacacgguuccugcgucaccaccauggccaaggacaagcccacgcuggacaucgagcuccuaaaaacggagguaaccaacccagccgugcugcggaaguuaugcaucgaggccaaaaucagcaacacgacgaccgacucccgaugccccacccagggggaggccacccugauggaggaacaggacgcgaacuuuguaugucgaagaacguuuguggaucggggcugggggaacggcuguggacuguucgggaaggggagccuuauaacgugcgccaaguuuaagugcgugaccaagcuggagggcaagaucguccaguacgagaaccucaaguacucggugaucgugaccguccacacgggcgaccagcaccagguggggaaugagagcacugagcacggcaccaccgccacuaucacuccgcaagcgcccacaucagagauccagcucaccgacuauggggcccugacccuggacugcagcccccgcacgggccucgacuucaaugagaugguccugcugacaaugaaggagaaaaguuggcucgugcacaaacagugguuccucgaccugccgcuccccuggacgagcggggccuccaccucccaggagaccuggaaucggcaagaccugcuggugaccuucaagaccgcccaugcuaagaagcaggaagucgugguucuaggaagccaggagggugcuaugcacacagcccugacgggggccaccgagauucagacuaguggcacuacgacgaucuucgccgggcaucugaaaugucgcuugaagauggauaagcugacccugaaaggaaugaguuacgucaugugcacggggucguucaaacucgagaaagagguggccgagacccagcauggcacgguguugguccagaucaaguaugaaggaaccgacgcgccgugcaagauccccuucagcacgcaggacgaaaaggguguuacucagaacggccggcuaaucaccgccaacccgauagugacggauaaggaaaagcccgucaauaucgaggccgagccgcccuuuggggaguccuacaucgugaucggggccggugagaaagcucuuaagcucuccugguucaagaaggggucuagcaucggaaagauguucgaggccacugcccgcggggcccggcgcauggccauccugggcgacacagcgugggacuuugggucgaucggcgggguguucaccuccgucgguaagcugguucaccagaucuucgggaccgccuacggggugcuguucuccgguguaagcuggaccaugaagauugggcugggcguccuucucaccugguuaggucuuaacucaaggagcaccucccucucaaugacuugcaucgcagugggccuggucacccuauaccucggaguuaugguccaagcugacuccgggugcgucaucaacuggaaagggcgugagcugaagugcgggagcggaaucuucgugacgaacgaaguacauacguggaccgagcaguauaaguuccaggccgacucucccaaaaggcuguccgcggccaucggcaaggcuugggaggagggcguuuguggcauccggucugcgacucggcucgagaacaucauguggaaacagaucuccaacgagcugaaccacauccugcuagagaacgacaugaaguucaccgucgugguaggggauguggugggcauccuggcccaggggaagaagaugauucggccccagcccauggagcacaaguacucauggaaguccugggguaaagcgaaaaucaucggcgccgacguccagaacacgaccuuuauuauugacgggccgaauaccccugaaugccccgacgaccagcgcgccuggaacaucugggagguggaggauuacggcuucgggaucuuuaccacgaauaucuggcugaagcuccgugacucacacacucagguaugugaucacagguugaugucagccgcgaucaaggacucuaaggccguccacgccgacaugggcuacuggaucgagagcgagaagaacgagacguggaaacuggcccgggccagcuuuaucgagguuaagaccugcaucuggcccaagucccauacgcucuggagcaacggcgugcuggaauccgaaaugaucauacccaagauauacgggggccccauaagccagcacaauuacagaccugguuacuucacccagaccgcgggccccuggcaccuggggaaacucgagcuggacuucgacuugugcgagggcacgacggucguaguggacgagcacugcgggaaccgggggccgucccuccgcacgaccaccgucaccggcaagaucauucacgaguggugcugccgaagcugcacgcugccgccccugagguuuaaaggggaagacgggugcugguacggcauggagauccguccugugaaggagaaagaggagaaucucgucaaguccauggucagcgccggcucgggggaggucgacuccuuuucgcuggggcugcucugcaucucaauuaugaucgaggaggugaugcgcucgcgguggagccgcaagaugcugaugaccggaacacuggccguuuuucuccuucuuaucaugggucagcucacguggaacgaccugauucgacuuugcaucaugguuggcgccaaugccagcgaucgcauggggaugggaaccaccuaucucgcgcugauggccaccuucaagaugcgcccgauguucgcugugggccuccuuuuccggcgccugacgucgcgggagguccugcuccugaccaucggccugucauugguggccuccgucgaguugccgaacagucuggaggagcucggcgacgggcuggccauggguaucaugauccugaagcuccugacagacuuccaaucucaccagcugugggccacucuccuaagccuuacuuuuaucaagaccacccucucccugcacuacgcuuggaaaacaauggccaugguccugagcaucgugucccucuuuccacugugccugucuacgaccucccagaaaaccacuuggcuccccguccuuuuaggcagcuuggggugcaagccgcuggcaauguuucugaucgcggagaacaagaucuggggccgcaagucauggccccugaacgaaggaaucauggcugugggcguugucucgauccugcucuccuccuuacugaagaaugacgugccgcuggcagggccccucaucgccggcggcaugcugaucgccugcuacguaauaagcggguccagcgcggaccuuucccucgaaaaggcggccgagguaagcugggaagaggaggccgagcacuccggcgccucucacaacauccugguggagguccaggacgacgggaccaugaagauuaaggacgaggaacgcgacgacacccugacaauccuccugaaggcgacacugcucgcagucuccggcguuuauccgcugagcauucccgccacccuguucgugugguacuucuggcagaaaaaaaagcagcgcuccggcguccuuugggacacgccuagcccaccggagguggagcgugccgugcuggacgauggcaucuaccguaucaugcagcggggcuugcugggccgcucccaggucggcguggggguguuccaagagaacgucuuucacacgauguggcacgugacccggggcgccgugcugauguaccaggguaaaaggcuagagcccagcugggcguccgugaagaaggacuuaaucuccuacggugggggguggcgcuugcaggggagcuggaauaccggggaggagguccaaguuaucgccguggagcccgggaaaaauccaaagaaugugcagacggcccccgguaccuucaagaccccugagggugaggugggcgcgaucgcccuggacuucaagcccgggaccagcggcucccccauugucaacagggaggggaagaucgucggucuguacgguaacgguguugucacgacaagcgggacguaugugagcgcgaucgcucaagccaaggccucucaggagggaccgcucccggaaaucgaggacgagguguuccggaagcgcaaccugacgaucauggaccugcacccagguucggggaagacucggagguaccucccggcgaucguacgggaggccaucaagcgcaagcuucggacccugauccuggcccccacucgcgugguugccucagagauggccgaggcccuuaaagggaugcccaucagauaucaaaccacggccgucaagagcgagcacaccggcaaagagaucguggaccugaugugccacgccacguucacuaugcggcuccugucacccgugcgcgugccgaacuacaauaugaucauaauggacgaggcccauuuuacugaccccagcuccauugccgcgcggggcuacaucagcaccagaguaggaaugggggaggccgccgccaucuucaugaccgccacgccgcccggcuccguggaagcguucccucagagcaacgcagugauccaggacgaggagcgugacauccccgagcgcucauggaacucaggguacgaguggauuacggacuuccccggcaagacggugugguucgugcccuccauuaagucgggcaaugacaucgccaacugucugcgcaagaacggaaagcgcgucauccagcucucccggaagacguucgauacugaguaucagaaaacgaagaacaacgauugggacuauguggugacgacagauaucagugagaugggcgccaauuuccgcgcugaccgggucauugacccccgccggugccugaagcccgugauccugaaagacgggcccgagagagucauccucgccggcccaaugccggucacuguggcauccgccgcacaacggcgcgggcggaucggucgcaaucauaacaaggagggcgaccaguauaucuacauggggcaacccuuaaacaacgacgaagaccacgcgcacuggacugaggccaagaugcugcucgacaacaucaacacccccgagggcaucaucccugcgcuguucgagccggagcgggagaaguccgccgccauugacggggaguaccgccugcggggcgaagcgcggaagaccuucguugaacucaugcgccgcggagaccugccaguuuggcuguccuacaagguagcaagcgagggcuuucaguacagcgaccgccgguggugcuuugauggcgagcgcaacaaccagguccucgaggagaauauggacguugagaucuggaccaaggagggggaacggaagaagcugcgcccccgguggcuugacgcccgcacguauuccgacccacucgcucugcgagaguucaaggaguucgccgcgggccgccggucgguguccggggaccugauccucgagaucggcaagcuaccgcagcaccugacccaacgcgcacaaaacgcccucgauaaccuggugaugcugcacaacagcgagcagggcgggcgggcauaccgccacgcuauggaggagcuccccgacaccaucgagacccugaugcuacucgcucugauugcaguacugacaggcggcgucacccucuucuuccuguccgggcgggggcuggggaagaccagcaucggccucuuaugugucauggcguccagugugcugcucuggauggccuccguggagccccacuggauagcggcaagcauaauccuggaguuuuuccugaugguccuccugaucccugagccagaccgccagcggaccccccaggacaaccagcuggccuacgucgugauagggcuccuguuuaugauccugaccgucgccgccaacgagaugggccuccucgagacaacaaagaaggaucugggaaucgggcacguggcuguggagaaccaccaccacgcuaccaugcuggacgucgaccuccaccccgcauccgcuuggacccuuuacgccguggcgacgaccauuaucacgccaaugaugcgccacacuaucgagaacacgaccgccaauaucucgcucaccgccaucgcgaaccaggccgcgauccugaugggacuggacaagggcuggcccaucuccaagauggacaucggugugccccuccuggccuugggguguuauagccagguuaacccccucaccuugacggcugcgguacugaugcucguggcacauuacgcuaucauagggccagggcugcaggcaaaggcuacccgggaagcgcagaagcguaccgccgcagguauuaugaagaaccccaccgucgacggaaucguagccaucgaccuggaucccgugguuuaugaugcuaaguucgagaagcagcucggucaaaucaugcugcucauucuaugcacuucgcaaauucugcugaugcgcaccaccugggcgcucugcgagagcaucacgcuggccacgggcccacugacaacucucugggaggggaguccgggaaaguucuggaacaccacgaucgccguguccauggcuaacaucuuucgcgggaguuaucuggccggcgccggauuagcguuuagccuuaugaagucccuugggggcgggagaagggguaccggugcacagggcgagacccucggcgagaaguggaagcgccaguugaaccaacuguccaagucagaauucaauaucuacaagcgcuccgguauaauggagguugaccgcagcgaagccaaggagggccugaagcgcggggagaccacgcgccacgcugucucccggggcaccgcgaaacugcgcugguuuguggagcggaaccucgugaagcccgaggggaaagucaucgaccugggcugcggccgcggggguugguccuacuacugcgccggucugaagaagguuacagaggugaagggcuacaccaagggugggccgggacacgaagagcccaucccgauggccacauacggcuggaacuuggucaaacugcacuccggcaaggacguguucuuuacgccgccggaaaagugcgacacccugcucugcgacaucggggaaucuucgccgaacccgaccauugaggagggccggacacugaggguccugaagauggucgagcccuggcuccgagggaaccaauucuguauaaagauacucaaccccuauaugcccucagugguagagacccuggagcagaugcagcgcaagcacggcggcauguuaguacggaacccgcugucacgcaacagcacacaugaaauguacuggguguccugcggcaccggcaacaucgucagcgcuguaaacaugaccaguaggaugcuacugaaccgcuuuacgauggcccacaggaagcccaccuacgagagagacgucgaccugggggcggguacccgccauguggccgucgagcccgagguggccaaccuugacaucauaggccagcgcaucgaaaauaucaagcacgaacacaagagcaccuggcacuacgacgaagacaaccccuauaagacgugggccuaccacggguccuacgaagugaaaccgagcggcuccgccagcagcauggugaacgggguggucaagcuccuuacuaagcccugggaugugauccccauggugacacagaucgccaugacagacacgaccccuuuuggccagcagcgcgucuucaaggagaagguugacacccggacaccgaaggccaagcgcgggacggcccagaucauggaggugaccgcccgguggcuguggggcuucuuaucccgaaacaagaaaccuagaaucugcacucgagaagaguuuacccggaaggugcgcagcaaugcagcgaucggugcagucuuuguggacgagaaucaauggaacuccgccaaggaggccgucgaggacgagcgcuucugggaccuggugcagaaagagcgcgagcugcacaagcaggggaagugugcgacgugcguguacaacaugaugggcaagcgggagaagaaguuaggggaguucggcaaagccaaaggaagccgugccaucugguacauguggcugggugcccgguuccucgaguucgaggcccucggcuucaugaaugaggaucacugguuuucccgugagaacagccuguccggggucgaaggagaggggcugcacaaacucgguuacauacugcgggacaucagcaagauaccggggggcaacauguacgcggacgacacagccggcugggacacccgcaucaccgaggaugaccugcagaacgaggcccggaucacggacaucauggagccggagcacgcguuacuggcaaccuccaucuucaaacuuaccuaccagaacaagguggugcgcguccagcgccccgcuaaaaauggcaccgugauggacgugaucagccggcgcgaccagcguggcuccgggcaggucggcacguauggccucaacaccuucacaaacauggaggcccagcugauccgccaaauggaaagcgaggggauuuuccuucccuccgagcuagagacccagaaccuggccgagagagugcuggauuggcuggagaaguacggcguugagcgccugaagcggauggccaucucgggggacgacugcgucguaaagcccaucgacgacagauucgcuacggcguugaccgcccucaacgacaugggaaaggugaggaaagacaucccccaaugggagccauccaagggguggaacgacuggcagcaaguccccuucugcagccaccacuuccaccagcugaucaugaaggacggucgcgagaucguuguucccugucggaaucaagacgagcuagucggccgcgcacgggugucccagggugccggguggagccuccgcgagaccgccugccugggcaaguccuaugcccagauguggcaacugauguacuuucacagacgcgaccuacgguuggcugccaacgccauaugcuccgcggugcccgucgauuggguucccacaagcaggacgaccuggagcauccacgcucaccaccaauggaugaccaccgaagacaugcuuagcguguggaaccgggucuggauagaggaaaacccuuggauggaggauaagacgcacguguccagcuggggcgacgugccuuaccuagggaagcgcgaagaccaguggugcgggucacugauuggccugaccgccagagccacuugggccagcaacauccaggucgcgaucaaccagguucggcgccuuauugggaacgagaacuaccucgauuacaugacauccaugaagcgguucaagaacgagggugacccggagggggcccugugguga

SEQ ID NO: 24298 - RNA, 9879 nt, Artificial Sequence
  derived and/or modified CDS sequence (opt11) from DENV-1__GQ199785__SS-prME
uccgugacaaugcuacugauguuaaugcccacagcacuugcguuccaucugaccacgcgcggaggugaaccccacaugauuguuuccaaacaagaaagaggaaaaagucucuuauucaaaaccucagcuggggucaacaugugcacuuuaauugccauggaccuaggagaacuuugcgaagacacgaugaccuacaaaugcccacgcaucacagaagucgaacccgacgacguggacugcuggugcaacacgaccgacaccuggguuacauauggaacauguagccagacaggagaacaccgacgagacaaacgcagcguagcacuggccccacacgucggccuaggccuggaaacgcgugccgaaacguggaugucaucagaaggggcguggaaacagauccagaaaguagaaacaugggcccuucgccaccccggcuucacuguaauagcgcuuuuucuugcacaugcgauaggaacuuccaucacgcagaaagguaucaucuucauccuuuuaaugcucguaaccccgagcauggcaaugcggugcgugggcauaggauccagagauuuuguggaggggcucaguggagccacauggguggacgucguccuagagcacgggagcugcgucacaaccauggcgaaagauaaaccuacccucgacauagaauuacucaaaacugaagucaccaaucccgcgguacuacgcaagcugugcauugaagcgaagauaucgaacacaacuacagacagccgguguccgacccaaggagaggcaacucuaguagaggaacaagacgcaaacuucguaugccgacgcaccuucguugacagaggaugggggaacgguugugggcucuuuggaaaaggaucucucaucacaugcgccaaguuuaagugcguaaccaaacuagaagggaagaucguccaguaugagaaucugaaauauuccgucaucgucacaguccacaccggcgaccagcaccaaguugggaacgagucgaccgaacacggcacaaccgccacaauaacgccucaagcccccacgagcgagauccaacuaacagacuacggcgcccucacccuagacugcagcccucgaacuggacuagacuucaaugaaaugguguuacuuacuaugaaagagaaauccuggcugguccacaaacagugguuccuggaucuaccccucccauggaccagcggugccagcacgagccaagaaaccuggaaccgucaagacuuacucguaaccuucaagacagcacaugcgaagaaacaggaaguagucguucucggaucacaagagggggcaaugcacaccgcgcuaacaggcgcgacggaaauacaaacaucagggacaaccacgauuuucgcuggucaucugaaaugccggcuaaaaauggacaaacucacucucaaaggaaugucauacguaaugugcaccggcucguucaaacucgaaaaagaagucgcagagacgcaacauggaacuguccucguacaaaucaaauacgaaggcaccgaugccccgugcaaaaucccuuucagcacccaagaugagaaagggguuacacaaaacggaaggcucaucaccgcaaacccaaucgugacagacaaagaaaagccugugaacaucgaggcggaaccgcccuucggcgagucguacauugucauuggcgcuggagaaaaagcccuaaagcucaguugguuuaagaaaggaucgucuaucggaaaaauguucgaagcaaccgcacggggagcccgaagaauggccaucuuaggggacaccgcgugggacuucggcucgaucggcggcguuuucaccuccguggggaagcuggugcaccaaauauucgggacugcguacggcgugcuauuuucgggcguaaguuggaccaugaagaucgggaucggcguauuacugaccuggcucggacuuaacucucgcagcacaucccuaagcaugacaugcauugcagucggccucgugacauuauaccuggggguaaugguccaagcagacuccgguugcguaauaaacuggaaaggccgagaacuuaagugcgggagugggauauuuguaacgaacgagguucauacguggacagaacaauacaaauuccaggcggacuccccaaagcggcugucagccgcuauaggcaaggccugggaggagggaguauguggcauccgcagugcgacacgccucgaaaacauuauguggaggcagauuagcaacgaacugaaccauauucugcucgaaaacgauaugaaauucacgguagucgucggggaugucguaggcauacuagcccaagggaagaaaaugauaagaccccaacccauggaacacaaguacagcuggaaaucguggggcaaggcuaaaauaauaggcgcugaugugcaaaauacaaccuuuauaauagaugguccaaauacgccugaguguccagacgaccagcgcgcauggaacauaugggaagucgaagauuauggguucggcauuuucaccaccaacauauggcuaaagcuacgggacaguuauacccagguaugcgaucaccgccuuauguccgcugccauaaaagacagcaaagcgguacacgccgacaugggcuacuggaucgaaagugagaaaaaugaaacauggaagcucgcccgcgcgucauucauagaggugaaaacuugcaucuggccaaaaucccacacccuguggucaaacggcguucuugagagcgaaaugauaaucccaaagauauacgggggcccgaucagccagcacaauuaucgaccuggcuacuucacgcagacugcgggccccuggcaucucggcaagcuggaacuagauuucgacuugugcgaagggaccacggucgucguggacgaacauugcgguaaccggggaccaagucucaggacaacaaccguaacgggaaaaaucauacaugaguggugcuguagaagcugcacacucccaccccuccgcuuuaaaggggaggacgggugcugguacggcauggaaauaagacccgugaaggaaaaagaagagaaccuugugaagucaaugguuagcgccgggucaggcgaaguagacucguucagccuaggacuccuaugcauauccaucaugauagaggaagucaugaggagccgguggagccggaaaaugcuuaugaccggaacacucgcgguguucuuccuacugauaauggggcaacugaccuggaacgaccuuauaagaucaugcaucauggugggggccaacgcguccgaccgcaugggcaugggcacgacguaccucgcacugauggccacauucaaaaugcgcccaauguucgcaguaggacugcuuuuccgucgucucaccuccagagaagugcuccugcuaacaauaggccuaagccuaguggcaucgguggagcuacccaacucacucgaagaacugggggacggacuggcaauggggauaaugauucucaaacuacuaaccgauuuucagucuuaccaacuaugggcaacacuccuaucacuaacguuuauuaaaacuacauucucacuccacuacgccuggaaaaccauggcaaugguccugagcauagugagccuccucccacucugccucagcacaacaagucagaaaaccaccuggcugcccgucuuguugggcucacucggcuguaaaccgcuaacaauguuccucauagcagagaacaaaaucugggguagaaaaucguggcccuuaaaugaaggaauaauggcaguagguaucguaucuauucugcucaguucucuccucaaaaacgaugugccccuagcaggcccucugaucgcuggcggcaugcucauugcaugcuacguuauaagugguagcucagcugacuugagccuugagaaggccgcagaaguauccugggaagaagaagccgaacauucaggagccucgcauaacauacugguagagguacaggacgacgggacaaugaagauuaaagacgaagaacgcgacgacacgcucacaauacuucuaaaagcaaccuugcuugcagucaguggaguuuacccgcugagcaucccggcaacacucuucguuugguacuucuggcagaagaagaaacagcgcagcgggguauuaugggacacaccaagcccacccgaagucgaaagagccguccuagacgauggcauauacaggaucaugcagagagggcuccugggaaggucccaagucggcguuggcguauuccaagagaacguauuucacaccauguggcaugugaccagaggugccgugcugauguaucagggcaagagacucgaacccucgugggcauccguaaagaaggaccuuauauccuacggagggggauggaggcuucagggaucguggaacaccggggaggaaguacaagugauagcaguggaacccgggaaaaaccccaaaaacgugcagacagcgccagggacguuuaagacaccagaaggggaggucggcgcuauagccuuggacuucaagcccggaaccuccgggagcccaauagugaaccgcgaggggaaaauaguuggcuuauacggaaauggagucguuacuaccuccggaacguaugucucagcaauagcucaagccaaggcgagccaagagggaccgcugccagagaucgaggaugagguguucaggaaacguaauuugacaauaauggaccugcacccaggcagugguaagacccgucgauaccuaccagcaaucguccgggaggcgauuaagcgcaaacucagaacgcucauauuagcgcccacgaggguagucgcaagcgagauggcagaggcccucaagggcaugccaauccgcuaucaaaccacagccguaaagagcgagcacacagggcgcgaaaucguagaccucaugugucacgcaaccuuuacaaugcgucuccucaguccaguccgaguacccaacuauaacaugaucaucauggaugaggcgcacuucaccgauccaucaagcaucgcggcgcgaggcuacaucuccacaagaguggggaugggugaggcugcagcaauuuucaugacugcgaccccaccgggguccguugaagcguucccgcaauccaacgcggucauccaagacgaagaacgcgauaucccagagcgauccuggaacagcggauacgaguggaucacugacuucccaggcaaaaccgucugguucgugccauccaucaagagcggaaacgacaucgcaaauugucuucgcaagaacggaaaacgagucauccaguuaucgcgaaagaccuucgacacagaauaccagaaaacuaaaaacaaugauugggacuauguugucaccacggauauuucagagaugggggccaauuucagggcggaccgggugauugacccccgacggugucuaaaacccgucauccugaaagacggcccggagcgcgugauacuggcagggccaaugcccguaacuguagccagcgcggcacaacgccgaggccgcauagggcgcaaccacaacaaggaaggcgaccaauacaucuacaugggccagccccuaaacaacgacgaagaucacgcucacuggacagaggcaaaaaugcuacuagauaauauaaacaccccggaaggaauaauaccggcacucuucgagccagagcgcgagaagucugcggccauagacggagaauaccgacuucgaggggaagcacgaaaaacguucguagaacucaugcgucgcggcgaucuaccuguauggcuuuccuacaagguagcauccgagggauuccaauauucagacaggagaugguguuucgauggcgaacggaacaaccaaguccuagaggaaaacauggauguggaaaucuggaccaaagagggggaaaggaagaaacugcggccgcgauggcuagacgcaagaacguacuccgacccccucgcccugagagaguucaaagaguuugcggcugggagacggagcguaagcggcgauuuaauccucgagaucggaaaacuaccgcagcaccucacacaaagagcccagaaugcgcucgacaaccuaguuaugcuccauaauagugagcaagggggcagagccuaccgccacgcgauggaagaacuccccgacaccaucgaaacgcugaugcugcuagcacugauugcggugcuaaccgggggagugacacucuucuuccucucagguaaggggcuggggaaaacaucgauagggcucuugugcgugauggccagcagcgcucuacuuuggauggcgucagucgagccacacuggauugcagcgagcauaauccuagaguucuuccugaugguacuucuaaucccagaacccgaucgucaacgcaccccacaggauaaucaacuagcauauguggugaucggccuauuauucaugaucuugacggucgcggcgaacgaaaugggccuacuugagacaaccaagaaagaccuagggauuggacacgucgcagucgaaaaccaccaucacgccacaaugcucgacguagaccuccauccggcuagcgccuggacacuguacgccguugccacaacgauaaucacaccgaugaugcgucacacgauagaaaacaccacagccaacaucucccuaacggcuaucgccaaccaagcggcuauacuaaugggccuagacaaagguuggccuaucucgaaaauggacaucggcgucccacuccucgcccucgggugcuacucccaagucaauccacucacucugacggcugccgugcuuaugcucguggcacacuacgcaaucauaggaccagggcugcaagcuaaggccacccgcgaagcccagaagcgaaccgccgccggaaucaugaagaauccaacggucgaugggauaguagcaauagaccuggauccaguggucuacgacgcgaaauucgagaagcagcuaggccagaucaugcuacucauacuaugcacaucucaaauacuccuuaugcgcacuacaugggcccuaugugagagcaucacacuggcgacaggccccuuaacgacauuaugggaagggucccccggaaaauuuuggaacaccacgaucgcaguaucuauggccaauaucuuucgcggcagcuaccuagccggagccggacuugcauucucgcuaaugaagucacucgggggcggcaggcgcggcacuggggcucaaggcgaaacccuuggcgagaaguggaaacgccaacucaaccagcugucgaaaagcgaauuuaacaccuauaagaggagcgggauaauggagguagacagaagcgaagccaaagaaggccuucgccgcggcgaaacaacgaaacacgcuguaucgcgaggaacagccaagcuacgcugguucguagagcggaaccuuguaaaaccugaagguaagguaaucgaucucggaugcgggcgagguggauggucguauuauugcgcaggacugaaaaaggugacagaagucaagggauacaccaagggagggcccgggcacgaggaaccgauacccauggcaacauauggcuggaaucuggucaaacuccauagcggaaaggacguuuucuucaucccgccggaaaaaugugacacauuauuaugcgauaucggagagucuagccccaaccccaccauugaagaagggaggacccucagaguccuaaaaaugguugaaccauggcuaagagguaaccaauucuguauaaagauauugaacccauauaugccaagcgucguggagacacuagagcagaugcaaagaaaacauggcggaaugcuuguaaggaacccauuaucgcgaaacaguacucacgagauguacuggguaucauguggaacagggaacauaguaucagcgguaaacaugacaagccgcauguuauuaaaccgcuuuaccauggcgcaccgcaaacccacguacgagagggacguagauuuaggcgccggcacccgacacguugcaguagaacccgaaguagcgaaccucgauauuauuggccagagaauagaaaacauaaaacacgagcacaaaagcacguggcacuacgacgaagacaacccauacaaaaccugggcauaccacgggaguuacgaggugaaaccguccgggucagccagcagcaugguaaacggaguagugaagcuccugacgaaaccaugggacguaauacccaugguaacccaaauagcaaugacggacacgacgccauucggacagcagcgagucuucaaagaaaaaguggacacacgcacgcccaaagcaaaacgcgggacagcccagauuauggaagucaccgcgaaauggcuauggggcuuuuugagccggaacaagaagccacguaucugcacgcgagaggaguucacccgaaaggugcgaagcaacgcagcaaucggcgcggucuucguggacgaaaaucaguggaacagugccaaagaagcggucgaagacgaacgcuucugggaccuaguacaucgggagcgugaacuacauaagcaagggaaaugcgcaaccugcguauacaauaugaugggaaaaagagagaagaaacuuggcgaguucggcaaagccaaagggucacgggcgauaugguauauguggcuaggugccagauuccuagaguucgaagcccuaggcuucaugaacgaggaccacugguucucgagagaaaacagccuaagcgguguggagggcgaagggcuacauaaacuagguuacauccuacgggacauaaguaaaaucccaggcgggaacauguacgccgaugacacagcagggugggauaccaggauuacugaagaugaucugcaaaaugaggccaaaauaacugauaucaugaaacccgaacaugcccuccuagcaacaucaauuuucaaacugaccuaccaaaacaaaguaguucggguucaacgccccgcgcgaaauggcacgguaauggacguuauaucacgucgugaccaacggggauccggacagguuggcacauacggccuaaacacauucacgaauauggaggcacagcucauacgacaaauggaaagcgaaggaaucuucagcccaagcgaauuagaaaccccgaaucuggcagaacggguuuuagacuggcuagagaaacauggcguagaaagacuaaagagaauggccauaaguggcgacgacugcgugguuaaaccaaucgacgaccgauucgcgaccgcgcuguccgcgcugaacgauaugggcaagguacgcaaggacaucccucaaugggagccauccaagggcuggaacgauuggcagcagguaccauuuuguagccaccauuuccaccaacucauaaugaaagacggaagggagauagugguacccugcagaaaccaagacgaacuuguagggcgcgcacgcgucucacaaggugcaggcuggucacuacgcgagacagcaugucuagguaagagcuaugcucaaauguggcaacugauguacuuccaccgcagggaccuacgcuuggcagcaaacgccauuugcagugccguuccagucgacugggugccaacuucgcggacaaccugguccauccacgcgcaccaccaauggaugacaaccgaagauaugcuaaguguauggaaucgaguauggauagaagaaaacccauggauggaagacaagacacacaucucgucguggggcgacgucccauaccucggaaaaagggaggaucaaugguguggcucacugaucggacucacagcccgggcuaccugggcaacaaacauccaaguggcaaucaaccaagugcgucgauuaaucggcaacgaaaacuaccucgacuacaugacgagcaugaaacgauuuaaaaaugaguccgacccugaaggugcguuaugguag

SEQ ID NO: 24299 - RNA, 9879 nt, Artificial Sequence
  derived and/or modified CDS sequence (opt11) from DENV-1__GQ199786__SS-prME
agugugaccaugcuuuuaaugcugaugcccacggccuuagccuuccauuuaaccaccagagggggagaaccgcauaugauuguuagcaaacaagaacgcgggaagucguuacuuuucaaaaccucggcgggaguuaacaugugcacguuaaucgcgauggaucuaggagaacuaugcgaagauaccaugacguauaaaugcccccggauaacggaaacggaacccgacgacgucgacugcuggugcaaugcaacggacacaugggugacauauggaacaugcagccaaacuggagaacaccgaagagauaagagguccguggcccuugccccacacgucggucucggacuugaaacaaggacugaaacguggaugucauccgaaggagccuggaaacagauacagcgcgucgaaacaugggcguuaagacauccagguuucacggucauagcgcuguuccuagcacacgcaaucggaaccuccaucacgcagaaaggcaucaucuucauccuacuaaugcuggugacaccgagcauggcgaugagauguguugguauuggaucacgcgacuuuguagagggccucucgggcgcaacguggguagacgucguccuagaacacgguucgugcguuacaacuauggcaaaagacaaaccgacccucgacaucgagcugcuaaagacggaggugaccaaucccgcuguccuaagaaagcucugcaucgaagcgaagauuagcaacacgaccaccgacucaagaugcccaacacaaggagaagcgacccugguggaagaacaagacgcuaacuucgucugucggagaaccuucgucgaucgcgggugggguaaugggugcggccucuucggaaaaggcucccugauaacgugcgccaaauucaagugcgucaccaagcuggagggaaagauugugcaguaugaaaacuugaaauacucagugauugugacagugcacacgggcgaucaacaucaagucggcaaugagucgaccgaacacggcacuacagcgacaauuacaccucaggcccccaccaccgagauacaacuuacggacuauggcgcgcuuacacuagacugcuccccgagaaccggacuagacuucaacgaaaugguucugcucacgaugaaagaaaaaucaugguugguccacaagcagugguuccuagaccucccgcuacccuggacaagcggcgccucgacaagccaagagacauggaaccgccaggaucuccucgucacauucaaaacggcacacgccaagaaacaggaaguaguggugcuuggaagccaagaaggggccaugcauacugcgcucacuggagccacagaaauucaaacaagcggaacgaccacaaucuucgcaggacaccucaaaugcagacucaagauggacaaacucacucugaagggcauguccuaugucaugugcacgggaucauuuaaacucgagaaagaaguagccgaaacacagcauggcaccguucugguacaaaucaaguacgaaggcaccgacgcgcccugcaaaauaccauuuagcacccaggaugagaaaggcgugacgcagaacggccgauuaauuacggcaaacccaauagucaccgacaaagaaaaacccguaaauauugaagcagaacccccauuuggcgaaucauacauagucauaggggcuggagaaaaagcccucaaacucucuugguuuaagaaagggagcucgauagggaaaauguuugaagcuaccgccagaggggcgcgacggauggcuauccugggcgauacagcaugggacuucggaucaaucgggggagucuucaccucugucggcaagcugguccaccagauuuucggaaccgccuauggaguucucuucuccggggucucuuggaccaugaaaauaggaaucggcguacuacuaacaugguuagggcucaauucuagaagcacuucacugucaaugacaugcauugcaguaggguuagugacccuuuaccucggcgugauggugcaagcagacucaggcugcguaaucaacuggaagggaagagaauugaaaugcggcaguggcauuuucgucaccaacgagguccacaccuggacugagcaauacaaauuccaagcggauaguccuaagcgccuuucugcagcgaucggaaaagcgugggaagagggggucugcggaauccgcagcgcaacacggcuagagaauauuauguggaaacaaaucaguaacgaacuaaaccauauccuauuagagaacgacaugaaguucacggucguugucggcgacguagccggaauccucgcccaaggaaagaagaugaucaggccgcaacccauggaguacaaauauagcuggaaaucauggggaaaagcaaaaauuaucggggcagacguacagaauacuaccuucaucauagacggaccgaacacccccgagugcccugacgaucaaagagcguggaacauuugggaagucgaagauuauggcuucggaaucuucaccacuaauauaugguuaaaacuacgagauucauacacccagguaugugaccaccgacuuaugagcgccgccaucaaagacagcaaagcgguccacgcugacaugggguacuggauagaauccgagaaaaaugagacauggaaauuagcgcgagcgagcuucauagaggugaagacuugcauauggccuaaaagccacacacucuggucgaacggugucuuagagucagaaaugauaaucccgaaaauauacggaggaccgaucucacaacacaacuaccgccccggguacuucacgcagacggcagggccuuggcaccucggcaaacucgaacuagacuucgacuuaugugaaggaaccacggucgugguagacgaacauugcgguaacagagggccgagccugcguacaaccacggugacaggcaaaauaauacacgagugguguugcagguccugcacgcucccuccucuacgcuuccggggagaagauggcugcugguacggcauggaaauacguccagucaaggagaaagaagagaaccucgucaagucgaugguaagcgcaggcagcggggaaguagacuccuucucucucgggcuacucugcauaagcaucaugauagaagagguaaugcgaagccgcuggaguagaaaaaugcucaugacggguacacuagcugucuuuuuccugcugauaaugggacaauuaacauggaacgaccucauacgccuaugcauuaugguaggugccaaugcuagcgaccgcaugggcaugggaacuacguaucuggcccuaauggcaaccuucaaaaugcgaccgauguucgcagucggccucuuguuccgacguuuaaccagccgggaggucuuacuccuaacgauuggacuaagccuaguugcaagcguggaauugccgaacagccuggaggaguugggugacgggcucgccauggguauaaugaucuuaaaacuucuaaccgacuuucagucgcaccaacuaugggcaacauuacuguccuugacguuuaucaagacgacauucucacuucauuacgccuggaaaaccauggccaugguacuaagcaucgucagccucuucccacuuugccuuagcacgacuucccaaaagacgaccuggcuaccaguacuguugggcagucuagguuguaaaccccugaccauguuccuaauagcagaaaacaagaucuggggccgccggagcuggccucucaacgagggaauuauggcuguaggcaucguaucaauucugcuuuccagucuguugaaaaacgacgucccacucgcggggccacuaauagccggcggaaugcucauagcgugcuacguuauuagcggauccucggccgaccugucacuggaaaaggcggccgaaguaucaugggaagaagaagcggagcacucaggggcaucccacaacauccucgucgagguccaagacgauggcacaaugaaaauaaaagacgaagaaagagacgacacauuaacgauacugcuuaaggcaacccuccuugcuguaagcggaguuuacccguuguccaucccggccacacuauucgucugguacuucuggcaaaagaagaaacaaagaaguggcguacucugggauacaccgaguccaccagaggucgagcgcgcaguacuagacgacggaauauacagaaucaugcaaagaggcuugcuggggaggagccaaguuggaguaggcguguuccaagaaaacguguuccacacuauguggcacgugacaaggggcgcggugcucauguaccaaggcaagcgacuagagcccucaugggcaucagugaaaaaggaccugaucaguuacggcgggggauggaggcuccaaggauccuggaacacgggcgaggagguacaaguaauagcggucgaacccggcaaaaacccaaagaacguucaaacagccccuggaacguucaaaacgccagaaggggaggugggagcaauugcucucgacuucaaaccgggaacuuccggaucaccaaucguaaaccgcgaaggaaaaauaguaggccucuaugggaacggaguagucacaacuagcggaacauacguguccgcaauugcccaagccaaagcaucccaggagggcccgcuccccgaaaucgaggaugagguauuucgcaagagaaaccuaacgauuauggaccuccacccaggcuccggcaagacacgucgcuaccuaccggccaucgugcgggaagcaauaaaacggaaacugcgaacgcuuauccuggcgccaacgcgggucguagccuccgagauggccgaagccuugaagggcaugccaauaagguaccagacgacggccgugaagagugagcauaccggaaaggaaauuguagauuugaugugccacgccacguucacgaugcgacuauuaucaccagugcguguacccaacuacaacaugauaaucauggacgaggcccacuucacugaccccaguucuauugcggcacgcgguuacauaucgacacgagucggaaugggagaggccgcagcaauuuucaugaccgccacacccccuggcucgguagaggccuuuccccaauccaaugccguaauacaggacgaggaaagggauaucccggagcgaucguggaacagcggguacgaauggauaacugauuuccccggcaaaacagucugguucguuccgaguaucaaaucagggaacgauaucgccaacugucuacgcaagaacggaaaacggguaauacagcucucacgcaagaccuucgacaccgaauaccagaaaacgaaaaacaacgacugggacuaugucgugacuacagacauuagcgaaaugggggcuaauuuuagggcugacaggguuaucgacccacgccguugccucaagccaguaauccucaaggauggccccgagcgagugauccuagccgggccaaugccagucacgguggccagugccgcacagagaaggggccgaauaggacgcaaccacaacaaggaaggggaucaauauauauauauggggcagccgcucaacaacgacgaagaccaugcucacuggacagaggcaaaaaugcuuuuagauaacauaaauacaccugaaggcaucauucccgcccuauucgagcccgagagagagaaauccgcugccaucgacggggaauaccgccugcguggugaggcaaggaaaacguucguugaacucaugaggcggggcgaucucccuguauggcuuagcuauaagguugccagcgaaggauuucaauacucagaccgcagaugguguuucgauggagagagaaauaaccaaguuuuagaagaaaacauggacguggagauuuggacaaaagaaggcgaaagaaagaaacucagaccacgauggcucgacgccaggaccuacucggacccgcucgcccuccgagaauuuaaagaguucgccgccggcagacguagcgucaguggagaccuaauauuagaaauuggaaaacugccccaacaucuaacacaacgagcucagaacgcccuagauaaccuuguaaugcuccauaacagcgagcaaggaggccgcgcuuaccgucacgcuauggaagaacuuccggacaccauugaaacccugauguugcuagccuugaucgcgguccucaccggcgggguaauacuauucuuccuaagcggacgcggacuaggcaaaaccagcaucgggcuccucugcguuauggcgagcagugugcuacuuuggauggcguccgucgagccacacuggauagccgcgucuaucauacucgaguucuuccugauggugcuccuaauaccagaaccagaccgccagagaacaccccaggauaaccagcucgccuacguagucauaggacuacucuucaugaucuuaacaguagcggcgaaugaaauggguuuacucgagaccaccaagaaagaccucggcauaggacaugucgcagucgagaaucaccaucacgcagccauguuggacguggaucugcaccccgccucugcguggacacucuacgcuguagcaaccacaaucaucacgccaaugaugcgccacacgaucgaaaacacaacagcuaacaucagccucacugcgaucgcaaaucaggcggcaauacugaugggacuggacaaaggcuggcccaucucuaagauggacaucggggucccccuccuagcccucgggugcuacucgcaaguuaacccgcugacauugaccgcugcuguccuaaugcuaguagcgcauuacgccaucauaggaccgggccuccaggcaaaggcgacgagagaggcgcaaaaacggacagcggcugggaucaugaaaaaccccacugucgacggaaucguagcgauagaucuugaucccgucguuuaugacgcgaaauucgagaaacaacucgggcagaucaugcuccucauccucugcacaagucaaauccuccucaugagaacgacuugggccuuaugcgagaguaucacccuggcgacuggaccccuuaccacccucugggaaggcagcccugggaaauucuggaacaccaccaucgccguauccauggcgaacauauuccggggcucguacuuagccggugcaggacuagcauucucacuaaugaaaagccucggcgguggacgacgggggaccggagcccagggugaaaccuugggggagaaauggaaacgccaacucaaccagcuuaguaaguccgaguucaacacauauaaacguagcgggaucauggaaguugaccgcuccgaggcaaaagaaggucuaaagcgcggggagacaaccaaacacgcugugucucgugguaccgcgaaacuccgaugguucgucgaacguaaucuaguaaaaccagaagguaaagucaucgacuugggguguggaagaggcggauggaguuacuacugugcuggucucaagaaaguaaccgaaguaaaaggguacacaaaagggggaccggggcacgaagaaccgauaccaauggccacauacggguggaaucuagugaaguuacacucuggcaaggacgucuucuuuauucccccugaaaagugcgacacucugcucugcgacauaggugaauccuccccuaaucccacgauagaagaaggaaggacauugagaguucuaaaaaugguggaaccguggcuacgcggaaaucaauucugcaucaaaauccuaaaccccuauaugccguccgucgucgaaacucuggaacagaugcaacgaaagcacggcggaaugcugguucgaaacccuuugucgcgcaauagcacacacgagauguacuggguauccuguggcacugggaacauagugagcgccguuaauaugacgucccgaaugcuacuaaaccgauucacgauggcccaccgaaagcccacauacgaaagagacguagacuugggagcaggaacaagacacguugccguugagcccgaaguggccaaccucgauauaaucggccagcgcauugaaaacaucaagcaugaacacaaaucuaccuggcacuacgaugaagacaauccguauaagacgugggcuuaucacgggucauacgaaguaaaacccucgggaagcgcaucaagcauggugaacggggucgugaaacuacucacuaaaccgugggaugugauccccaugguuacgcagaucgccaugacagacaccacccccuucggccaacaaagaguuuuuaaagagaaaguggauacgcgaaccccaaaggccaagcgagggacagcccaaaucauggaaguaacggcgaaguggcuguggggcuuccuuagcaggaacaagaagccucgaaucugcacgcgggaggaguuuacgcgaaagguccgcuccaacgcugccauaggugcaguuuucguggacgaaaaccaguggaacucagccaaggaggccgucgaagaugaaagauucugggacuuaguccaccgggaaagggaauugcacaaacagggcaagugcgccaccugugucuacaauaugaugggaaagcgcgagaagaagcugggagaguucggcaaggccaaagggagccgggccauaugguacauguggcuaggagcccgauuccuagaguucgaagcccucggcuuuaugaacgaagaccacugguucucccgcgaaaacagccucaguggcguagagggcgagggucuucacaagcugggauacaucuugcgcgacauaucgaaaauccccgggggaaauauguaugcugaugacaccgccggaugggauacgcggauaaccgaagacgaccuccagaacgaagcacguauuacggacaucauggagccagagcacgcccuccuggccagguccaucuucaaacugaccuaucaaaacaaagugguccguguacaacgaccagcgaaaaacggaacaguaauggacgugauaagucgacgagaccagcguggcucaggacagguggggaccuauggguuaaacaccuucacgaacauggaggcgcaacucauucgucaaauggaaucggagggaaucuucagcccuucggagcucgaaacuccuaauuuagcggaacgaguccuagacuggcuugaaaaauacggcguugaacgacuuaaacgcauggcgaucucgggagaugauugcguaguaaaaccgauagacgauagauucgcaaccgcccuaacagcccuuaacgauauggggaagguuaggaaagacauaccacagugggagccgaguaagggcuggaacgacuggcaacaaguaccuuucuguagccaccacuuccaccaacuaauaaugaaagacggccgcgaaaucguaguuccaugcagaaaccaggacgaacuuguuggcagagcaagggucucacaaggcgccggguggucucuucgggaaaccgcaugucuugggaaauccuacgcccaaauguggcaguuaauguacuuccacagacgcgaccuccgccuagcagcaaacgcgauuugcucggccguacccguggacuggaucccaacaucaagaaccacaugguccauacacgcgcaccaccaauggaugaccaccgaggacaugcuaucuguguggaaccgagucuggaucgaagaaaaccccuggauggaggacaagacccacaucagcucauggggagauguacccuaccuaggcaaacgggaagaccaguggugcggaucacuaaucggccuaaccgcgagggccacaugggcuaccaacauccaggucgccauaaaccaaguacgccgcuuaauaggaaaugaaaacuaccuagacuacaugaccucaaugaaacgcuucaagaacgaaagcgacccggaaggggcacugugguga

SEQ ID NO: 24300 - RNA, 9879 nt, Artificial Sequence
  derived and/or modified CDS sequence (opt11) from DENV-1__GQ199787__SS-prME
agcgugaccaugcugcugaugcugguccccacagcccuggcuuuccacuuaaccacccguggcggggaaccccacaugaucgucaccaagcaggagcggggaaagagucuguuauucaagaccagcgcggggguaaacaugugcacccuaaucgccauggaccugggugagcugugcgaggacacuaugacauacaaaugcccucggaucacagaggccgagccggacgaugucgacugcugguguaacgccaccgacaccugggucaccuacgggacuuguagccaaaccggggagcacaggcgggacaagcguagcguggcacucgcgccucacguagggcuggggcuagaaacccggacugaaaccuggauguccagcgaaggcgcuuggaagcaaauccaacggguggagacuugggcccuccgacaccccggguucaccguaaucgcccuguuucuggcgcaugcgaucgggaccaguauuacccagaaggggaucaucuucauccuuuugaugcuggugacgcccucgauggccaugcggugugugggcauaggaucccgcgacuucguggaagggcucuccggcgccaccugggucgacgugguccuggagcacggcuccugcguuaccaccauggcaaaagacaagcccacgcuggacaucgagcuacugaagaccgaggugaccaacccugcggugcuacggaaguuaugcauugaggcgaagaucagcaacacaacgaccgauucccgcugccccacccaaggcgaggcuacccugauggaggagcaggacgccaacuuuguuugccgacgcacauucguggacaggggcugggggaacggcugcggguuguuuggcaaaggaagccuaaucacgugcgccaaguuuaagugcgugaccaaacuggaaggcaagaucgugcaguacgaaaaccugaaguacuccgugauagucacgguccauacgggcgaccagcaccagguuggaaacgaaaguaccgagcauggcacaacagccacgaucacgccccaagcuccaaccucggagauccagcucacagauuacggggcucugacccuggacugcagccccagaacgggccucgacuucaacgagaugguccugcucaccaugaaagagaaguccuggcucgugcacaagcagugguucuuagaccugccgcugcccuggaccucuggcgccucgaccucucaggagacguggaauagacaggaccuguuggugaccuucaaaaccgcccacgcgaagaagcaggaaguaguggugcucggaucacaggagggcgccaugcacaccgcccuuacuggggcaacggagauccaaaccaguggcaccacgacaauauucgcugggcaccugaagugccgccucaagauggacaagcugacgcugaaggggaugagcuacgucaugugcacuggcuccuucaagcucgagaaagagguggcggaaacucagcaugguaccguguugguccagaucaaguacgaggguaccgacgcccccugcaagauaccauucuccacccaagaugagaagggggugauucagaauggucgguugaucacggccaacccuaucgugaccgacaaagaaaagcccguaaacauugaagccgagccgccuuucggggaguccuauaucgugaucggcgugggcgagaaggcgcugaagcucaguugguucaagaaggguucuucaaucggcaagauguucgaagccacagcacgcggggcgcggcguauggccauucuaggggacaccgcgugggauuucggguccaucggcggcgucuucacgucaguagguaaguuagugcaccagauauucggcaccgccuacgggguccuuuucuccggcgugaguuggacaaugaagauugggaucggcgugcuucugaccuggcucggucugaacuccaggagcacgucccugagcaugaccugcauagcugucggucucgugaccuuauaccucggcgugaugguccaggcagauuccgggugcgugauuaacuggaagggacgggagcugaaaugcggaagcggcaucuucgugaccaacgaaguccacacguggacugagcaguacaaguuccaggccgacagcccgaagcgccuguccgcggccauugggaaggcaugggaagagggggugugcggcauccggucugccacccgccuggagaacaucauguggaagcagaucaguaacgagcucaaucacauccugcuggaaaaugacaugaaguucacgguggucgugggugacgucgucggcauccucgcccaggggaagaagaugauccggccccaacccauggaacauaaguacagcuggaagucgugggguaaggcaaagauaaucggagccgacguccagaacaccacguucauuaucgacgggccuaacaccccagagugccccgacgaccagcgcgccuggaacauaugggagguggaggacuacggguucgggaucuucaccaccaacaucuggcucaagcugcgggauucguacacccaggccugcgaccaccgccugaugucggcggcgauuaaggacagcaaggccguccacgccgacauggguuacuggauagaguccgaaaagaacgagaccuggaagcuagcacgggcgagcuucauagaggugaagacgugcaucuggccgaagucgcacacccuguggaguaacggugugcucgaguccgagauggucauccccaagauuuacgguggcccaaucucacagcacaacuaccgccccggguauuucacgcagacggccgguccuuggcaccugggaaagcucgaacucgauuucgaccugugcgagggaaccacugugguugucgacgagcacugcgguaacagggggcccucccuuagaacuaccacugugaccggcaagaucauacacgaguggugcugccggagcugcacguugccgccccuacguuuuaaaggagaggacgguugcugguacggaauggagaucagaccagugaaagaaaaagaggaaaaccuggucaaguccauggugagcgccggcaguggcgaaguggacaguuucucccucggacugcucuguaucuccaucaugauugaagaggucaugcgaucccggugguccaggaaaaugcuaaugaccggcacccuggccguguuccugcuccugaucaugggccagcucaccuggaaugaucucauccggcugugcaucauggugggggccaacgcgagcgaccgcauggggaugggcaccaccuacuuggcgcucauggcuacguucaaaaugcgcccgauguucgccgucgggcugcuguuccggcgccucaccucacgggagguucugcugcucacgaucgggcugagccuggucgccagcguggagcuccccaacagccuggaggagcugggcgaugggcucgcgaugggaaucaugauucuuaaguuacucacggacuuucagucccaucagcugugggccacacugcucagucuuacauucaucaagacgacccuaagucuccauuaugcguggaagaccauggccauggugcugucgaucgucucccuguucccccucugccugagcaccaccucucagaagaccaccuggcugcccgugcuccugggcagcuugggaugcaagccguugaccauguuccucaucgcggagaacaagauuuggggccgcaaauccuggccccuuaacgaggguaucauggccguggggguugugucgauccuccugagcuccuugcucaagaacgaugugccguuagccgggccacugauagccggcggcaugcucaucgcuugcuauguaauuagcgggaguagcgcggaccugagccuggagaaggcggccgaaguuucuugggaagaggaagcagagcacuccggcgcuagccauaacauacucguggagguucaagaugacgggacgaugaaaauuaaggaugaggagcgggacgauacucugaccauucugcucaaggcaacccugcuggcuguauccggcguguacccgcucucgauccccgcaacgcuguuccugugguacuuuuggcagaaaaagaagcagcgcagugguguccugugggacacucccucaccgccugaggucgagcgggcggugcucgacgacggaaucuaucguaucaugcaacgggggcugcucgggcgcucccaaguaggcguggggguguuucaggagaacgucuuccacaccauguggcacguaacccggggcgccgugcugauguaccaggggaaacgacuggaacccucgugggcuuccgucaagaaagauuugaucagcuacggcgggggguggcguuugcagggcagcuggaacaccggggaagagguucaagugaucgcagucgaaccuggcaagaaccccaagaacguacagacggcccccgggaccuucaaaacccccgaaggcgagguaggcgccaucgcgcuggacuucaagcccggaacuuccgguaguccaaucgucaaccgggaggggaagauagucggccuguacggcaacgggguggucaccacaagcggcacauacgugagcgcgaucgcccaggccaaagcgucccaagagggaccgcuucccgagaucgaggaugagguguuccggaagcggaauuugaccaucauggaccugcaccccggcagcgggaaaacgcggcgcuaccuccccgcgaucguucgagaggccaucaaacgcaagcugcgaacccucauacucgcaccuacccgcgugguagcaucagagauggccgaggcgcugaagggcaugcccauccgcuaccagacuacggccgucaagucugagcauaccgguaaggagaucguggaccuaaugugccacgccacauucaccaugagacuacuuaguccagugcguguuccgaacuacaacaugaucaucauggacgaagcccauuucacggaucccucgucuaucgccgcuaggggauacaucagcaccagaguaggcaugggcgaagcugccgcgaucuucaugaccgccacaccgcccggcuccguggaggcguucccgcaaagcaacgccgucauccaagacgaggagcgggacauaccugaacguucuuggaacucuggguacgaguggauaacggacuuucccggcaaaaccgucugguucguucccucuaucaagaguggaaaugauaucgccaacugccuacggaagaacgggaagcgcguaauccagcucucccgcaagaccuucgacacagaguaucagaagacgaagaacaacgacugggauuacguuguuaccacggauaucagcgagaugggcgcuaacuuccgcgcggacagggugauagacccgcgccggugucugaaacccguuauccuaaaagacgggcccgagcgggugauccucgccggcccaaugccugucaccguggccuccgccgcccagcggcgcgggcgaaucggcagaaaccacaauaaggagggugaccaauacaucuacaugggucagccccugaacaacgacgaggaccaugcccacuggacggaagcaaaaaugcugcuagacaacaucaauacccccgaaggcaucauccccgcucuguuugagccggagcgagagaaguccgcugcgaucgacggugaguaccggcugcgcggcgaggcaagaaagacuuucgucgaguuaaugagaaggggagaucugccgguguggcugucuuacaagguggccagugagggcuuucaguacagcgaccgucgguggugcuucgacggcgagcgcaauaaucagguccucgaggagaauauggacguggagauuuggacaaaggaaggggagcguaaaaagcugcgcccacgcuggcucgaugccagaacguauucggacccccucgcacugcgggaauucaaggaauuugccgcgggacgccggaguguguccggggaccugauccuugagaucggcaagcucccucagcaccuaacccagcgcgcccagaaugcccucgacaaccuggucaugcuacacaacagcgagcagggaggucgggccuaccgccacgcuauggaagaacuacccgacaccauugagacccugaugcugcucgcccugaucgccgugcugacgggggggguaacacuuuucuuccuguccggccggggccuggggaaaaccagcaucggcuuacuguguguaauggcguccagcgugcugcucuggauggcauccguggaaccccacuggaucgcggccucaaucauuuuagaguucuuccugauggucuugcucauacccgagccggaccgccagcggacgccccaggauaaccagcuggccuacguaguuaucgggcuccuuuuuaugauccugaccgucgccgccaacgagaugggccuccuugagacgaccaaaaaggaucugggaaucggccacguggcgguggagaaccaccaccacgcuaccauguuggaugucgaccuucaccccgccuccgcauggacccucuacgcgguggcgacgaccaucauuaccccaaugaugcgacacaccaucgagaacacgacugccaauaucucacucacggcuaucgccaaccaggccgcgauccugauggggcuggacaagggguggcccauauccaagauggacaucggcguuccccuccuggcacuggggugcuauagccaggucaacccccucacuuuaacugcggccguguuaaugcuuguggcgcacuacgccaucaucggccccgguuuacaagccaaggcaacgcgggaagcccagaagagaaccgcggcuggcaucaugaagaacccgacgguagacgggaucguggccaucgaccuugacccugucgucuacgacgccaaguuugaaaagcagcuaggccaaaucauguugcugauucucugcacgucucagauccugcuuaugcggaccacuugggcgcuaugugagagcauuacccuggcgacaggcccacugaccacauuaugggagggcucccccggcaaguucuggaacaccacgaucgccgugaguauggccaauaucuuccgagggaguuaccuggccggagcuggccuggcguuuagccucaugaagucccucgggggcgggcgccgggguaccggcgcccagggcgagacgcugggcgaaaaauggaagaggcagcucaaccagcuguccaagagcgaauucaacaucuacaaacgguccgguaucauggagguggaccgcagcgaggccaaggaaggcuugaagcgcggggagaccacgcgccacgccgucucccgaggcacugcgaaguuacgcugguuugucgaaagaaacuuggucaagcccgaggggaaagucauagaccucggcuguggacgcgggggcuggagcuacuacugcgccgggcugaagaaaguuaccgaggugaagggcuacaccaagggagggccgggccacgaagagcccaucccuauggccacguacggguggaaucuggucaagcugcauucgggaaaggacguuuucuucacccccccagagaagugcgacaccuuacucugcgacaucggggagucaucucccaacccgaccauugaagagggccggacguugcgcguguuaaagauggucgagccgugguuacgggggaaccaguucugcaucaagauccuaaaccccuacaugcccagcgugguggagacucuggagcagaugcagcgcaagcauggcggcaugcucgugcggaacccucugucccggaacucuacacacgaaauguacuggguauccugcgggaccgggaacaucgugucagcagucaacaugacaucgcggaugcuguugaaccgcuucacgauggcccaccguaagccuacuuacgagcgggauguggaucugggggcgggcacacgccacguggcggucgaacccgaaguggccaacuuagacauaaucgggcaacggauagagaacaucaagcacgagcacaaaagcaccuggcauuacgacgaggacaaucccuacaagacaugggccuaccacggguccuaugagguaaagccgagcggcucugccuccagcauggugaacgggguggucaagcuccucacuaagcccugggacgugauccccauggucacccaaauagcgaugaccgauacgaccccauucggccagcagcgugucuucaaggagaagguggauacccggaccccgaaggccaagcgcgguacagcucagauaauggaagugacagcccggugguuauggggcuucuuaucucguaacaaaaaaccccggaucugcacccgcgaagaauucacccgaaaaguccgcucgaacgccgcaaucggcgccguuuucguggacgaaaaccaguggaacucagccaaggaggccgucgaagacgagcgguucugggauuuaguccaaaaagagcgcgagcugcacaagcaggguaagugcgcuacgugcguguacaacaugauggggaagcgcgaaaagaagcugggggaguucggcaaggcuaaagggucacgcgcuauuugguacauguggcugggagcccgguuccuggaauucgaggcucucggauuuaugaacgaggaucauugguuuucuagagaaaauagcuugagcggggucgagggcgaggggcugcacaaacucggguauauccugcgggacauaagcaaaauucccgggggcaacauguacgccgacgauacagccggcugggacacccgcaucaccgaggacgaucugcaaaacgaagccaagaucacggacaucauggagccggagcaugcguuacuggccaccuccauuuucaagcuaaccuaucagaacaaggugguccggguccagcgccccgcuaagaacgggacgguaauggaugugaucagccgccgagaccagaggggguccgggcagguuggcacguacggccucaacacauucacuaauauggaggcccagcugaucagacaaauggagucugaggggaucuuucugcccuccgagcuugagacuccuaaucuggccgagcgcguacuugacuggcucgagaagcacggcguggaacggcugaagcgcauggcgauaucaggggaugacuguguugugaagccgaucgaugaucgguucgcaacugcgcuaaccgcacucaaugauaugggcaaggugaggaaggacauaccccaaugggagcccuccaagggguggaacgacuggcagcagguccccuucugcagccaccauuuccaccaacugaucaugaaggacggccgggaaaucgugguucccugccgcaacgaagacgagcuggucggacgcgcucgcgugagucagggggcuggguggucgcuacgggaaaccgccuguuugggaaagagcuaugcacagauguggcaacugauguacuuccaccggcgggaccuccgccuggccgcuaaugcuaucuguuccgcgguaccggucgauuggguucccacuagccggacgaccugguccauccacgcccaccaucaguggaugacgaccgaggauaugcugagcguguggaaccgcgucuggaucgaagagaaccccuggauggaggacaagacacauguguccagcuggggcgacgugccguaccucgggaagagagaggaccaguggugcggaucccugaucggauuaaccgcccgugccaccugggccuccaacauacaggucgcgaucaaccaaguacgccggcucaucgggaaugagaacuaccuagauuacaugaccuccaugaaacgguucaagaacgagggcgaccccgagggugcccugugguaa

SEQ ID NO: 24301 - RNA, 9879 nt, Artificial Sequence
  derived and/or modified CDS sequence (opt11) from DENV-1__GQ199788__SS-prME
agcgugacuaugcugcucaugcugaugcccaccgcccuggcauuccaucucacgacccggggcggggaaccgcacaugaucguguccaagcaggaacgggguaagagccugcuguucaagaccagcgcgggggugaacaugugcacucucauagcaauggaccugggggaguucugcgaggacacgaugaccuacaagugcccccggaucaccgaagccgagcccgacgacguggauugcuggugcaacgccacugacacgugggugaccuacgggaccuguagccagaccggcgagcaccggcgggacaagcgguccguggcccuggcgccccacgugggccucgggcuggagacgcgcaccgaaacuuggaugagcagugagggggccuggaagcaaauccagcggguggagaccugggcgcugcgccaucccggguucacggugaucgcccucuuccuggcacacgcgaucgggaccagcauuacccagaagggaauuaucuuuauccuccucaugcuggugacgcccuccauggcaaugcggugcgugggcaucggcagccgcgacuucguggaggguuuguccggcgccacguggguggacgucgugcuagagcacgggucuugcgugaccaccauggccaaggacaagcccacccuggacaucgagcugcucaagacggaagucacaaaccccgcggugcugcggaaacugugcaucgaagccaagaucuccaacaccaccacggacagcagaugcccgacccagggcgaggccacccucguggaggagcaagacgcuaacuuugucugucggcgcacauucguggaccggggcugggggaacgggugcgggcuguucggcaagggguccuuaaucacgugcgcgaaguucaaaugcguuacuaagcucgagggcaagacuguucaguacgaaaaccugaaguacagcgucaucgugaccguccacacgggcgaccagcaccaaguggggaacgaguccacagagcacggcacuaccgccaccaucacuccccaggcccccagcaccgagauccagcugaccgacuacggggcccucacccuggauuguucaccccggacgggcuuagacuucaacgagaugguucuccugaccaugaaggagaaguccuggcuagugcacaagcagugguuucucgaccuuccucuccccuggacaagcggcgcguccaccucccaagagacuuggaaccggaaggacuuguuagugaccuuuaagaccgcccacgcgaagaagcaggaggucguggugcugggcucucaggaaggggccaugcacaccgcccucacgggagcaaccgagauacaaaccagcggcaccacgaccaucuucgccgggcaccugaaaugccgccuaaagauggacaagcucacccugaaggggauguccuaugucaugugcaccgggagcuucaagcuggaaaaggagguggcggagacgcagcacggcaccgugcucguccagaucaaguacgaggguacugaugcccccugcaagaucccguuuuccacccaggaugagaagggggugacgcagaaugggcggcugauuacagccaacccgauugugaccgauaaggagaaacccgucaacaucgaggcggagccgccguucggggaguccuacaucgugaucggcgcgggcgagaaggcccuaaagcuguccugguuuaagaaggggagcucgaucggcaagauguucgaggccaccgcccggggugcccggcgcauggcuauccucggugacacggccugggacuucgggagcaucggcggcguguuuaccuccgucgguaagcugguccaccagaucuucgggaccgccuacgggguccuguucaguggcgucuccuggaccaugaaaaucgggaucggcguguugcugacguggcugggccucaacucucgcuccaccagccuguccaugaccugcaucgccguagggcuggucacccucuaccugggcgugauggugcaggccgacagcgggugcgucaucaacuggaagggccgggagcucaaaugcgggagcgguaucuucgugacgaacgaggugcauaccuggaccgaacaguauaaguuccaagcagacuccccgaagaggcucucggccgccaucggcaaggcgugggaggaaggggucugcggcauccgguccgccacccgccuugagaauauaauguggaagcaaaucagcaaugagcugaaccauauccuccuggaaaaugacaugaaguuuaccgugguggucggggacguggcgggcaucuuagcccaggggaagaagaugauccguccucagcccauggaguacaaguacuccuggaaaagcugggguaaggccaagaucauaggcgccgacgugcagaacacaaccuuuauaauagacgggcccaauaccccagaaugccccgacgaccagcgcgcguggaauaucugggagguagaggacuacggguucgggaucuucaccacgaacaucuggcucaagcugcgagacuccuacacccaggugugcgaccaucgccugaugagcgccgccaucaaggacuccaaagccgugcaugccgacaugggcuauuggaucgaguccgaaaagaacgagacauggaagcucgcccgagccuccuucauagaggucaagacaugcaucuggcccaagucacacaccuugugguccaacgggguacuggagagcgagaugaucauccccaaaaucuacgggggcccgaucucccagcacaacuaccgcccuggguacuucacccagaccgccggcccauggcaccucgggaagcuggagcuggacuucgaccucugcgagggcaccacgguggugguggaugagcauugcggcaaccgggguccgagcuugcgcaccaccacaguaacggguaagaucauccaugaguggugcugccggucaugcacucugccuccgcugcgcuucaagggcgaggacggcugcugguacggaauggagauccggcccgucaaggagaaggaggagaaucuggucaagagcauggugagcgccggcuccggcgaggucgacagcuucucccuggggcucuuaugcaucagcaucaugaucgaggaggugaugcgcuccagauggagccgcaagaugcugaugaccgguaccuuggccgucuucuuccugcugaucauggggcagcucacauggaaugaccucauccgucugugcaucauggucggcgcgaacgccuccgaccgaauggggaugggcacaaccuaccucgcgcucauggcaacauucaagaugcgcccgauguucgccgugggccuccuguuccggcgucucacgagccgggaggugcugcuccugacgauuggucugucccuggucgcgagcguggagcugccuaauucccuggaggagcucggggacgggcuggccaugggcauaaugauccugaagcuacugacagauuuccagagccaccagcugugggccacccuccuuucccugacguucaucaagaccaccuucagccuccacuaugcauggaagaccauggcgaugguccuguccauugugagccuguucccccucugucugaguacgaccagccagaagaccaccuggcugcccguucucuuaggcucucucgguugcaagccccucacgauguuccugaucgccgagaacaaaauauggggccgcaaaaguuggccucugaacgaggggaucauggccgucggcaucguuagcauccuccuguccucccugcucaagaacgacguuccgcuggccgggccccugauagccgguggcauguuaaucgcgugcuacgucaucuccggcagcagugccgaccugucucuggagaaggccgcugagguguccugggaggaggaggccgagcacagcggcgcgagccacaacauucucguggagguccaggacgacgguacgaugaagaucaaagacgaagaacgcgacgacacucugaccauccugcucaaggccacccugcuggccguguccggcgucuacccgcucuccauacccgccacgcuguuugucugguacuucuggcagaagaagaagcagcgcagcggggugcugugggacacacccucuccucccgagguggaacgagcagugcucgacgacggcauauaccgaaucaugcagcggggucuccuggggaggucacaggugggcguagggguguuccaggaaaacguguuccacaccauguggcacguuaccagaggggcggucuuaauguaccaggggaagcgccucgagccauccugggcuagcgugaagaaggaccugaucuccuacgguggcggguggcggcugcagggcucauggaacaccggagaggaggugcaggucaucgccguggagcccgguaagaauccgaagaacgugcagaccgcaccugguacauucaagaccuccgaaggcgaggucggcgccauagcuuuagacuucaagcccgggacgagcggcaguccuaucgugaaucgagaagggaagauuguaggccuuuauggcaauggggucgugacgaccuccggaaccuacgugagcgccauagcucaggccaaagcgucccaggaggguccccugccggagaucgaggacgaggucuuccggaagcgcaaccucacgaucauggaccugcacccuggcagugggaagacucggagauacuugcccgccauugugagagaggccaucaagcgcaaacuucggacccugauccuggccccgaccaggguggucgccuccgagauggccgaggcccucaagggcaugcccauccgcuaccagacgaccgccguuaaguccgagcacacaggcaaggagaucguggaccugaugugccacgccacguucacaaugaggcuguugucccccguccgcgugcccaacuacaacaugaucauaauggacgaggcccacuucaccgacccaagcucgaucgcugcccggggguacaucagcacgcgcgugggcaugggggaggcugccgccaucuucaugacggcgaccccgcccggcuccgucgaggccuucccccagagcaaugcuguaauccaggaugaggagcgggauaucccagagcgcuccuggaacagcggguacgaguggaucacagacuuccccggcaaaaccgugugguucguacccuccaucaagagcggcaacgacauugccaacugcuugcggaagaacgggaagagagugauccaguuaucccggaagaccuucgacacggaguaccagaagaccaaaaacaacgacugggacuacguuguuacaaccgacaucagcgagaugggcgcgaacuuccgcgccgaccgggugaucgacccuagacggugccucaaaccggugauccugaaggacgggcccgagcgcgucauccuggccggccccaugcccguaacggucgccagcgcggcacagcgccgcgggcggaucggccgcaaccacaacaaggagggcgaccaguauaucuacauggggcagccgcucaacaacgacgaggaccacgcgcacuggaccgaggcgaagaugcuguuagacaacauaaacacccccgagggcaucaucccggcccucuuugagcccgaacgggagaaguccgccgcgaucgacggggaguaccgccugaggggcgaggcccggaagaccuucguagagcugaugcgccgcggggaccucccgguguggcugaguuacaaagucgccucggagggcuuccaguacagcgaccgccgguggugcuucgacggcgagaggaacaaucagguucuggaagagaacauggacguugaaaucuggaccaaggagggggagagaaagaagcuccggccccgguggcuagaugcccgcacauacagcgacccccuggcccuccgcgaguucaaggaguucgcggcaggccgucggagcgucagcggggaccugauccuggagauuggcaagcucccccagcaccugacgcaacgcgcucaaaacgcucuggacaaccucgugauguugcacaacagcgagcagggcgggcgugcguaccgacacgccauggaggagcugccggacaccauugagacgcucaugcugcuugccuuaaucgcggucuuaaccggcggggucacccuauucuuccucuccggccgggggcucggaaagaccagcaucggccugcucugcgugauggccuccagcguccugcuguggauggcguccguugagccccacuggaucgccgccucaaucaucuuagaguucuuucugauggugcugcugaucccagagcccgaccgccaacgaacaccccaggacaaucagcucgccuacguggucaucgggcuccuguucaugauccugacgguggccgcuaacgagaugggcuugcuugagaccaccaagaaagaucuggggaucggacacguggccgucgagaaccaucaucacgccgccauguuggacguggacuugcaccccgccuccgcuuggacacuguacgccguggccacgaccaucaucacgcccaugaugcgccauacuaucgagaacacgaccgccaacauuucccugaccgccaucgcaaaccaggccgccauccucauggggcuggacaagggauggccgaucuccaaaauggauaucgguguaccccugcuagcccugggguguuacucacaggugaaccccuuaacgcugaccgcggccguacugaugcuggucgcacacuacgccaucaucgggcccggucuccaggccaaggcgacccgggaggcccagaaaagaacagcugccggcauuaugaagaacccgacgguggacgggaucguggccaucgaccuggaccccgucguguacgacgcgaaguucgagaagcagcugggccagauaaugcuccugauccucugcacgucccagauccuccugaugcgcaccaccugggcucucugugagagcaucacccucgccacgggcccucugaccacccuaugggagggguccccuggcaaguuuuggaacaccacgaucgccgugagcauggccaacaucuuccgugggucguaccucgcgggcgccggccuggccuuuuccuuaaugaagucccucgggggagggcgccgaggcacgggggcccaaggcgagacccugggcgagaaguggaagagacaacugaaccagcucaguaagagcgaguucaacaccuauaaacgguccgggaucauggagguggaccgaagcgaggcgaaggaaggccugaagcgcggggagacgaccaagcacgccgugucccgcggcaccgcaaagcuccggugguucguggagagaaaccucgucaagccggaggggaaagugaucgaccucgguuguggccgcggcggguggagcuacuacugcgcggggcugaagaaggugaccgaggugaaggguuacacaaaggguggccccggccacgaggagcccauucccauggccaccuacgguuggaaccuggugaagcuccacuccggcaaagacguguucuuuaucccgccugagaagugcgacacccuguugugcgacauuggggagagcucccccaaccccaccaucgaggaggggcggacucuccgggucuuaaaaaugguggagccuuggcugcgcgggaaccaguucugcaucaaaauccucaauccguauaugcccagcgugguggagacccuggagcagaugcagcggaagcacggcggcaugcuggugcgcaacccccucucccggaacagcacacacgaaauguacugggugagcugugggacgggcaacauagucagcgcugugaacaugaccucccgcaugcugcugaaccgcuucacgauggcccaucguaagccuaccuacgaaagggacguggaccugggggccggcacccggcacguugccguggagcccgagguggcgaauuuggauaucauaggccaacgaauagagaacaucaagcacgagcacaagagcacuuggcacuacgacgaagacaaccccuacaagacaugggcguaccacgguucauaugaggucaagcccucaggcagugccagcucuauggugaacgggguggugaagcugcucaccaagccgugggacgugauuccuauggucacccagaucgccaugaccgacacgacacccuucggccaacagcgaguguucaaggagaagguggacacccgcacccccaaggccaagcggggcacggcccagaucauggaggucaccgcuaaguggcuguggggcuuccuguccaggaacaagaagccccggaucugcacacgagaggaguucacccggaaggugcggagcaacgccgccaucggcgccguguucgucgacgagaaccaguggaacucagcgaaggaggcaguggaggacgagcgguucugggaccucgugcaccgcgagcgggagcuucacaagcaagggaaaugcgccacaugugucuacaacaugaugggcaagcgggagaagaaguugggggaguucgggaaggccaaggggagcagggccauaugguacauguggcuuggcgcgcguuuccuggaguucgaagccuuaggcuucaugaacgaagaccacugguucucccgggagaacucacucuccgggguggagggcgagggguuacacaaacugggcuacauucugcgcgacaucagcaagaucccaggagggaacauguaugccgacgacacagccggcugggacacccggaucaccgaagacgacuuacagaacgaggccaagaucacggacauuauggagcccgagcacgcgcugcuagccaagucuaucuucaaguugaccuaucaaaacaaggugguccgugugcagcggccggccaagaacgggaccgucauggacgucaucagccgccgcgaucagcggggauccggccaggugggcacuuauggccugaacacauucaccaacauggaggcccagcuaauccgacagauggagagcgaggggaucuucucccccucugagcuggagacaccaaaccuagcccggcgaguacucgacuggcuagagaaacacggcgucgagcguuugaagcgcauggcgaucuccggggacgacugcguggugaaaccgaucgacgaccgguucgccaccgcacucacugcccugaacgauauggggaagguccgcaaggacaucccgcaaugggagccuagcaagggguggaacgauuggcagcagguccccuucugcagucaccacuuccaccagcugauaaugaaagacggccgggagauugugguucccugccggaaccaggacgagcucgugggccgggcccgggugucccagggagcggguugguccuuacgagaaaccgccugccuggggaaauccuacgcccagauguggcagcuaauguauuuccaccgucgggaccugcgcuuagccgcgaacgccaucugcucggccgucccgguggacugggugcccaccucccggaccacguggagcauccacgcccaccaccaguggaugaccaccgaggacaugcucuccgucuggaaccgcguguggaucgaggagaaccccuggauggaggauaagacccauaucagcuccuggggcgauguacccuaccuggggaaacgggaggaccaguggugugguagccugaucggccucacugccagagcgaccugggccaccaacauccaggucgccaucaaccaagugcgccggcugaucgggaacgagaacuaccuggacuacaugaccuccaugaagcgguucaagaacgagucagacccggagggcgcccucugguag

SEQ ID NO: 24302 - RNA, 9879 nt, Artificial Sequence
  derived and/or modified CDS sequence (opt11) from DENV-1__GQ199789__SS-prME
agcgugacuaugcuucuaauguuaaugccuaccgcccuggccuuccaccuaacgacgcgcggcggagaaccccacaugaucgucagcaagcaggaacgcggcaagagccuccuguucaagacaagugccgggguuaauauguguacccucauagcuauggaucuaggggaguucugcgaggacaccaugaccuacaagugcccucggaucaccgaggccgagcccgacgacguggacuguugguguaacgccacugacaccuggguuacauacgggaccugcagccaaaccggcgagcaccggcgcgauaagagaaguguggcccuggcuccccacgugggacucggacuggagacccgcaccgagaccuggaugagcucugaaggggcuuggaagcaaauccagaaggucgagaccugggcccugcggcacccggguuucacggugauagcacucuuccuggcgcacgcgaucggcacaucgauuacccagaaggggauaaucuucauacuacuaaugcuuguuaccccuagcauggcuaugcguugcgucggcaucgguagccgagacuucguggagggccugagcggcgcgacuuggguggacgucgugcucgaacacggauccugcgucacaacuauggcgaaagacaagcccacccuggacaucgaguuguuaaagacagaagucaccaaccccgcggugcuuagaaaacuauguaucgaagccaaaaucuccaauaccacuacggauucucgcugcccgacgcagggcgaggcaacucuagucgaggagcaggacgccaacuucgucugccgacguaccuucguggaucgcggaugggggaacggcugcggauuauucggcaaagggucccugaucacgugugcgaaguucaaaugcguaacaaagcuggagggcaagacuguacagcaugaaaaccucaaguacuccgugaucgucacgguccacacgggagaccaacaucaaguggggaaugaauccaccgagcauggaaccacagcgacgaucacgccacaggcccccagcacagagauccagcuuaccgacuauggcgcccucacacuugacugcagcccccggacgggccucgacuucaacgaaaugguccucuugaccaugaaggaaaaguccuggcugguacacaagcagugguuccucgaccugccccuccccuggaccucuggagccaguaccagccaggaaacguggaaucgcaaggaccucuuggugaccuucaaaacggcucaugcgaaaaagcaggaggucgucgugcuggggucccaggaaggcgccaugcauacagcccucacaggugcaaccgaaauccagacuagcggaaccacaacaaucuuugccggacaccugaagugccggcugaagauggacaagcucacccugaagggcacaagcuaugucauguguacgggcaguuucaagcuggagaaagaggucgcagagacccagcacggcaccgugcucgugcagauaaaauacgaaggcacggacgcccccugcaagauaccguucucgacgcaggacgagaagggugugacccaaaauggacgcuugauaacagccaacccaauagucacggauaaagagaagcccguuaacauugaagccgagccacccuucggggagagcuauaucgucaucggcgcgggcgagaaagcucugaaguuguccugguucaagaaaggguccucaaucggcaaaauguuugaggccacugcccgaggggccagacgcauggcaaucuuaggcgacacugccugggacuucggcagcaucggcgguguguucacguccgucggaaagcuggugcaccagauuuuuggcaccgcguacggggucuuauucagcggagucucauggacgaugaagauuggaaucggcgugcuccuuaccuggcugggccucaacucucgcucaaccagccuuucaaugacguguaucgccgugggucuggucacgcuuuaccugggcgugauggugcaggccgacagcggaugugucauuaauuggaaagggcgcgagcugaagugcgggaguggcaucuucguaaccaacgaaguccacaccuggacugagcaauauaaguuccaggcggacucaccgaagcggcucagcgcagcuaucggcaaggcgugggaggaaggggucugcggcauccgcuccgcgaccaggcucgagaacauuauguggaagcaaaucucuaacgagcugaaucacauacuucuggagaacgauaugaaguucaccgugguuguaggagacgucgcgggcauccuggcacaggggaagaagaugauccgcccccagcccauggaguauaaauacuccuggaaauccuggggaaaggccaagauuaucggcgcggacgugcagaacaccaccuucaucaucgacggccccaacacccccgaaugccccgacgaucagcgcgccuggaacaucugggagguggaggauuacggcuuuggcaucuucacgaccaacauuuggcucaagcugcgcgacucuuauacgcaagugugugaccaccggcugaugucugccgccauuaaggacucuaaagcugugcaugccgauaugggcuauuggaucgagagcgagaagaacgagaccuggaaacuagcuagagccagcuucauugaggucaagacgugcaucuggcccaaaucgcauacccuguggaguaauggcguauuggagagcgagaugauaauuccgaagaucuauggcggcccgaccucgcagcauaacuaccggccuggguauuuuacccagacugccggccccuggcaccucggaaaacuggaacuggacuuugaccucugcgaggggaccaccgucguuguggacgaacacugcggcaauagagguccaucacugcgcaccacgaccguaacaggcaaaaucauccacgaauggugcugccgaucuuguacccugccgccccugagauuuaagggugaagacgguugcugguacggcauggagauucgccccgucaaagagaaagaggaaaaccugguaaagaguauggugucugcaggcuccggcgaggucgacucuuucucacugggguuacugugcaucucaaucaugauagaagaggugaugcgcucccgcuggagccggaagaugcugaugacgggcacccucgcaguauuuuuccugcugaucaugggccagcucaccuggaacgacuugauucgcuugugcaucaugguuggcgcgaacgccuccgaccggauggggaugggcaccacguacuuggccuuaauggccacguucaagaugcgcccgauguucgcagugggguuacuguuccgcagauuaaccagucgagagguccugcuccucacuaucgggcugagccucgucgcguccguagaacugcccaacucgcuggaagaauugggcgaugggcucgccaugggcaucaugauccuuaaauuacugacagauuuccagucccaccaauuaugggccacauugcucucccucaccuucaucaaaacaacuuucagccuccacuaugccuggaaaaccauggcgauggugcuaucuaucgugagccuauuucccuugugucugagcacaacuagccagaagacgaccuggcugccagugcuacuggguucccuggggugcaagccgcucacaauguuccuaaucgcugaaaacaagaucuggggacgcaagagcuggccccugaaugaggggaucauggccgucgguaucgugucuauucuccuuaguagcuuacucaagaacgacgucccccuggccggaccccugaucgccggcgguaugcucauagcgugcuacgucauuagugggagcuccgcagacuugagccucgagaaagcugcagagguguccugggaggaggaggcugagcacagcggcgcgucacacaauauccugguugaaguccaggacgacgggaccaugaagauaaaagaugaggagcgugacgacacccugacgauccugcucaaggccacacuguuagccgugagcggcguguacccgcucagcaucccugcuacacucuucgugugguacuucuggcagaagaaaaagcagcguagcggggugcuuugggacaccccaagcccacccgagguggagcgcgccguccuugacgacggcaucuaccgcaucaugcagcggggccuguuagggaggagccaggugggcgucgggguuuuccaggagaacguguuucauacgauguggcaugugacacgcggcgccguccugauguaccaagguaagcggcuugaaccuuccugggccuccgugaaaaaggaucugauuucauacggcggcggguggcgacugcagggauccuggaacaccggggaggagguucaagucaucgccguagagccugguaaaaaucccaagaauguucaaacagcgccugggacguucaagaccagugagggcgaagucggcgcuaucgcucuugacuuuaaacccgguaccagcgggagcccuaucguaaaucgggagggcaagauagucggcuuauacggcaacgguguuguaacaaccucgggcaccuacgugagcgccauagcccaggccaaggcgucccaagaagggccccugccggagaucgaggaugaggucuuccgcaagcgcaaccucaccaucauggaucugcacccgggcuccggcaagacccgcagguauuuaccggcgaucguucgcgaggccaucaagcggaaacuucgcacuuugauccuggccccaacucgaguggucgcauccgagauggcggaggcucuaaaggggaugccuauccgcuaccaaacgaccgccgugaagggugagcacaccgggaaggagauuguggacuugaugugucacgccaccuucacuaugcgccugcucaguccggugcgggugccuaacuauaacaugaucaucauggacgaggcccauuucaccgacccaucaagcauagcggccagaggcuacaucagcacgcgcguagggaugggcgaggccgccgccauauucaugacagcuaccccuccggggucuguagaggcguucccccaguccaaugcuguuauccaggacgaggaacgcgacaucccggagcggagcuggaacuccggcuacgaguggaucacugacuuucccggaaagacggugugguucguucccagcaucaaauccggcaacgauaucgccaacugccugcguaagaacgggaagcgggugauccaacuaagccgcaagacauucgacaccgaguaucagaagaccaagaacaacgauugggacuacgugguaacgaccgauauuucggagaugggugcgaacuuccgggccgaccgcgugaucgauccacggaggugcuugaaaccagugauccuaaaggaugguccagagcgcgucauacuagcugggccaaugcccgugaccguagcgagcgccgcgcagaggcggggccgcauaggccggaaccacaacaaagagggggaccaguacaucuacaugggacagccuuugaacaaugacgaggaccaugcacacuggaccgaggccaagaugcuguuagacaacauuaacacccccgaggggaucauccccgcccuuuuugagcccgagcgggagaagucugccgcaaucgacggcgaguaucggcugcgcggggaggcgcgcaagaccuuuguggagcugaugcggcgaggcgaccucccaguguggcugucguauaaggucgcuuccgagggauuucaguacuccgaccggcgcuggugcuucgauggcgaacgaaauaaccagguauuagaagaaaacauggacguggagaucuggaccaaggaaggcgagcgcaagaagcuccggccccgcuggcuggacgcccggaccuacucugauccacuagcccuccgcgaguuuaaagaguucgcggcaggucgucgcucugucucaggcgacuuaauccuggagauugguaaguuaccgcagcacuugacacagcgggcacagaaugcccuagauaaccucgugaugcuucacaacuccgagcaaggcgggagagcuuaccggcacgcgauggaggaacuaccggacaccaucgaaacucucauguuacuugcccucauagccguguugacugggggcgucacccuauuuuuccuaucgggcagaggcuugggaaagacgaguauaggacugcuaugcgugauggccagcuccgcccugcuguggauggccucgguggagccacacuggaucgcugccagcaucauccucgaguucuuucuuaugguccuacugaucccagagccugacaggcaacgcaccccacaggauaaucagcuggccuacgugguuaucggccuuuuguuuaugauccuaaccgucgcagccaacgaaauggggcugcuggagacgacgaagaaagaucugggcauaggacacguagccguggagaaccaccaucacgccgcaaugcuggacgucgacuugcacccggcguccgcauggacccucuaugccguggccaccaccauuauaacgcccaugaugcggcauacaaucgagaauacuaccgccaacaucucccuuacugcaaucgcgaaccaagcagccauccugaugggccuggacaagggauggcccauuagcaagauggacauuggagugccccugcucgcgcugggcugcuauucccaaguuaauccgcucacccucacggcagcaguccugaugcugguggcgcacuacgcaauuaucgggcccggcuugcaggcgaaagcuaccagggaggcgcaaaaacgaacggccgcagggaucaugaaaaauccgacagucgacggaaucguagcgaucgaccuggaccccgucgucuacgacgcaaaguucgagaagcagcugggccagaucaugcucuuagugcuguguacgucgcagauccugcuaaugaggacgacgugggcccugugugaguccaucacucuugccacagguccccugaccacccugugggaagguucaccugguaaguucuggaacacaaccaucgccgucucaauggcaaacaucuuccgcgggagcuaccuagccggugcugggcuggccuuuagccugaugaagucccuagguggagggcggcgcgggaccggagcccagggcgagacgcugggcgagaaguggaaaaggcaacugaaccagcuuagcaaguccgaguucaacacuuauaagcgcagcggaaucauggaaguggaucgauccgaggccaaagagggcuuaaagcgcggagagacgacaaaacaugcugugucacgggguacggcuaagcugcggugguucguggagcggaaucuggugaagccggaagguaaggugaucgaccugggcugcggucgcggcgggugguccuacuauugcgccggucugaagaaggugaccgaggucaagggcuacaccaaaggcggcccggggcacgaggaaccgauccccauggcgacuuacggauggaaccucgugaagcuccacuccgggaaggacguguucuucaucccacccgagaaaugcgacacacugcugugcgauauaggcgaguccuccccgaaccccacgaucgaagagggucguacccucaggguccugaagaugguggaaccuugguugcggggcaaucaguucugcaucaagauccuaaaucccuacaugccuuccgugguugagacgcuggagcaaaugcaacgcaagcacggcggcauguuagugcggaauccccucagccgaaacuccacccacgaaauguacugggugagcugcggcaccgggaacauagucucugcuguuaacaugaccagcagaaugcuuuugaaccgcuucaccauggcacaccggaaacccaccuacgagcgcgacguagaccucggggcagggacgcgccacgucgcgguggagcccgaaguugcaaaucuggacauuaucggccagcggaucgagaacaucaaacacgaacacaagaguaccuggcacuacgacgaggacaauccauauaagaccugggccuaucacggcagcuaugagguuaaacccuccggcagcgcauccuccaugguuaacgguguggugaagcugcucacgaagccgugggacgugauccccauggugacgcagaucgccaugacggacaccacuccguucgggcagcagcgcguguucaaggaaaagguugacacgcguacccccaaggcgaaacgcggcaccgcgcagaucauggaggucacugccaaguggcuguggggcuuccuuagccggaauaagaaaccgcgcaucuguacacgggaggaguucacccgcaaagugcggucuaaugcggccaucggagcagucuuuguagacgaaaaucaguggaacagcgcgaaagaagccguggaggacgagcgcuucugggaccucgugcaccgugaaagagaauugcacaagcaggggaaaugcgcgacaugcguguauaauaugauggguaagcgggagaagaagcugggugaguucggcaaagccaagggcuccagggcuaucugguauaugugguugggcgcccgguuccuggaguucgaagcgcugggguucaugaacgaggaucacugguucagccgcgaaaauucccucagugguguggaaggcgaaggguuacauaagcuggguuacauacuccgggacaucucaaagauacccggcgggaacauguaugccgacgauaccgccgggugggacacgcgcaucacggaggacgaccugcaaaacgaagcgaagaucacggacaucauggagccggagcaugcccuguuagccaagagcaucuuuaagcugaccuaccagaauaaggugguaagggugcagcgcccagcgaagaacgguacggucauggacguuaucagucggcgagaucagcgaggcagcggccaggugggcaccuacggucugaacaccuucaccaacauagaagcgcagcucauacggcagauggagucggaagagauuuucagcccuuccgaacuggagacgcccaacuuggcgggacgcguccuugacuggcucgagaagcauggagucgagcgacugaagcgcauggcaaucucaggggacgacugcgucguaaagccuauugacgauagguucgcuaccgcccucacugcccugaacgacauggggaaaguccgcaaagacaucccgcagugggagcccuccaaaggcuggaaugacuggcagcaagugcccuuuugcucacaucacuuucaccagcuuaucaugaaagacggccgugagaucgugguuccuugcagaaaccaagaugaacucguggggcgggcgcgcgugagccaaggcgcgggguggucccugcgggagacugccugcuuaggcaaguccuaugcccagauguggcagcucauguacuuccacaggcgggacuuacgcuuagcggcuaacgcgaucuguuccgcugucccgguggacugggugcccacuagccggacgaccuggagcauccaugcccaucaucaauggaugacuacggaagacaugcucagugucuggaaccgaguuuggaucgaggagaacccguggauggaggacaagacccacaucucgagcuggggcgacgugcccuacuuaggcaaacgagaggaucaguggugcgguucauuaaucgggcucaccgcccgcgcuacgugggcuaccaacauacaaguagccaucaaucagguucggcgccugaucggcaacgagaacuaccuggacuauaugacgagcaugaagcgcuucaaaaacgaguccgacccggagggggcccucugguga

SEQ ID NO: 24303 - RNA, 9879 nt, Artificial Sequence
  derived and/or modified CDS sequence (opt11) from DENV-1__GQ199790__SS-prME
uccguaacaauguugcucaugcugaugccaacugcacucgcauuccacuuaaccacucggggaggagaaccgcacaugaucgugacuaagcaagagcgcggaaagucccuacuguucaagaccagcgcaggagugaauaugugcacacucaucgcgauggaccugggugaacucugcgaggacacgaugacauauaaaugccccaggauaacugaagcagaacccgacgaugucgauuguuggugcaacgcaacagauacguggguaacauauggaacuugcucucaaacuggugagcaccgccgagacaaacgcagcguagccuuagcaccccacgucggacucgggcucgagacacggacagagacguggaugucuagcgaaggcgcguggaagcaaauacagcguguagagaccugggccuuacgucaccccgguuuuacgguuauagcacucuuccucgcacaugugauuggaacaagcaucacccaaaaagguaucaucuucauacuacucaugcucgucacaccauccauggcaaugagaugugucggaaucgguucaagggauuucgucgagggauugagcggagcaacuuggguagacguaguacucgaacacggcucuugcguaaccacaauggcgaaggacaagccaacccucgacauagagcuacuaaaaacugagguaacaaaucccgcagugcuccgcaagcuuugcauagaagcaaaaauaucaaauacgacgacagacagccgcugucccacgcaaggggaagcgacucucauggaggagcaagacgcgaacuucgucugccgacgaaccuuuguagaccggggcuggggaaacggcuguggacuguuuggaaagggaagcuuaauaacuugugcuaaguuuaaaugcgucacgaaacuugaaggaaaaauaguacaauacgaaaaccugaaguauagcgucauaguaaccguccauacuggagaccaacaccaggucggcaacgaaucaacggaacacgggaccacagcgacaaucacgccgcaagcgcccacuagugaaauacaacuaacggacuacggagcccucacacuagacugcagcccccgcaccggacuugacuuuaaugaaaugguucugcugaccaugaaagaaaaaucauggcucguacauaagcaaugguuccucgaccuccccuuaccauggacaucuggcgcaucgacgucacaagagacguggaaucgccaagaccuacuaguaaccuucaagacagcccaugccaaaaaacaggaaguaguaguacuaggaucgcaagaaggcgccaugcacacagcccugacaggagcgaccgagauccaaaccucaggcaccacaacuauuuucgcaggccaccuaaaaugcagacuaaaaauggacaagcuaacacucaaaggcaugucauacgucaugugcacagggaguuucaagcucgagaaagaggucgccgagacacagcauggaaccguucugguccagauaaaauaugaaggaacggacgcgccaugcaaaauaccguuuucuacccaagacgagaaaggcguaacacaaaacgggcgccuaaucaccgcaaauccaauagucacugacaaagaaaagccugugaacaucgaagcugaaccgccauucggugagucuuauaucgugaucggcgcgggagagaaggcucucaagcuaaguugguuuaaaaagggauccucgauaggcaagauguucgaggcgaccgcucgcggcgcaagacgcauggccauccucggagacacugccugggacuucgguagcauagggggaguauucacuagcguggguaaguuggugcaccagaucuucggcaccgcguacgggguauuguucucgggaguaagcuggacaaugaagaucggcauuggcguucucuugaccuggcucggcuugaauagcagauccacaagccucagcaugacgugcaucgcaguggggcuagucacccuauaucugggugugaugguccaagcggacagcggaugcgugaucaauuggaagggacgcgaacuuaaaugcgggagcggcauauuugucaccaacgagguccacaccuggaccgagcaguacaaauuccaagcagacagcccuaaaagacucucagcagcaaucggaaaggcaugggaagaagggguaugcggaauccggucagccacccgcuuagagaacauuauguggaagcagauuagcaaugagcucaaccacauccuacuagaaaacgacaugaaauuuacugugguaguuggagauguagucgguauacucgcucaagguaagaaaaugauuagaccucagccaauggagcauaaguacagcuggaagagcuggggaaaggcaaagauaauuggcgcagacguccaaaacacaacuuucaucaucgacgguccgaacacccccgagugcccggacgaccaaagagccuggaauaucugggaagucgaggacuacggguuugggauauucacgacaaacauuuggcuaaagcugcgugauagccauacacagguaugcgaucacagacuaaugagcgccgccaucaaagacucaaaggcaguacacgcagauaugggauacuggauugaaagugagaaaaacgaaacguggaagcucgcucgcgccucguuuaucgagguuaaaacaugcauauggcccaaaucacauacacuauggucaaaugggguacuggaaagcgaaaugauaaucccaaaaauauacgguggcccaauaagccagcacaacuaccgaccaggguacuuuacgcagacggcgggcccauggcauuugggcaaacuggaacucgacuucgaccugugcgaggggacaaccguagucguggaugaacauuguggaaaccgagguccaagccuucguacaacuaccgugacaggaaaaaucauccaugaauggugcugucggucauguacgcucccaccccucagauucaagggggaagacggcugcugguacggcauggagaucagaccagugaaggagaaagaagagaaccuaguaaaaagcauggucagcgcugggagcggcgaagucgacuccuucucacucggguugcuguguaucucaaucaugauagaagaagugaugagaagucgcuggucccgcaagaugcucaugaccggaaccuuagcaguguuccuacuauuaaucaugggccaacucacauggaacgaccuaauccgccugugcauaaugguuggggccaacgcgagugacaggaugggaaugggaacaacguaccucgcgcugauggcuacauucaaaaugcgacccauguuugcggucggccuccuauuccgccgccucaccuccagagagguccuauuguuaaccaucggucucagccuggucgccaguguggaacuaccuaacucuuuagaagaacugggcgacggccuagccaugggcauaaugauacucaaacuccuuacggacuuccaaagccaucaacucugggccacacuacucagccuuaccuucauuaagacgacgcugucccuucacuaugcguggaagacuauggcaaugguucuaucuauagucucacuuuucccgcucugcuuaucaaccaccucacagaaaacgacguggcugccggugcuccucggcaguuugggcugcaaacccuuagcaauguuucugauagcagagaauaagauuuggggccgcaaaaguuggccccugaacgaagggauuauggcagugggcgucgugucgaucuuacugagcagccuccucaagaacgacgugccccuagcgggcccccuaauagccggcggaaugcuaaucgcuugcuacgucauaaguggaagcagcgccgaccucucccucgagaaggcugcggaaguaucaugggaagaggaggcugagcauucaggcgcgagucacaauauauuaguagagguccaagaugacgggaccaugaaaaucaaagacgaagagagggacgacacacuuaccauacugcugaaagcaacccuguuagcagugucaggcguauacccacuaagcaucccagcaaccuuguuugucugguauuucuggcagaagaaaaagcaaagaucggggguacuaugggacacgccgucuccuccugaaguagaacgggcgguucuugacgacggcaucuaccggaucaugcagcggggucugcugggaaggagucaagucggcguaggcguauuucaggagaauguuuuucacacgauguggcauguaacgaggggagcaguuuuaauguaucaagggaaacggcuagagcccucaugggcuuccguuaagaaagaucugaucagcuacggagggggcuggagacugcaaggcaguuggaacacaggugaagaagugcagguaaucgcaguugaaccaggaaagaacccgaaaaacguacaaacagccccuggcaccuucaaaacaccugaaggggaaguaggagcgauugcgcuugacuucaagccagguacgaguggaucaccaaucgucaaccgcgaaggaaagauugucggacucuacggcaacggaguuguaacaaccagcggaacguacguguccgcuauugcccaggcuaaagccagucaggaaggcccauuaccggaaaucgaggacgaaguguucaggaagcgaaacuuaacaauaauggaccuccaucccgguagcgggaagacgcgaagguaucugccagccaucgugcgagaggcgaucaaacgaaagcuaaggacguugauacuagcccccacaaggguaguugccucggaaauggccgaagcacuuaaagguaugccuauacgauaccaaaccacagcaguuaaaagcgagcauaccggaaaggaaauaguggaccuuaugugccacgcaacauucacgaugagacucuuaagcccgguaagaguucccaacuacaacaugaucauaauggacgaagcccacuuuacggacccaagcuccaucgccgcacgcggguacauaaguaccagaguaggaaugggcgaggccgcagccaucuucaugacggcaacacccccaggcagugucgaggccuuuccccagagcaacgcggucauacaggacgaagaaagagacaucccggaaaggucauggaacagcggguaugaguggauaacagacuuuccuggaaaaacggucugguucgugccgucuauaaagucuggaaaugacauagcuaacugccuaaggaaaaauggcaagcgcguaauacaacugagcagaaaaaccuucgauaccgaauaccagaaaacuaaaaacaaugacugggacuacguaguaaccacggacauuucagaaaugggggccaacuucagggcugaccgcgucaucgacccaagacggugccugaaaccagugauacucaaggacgggcccgaaagagucaucuuagcugguccaaugccagucaccguggcgagcgccgcccagagacgcggccgaaucgggcguaaccacaacaaggaaggagaccaauacaucuacaugggacaaccacucaacaacgacgaggaccacgcacacuggacagaggcaaaaaugcugcuagacaacauaaacacgccagaaggaauuauaccggcauuauucgagcccgaacgagaaaaaagcgcugcaauagacggagaauaccgccuaaggggcgaggccagaaaaacauucguagaacucaugcgccgaggggaccuuccggucuggcucuccuacaaaguagcaagcgaaggguuucaguacuccgaccgaagauggugcuucgacggugaaagaaacaaucaaguacucgaagaaaacauggacguagaaaucuggacaaaggagggggagcgcaagaaacuucgaccccgguggcucgacgcucggacuuacagcgacccccuggcgcuacgggaauuuaaagaguucgcagcaggccggaggucgguaucaggagauuuaauauuggaaaucgggaaacucccgcagcacuuaacccagagagcacagaacgcacuagauaacuuagugaugcugcacaacucugagcaggggggacgugccuaucgacaugccauggaggagcuaccagauacuaucgaaacauuaaugcugcucgcccucaucgcgguacuaaccggaggaguaacauuguuuuuccuaucgggaagaggccuggguaaaacuucuauugggcuacuuugugucauggcgucguccguccuucuauggauggcgaguguagaaccacauuggauagcagccagcauuauccuggaauucuucuuaaugguccuacugaucccggagccugaccgccaacgcacaccacaagauaaucaauuggcauauguagugauaggccuuuuauucaugauucuaacagucgcggcgaacgagaugggacuccuagaaacgacaaaaaaggacuuaggcauaggacaugucgcaguagagaaucaccaccacgccaccauguuggacgucgaucuccaccccgcgagcgcuuggacccucuaugccguagcaacaaccauuaucacccccaugaugcgacacacgaucgaaaauacgacugccaacaucucacucaccgcaauugccaaucaagcagcgauccugaugggacuugacaaaggguggccgaucuccaaaauggacauuggugucccccuucucgcacuaggcugcuacagccaagugaacccacugacacuaacggcggcgguccugaugcucguagcacacuaugcgauaaucgggcccggauugcaggcgaaagccacgagggaagcacagaaacguacagcagccgggaucaugaaaaacccaacggucgauggaauugucgccauagacuuggaucccgucguauacgaugcgaaauucgaaaaacaacucgggcagaucaugcuacuaauacuauguacaucgcaaauucugcuaaugcgaacaacgugggcuuugugugaauccaucacacuugcgaccggaccgcucacaacacugugggaaggaagccccgguaaguucuggaacaccaccauagcaguguccauggcaaacauauuccgcggauccuaccucgccggagccgggcucgccuucucacucaugaaaucccugggcggaggaagaagaggcaccggagcccagggagagacucuaggggaaaaauggaagcgucaacuaaaccagcuaaguaaguccgaauuuaauauuuacaaaagaagugguaucauggaagucgacaggagcgaagccaaagaagggcuuaaacggggagaaaccacaaggcaugccgucagccgaggaaccgcgaaacuucgaugguucguugaaaggaaccuagucaaaccagagggaaagguaaucgacuuaggaugcggacgaggcggcuggaguuacuauugcgcggggcucaagaaagugaccgaagucaaaggcuacaccaaggggggucccggccacgaagagccuauaccgauggccacguacggcuggaaccuggugaaacuccacagcggcaaagacgucuuuuucacaccaccggaaaaaugcgacacgcuacuaugcgacauaggagaauccucgcccaacccgacaaucgaagagggcagaacccuuagaguccucaaaaugguagaaccgugguuacgcggaaaccaauucugcaucaaaauccucaacccauauaugcccaguguggucgagacgcuagaacaaaugcaacguaagcacggcgggaugcucgucagaaauccgcucagucgaaauuccacccaugaaauguauugggucucgugcgggacaggaaauauaguauccgcagugaacaugacaagcaggaugcuacugaaccgguucacaauggcccacagaaagccgaccuaugaacgcgacgucgaucuaggagcggggacccgccaugucgcagucgagccagaaguggcaaaucuagacaucaucggccaacgaaucgagaauaucaaacacgaacauaagagcaccuggcacuaugacgaagacaaccccuauaagaccugggccuaccauggcucguacgaggugaaacccagcgguagcgcuagcuccauggucaauggaguugucaaauuguugacaaaaccgugggacguaauaccgaugguaacccaaaucgccaugacagacacaacgcccuucgggcagcaacgggucuucaaagaaaaaguagacacgagaacaccaaaggccaagagaggcacggcacaaauaauggaggucacagcaagguggcucuggggcuuccuuagcagaaauaaaaagccccgcauauguacgagagaggaauucacgagaaaagugcgcagcaacgcagcuaucggggccgucuuugucgacgagaaccaguggaacucagcaaaagaggcagucgaggaugagcgguucugggaccuagugcaaaaggagcgugaguuacacaaacaggguaagugcgcgacuugcguauacaacaugaugggcaaacgcgagaaaaaacucggggaguucgguaaggccaaaggcucacgggccauaugguacaugugguugggcgcgagguuccuagaauucgaagcgcugggcuucaugaacgaagaucacugguucucccgggaaaauagccuaagcggaguagagggugagggacuccacaagcuaggauacauccucagagacauuucgaagaucccggggggaaacauguaugcagacgauacagcgggaugggauacgcgaaucacagaggacgaccugcaaaacgaagcacgaaucacagacauaauggaaccagaacacgcacuucuagcaacuaguauauucaaacugaccuaccagaacaagguagugagaguacagcggccagcgaagaacggaaccgucauggacgucauuucgaggcgggaucaacgggguagcggacagguaggaacauauggucugaacacguuuaccaacauggaggcgcaacuaauacgccagauggaguccgaaggaauauuccuacccucggaacuugaaacucaaaacuuggccgaacgugucuuagacuggcuagagaaauacggaguagaacgccucaaacgaauggcgaucagcggagacgauugugucgucaaaccuaucgaugaccgauucgcaaccgcacuuaccgcgcucaaugacaugggaaaaguaaggaaagacauaccucagugggaacccagcaagggguggaacgacuggcagcaggucccguucugcucgcaucauuuccaccagcuaaucaugaaggacggccgagaaauuguagugccgugcagaaaccaagacgagcucguugguagagcaagagucucucagggcgcaggcuggagucuccgagaaaccgcuugccuagguaaauccuacgcccagauguggcagcucauguacuuccaccggcgcgaccugcgacucgcagcgaacgcaauuuguuccgcgguccccguagacuggguccccaccagcagaacgaccuggaguauacaugcucaccaccaauggaugacgacagaagauauguugucgguauggaaccgagucuggauagaagagaacccauggauggaggacaaaacucacguaucuucauggggggacgugccguaccuaggcaagagggaagaucaguggugcggcucccuaaucggccucacggcacgcgcgaccugggccucaaacauccaggucgcgauaaaccaagugcgacgacuaauaggaaacgagaacuaccucgauuacaugaccagcaugaagcgauucaagaaugaaggggaucccgaaggagcccugugguga

SEQ ID NO: 24304 - RNA, 9879 nt, Artificial Sequence
  derived and/or modified CDS sequence (opt11) from DENV-1__GQ199791__SS-prME
agcgugacgaugcucuuaaugcugaugcccacggcgcuggccuuccaccuaacaacccgggggggggagccccacaugaucgugaccaagcaagagcggggcaagagccugcuuuuuaaaacgagcgcgggggugaacaugugcacccucauagcaauggaucugggcgagcugugugaagacaccaugaccuacaaguguccccguauaacggaggccgagcccgacgacguggacuguugguguaacgccaccgacaccugggucaccuacgggacuugcagccagacuggcgagcaucggcgugacaagcggucggucgcccuugcgccccaugugggacucggguuggagaccaggaccgagacauggauguccagcgaaggcgccuggaagcagauccaacgcgucgagacgugggcccuccggcaccccggguucaccgugaucgcccuguuccuggcgcacgcuauaggcaccuccaucacacagaaggggauaaucuucaucuugcuaaugcucgugacgcccagcauggcuaugagaugcgucggcauuggcucacgcgacuuugucgagggguuaucaggcgccacuuggguagacguagugcuggagcacggauccugcgucaccacuauggcaaaggacaagcccacgcuggacaucgagcuccugaaaaccgaggucacaaaccccgcggugcugcggaaacucugcauagaagccaagaucagcaacaccacgaccgauagcaggugucccacccagggcgaggcuacccugauggaagagcaggacgccaacuuugugugccgacgcacguucguagaucgggggugggggaacggcugcggguuauucggaaagggcagccugaucacgugugccaaguucaagugcgugaccaagcuggaaggcaagauagugcaguacgaaaaccuuaaauacuccgucaucgucacggugcacacuggagaccagcaccaagugggcaacgaaucaaccgagcacggcaccaccgcgacgaucaccccucaggccccaaccuccgaaauccagcuuacggacuauggggcccuuaccuuggacugcagcccaagaacgggccuggacuucaacgagauggugcuacugacuaugaaggagaagucuugguugguacacaagcagugguuccuugaucuuccgcucccguggaccagcggggccucaaccucccaggagacguggaaucggcaagaccugcuggugacuuucaagaccgcccacgcgaagaaacaggagguggucgugcuuggaagccaagagggugcaaugcacaccgcccugacgggggccacugagauccaaaccuccggcaccacuacaaucuuugcgggucaucugaagugccgccucaagauggacaaacugacccugaagggaaugagcuacgugaugugcaccggguccuucaagcucgagaaggaggucgcggaaacgcagcaugguaccgugcugguccagauuaaguacgaaggcaccgacgcccccugcaagauccccuuucugacccaggacgagaagggggugacgcagaacggacggcugaucaccgcuaaccccaucguaaccgauaaggagaaacccgugaacaucgaagccgagccgcccuucggggaaagcuacauugucauaggcgcaggcgagaaggccuugaagcuguccugguuuaagaaggggagcuccaucggaaagauguucgaggccacggccaggggggcacggcgcauggccaucuuaggggacacggcuugggauuucggcagcaucgggggcguuuucacaucgguggggaagcucguccaucagauuuucgguaccgccuacggcgugcuguucagcggcgugaguuggaccaugaagaucgggaucgguguccugcucacguggcugggucugaacagccgguccaccagccucucgaugacauguaucgccgucgggcuggugacccuguaucucgguguuauggugcaagccgauagcgggugcgugaucaacuggaagggacgggagcugaaaugcggguccggcaucuuuguuacgaacgagguacacacuuggaccgagcaguacaaguuccaagccgacucaccgaagcgacugagcgccgccaucggcaaggccugggaggaggguguuugcggcauccggucugccacccgccucgagaacauaauguggaaacagauuuccaacgaacugaaccacauccugcucgagaacgacaugaaguucacagucguugugggcgacgucgugggcauccuggcucaggguaagaagaugauucguccccaaccuauggagcauaaguacuccuggaaguccuggggcaaagcaaagauuaucggugcggacguacagaauacgaccuuuaucaucgacgggcccaauaccccggaguguccagacgaucagcgcgcuuggaacaucugggaggucgaggacuacggcuucgggauauuuaccacaaacauuuggcugaagcuccgggacuccuacacccaggugugcgaucacagauugaugucggcggccaucaaggacucuaaggccguucacgcagauaugggcuacuggaucgagagcgagaaaaacgaaacauggaagcuggcccgggcuuccuucauugaggugaagacguguaucuggccuaaaagccacacgcucugguccaauggcgugcuggagagcgagaugaucauuccuaagauauacgguggccccauuucccagcauaacuacaggcccggguacuucacccaaaccgccggccccuggcaccuggggaaacucgagcuugacuuugaccugugcgaaggcacuacgguggucgucgacgagcauugcggcaaucgggggcccucucuccgcacuacaacgguuacggggaagaucauccaugaguggugcugucggagcugcacccugccgccccuucgcuuuaaaggggaggacggcugcugguacgguauggagauacggcccgucaaagagaaggaggagaauuuggucaagucgaugguguccgccggcaguggcgagguggacuccuucucccuggggcuucucugcauuagcaucaugaucgaggaggugaugcgaagccgguggucucgcaaaaugcugaugaccgggacccuugcaguauucuugcugcugauuauggggcagcucacguggaacgacuugauaagguuaugcauuauggucggcgccaaugcuucggaccgcaugggaaugggcaccacuuaccucgcguugauggccaccuuuaagaugaggccgauguucgccgugggacugcucuucagaaggcugaccagcagagaggugcuguuacucaccauuggguuaucuuuagucgccagcgucgaacuacccaacucccuggaggagcucggcgacgggcuggcuaugggcauaaugauucugaaacuccuuaccgacuuucagagccaccaacugugggccacccuccugagccugacguuuaucaagaccacccuuagccugcacuacgcuuggaaaacaauggccaugguacugucgaucgugagccuauucccacucugccuguccacgacuagccagaagacuacauggcuuccagugcugcuggguucgcugggguguaagccgcugacgauguuccugaucgccgagaacaagaucuggggccgcaagagcuggccgcugaacgaggggauuauggcggucggcguggugucaauccuucugaguagucuguugaagaacgacgucccccuggccgggccccucaucgcaggcggcaugcugaucgccuguuacgugaucuccgggucuagugcagaucugagccucgagaaagccgcugaggugaguugggaggaggaggcggagcauagcggugccucucauaauauccuggucgaggugcaggacgacgggacuaugaagaucaaggaugaggagcgggacgacacacugacaauccuccuuaaggcaacccucuuggcaguuaguggcgucuacccucugagcauccccgccacuuuguucgugugguauuucuggcagaagaaaaagcagagaucaggagugcuaugggacacuccaucgccgcccgagguugagagggccgugcucgacgauggaauuuaccgcaucaugcagcggggccugcuggggcgcucccaagugggcgugggaguguuccaggagaauguuuuucacacgauguggcauguaacaaggggcgccgugcugauguaucagggaaagagacuggagcccucaugggcgagcgugaagaaggaccuaauauccuacggcggcggauggcggcuucaggggagcuggaauacgggggaggagguucaggugauugccguggagcccggcaagaaccccaaaaacguccagacggcgcccgggaccuucaagaccccggagggcgaggucggcgccauugcacucgacuuuaagcccgggaccucaggcucucccaucguaaaccgcgaggggaaaaucgucggcuuguacggcaacgguguugugaccacuuccgguaccuacguuagcgcuauugcccaggcuaaggcuagccaggagggaccgcugcccgaaaucgaggacgagguguucagaaagcgcaaucugacgaucauggaccugcacccuggcuccggcaaaacuagacgauaucuacccgcgaucgugcgugaagccaucaaacgcaagcugcggacccugauccuugcccccacccgcguugucgcaagcgagauggccgaggcgcugaaaggcaugccuauccgauaccagacgaccgcugucaagucugaacacaccggcaaagaaaucgucgaccugaugugccaugccacuuuuacgaugcggcuauuaagccccgugcgcgugccuaauuacaacaugauuauaauggacgaggcccacuucacggaccccuccagcaucgccgcgcggggguacauuuccacucgcgucgguaugggggaggccgccgccaucuucaugacugccaccccgcccgggagcguggaggcguucccccaguccaacgccgugauccaggaugaggaacgggauauucccgagcgcucguggaacucggguuacgaguggaucaccgacuuccccgguaagaccguaugguucgugcccagcaucaagucaggcaacgauaucgccaacugcuugcggaagaacgggaagagggugauacagcucagccggaagaccuucgacacagaguaccagaagaccaagaacaaugacugggacuacgucgugaccaccgacauauccgaaaugggcgccaacuuuagagccgaccgggucaucgacccccgcagaugccugaagcccgucauccugaaggacggccccgagcgugucauucucgccggccccaugccugucacggucgccagcgcggcccagcgacggggucggauuggccgcaaccacaacaaggaaggugaccaguacaucuacaugggucagccucugaacaacgaugaggaccacgcgcacuggacagaggccaagaugcuucucgacaacaucaacacccccgaggguaucauccccgcccucuucgagccggagcgggaaaaaucugccgccaucgacggugaguaccgcuuacgcggcgaggcucggaaaaccuucguggagcucaugcgccggggggaccugcccgucuggcugucguauaagguugccucugagggcuuccaguacagcgacaggcguuggugcuucgauggcgagcguaacaaccagguccucgaggagaacauggacgucgaaaucuggacaaaggagggcgagagaaagaagcuacgcccccguuggcuggacgcgaggacuuacagcgauccucuagccuuacgugaguuuaaagaguucgccgcaggcaggagauccguuagcggcgaccugauccucgaaauaggcaagcugccgcagcaucugacccagcgcgcucagaaugcccuugacaaucuggugaugcugcacaacucugagcagggcgggcgcgccuaccgccacgcgauggaggagcucccggacaccaucgagacgcuaauguugcucgcccuuauugcaguccugacaggaggggugacccuuuucuuccuuagcggccggggacugggcaagaccuccaucggcgugcucugcgucauggcaaguuccguucugcuguggauggccagcguagagccccacuggaucgcggcaucgaucauccucgaguucuuccugauggugcugcucauccccgaaccagauaggcaaagaacuccccaggauaaucagcuggcauacguggugauaggacuccuguucaugauccugacggucgccgccaaugagaugggccugcucgagacuaccaagaaggacuuagggaucggccauguggcgguggaaaaucaucaccacgccaccaugcuggacgucgaccuccaccccgccagcgccuggacguuauacgccguggcgaccacgauaaucacccccaugaugcgccacacgaucgagaacaccaccgccaacaucucccuaaccgccauugccaaucaagccgcaaucuuaauggggcuggacaagggcuggccaaucagcaagauggacaucggcgugccccugcucgcccucgggugcuauucccagguuaacccacugacccucaccgccgccguacucauguuagucgcgcacuacgccaucauaggacccgggcuccaggccaaggcuacuagagaggcucagaagcgcaccgcggccggcaucaugaaaaaccccacaguggacgggaucguggcuaucgaccuggaccccgugguauacgaugcaaaguucgagaagcagcugggccagauuaugcuccugauuuuauguacaucacagauccucuuaaugagaaccaccugggcccugugcgaguccauaacgcucgcgacaggcccccugacaacccugugggaggguagcccgggcaaauuuuggaacacgaccaucgccguaaguauggccaacaucuuuagagguagcuauuuagcuggugcuggccuggcguuuucgcugaugaagagccucggcggcgggcgccggggcaccggggcccagggagagacucugggcgagaaguggaagcgccaacugaaccagcucagcaagagcgaguucaacaucuacaagcggagcgggaucauggaaguggauagguccgaggcaaaggagggccuaaagcggggggaaacuacccgccacgcggucucccggggaacugcgaagcugcgcugguucguggagagaaaccuggugaagcccgaggggaagguuaucgaccuuggcugcggacgcggaggcuggucuuauuacugcgcugggcugaagaagguuacugaggugaagggcuacaccaagggcgggccuggucaugaggaacccaucccgauggccaccuauggguggaaccuggucaagcuccacucagguaaggacguguucuuuacuccgcccgagaaaugugacaccuugcucugcgacaucggcgaguccagcccaaauccuacgaucgaggagggcagaacccuccgcgugcucaagauggucgagcccuggcugcgggggaaccaguuuugcaucaagauucuuaacccauacaugcccuccguggucgagaccuuagagcagaugcagagaaaacacggcggaauguuaguccgcaacccgcucagccgcaacuccacccacgaaauguauugggugagcugcgggaccgggaacaucguuucagccgugaacaugaccagccgaaugcuguuaaaucgcuucacuauggcgcaucgcaaaccaaccuaugagcgggacguggaccucggggcuggcacgcgccacguggccgucgagcccgaggucgccaaucuggacaucaucggacaacgaauugagaacaucaagcacgaacacaaauccacauggcauuacgacgaggacaaccccuacaagacuugggcuuaccacgggagcuacgaggucaaaccguccgggucggccucuagcauggugaacgggguagucaagcuguugaccaagcccugggacgugauucccaugguaacccagauagcuaugacagacaccacccccuuuggacagcagcgcguguuuaaggagaagguggauacgcggacaccgaaggccaagcgcggcaccgcccagaucauggaggucaccgcccgcuggcuguggggguuccuuucucgcaacaagaagccucggaucugcacccgcgaggaguucacucggaaggugcgcuccaacgcugcuaucggggccguguucguggacgagaaccaguggaacagcgccaaggaggcaguggaggacgagcgguucugggaccucgugcagaaggaacgggagcugcacaagcaagggaagugcgcgaccugcgucuacaacaugaugggaaagcgugaaaagaagcuaggggaguucggaaaggccaaggggucgcgcgcgaucugguacaugugguuaggagcccguuuccuggaguucgaggcgcucggauucaugaacgaagaccacugguucagccgugagaauucccucucgggggucgaaggcgagggucuccacaagcugggauacauccuccgggacauauccaaaauaccugguggcaauauguacgcggacgacaccgcaggcugggacacccgcaucacggaggaugaucuccagaacgaggccaagaucacugacaucauggaaccggaacaugcucugcucgccaccagcaucuuuaagcugaccuaccagaacaaggugguacggguucagcgccccgcgaagaacgguacugugauggacgugauaagccgccgggaucagcgcggcagcgggcagguugggaccuacggacugaacaccuuuaccaauauggaggcacagcuaauccggcaaauggagagcgaggguauauuccugcccagcgagcuggagacgcccaaccucgcggagcgcgugcuggacuggcuggagaaauacgggguggagcggcucaagcgcauggccauauccggugacgacugcguggugaagccgaucgacgaccgguucgccacugcccugaccgcccugaaugacaugggcaaggugcgcaaggauauaccccagugggagcccagcaagggcuggaacgacuggcagcagguacccuucugcucccaccauuuccaucaguugaucaugaaggacggccgggagaucgucgugccaugccgcaaucaggaugagcuggucgggcgggcuagagugagucagggagcuggcuggucccugcgggagaccgcgugucucggcaagaguuacgcccagauguggcagcugauguacuuccacagacgggaccugcgccucgccgcgaacgccaucugcagcgcggugcccgucgacugggugcccacgagcagaacuaccuggucgauacacgcccaccaccaguggaugacgacggaagauauguuguccguguggaauaggguguggaucgaagagaaucccuggauggaggacaagacacacgucaguaguuggggugacgugccauaccucggcaagcgggaggaccaguggugcggcagccucaucggcuugacugccagggccacgugggccagcaauauucaggucgcgauaaaccaagugcgccggcugauagggaacgagaauuaucucgacuacaugaccagcaugaagcgcuucaagaacgagggugaccccgagggggcuuucugguga

SEQ ID NO: 24305 - RNA, 9879 nt, Artificial Sequence
  derived and/or modified CDS sequence (opt11) from DENV-1__GQ199792__SS-prME
agcgugaccaugcugcucaugcugaugcccacagcccuggccuuccaccucaccaccaggggaggggagccccacaugaucgugucgaagcaggagcgggggaagucgcugcuguucaagaccuccgccgggguuaauaugugcacccucauagcaauggacuuaggcgagcugugcgaagauaccaugaccuacaagugcccccgcaucaccgaggccgaacccgacgacguggacuguuggugcaacgccaccgacgcauggguuaccuacgguacgugcagccagacuggagagcaccggcgggauaagcguucgguggcccucgcgccccacguggggcuggggcuggagaccagaaccgagacguggauguccuccgagggcgccuggaagcaaauccaacgggucgaaacgugggcccugcgccacccaggguucaccgugaucgcgcuuuuccuggcccacgcgaucgguacgagcaucacccagaaggggaucaucuuuauacuccugaugcuugugacaccguccauggccaugcggugcgucggcaucggaucacgcgacuucguggaggggcucuccggcgcaaccuggguagacgucgugcuggagcacgggagcugcgugacgacuauggcgaaggacaagcccacccuggacaucgaacuacuuaagaccgaagucacgaaccccgcagugcugcggaagcucugcaucgaggccaagauuuccaacaccaccacggauucacggugcccgacgcagggcgaggccacacugguggaggaacaggacgcuaacuucgucugccggcgcaccuuuguggaucgcggcugggggaacggcuguggccuguucggcaaggggagucucauaacgugcgcgaaguucaagugcguuacgaaacuugagggcaagaucguccaguaugagaaccuuaaguacagcgugaucgugaccguccacacgggcgaccagcaccagguggggaacgaauccaccgagcacgguacgacugcuaccaucacgccccaggcccccaccacggagauccagcucacggacuauggcgccuuaaccuuagacugcucgccccggaccggccucgacuucaacgaaaugguccugcucacgaugaaggagaaguccuggcucguucauaagcagugguuccuggaccugccacucccguggaccagcggggcaucgaccucccaggaaaccuggaaccgacaggaccugcuggugacuuucaaaacugcgcacgccaaaaagcaggaggucgugguucugggcagucaggagggcgccaugcacaccgcccugaccggggcgacggagauucagaccuccggaaccacuaccaucuucgcggggcaccucaagugucgccucaagauggacaaauuaacccugaaggggaugagcuaugucaugugcacgggguccuucaaacucgagaaggagguggccgagacccagcacggaacgguucuuguacaaaucaaguacgagggcaccgacgcccccugcaagauccccuucagcacccaggacgaaaagggggugacccagaacgggcggcuaaucacggcgaaccccaucgugaccgacaaggaaaagccagucaauauagaggcggaaccgccguuuggcgagucuuacauugugaucggggcaggggagaaagcccugaaauuaagcugguucaagaagggguccagcauuggcaaaauguucgaggccaccgcuagaggggcgcggcgcauggccauccugggagauaccgccugggauuucggguccaucggcggcguguucacgagcgucggcaaacucgugcaccagaucuucggcaccgccuacgggguccucuucuccggcgucagcuggacgaugaaaauugguaucggcgugcuacugacauggcuuggucugaacuccagaaguacgucccugucuaugaccugcauagccguggggcucgugaccuuguaucugggcgucauggugcaggcagacuccggcugcguaaucaacuggaagggccgggagcugaagugcgggagcggcaucuucgugaccaacgaagugcacacguggaccgagcaguacaaguuccaggccgacagcccgaaacgacucuccgccgcuaucggcaaggccugggaagagggggucugcggcauccggagcgcgacccgccuggagaacaucauguggaagcagaucaguaacgaacuuaaccacaucuuacuggaaaacgacaugaagcucaccguaguggucggggacguggccggcauccuggggcagggcaagaagaugauccggccucagcccauggaguacaaguacuccuggaagucauggggcaaggccaagaucauuggggccgacgcgcaaaacaccacguucaucaucgacggccccaacaccccggagugccccgacgaucagcgcgccuggaacaucugggagguggaagacuacggguucggcaucuucaccaccaacaucuggcucaagcuccgggacagcuacacgcaggucugcgaccaccgccugauguccgccgcaaucaaggacagcaaggcggugcacgccgacaugggcuacuggaucgagucagagaagaacgagaccuggaagcuggcgcgggccuccuucaucgaggugaagaccugcaucuggcccaagucccacacccucuggucgaacgggguccuggaguccgagaugaucauuccgaagaucuacggagggcccauaagucagcauaacuaccgucccggcuacuuuacgcagaccgcggggcccuggcaccugggcaagcucgagcuggacuucgaucugugugaggguaccaccgugguggucgacgagcacugugggaaccggggcccgucacugcgcacaaccacggugaccgggaagaucauccacgaguggugcugccggagcugcacucugccgccccugcgcuuccggggcgaagauggguguugguacggaauggagauccggcccgugaaagagaaagaagagaaccucgucaaguccauggugagcgccggcaguggcgagguugacagcuucucuuugggccugcuuugcaucuccaucaugaucgaggagguaaugcguagucgcugguccagaaagaugcugaugacggggacccucgcgguauuuuuccuccucaucaugggccagcugaccuggaaugaccucauacgccugugcaucaugguaggggcaaacgccagcgaccgcauggguaugggcacgacguaccuugcccucauggccacauuuaagaugcggccgauguucgcgguuggguuauuauuccgccggcucaccucccgggaagucuuacuguugacgaucggccugucuuuaguggccuccgucgaacucccaaacagccuggaggagcugggggacggccuugcgaugggcaucaugauucuuaaacugcugaccgacuuccagucccaccaacuuugggcaacccugcucagccucaccuucaucaagacgaccuuuagucugcacuacgcguggaagaccauggccaugguguuaucaauugucucccuguucccccugugccucagcacgacgucccagaagaccaccuggcugccuguucugcucgggucccugggcuguaagccgcuuaccauguuucuuaucgccgagaacaagauauggggacggaaauccuggccacugaacgagggcauuauggccguggggaucgucaguauucugcucagcuccuuauugaagaaugaugugccccuagccggcccccugaucgcgggcgggauguuaaucgccugcuauguuauaagcggcuccagugcugaccuaagccuggagaaggccgcggaggucagcugggaggaggaagcugagcacuccggggccagccauaacauauuaguggaggugcaggacgacggcacgaugaagaucaaggaugaggaacgcgacgacacccucaccauacuacugaaagcaacccugcuggccguaucugguguauauccgcugaguauccccgcuacccucuuuguaugguacuuuuggcagaagaagaagcagcggagcggcguacugugggauacgccgagcccgcccgagguggagcgcgcggugcuggacgacgguauuuaucggaucaugcaacgcggccuuuuaggcaggucccaaguaggggugggcguguuccaggagaacgucuuccacaccauguggcacgugacucgcggggccguacugauguaccagggcaagcggcuagagcccucgugggcauccgucaagaaagauuuaaucagcuacgguggaggguggcgccugcguggaucuuggaacaugggcgaggaaguccaaguaaucgccgucgagcccgggaagaaccccaagaacgugcagaccgcucccgguacguuuaagaccccagaaggagagguuggcgcgaucgcccuagacuucaagcccgggacgagugggucgcccaucgucaaccgcgaaggcaagauagugggccucuacgggaacggcguggucacgacuagcgggaccuacgugagcgccauugcccaggcuaaggccucccaggaaggcccgcugcccgagaucgaagacgagguguuccgaaagagaaaccucacuaucauggaucuccaucccgggucgggcaagacccgacgcuaccuaccggcgaucgugagagaggcgaucaaacgcaaguuacggacucucauccuggcccccacccgggugguggcgagugagauggcggaagcacuuaaggguaugccgaucagauaccagaccaccgccgucaaguccgaacauacggggaaggagauugucgaccuuaugugccacgcuaccuucacaaugcggcuguuaagucccgugcgcgucccgaacuacaacaugaucauuauggacgaggcgcacuucaccgaccccagcuccauugccgccagaggguacauuagcacucgcguggggaugggcgaggccgcugcgaucuucaugaccgccacaccgcccggcuccguggaggccuucccgcagagcaaugcuguuauucaggaugaggagcgggacauccccgagcgcucuuggaacagcggcuacgaguggaucaccgacuuccccgggaaaacggugugguucgugcccuccaucaagagcgggaaugacaucgcgaauugucuccgcaagaacggcaagcggguuauccagcuguccaggaagaccuucgacacggaguaccaaaagaccaagaauaacgacugggacuacguggugacuacagauaucagcgaaaugggggcuaacuuccgcgcggauagggucaucgacccccgccggugccugaagcccgugauccucaaggacggccccgagcgugugaucuuggccggacccaugccggucaccguggccuccgcagcacagcggcguggccgcauuggccgcaaccacaacaaagaaggggaccaauauaucuacaugggccagccccugaacaacgacgaggaucacgcccacuggaccgaggccaagaugcuccuugacaacaucaauacgccagagggcauaauccccgcccuguucgagccggaaagggaaaaguccgcggccgucgacggcgaguaucggcucagaggggaagcccguaagaccuucguggagcugaugagacggggcgaccugcccgugugguuauccuacaaggucgccagcgagggcuuccaguauagcgaccgccgguggugcuucgauggcgagcgcaacaaccaagugcuggaggaaaacauggacguagagauuuggacuaaagagggugagcggaagaagcugcgcccccguuggcucgacgcccgcaccuacuccgacccccuggcgcugcgggaguucaaagaguucgccgccgggcgacggagugucuccggcgacuugauccuugagaucgggaagcugccgcagcaucucacgcagcgggcccaaaacgcucuggauaaccuggugaugcuccacaacagugagcagggcgggcgggcguaccgacaugcaauggaggaguugcccgacaccaucgagacccugaugcuucuggcccugauagcggugcucaccgggggcguuacucuuuucuuccuguccgggcggggccuaggcaagacuucgauuggccugcugugcguaauggcguccagcguucuccuauggauggcgucugucgagccccacuggaucgccgccucgaucauccuggaguucuuucucaugguacugcugaucccggagcccgaccgccagaggacuccccaggacaaccaacuugcguacguggucaucggccugcuguucaugauccuaacuguggcggcgaacgagauggggcugcuggaaaccacuaaaaaggaccucggcaucgggcacguggccguagaaaaccaccaccacgcagcaaugcuagauguggaccugcaccccgccagugccuggacucucuaugccguggccaccacgauuaucacgccgaugaugcgccacaccaucgagaacaccacagccaacaucucucugacugcgaucgccaaccaggccgccauccugaugggccuugacaagggcuggccgaucuccaaaauggacauaggggucccccuucuggcgcuaggcugcuauagccaggucaacccccucacccugaccgcugccgugcuaaugcucguagcccauuacgcuaucaucgguccgggccuucaagccaaagccacgagagaagcgcagaagcggaccgccgcagggaucaugaagaaccccacuguggacggcauaguggccaucgacuuggacccaguaguguaugaugccaaguucgagaagcagcuagggcagaucauguuacucauucugugcacgucccagauccugcuaaugcgcaccacgugggcccuaugcgagagcaucacacuggccaccgggccccucaccacgcugugggaaggcuccccggggaaguucuggaacacuaccauagccgugagcauggcgaacaucuucagaggcuccuaccuggccggcgccgggcuggccuucagccuaaugaagucccugggagggggccgccgggggaccggugcgcaaggcgagacguuaggggagaaguggaagagacagcugaaccaacugagcaagagcgaguucaacaccuauaaaagauccgguaucauggaggucgaccgcagcgaggccaaggaggggcucaagcggggcgagaccacaaagcacgccgugucccgugggacggcaaagcugcggugguucguggaacgcaaccucgucaaacccgaggggaaggugauugaucucgguugcggacggggcggguggagcuacuacugcgcgggccucaagaaggugaccgaggucaaaggcuacacuaagggcggccccggucacgaggagcccaucccgauggcgaccuacggcuggaaccugguaaaguugcacucaggaaaggacguauucuuuaucccgcccgagaagugcgacacguugcugugcgacaucggcgagagcuccccaaacccgacaauagaggaggggcgcacgcugcggguucucaagaugguggagcccuggcugcgcggcaaucaguucugcauaaagauccugaauccguacaugcccucaguugucgagacccucgagcagaugcagcggaaacacggcgggaugcuggugcgcaacccacuguccagaaacagcacgcacgagauguauugggugucgugcggcaccgggaacaucguaagcgccgucaauaugacuuccagaaugcuccugaaccgcuucaccauggcccaccguaagccgaccuacgagcgcgacguagaccuggggacgggcacccggcaugucgccguggagcccgagguagcgaaucuagauaucaucgggcagaggauagagaacaucaagcaugagcacaagagcaccuggcacuacgacgaggauaacccuuauaaaacgugggcguaccauggcuccuaugaggucaaaccgagcgggucagccagcagcauggucaacggcgucgugaagcugcucaccaagccaugggacgugauaccgauggucacccagaucgccaugaccgacaccacccccuucgggcaacaacgaguauuuaaggagaagguggacacacgcaccccgaaggccaagcggggcacugcccagaucauggagguaacugcgcgcuggcucuggggcuuccuuucccgcaacaagaagccccgcauaugcacccgggaggaguucacaagaaaggugcggagcaacgcagcaaucggcgccgucuucgucgaugagaaccaguggaauagugcuaaggaagccguggaggacgagagguucugggaccucgugcaccgggagcgcgagcuccauaagcaagguaagugcgcgaccugcgucuauaacaugauggggaagcgggagaagaaacugggggaguucgggaaggccaagggcagccgcgccaucugguacauguggcugggcgcgagauuccucgaguucgaagcccuggguuuuaugaacgaggaccacugguucuccagggagaacagccuguccggcguggaaggggagggccugcacaagcugggauauauacugcgggacauuagcaaaauccccggcggcaauauguacgccgacgauacggcugggugggacaccagaaucaccgaagacgaccuccagaacgaagcaaagaucaccgacaucauggagccggagcacgcacugcuggcaaaggccaucuucaagcucacguaccagaauaaggucguccgcguccagcggcccgccaagaacggcacagugauggacgugaucucccggcgggaccaacgcgggagcggacaagugggcaccuacgggcuuaacaccuucaccaacauggaggcccagcugauccgccagauggaguccgaagguaucuucucucccuccgagcuagagacccccaaccuggcagagcgcgcguuagacuggcucgaaaaguauggcguugagcgucugaagcgcauggcaauuucaggcgacgacugugucgucaaaccgaucgacgaccgguucgcuacugcccugaccgcgcucaacgacauggggaaggugcgcaaggacaucccccagugggagccaucuaaaggcuggaacgacuggcagcagguaccuuucugcagccaccacuuccaccagcugauuaugaaggacggucgcgagaucgucgugccuugucgcaaccaagacgagcuggucggccgggcccgcgugucccaaggcgccggguggagccuccgggagaccgccugcuugggaaaaagcuacgcacaaauguggcagcugauguauuuccaccgacgggaccuacgccuggccgcaaacgccauuugcagugcugugccaggggacuggguccccaccucucggacgaccuggaguauccacgcgcaccaccaguggaugacaacggaagacaugcugagcguguggaaccgcguguggaucgaggagaaccccuggauggaggacaagacgcacaucuccagcugggaagacguuccauacuuaggcaagcgcgaggaccaguggugcggcucccugauagggcugacugcucgggcaacgugggccaccaacauccagguggccauuaaccaggugcgcaggcuaaucggcaaugagaacuaccuugacuacaugacuagcaugaaacguuucaagaacgagucggaccccgagggggcgcugugguga

SEQ ID NO: 24306 - RNA, 9879 nt, Artificial Sequence
  derived and/or modified CDS sequence (opt11) from DENV-1__GQ199793__SS-prME
agcgucacgaugcugcucaugcugaugccuaccgcucuggccuuccaccucaccacccggggcggggagccccacaugauugugaccaagcaggaacgugguaagagccuccuuuucaagaccagcgcggggguuaauauguguacccugaucgcaauggacuugggggagcugugcgaggauaccaugaccuacaagugcccccggaucacggaggcugagcccgaugacguugauugcuggugcaacgccacugacaccugggugaccuacgggacgugcucccagacaggggaacaccggcgcgacaagcggagcguggcuuuagcgccccacgugggccuggggcuggagacccgcaccgagaccuggauguccagcgagggcgccuggaagcagauccagcggguugagacgugggcacuccgccaccccggguucaccguaauagccuuauuccuggcgcacgccaucggcaccuccaucacccagaaggggaucauauucauccuccucaugcuggucacaccaagcauggcaaugcggugcgucggcauaggauccagggacuucguggaggggcugagcggcgcgaccuggguggacguggugcuggagcauggcucuugcgucacaaccauggcuaaggacaagccgacgcuggacaucgagcuccugaagaccgaggucacgaacccugcggugcuccggaaacucuguaucgaggccaagaucagcaauaccacgaccgacucacgcugcccuacacaaggcgaggccacccugauggaggagcaggaugccaacuuuguuugccggcgcaccuucgucgaccggggcugggggaacgguugcgggcuguucggcaaggggagccucaucacuugcgccaaguuuaagugcgugaccaaacuggagggcaagaucgugcaguacgagaaccugaaguacuccgucaucguuaccgugcacacgggcgaccagcaccaagucgggaacgaaucuacugagcacgguacaaccgcgacaaucacgccccaggcucccaccuccgaaauccagcucaccgacuacggggcucugacccuggacugcagcccgcgcacgggcuuagacuucaacgagauggugcugcucaccaugaaagaaaaguccuggcuuguccauaagcagugguuccuggaccucccacuccccuggaccagcggggccaccacaagccaggaaaccuggaaccggcaggaccugcucgucaccuucaagacagcccacgcgaagaagcaggagguggucgugcucggcucccaagagggggccaugcacacggcacugacgggggccaccgagauccagaccagcgggacgaccaccauauucgccgggcaccugaagugucgccucaagauggacaagcugacccugaaggggaugucuuacguuaugugcacgggaucuuucaagcucgagaaagaggucgcggagacccagcacggcacugugcugguucagaucaaguacgaggguaccgacgcccccuguaagauccccuuuuccacccaggacgagaaggggguaacccagaacggccggcuuaucaccgccaacccgauugucaccgacaaagaaaagcccgugaacaucgaggcagaaccccccuucggggagagcuacaucguaaucggcgccggcgagaaggcccugaagcucucaugguucaagaaggggagcuccauuggcaaaauguuugaggccacggcccgcggggcccggcgcauggcgauccugggagacaccgcaugggacuucggguccaucggcggcguauuuacauccguggggaaguugguccaucagaucuucggcacggcauaugguguccuguucagcgggguuuccuggacgaugaagaucgggaucggcguccucuugaccugguuaggccugaacucgcgcuccaccucguuguccaugaccugcaucgcugugggacucgugacgcuauaccugggcgucaugguacaggccgacagcggaugcgugaucaauuggaaaggccgggagcucaaauguggguccggcauauuugucacgaacgaagugcacaccuggacugaacaguauaaguuccaggcggacuccccgaagcgccugucugcagccaucggcaaagcaugggaagagggagugugcggaaucagaucugcuaccagacuggagaacaucauguggaagcagauaagcaacgagcucaaccacaucuuacuggaaaaugacaugaaguuuacggucgucgugggggacgucgugggcauccucgcucaagggaagaagaugauucggccucagcccauggagcacaaguacuccuggaaauccuggggaaaagcgaagauuaucggcgccgacgugcagaacaccaccuucaucaucgacgggcccaauacgccggagugccccgacgaccagcgcgccuggaacaucugggaggucgaagacuacggcuucgggaucuucacuaccaacaucuggcugaagcugcgggacagcuacacccaaaugugcgaccaucgcuugaugagcgcagccaucaaggacucgaaggccguacaugccgacaugggauacuggaucgagagcgagaaaaacgagaccuggaagcuggcccgggcgagcuucaucgaggugaagacguguaucuggcccaagucccauacccugugguccaacggcguccuagagagcgagaugauaauuccuaagaucuacgggggcccuaucucccagcacaacuaccgcccgggcuauuucacccagaccgccggcccguggcaccugggcaagcucgagcucgauuucgacuugugcgagggcacgaccguggucgucgacgagcacugcggcaaccgggggccgucucuucgcaccaccacagucaccggcaaaaucauccacgaguggugcugcaggucgugcaccuuaccaccgcuucgcuucaagggcgaagacggaugcugguacgggauggagauccggcccgugaaggaaaaggaggaaaaccuggucaagagcauggucuccgccggaagcggcgagguggauuccuucucccucggguugcuaugcaucucaaucaugaucgaagaggucaugcgcucucgcuggagccgcaagauguugaugaccggcacgcuggccgucuuccugcuccuuaucauggggcagcugaccuggaacgaccucauccggcuguguauuauggugggggcuaacgccagcgaccgcaugggcaugggcaccacguaccuggcgcucauggccacguucaagaugcgccccauguucgccguaggucuccuguuccgacgucucaccucgcgggaagugcugcugcuaaccauuggccuguccuuggucgcgagcguggagcuuccgaacucccuggaggaacugggcgacgggcucgcgaugggcaucaugauccugaagcugcucacggacuuccaaagccaucagcuaugggcuacccugcucuccuugaccuucauaaagaccacccuaagucugcacuacgccuggaaaacgauggccaugguucugaguaucguuagccucuucccacucugucucuccaccaccagccagaagacgacguggcugcccgugcuccuggggucgcuggggugcaagccgcucaccauguucuugaucaccgagaacaaaaucuggggcagaaagagcuggccccuaaacgaggggaucauggcgguuggcgucgucuccauucucuugagcagccuccucaagaacgacgugccccuggccgggccccugauagcuggcggaaugcucaucgcgugcuaugucaucucugguagcagcgcagaccugagccuggagaaggcagccgagguauccugggaggaggaggccgagcacucaggcgccucccacaacaucuuaguggagguccaggacgacgggaccaugaagaucaaggaugaggagcgggacgacacccugacgauccuguugaaggccacgcugcuggcgguuaguggcguguauccgcucuccaucccugcaacccuguucgucugguacuucuggcagaagaagaagcaacgcagcgggguguugugggacacccccagcccccccgagguggagcgggcgguccucgaugacggcaucuaccgcaucaugcagcggggccuccucgggcgcagccagguuggggugggaguuuuccaggagaacguguuccauacgauguggcacgugaccagaggcgccguccugauguaccaggggaagagacucgagcccucuugggccucgguaaagaaggaccuaaucuccuacggaggcggauggcggcuccagggcagcuggaacgcgggcgaggagguucaggucaucgcaguggaaccgggcaagaacccaaaaaacgugcagaccgcucccgggaccuucaaaacccccgaaggugaggucggcgccaucgcucucgacuucaagcccgggaccuccggcucccccauagugaaccgcgaagguaaaaucguuggccuguacggcaacggggucgugaccaccuccggcacguacgugagcgcgauugcccaagccaaagccagccaggagggcccgcugcccgagaucgaggacgagguguuucggaagcgcaacuugaccaucauggaccugcaccccggaagcgguaagacccgcagguaccuaccagcgaucgugagggaggccaucaagcggaagcuccggacccugauccuggcccccacgcgcgucgucgccagugagauggcagaggcucucaaagggaugcccauccgauaucaaacgacagccgugaaguccgagcauaccggcaaggagauuguggaccuuaugugccaugccacguucacaaugcggcugcucucuccaguccgcgugccaaacuacaacaugaucaucauggaugaggcgcacuucaccgaccccuccagcaucgccgcgcggggguauaucuccacacgcguuggcaugggcgaggcggccgccauuuuuaugacggccacgccgcccgguagugucgaggcuuuuccccagucaaacgccgugauucaagacgaggaacgggacauccccgagcgcucuuggaauagcgggcacgaguggaucaccgacuuucccggcaaaaccgugugguucguacccagcaucaagucaggcaacgacaucgccaacugccugcggaagaacgggaagcgggugauccaacugagccggaagacguucgacaccgaguaucagaaaacgaagaacaacgacugggauuauguugucaccacggacaucuccgagaugggggcuaacuuucgugcggaccgggucauagauccgcgccggugccucaaacccguuauucugaaggacgggccggagcgcgucauauuggccggcccuaugccgguaaccguugccagcgccgcccaacggcgcgggcggauuggccgcaaccacaacaaggagggcgaccaauauaucuacauggggcagccccucaacaacgaugaggaucacgcgcacuggaccgaggccaagaugcuauuggacaacaucaacaccccagagggcaucauccccgcccuuuuugagccggagcgggagaaguccgccgccauagauggagaguaccgucuucgcggcgaggcucggaagacguucgucgagcugaugcgccgcggggaccuuccgguauggcuuaguuacaagguggcguccgagggguuccaguacagcgaucgucgguggugcuucgacggagaacgcaacaaccaggugcucgaagagaauauggacgucgaaauuuggacaaaggagggggaacggaagaagcuccgcccaagauggcuggacgcccguaccuacagcgaccccuuagcucuccgggaguucaaagaguucgcggcgggccgccgaagcgucucuggggaccuaauuuuggagaucgguaagcuaccccagcaccugacgcagcgugcucagaaugcgcuagacaaccucgugauguuacacaacuccgagcaaggcgggcgggcuuauagacacgcgauggaagagcuucccgacacaauugagacccucauguugcuggcgcucaucgcaguccugaccggagggguuacccuguucuuucuaagcggccgggggcuggggaagaccucaaucggcuuacucugcgugauggcuuccuccgugcuguuauggauggcgagugucgagccccacuggaucgcugcauccaucauccucgaguucuuccuuauggugcugcucauccccgagccggaccgccagagaaccccccaggacaaucaacuggccuacgucgucaucggucuacucuuuaugauccuaacaguggccgccaacgagaugggccugcuugagacaaccaagaaggaccuaggaaucggacacguggcgguagagaaccaccaccaugccacgaugcuggacguggaccuccacccugccagcgccuggacccuauacgccguggcgaccaccaucaucacgccgaugaugcgccacaccaucgagaacaccacagccaacauuagucugacagccaucgccaaccaggcugcgauccucauggggcuugacaaaggcuggcccaucagcaagauggacaucggagucccccugcucgcccuggggugcuacucccagguaaacccccugacccucaccgccgccguucugaugcugguagcccauuacgcaaucaucgggccagggcuccaggccaaagccaccagggaggcccaaaaacguaccgcggccgguaucaugaagaaccccaccguggaugggaucguggccaucgaccuggaucccgucgucuacgaugcaaaguucgaaaagcaacugggccaaaucaugcuccucauucugugcaccagccagauucuuuuaaugcgcaccacgugggcccugugcgaguccauaacccucgcgacuggucccuugacaacgcuuugggaagggagcccgggcaaguucuggaacacuaccaucgccgugaguauggccaacaucuuccgggggagcuaucuggccggggccggccuugcguucucccugaugaagucccuugggggcggcaggagaggcacaggggcccaaggcgagacgcugggagaaaaguggaaacgccaacuaaaccagcucagcaaguccgaauuuaacaucuacaaacggucugggaucauggaggucgaccgauccgaggccaaggagggccugaagcgcggggaaaccacccgccacgccgugagccggggcaccgcgaagcugcgcugguucguugagcggaauuuggucaaacccgaggggaagguaaucgaucucggcugcggccgcggggguuggucauacuacugcgccggguugaagaaggugacggagguaaagggcuacaccaagggcgggcccggccaugaggagcccauuccuauggccaccuauggguggaaccuggugaaauugcacagcgggaaagacgucuuuuucacgccucccgagaagugcgacacguuacugugcgacaucggggaguccagcccuaacccgacgaucgaggaaggccggacccuccgcguucugaagaugguggagccuuggcuccgggggaaccaguucugcauuaaaauccuuaacccuuacaugcccuccguggucgagaccuuggagcaaaugcagcgcaaguacggcggcaugcugguucggaauccgcucagccgcaacagcacucacgaaauguauuggguaagcugcgggacggggaacaucgucucagccgugaacaugacgagccggauguugcugaaccguuucaccauggcccaucgcaaacccacuuacgagcgggacguggaccuuggggcaggcacgcgacacgucgccguggagccggagguggccaaccuggacaucaucggacagaggaucgagaacaucaagcaugaacacaaguccacuuggcacuacgacgaggacaaccccuacaagacgugggcguaccacgggagcuacgaggucaagccguccggcagcgccuccucgaugguaaacggcgucgucaaguuacucacgaagcccugggacgugaucccuauggucacgcagaucgcgaugaccgacaccacacccuucggccagcagcgcguguucaaggagaagguagacacgcggacgccgaaggccaagcgcgggacggcccagauuauggaggucaccgcacgguggcucuggggcuucuugucacgcaacaagaagccccggaucuguacgcgcgaagaauucacccggaaaguccguuccaacgccgcgauuggcgccguguucgucgacgagaaccaguggaauagcgccaaagaggccguggaggacgagagauucugggaucucguucagaaggagcgcgagcugcacaaacaggguaagugugccacuugcguguacaacaugaugggaaagagagagaagaagcugggggaguucggcaaggccaaggggucacgcgccaucugguacauguggcucggcgcccgcuuccuggaguuugaggcccugggcuuuaugaacgaggaccacugguuuagccgggagaacuccuuaagcgggguggagggcgaagggcuacacaagcugggcuacauccuccgcgacaucucgaaaaucccaggaggcaacauguaugcagacgacacagccggcugggauacgcgcauuaccgaggaugaucugcagaacgaggccaaaaucaccgacaucauggagccggagcaugcuuugcucgccaccagcaucuuuaaguugacguaccagaacaagguugucagggugcagcgccccgcgaagaacggcacagugauggacgucaucucccgccgggaccagcgaggcagcggccaaguugggaccuauggacuaaacaccuucacgaacauggaagcucagcugaucaggcagauggaauccgaggggaucuucuugcccagcgagcuggaaacccccaaccuggccgagcgcgugcuggacuggcuggagaaguacggcguagagcggcucaagcgcauggccauauccggggaugacugcguggugaagccgaucgacgaccgguucgcuacagcgcuuaccgccuuaaacgacaugggaaagguucgaaaagauaucccgcagugggaaccauccaaaggguggaacgauuggcagcaggugcccuucugcucccaucacuuccaccaauuaaucaugaaggacggcagggagauugugguuccgugcaggaaccaggacgagcuggucggcagggcccgagugagccagggggccggcuggucucugcgggaaacggccugccucgguaagagcuacgcacagauguggcagcugauguacuuccaccgccgggaccuccgccuagccgcgaacgccaucugcagcgcgguccccguggauugggugcccaccucccggaccaccuggagcauccacgcccaccaucaauggaugaccacugaggacaugcuauccgucuggaaccgcguauggaucgaggagaacccuuggauggaggacaaaacccauguuagcuccuggggcgacgucccguaccucgggaagcgggaggaccaauggugcggcagcuuaaucggccugacggcccgcgccaccugggcguccaauauccagguggcgauaaaccaggugaggcgguugaucgggaacgagaacuacuuagacuacaugacaucuaugaagcgcuucaagaacgagggcgaccccgaaggugcccugugguga

SEQ ID NO: 24307 - RNA, 9879 nt, Artificial Sequence
  derived and/or modified CDS sequence (opt11) from DENV-1__GQ199795__SS-prME
agcgugaccaugcugcucaugcugaugccuaccgcgcuggccuuccaccucaccacccgggguggggagccccauaugaucgucagcaagcaggagcggggcaagagccugcuguuuaagaccagcgccggcgugaacaugugcacccucauugccauggaccugggcgaauuaugcgaggacaccaugaccuacaaguguccccgcauaacagagaccgagcccgacgacguggacugcuggugcaacgcaacggacaccugggugaccuacgggaccuguagccagacgggugagcaccggcgcgauaagcggaguguggcccucgcgccccacgugggucuggggcuggagacccgcaccgagaccuggaugagcuccgagggcgcguggaagcagauccagcgggucgagacgugggcccuccgccaccccggguucaccgugaucgcacuguuccuggcccacgcaaucggcaccaguaucacccagaaggggaucauuuucauccuacugaugcuggugacgccguccauggccaugcggugcguaggcaucggcagccgcgacuucguggaggggcucuccggcgccacuuggguggacgucgugcuggaacacgggagcugcgugaccaccauggccaaagacaagcccacucuggacauugagcucuugaagaccgaggucacuaaccccgccgugcuccguaagcucugcaucgaagcgaagaucagcaacaccacgaccgacagccgcuguccgacucagggcgaggccacccugguggaggagcaggaugccaacuucgucugccggcgcacguucguggaccggggaugggggaacggcugcgggcuuuucggcaaggggucccucaucacgugcgccaaguucaagugcgugaccaagcuggagggcaaaaucguccaguaugagaaccugaaauacuccgugaucgugaccguccacacuggcgaccagcaccagguggggaacgaguccaccgagcacgguaccaccgccaccauaacgccucaggcgcccaccaccgagauccagcucaccgacuacggggccuuaacucuggauugcagcccacguaccggucuagacuucaacgagaugguccugcugaccaugaaggagaaguccuggcucgugcacaagcagugguuccuggaccugccccuacccuggacgucuggggccagcaccucccaggaaaccuggaaccgucaggaucugcucgugaccuucaagaccgcccacgcgaagaaacaggaggucgugguucucggcagccaggagggcgcgaugcacacggcccugaccggcgccaccgagauacaaaccuccggcacgaccaccaucuucgccgggcaccugaagugccgccucaagauggauaaacuuacccugaagggcaugagcuacgucaugugcacagggucauucaagcucgagaaggagguggccgagacccaacacggcaccgugcugguucagaucaaguacgagggcaccgacgcccccugcaagauccccuucaguacgcaagacgagaagggugugacccagaauggccggcugaucaccgccaacccgauugugaccgacaaggaaaagcccgucaacauugaggccgagccgcccuucggugaguccuacauugugaucggagccggcgagaaagcgcugaaacugagcugguuuaagaaaggguccucgaucggcaaaauguucgaggccacggcacgcggggcccgacgcauggccaucuuaggcgacacggcgugggacuucggguccauaggcggcguguucaccagcgucgguaagcuggugcaccagauauucggaaccgccuacggggugcuguucuccggcgucagcuggacgaugaagaucgggaucggcgugcugcugaccuggcucggccuuaacucccguagcacuagccugagcaugacuuguaucgccgucgggcucguuacgcuguaccuuggcgugaugguccaagccgacucgggauguguaauaaacuggaagggccgggagcucaagugcggaagcggcaucuuugugaccaacgaggugcacaccuggaccgagcaguacaaguuccaggccgacucaccgaagcgccuguccgcugcuaucggcaaggccugggaggagggggucugcggcauccggagcgccacccgccuggagaacaucauguggaagcagaucuccaacgagcucaaccacauacugcuggagaacgacaugaaguucacggugguggugggggauguggcggguauccucgcgcaggggaagaagaugauccggccgcagccaauggaguacaaauacagcuggaaguccuggggcaaggccaagaucaucggcgccgacguacagaacaccaccuucaucauugacgggcccaacaccccggagugcccggacgaccagagagccuggaacaucugggaggucgaggacuacggcuucgggaucuucacgaccaacaucuggcugaagcuucgagacaguuacacccaagugugcgaccaccgccucauguccgcggccaucaaggacagcaaggccgugcacgccgacaugggcuacuggaucgaguccgagaagaacgaaaccuggaagcuggcccgggcgagcuucaucgaggucaagaccugcaucuggcccaaaucccacacccuuuggagcaacggugugcucgaguccgagaugaucauacccaagaucuaugggggaccgaucagccagcacaacuaccgcccgggguacuucacccaggccgcaggccccuggcaccuggggaagcuggagcucgacuucgaccugugcgagggcacaacgguuguuguggacgagcacugcggcaaccgggggccgucccugcgcaccaccaccgugacgggcaagaucauccacgaaugguguugccggagcugcacccugccgccgcuccgcuuccggggggaggacggcuguugguacgggauggagauccggccagucaaggagaaggaggagaaccuagugaaguccauggugagcgccggaucuggcgaggucgacuccuucagccucgggcuguuauguaucuccaucaugaucgaagaggugaugcggagccgcugguccaggcgcaugcucaugaccggaacacuggccguuuucuuccuacucaucauggggcagcugaccuggaacgaccugauccgcuugugcaucauggucggcgcgaaugccagcgaucggauggggaugggcacuaccuaccuggcccugauggccaccuuuaagaugcgccccauguucgccguagggcuccucuuucggcgccuaacguccagagaagugcuccugcugaccaucgggcucucucuugucgcguccguggagcugcccaacagccucgaagagcugggcgacgggcuggccaugggcaucaugauccucaaguugcugaccgacuuucagucccaccagcucugggccacccugcugagccugacguucaucaagaccacguucucccugcacuacgccuggaagaccauggcgaugguccugagcaucgugucccucuucccccugugucugagcacgacgucccagaagaccaccuggcuccccguguuacuggguagccucgggugcaagccgcugacgauguuccugaucgcagagaacaagaucuggggccgccgguccuggccccucaacgaggggaucauggccgucggcaucguaagcauccugcuaagcucccuccugaagaacgaugugccuuuagcugggccccuaauugcaggaggcaugcuaaucgcguguuacgucaucagcggguccuccgccgaccugucccucgagaaggcugccgaggucucuugggaggaggaggccgagcauuccggcgcaucucacaacauccugguagagguccaggacgaugggaccaugaaaaucaaggacgaggagcgcgacgacaccuuaaccauacuucugaaggccacgcugcucgccgucuccggcguguacccacugucuaucccugccacgcuguucgugugguacuucuggcaaaagaagaagcagcgguccggggugcucugggacaccccuucgccacccgagguggagcgcgcaguccucgacgacggcaucuaccgcaucaugcagcguggccugcuagggcggucccaggugggcgucggugucuuccaggagaacguguuccacaccauguggcacgugacgcguggcgcgguccucauguaccaggggaagcgucuggagcccagcugggccucugugaagaaagaucugaucagcuacggcggaggguggcgacuccagggcuccuggaacacgggagaggaggugcaggucaucgccguugagcccggcaaaaaccccaagaacguacagaccgcccccgggacuuucaagacccccgagggcgagguaggugccauugcgcuggacuucaagcccgggacgagcggcuccccaaucgucaacagggaggggaagaucgugggccuguacggcaacggggucguaaccaccagcggcaccuacgugucugccaucgcccaggcuaaggcgucccaggaagggccgcucccugagauugaggaugagguguuccgcaagcggaaccuaacgaucauggaccugcacccaggcagcgggaagacccgccgguaccucccggccaucguacgcgaggccaucaagcgcaagcuacggacgcugauccucgcacccacccgcguugucgccuccgaaauggccgaagcgcugaagggcaugcccaucagauaucagacgaccgccgucaagagcgagcacaccggcaaggagaucguugaccugaugugccaugccaccuucacuaugcggcuccugucccccguccgggugccgaacuacaacaugaucaucauggacgaggcccacuucaccgaccccagcuccaucgcggcccgcggguacaucagcacccgggugggcaugggggaagcggccgccaucuucaugaccgcgacgccccccggcuccgucgaggcauuuccgcagucuaacgccguaauccaggacgaggaacgcgacaucccagagcgguccuggaacucuggguacgaguggaucaccgacuuccccgguaagaccgugugguucguaccuucuauuaagucgggcaacgacauugccaacugccugcgcaagaacgggaagcgggugauccagcugucccgcaagaccuuugacacggaguaccagaaaaccaagaacaacgacugggacuacguggugacaaccgacaucagcgagaugggcgcgaacuuccgagcagaccgcgugauagacccgcgucgcugccugaagcccgugauccugaaagacgggcccgagcgggucauacuugccgggcccaugccggugacggucgcguccgccgcucagcgccgggggagaaucggccgcaaccacaacaaggaaggcgaccaguacauuuacauggggcagccccugaacaacgacgaggaccacgcccacuggaccgaggccaagaugcuucucgacaacaucaacaccccggagggcaucaucccggcccuguucgaaccggagcgggagaaguccgccgcgaucgacggggaguaccgccugcggggggaagccaggaagaccuucguagagcucaugcggcgcggggaccugcccguguggcuguccuacaaggucgcaagcgaaggcuuccaguacucagaucggcgcuggugcuuugacggcgagcggaacaaccaggugcucgaggagaacauggacguggagaucuggaccaaggagggggagcgcaagaagcugaggccccgauggcuagacgcccggaccuacuccgauccgcuagcgcugagggaguucaaagaauucgccgccggccggcgcagcguauccggggaucugauccucgagaucggcaaguugccgcagcaccugacgcagcgggcgcagaacgcgcucgauaaccugguaaugcugcacaacagugagcaaggcggccgcgcguaccggcacgccauggaggagcuccccgacaccaucgagacgcugaugcugcucgcccugaucgcggugcugacgggcggugucacccuuuuuuuccuguccggcagggggcugggcaaaaccagcaucggccuccugugcgugauggccuccagcgugcuccucuggauggcguccgucgagccgcacuggaucgccgccagcaucauucuggaguucuuccugauggugcuccuuauccccgagccggaccgacagcgcacaccccaagacaaccagcuggccuauguggucaucgggcugcuguucaugauacugacgguggccgcgaacgagaugggccuccuggagacuacgaagaaagaucuggggaucggccacguggccgucgagaaccaccaccacgccgccaugcuagacguggaucugcacccugccuccgccuggacgcuguacgccguggccacgaccaucauuaccccgaugaugcgucacaccaucgaaaacacgaccgcgaacaucagcuuaaccgccaucgcgaaccaggccgccauccugaugggccuggacaagggcuggcccauuuccaaaauggauaucggcgucccccuccuggcccuuggaugcuacagccaggugaacccccucacccugacggcggcggugcugaugcucguagcucacuacgccaucaucggaccggggcugcaggcgaaggcgacccgggaggcccagaaacgcaccgcagcugguaucaugaagaaccccaccguggacgggaucguggccauugaccuggaccccgucgucuacgacgcgaaguuugagaagcaacucggccagaucaugcuauuaauccucugcacgucacagauccugcugaugcggaccaccugggcucucugcgagagcaucacccuggccacaggcccucugaccacgcucugggagggguccccaggcaaguucuggaacaccacaaucgccgugagcauggccaauaucuucagaggcuccuaccuggcgggcgccggccuggccuucagccucaugaagucccucgggggcgggcgucgcgggaccggggcgcagggcgagacccugggcgaaaaguggaaacgccagcucaaucagcuguccaagucagaguuuaacaccuacaagcgcuccgggauaauggaggucgaccggagcgaggcgaaagagggccugaagcgcggggagacgaccaagcacgccguuucccggggcaccgccaagcuccgcugguucguggagcggaaccuggucaagcccgagggaaaagugaucgaucugggcugcgggcgcggggguuggagcuacuauugcgccgggcuuaagaaggugaccgaggucaagggcuacacgaagggcggccccggccaugaggaccccauaccgauggccaccuacggguggaaccucgugaagcugcauuccggcaaggacguauucuucaucccgccagagaagugcgacacccugcucugugauaucggggagagcuccccaaacccgaccaucgaggagggccguacgcugcgcguccugaagaugguggagcccuggcucagggguaaccaguucugcaucaagauccugaaccccuacaugcccucgguggucgagacacuggaacagaugcagcgcaagcacggcgguaugcucguccggaacccguuaagucgcaacagcacucacgagauguacuggguguccugcgggaccggcaacaucgugagcgcggugaacaugaccucaagaaugcugcucaaccgguucacgauggcccaccgcaagcccaccuacgagcgggacguggaccugggggccggcacccgccacgucgccguggagcccgagguggccaacuuggacauuauuggccagcgaaucgagaauaucaagcacgagcauaagagcaccuggcacuacgacgaggacaacccauacaagacgugggcguaccacgggucguacgaggucaagccgagcggcuccgcaagcucgauggugaacggggucgugaagcuccucaccaaacccugggacgugaucccaauggucacccagaucgccaugaccgacacgacccccuucgggcagcagcgcguguucaaggagaaggucgacacccggaccccgaaggccaagcgcgggacggcacagaucauggaggucaccgcgaaguggcuguggggcuuucucuccagaaacaagaagccgcgcauuuguacccgggaggaguucacccgcaaggugcggagcaacgccgccaucggcgcaguguucgucgacgagaaccaguggaacuccgcgaaggaggcuguggaggacgagagguucugggaccuggugcaccgggagcgcgagcugcauaagcaaggcaagugugccacgugugucuacaacaugaugggcaagcgggagaagaagcucggggaguucggcaaggccaaggggucacgcgccaucugguacauguggcugggggcgcgguuccuggaguucgaagcccucggcuucaugaaugaggaccacugguuuucccgcgagaacagccugagugggguggagggugagggacuucacaagcucggcuauauacugcgggacauaagcaagauccccgggggcaacauguacgccgacgacaccgccggcugggacacccgcaucaccgaggacgaucugcagaaugaagcccgcaucacggacaucauggagccggagcacgcgcuccuggccaagucgaucuucaagcugaccuaccagaacaaagugguacgcgugcagcgccccgccaagaacgggaccgugauggacguaaucagccggcgcgaccagcggggcagcggccagguggggacguacggccugaauacauucaccaacauggaggcccagcugauacgccagauggagagcgaggggaucuucucccccucggagcuggagacccccaaccucgccgagaggguucucgacuggcuggagaaguauggugucgagcgccucaagaggauggcgauauccggugaugauugcguggugaagccgaucgacgaccgcuuugccacagcccugacggcccugaacgacaugggcaaggucagaaaggacauaccccagugggagcccagcaagggauggaacgauuggcagcagguccccuucugcucccaccacuuccaccagcucaucaugaaggacggccgcgagaucguggucccgugccggaaccaggacgagcuggugggccgagcccgggugagccagggggccggcuggagccugcgcgaaaccgcgugcuuggggaaauccuacgcccagauguggcagcugauguacuuucaccggcgcgaccuucggcucgcugcgaacgccauaugcagcgcuguccccguggauuggauccccaccucccgcaccacauggagcauccacgcccaccaccaguggaugaccaccgaggacaugcuguccguguggaaccgcguguggaucgaagagaaccccuggauggaggauaaaacccacaucaguuccuggggcgacgugccguaccuggggaaaagggaggaccaguggugcggcagccucauuggccugacggcccgcgcgaccugggccaccaacauccaaguggccauaaaccagguaagacgccuuaucgggaacgagaacuacuuagacuacaugaccuccaugaagcgguucaagaacgagagcgacccugagggcgcccugugguga

SEQ ID NO: 24308 - RNA, 9873 nt, Artificial Sequence
  derived and/or modified CDS sequence (opt11) from DENV-1__FJ882547__SS-prME
agcgugacgauguugcucaugcugaugcccaccgcgcucgcauuccaccucaccacucguggcggggaaccccacaugauugugagcaagcaggagcggggcaagucauugcuguucaagacaagcgcgggggugaacaugugcacccucaucgcuauggauuugggcgagcucugugaggacacgaugacguacaaaugccccaggaucacagaggccgagcccgacgacguggacugcugguguaacgccaccgacacgugggugaccuacgggaccuguagccagacuggcgagcaccgccgcgacaagcgguccguggcacucgcgccgcacguaggccugggucuagagacgcgcacagagacuuggaugucgagcgagggcgcuuggaagcagauccagcgggucgagaccugggccuugcgccaccccggguucacggugaucgcauuguuccucgcucaugccaucgguaccagcaucacccagaaggggauaauuuucauccuccugaugcucgugacccccuccauggcaaugcggugcgucggcaucggcagucgcgacuucguugaggggcuuuccggcgccacguggguggauguagugcuggagcacgguagcugcgugaccacgauggccaaagacaagcccacccuggacaucgagcuccucaagacggagguaaccaaccccgcugugcuccggaagcucugcauagaggccaagaucuccaacaccaccacggacagccgcugcccgacucagggcgaggcgacccuuguggaggagcaggacgcaaacuuugucugucggcgcaccuucguggaccggggaugggggaacggcuguggguuauucggcaaggggucccucauaaccugcgccaaguucaagugcgugaccaaacuugagggcaagaucguccaguacgagaaccucaaguacagcgugaucgugacuguccacaccggcgaucagcaccaaguuggaaacgaguccaccgagcacggcacaaccgcgaccauaacgccccaggcccccacuaccgagauccagcucaccgauuacggggcccugacccuagauugcagcccgcgcaccggcuuagacuucaacgagaugguccugcugaccaugaaggagaaguccuggcucgugcacaaacagugguuccuggaccugcccuugcccuggacgagcggggccaguaccucccaggaaacuuggaacaggcaggacuuacuggugaccuuuaagaccgcacaugcuaagaagcaggagguaguggugcucggcagccaggagggcgcgaugcacacugcucugacgggggccaccgagauucagaccucuggcaccacgaccaucuucgccgggcaucugaagugccgccuaaagauggacaagcugacccugaagggcaugagcuaugucaugugcaccgggagcuucaaguuagagaaggagguggccgagacucagcacggcaccguguuaguccagaucaaguacgagggcacagaugccccauguaaaauccccuucaguacccaagacgagaaaggggugacgcagaacgggcgccugaucaccgccaacccgaucgugacugacaaggagaagcccgucaacaucgaggccgagccgccguucggagaguccuacaucguaaucggcgcgggcgagaaagccuugaaacucagcugguucaagaagggauccagcaucggcaaaauguucgaggccaccgccagaggggcgcggaggauggcgauccugggagacacggccugggacuucgggucuaucggcggcguguucaccucugugggcaagcucguucaccagaucuucggcacugccuacggcgugcuguucuccggcgucagcuggaccaugaagauagggaucggcgugcugcugacguggcugggccugaacucccgcagcaccucgcugagcaugacaugcaucgccguggggcucgucacccuguaccugggcgugaugguucaggccgacucagggugcgucaucaacuggaaaggccgggaacucaagugcgggagcggcauuuucgugacgaaugaggugcauacauggaccgagcaguacaaguuccaggcagacucgccgaagcgccuguccgccgccaucggcaaagccugggaggaagggguuugcgggauucgaagcgccacccgccuggagaacaucauguggaagcaaauuuccaaugaguuaaaccacauacugcucgagaacgacaugaagcucacgguagugguuggggauguggcgggcauccuagggcagggcaagaagaugauucggccccaaccuauggaguacaaguacucguggaaaucaugggguaaggccaaaaucauuggggccgacgcccaaaacaccacuuucaucauagacggcccaaacacuccggagugcccugacgaccagcgcgcguggaauaucugggagguggaggacuacggcuucggcaucuucaccacgaacauauggcucaaguugcgggacagcuacacccaggucugcgaccacagacugauguccgcggcuaucaaggacucgaaagccgugcacgcagauaugggcuacuggaucgaguccgaaaagaacgagaccuggaagcuggcccgggccagcuucaucgaggugaagaccugcaucuggcccaagucccacacgcuguggagcaacggggugcuggaaucggagaugaucauccccaagauauauggcgggccgaucagccagcacaacuacaggcccggcuacuucacgcagaccgccgggcccuggcacuugggcaagcucgagcuggacuucgaccucugcgagggcacgacuguugugguugacgagcacugcggcaacagggggccguccuuacgcaccacaaccgugacggggaagaucauccacgaguggugcugccggagcuguacguuaccgccccuacgcuuccgcggcgaagacgguugcugguacggcauggagauccgccccguuaaggagaaggaggagaaccucgucaaguccauggugagcgccggcagcggggagguugauuccuucagccuggggcucuuaugcaucucgaucaugaucgaggaagucaugcggucccgcugguccagaaagaugcugaugaccgggacucuggccguguucuuccuuuugaucaugggccagcucacguggaacgacuugauucgccugugcaucauggucggcgcgaacgcuagcgaucgcauggguaucgguacgaccuaucuggcgcuaauggccaccuucaaaaugaggccgauguuugccgucggccugcuguuccgacgguuaacaucccgcgaggugcugcuacucaccaucggccugagccugguggcuuccgucgagcuccccaacucccuggaggagcugggggacggccucgccaugggcauaaugaugcugaagcugcucaccgacuuccagucccaccagcugugggccacucugcucagccugacguuuaucaagacaacguucucccugcacuacgcauggaagaccauggcgauggugcucaguauagucucccuguucccccugugcuugagcacgaccucccaaaagacgaccuggcuccccguucugcuugggucacugggcugcaagccgcugacgauguuucucauugccgagaacaagaucuggggucguaagucauggccccugaacgagggcauaauggccguagggaucgucucaaucuuacuuagcucccugcucaagaacgaugugccccucgccggcccccuuaucgccggagggaugcugaucgcguguuacgugaucagcggcucaagcgccgaccucucacuggaaaaggccgccgaggucucgugggaggaggaggcagagcacucuggggcgagccacaacauccugguugagguacaggacgacgggaccaugaaaauuaaggacgaggagcgcgacgacacccucacgauccugcuuaaagcuacucuccuggccgucagugggguuuacccucucaguauacccgccacccucuucgugugguacuucuggcagaagaagaagcagcgguccggcguccugugggauacccccucuccuccggagguggagcgugcaguucuggacgacggcaucuaccggaucaugcaaagggggcugcucggccggucccaggucggggugggaguguuccaggaaaacgucuuccacaccauguggcacgucacccgcggagcggugcugauguaccagggaaagagacuggagccgagcugggccucggucaagaaggauuugaucucuuacggcggaggguggcgccugcggggguccuggaacacgggagaggagguucaagugaucgcuguggaaccugggaagaaucccaagaacgugcaaacagcccccgguaccuucaaaacccccgaaggcgaggugggggccaucgcccuggauuucaaacccggcacgagcgguucaccgaucgucaaccgugagggcaagaucgugggccucuacgggaacggcgucgucaccaccuccgggaccuacgugagcgccauugcccaggccaaagcgucccaggagggcccgcugcccgagaucgaggacgagguguuccggaaacgcaaccugacgauuauggaccuccacccggguagcggcaagacccggcgcuaucugccggccaucguuagggaggccauaaagcggaagcuccgcacccucauccuggcccccacccgggugguagccagugagauggcggaagcacugaaaggcaugcccauccgcuaccagacgaccgccguuaaaagcgaacauaccgguaaggagauaguugaccucaugugccacgccacuuucacgaugcgacugcucucgcccgugcgaguaccgaauuacaacaugaucauuauggacgaggcccacuucacugaucccagcuccaucgccgcccggggcuacaucucaacccggguggggaugggcgaagccgccgcgaucuucaugacugcgacgccgcccggauccguggaggccuucccgcagucuaaugccgucauccaggacgaggagcgugacauacccgagcgcuccuggaacagcggauaugaauggaucaccgacuuuccgggaaagaccgugugguuugugcccuccaucaagagcgggaaugacaucgccaacugccuccgcaagaacggcaaacgcguuauccaguuaucccggaaaaccuucgacacggaguaccagaagaccaaaaacaacgacugggacuacguugugaccacggacaucuccgagaugggggcgaacuuccgcgccgaucgggugaucgauccacgccggugucuaaagcccgugauccuuaaggacggccccgagcgcgugauccuugccgggcccaugccggucacgguggcguccgccgcgcagcggcgcggccgcaucggacgcaaccacaacaaggagggggaccaguacaucuauaugggccaaccgcugaauaaugacgaggaccacgcccauuggacggaagcaaaaaugcucuuagacaauaucaacaccccggagggcauuauccccgcgcuguuugagccggagcgcgagaagucugcagcggucgacggcgaguaucggcuccgcggggaggcucggaagaccuucguggagcugaugcgccgaggcgaccuucccgugugguuaucauacaaggucgccuccgagggauuucaauacucagaccggcgguggugcuucgacggggagaggaauaaccagguucuggaggagaacauggacguggagaucuggacgaaggagggcgaggggaaaaaguuacggccccgcuggcucgacgcgcggaccuauuccgacccccuggcccugcgcgaguucaaagaguucgcggcgggccggcgcuccgucucaggcgaccucauccuggagaucgggaagcugccgcagcacuugacacagcgugcucaaaacgcccuggacaaccuaguaauguuacacaacagcgaacagggcgggcgcgcguaccgccacgcgauggaggagcugccagacacaaucgagacgcucaugcuccuagccuugaucgcuguccucaccggcggggucacgcuauuuuuccugaguggccguggccuggggaagaccagcauaggccuacugugugugauggcuuccagcgugcuccuguggauggcguccguggagccccacuggaucgccgccagcauuauccuggaguucuuccucaugguucugcucauccccgagccggauagacagcgaacgccccaggacaaccaacucgcuuacguggucaucgggcugcuguucaugauacucacgguggcagccaacgagaugggccugcuggagacuacgaagaaggaccucgggaucggccacgucgccgucgagaaccaccaucaugcggccaugcuagacguggaccugcaccccgcauccgcguggacccuauacgccguggccacgacuaucauuaccccgaugaugcggcacaccauugagaauacuacagccaauaucucauuaaccgcgaucgcgaaucaagcggccauccugaugggccucgacaagggguggccaauauccaagauggacaucggcguaccccugcuggcccucggcugcuacucccaagucaaccccuugacccugacggcggccgugcucaugcugguggcccacuacgccaucaucggcccggggcugcaggccaaggcgaccagagaggcacagaagcgcaccgccgcaggcauaaugaagaacccgaccguagauggcaucguggccaucgaccuagaccccguagucuacgacgcaaaguucgagaagcagcuaggacagaucaugcugcucauccugugcacgagccaaaucuuacucaugcggaccaccugggcccugugcgagagcauaacccuggccacgggaccccucacuacucugugggaggggucuccggggaaguucuggaacaccacgauugcuguuagcauggccaacaucuuccgaggcuccuaccuggcgggggcgggccuagccuucucucuaaugaagucccucgggggcgggagacgcggcaccggcgcccagggcgagacccucggcgagaaguggaagcggcagcucaaccagcuguccaagucggaguuuaacaccuauaagcguagcgggaucauggagguugaccggagcgaggccaaggaaggauuaaagcgcggggagacuaccaagcaugccgugucccggggcaccgccaagcugcgcugguucguggagcgaaaccugguaaagccggaggguaaggugaucgaccuggggugcggccgcgggggauggagcuauuacugcgccgggcucaaaaagguuaccgaggucaagggcuacacuaagggcgggcccggacacgaagaacccauaccgauggcgaccuauggguggaauuugguuaagcuccacuccggcaaggauguguucuucaucccgcccgagaagugcgauacacuccugugcgacaucggagaaagcucccccaauccuaccaucgaggagggccggacacugcgcguucucaagaugguggagcccuggcugcggggcaaccaguucugcaucaaaauccugaaccccuauaugccuagcguggucgagacccucgagcagaugcagcgcaagcacgggggcauguuggugcggaacccccugucucgcaacagcacucacgagauguacuggguuuccugcgggaccggaaauauagucucggcggugaacaugaccuccaggaugcuccugaaucgcuuuaccauggcccaucgcaagcccaccuacgagcgggacguugaccuaggcaccggcacacgccacguugcgguggagcccgagguggccaaccucgacaucaucggccagcggaucgagaauaucaagcacgagcauaaaagcacguggcacuacgacgaggacaaccccuauaagaccugggccuaccacggguccuacgaggucaagcccagcggcagcgcgagcuccauggucaaugggguugugaagcugcugaccaagcccugggacgugauccccaugucccccaucgcaaugaccgacacuacuccguuagcccagcgcgucuucaaggaaaaggucgacaccaggacucccaaggccaagcgcgggacggcgcaaaucauggaggucaccgcgcgguggcuguggggcuuucugagccgcaacaaaaagccgaggaucugcacccgugaggaguucacccggaagguccgcuccaacgcugcaaucggggccguguucguggacgagaaccaguggaacagcgcgaaagaggcagucgaggacgagcgguucugggaccucgugcaccgggagagagaacugcacaaacaggggaagugcgcgacgugcguuuacaacaugauggggaagcgcgagaagaaacugggugaguucgggaaggccaagggcucucgagcaauaugguacauguggcucggcgcacgguuucuggaguucgaggcacugggguuuaugaaugaggaccauugguucucgcgggagaacaguuuauccggcguugagggggagggccugcacaaacuuggguacauccuccgcgauaucuccaagaucccgggcggcaacauguacgccgacgacaccgccgggugggauacccggauuaccgaggacgaccugcagaacgaggccaaaaucaccgacaucauggagccagagcacgcucuccuugcgaaagccauauucaaguuaacguaccagaauaagguggugcggguccagcgcccugccaaaaacggcaccgugauggacgugaucagccggcgcgaccaacggggcuccggccaaguaggcaccuacgggcuaaauacguucacgaacauggaagcucaguuaauacgccaaauggagagcgaggagaucuucucacccagcgagcuggagacgccgaaccuggcggagcgggccuuagauuggcucgagaaauacggcguggaacgccugaagcguauggcaaucuccggggacgacugcguggucaagcccauugaugacagauuugcgaccgcccucacagcgcucaacgacaugggcaaggugcgcaaggacauaccccagugggagcccagcaaggguuggaacgacuggcagcaggucccguucugcucccaccacuuucaccagcugaucaugaaggauggccgcgagaucguaguacccugccgaaaucaagacgagcugguggggcgggccaggguaagccaaggggccggcuggagccugcgcgaaaccgccugccuggggaaguccuacgcgcagauguggcagcucauguacuuccaucgacgcgaccugcggcuggccgccaacgccaucuguucagccguucccgucgauuggguuccaacgucccgcaccaccuggaguauccacgcgcaccaccaguggaugacgaccgaggacaugcuguccguguggaaccggguguggauagaggagaacccauggauggaggauaaaacccacaucagcucgugggaagacguucccuaccugggcaaacgcgaggaccaguggugcggcagccuaaucggccucacggcccgcgccaccugggccaccaauauacaggucgcuauaaaccaggugcggcgccugauuggcaacgagaacuaccuggauuauaugaccuccaugaagagguucaagaacgagagcgaccccgagggggcacucugguaa

SEQ ID NO: 24309 - RNA, 9879 nt, Artificial Sequence
  derived and/or modified CDS sequence (opt11) from DENV-1__GQ199797__SS-prME
ucgguuacgaugcuacuuauguuaaugccaacggcacucgcguuucaucuaaccacgcgcggcggggaaccacacaugauaguaucgaaacaagaacgcgggaaaagccuccuauuuaagaccagcgcaggagugaacaugugcacuuuaaucgcaauggaccugggagaguucugcgaagacaccaugacguauaaaugcccccgaaucacagaagcugaaccggacgaugucgacugcuggugcaacgcaacggacaccugggucacauaugguaccugcagccaaaccggagagcaucgcagagacaagcgcucaguggcacucgcgccucacgucggacugggacucgagacacgaacggaaacuuggaugucaagcgaaggcgcguggaaacagauacaacgcguugaaacaugggcauugagacaccccggcuucacaguaaucgccuuguuccucgcgcacgcgauaggaacaucuauuacccagaaaggaauaauauucauccuccuaaugcucguuacaccgucgauggccaugcgcuguguugggaucggcucucgcgauuucguagagggccugaguggcgcaacguggguggaugugguccucgaacauggcagcugugugaccaccauggccaaagauaaaccaacacucgacaucgaauuacuaaaaacagaggugacgaaccccgccguacuaagaaagcuguguauagaagcaaaaauauccaauaccacaacagacucccgauguccuacccaaggagaggccacccuaguagaggaacaagacgccaacuuugucuguagaagaacuuucguggacaggggcuggggaaacggauguggauuguuuggaaaaggcucccugauaacaugcgcuaaguucaaaugcgucacaaagcucgaaggcaaaacaguccaauacgagaaccuaaaauauagcgugaucgugacaguccacacgggagaccaacaccagguaggcaacgaaaguaccgagcacggaacgaccgccaccauaacaccccaagcgccaucaacggaaauccaacucacugacuauggagcccuuacuuuagacugcucaccacgcacgggccuagacuuuaacgagaugguacuccuaaccaugaaggaaaagagcuggcucgugcacaagcaaugguuccucgaucuaccacuuccauggacaucgggugccucaacgagccaagaaacauggaacagaaaagaccuucucgucacguucaagacugcucacgcaaagaaacaagaggucguaguacuaggaucccaagaaggagccaugcacacggcauuaacaggcgccaccgaaauacaaacauccggaaccacgacaaucuuugcgggacacuugaagugucgacugaagauggauaaacuaacacucaaaggcaugagcuacgucaugugcacgggcagcuucaagcuagagaaggaggucgccgaaacacagcauggaacaguucuagugcaaauaaaguacgaaggcacagacgccccaugcaaaauucccuucagcacucaagaugaaaaaggagugacacaaaacggaaggcuaaucaccgcgaaccccauaguaacugacaaagaaaaacccgugaacauagaagcggagccaccguucggcgaaucguacaucgugauaggagcaggcgaaaaggcucucaaacuaagcugguuuaagaaagguuccuccauaggcaagauguucgaggcaaccgccaggggagcgcggaggauggcuaucuugggagauacagcaugggacuucggcucgauaggaggcgucuucaccuccgugggcaagcuaguacaccagauauucgggacggcguacggcguucucuucuccggggugucuuggacaaugaagauaggaaucgguguccugcucacauggcugggauuaaauagucgcucaacuagccuuaguaugacuugcauagcugugggauugguaacgcucuaccugggagucaugguacaggcagacagcggcugcguaauaaacuggaaaggccgcgaacugaaaugcggaagcggaauauuugugacaaacgaaguccacacuuggaccgaacaauacaaauuccaggccgacagcccuaaacgccugucagcagcgaucgguaaggcgugggaagaaggcguguguggaauacggucggccacgagacucgagaacauaauguggaagcaaauaucgaacgagcucaaucacauccugcuagagaacgauaugaaguucaccguugucguaggcgacgucgccggaauacuggcucaggggaaaaagaugauacgcccacagccgauggaguacaaguacuccuggaaaucuuggggaaaggcgaagaucaucggcgcugacgugcaaaauacaaccuuuaucaucgacggccccaauaccccggagugcccagaugaucagcgggcauggaauauuugggagguagaggauuauggauucggaaucuucacaacaaauaucugguuaaaacuacgugacagcuacacacaaguaugcgaccaccggcucaugucggcagcaauaaaggacucaaaagcagugcacgcagacaugggguacuggaucgaauccgagaaaaacgagacauggaaauuagcgcgggcaucguucauagaaguuaagacgugcaucuggccaaaaucacacacacucuggucuaacggaguccuagagagugaaaugaucauacccaaaauauauggaggcccgaucucgcaacacaacuaucgcccuggguauuuuacccaaacagccggaccauggcaccucgguaaacuggaacucgacuucgaccugugcgagggaaccaccguagugguagacgagcacugcgggaauagaggaccgucucucagaacgacuacgguaacaggcaaaauaauccacgaauggugcuguagaucaugcacccugccaccacuccgguucaagggagaagauggaugcugguaugggauggaaauccggcccguuaaggaaaaagaagaaaauuuaguuaaaucaauggucucagccgggagcggcgaagucgauucguucagccuagggcuacuauguauaucgauaaugaucgaggagguaaugcgaucuagauggucacggaagaugcucaugacuggaacccuagcgguauucuuccuucugaucaugggucagcuaacauggaacgaccuaauaagacugugcaucauggucggcgccaaugcaagcgaccgcaugggaaugggaacgacguaccucgccuuaauggccacauucaagaugcgacccauguucgcggucggacuccucuuccguagacuuaccucgagagagguauugcuucucaccaucggacuuagccuagucgccagcguggagcucccaaacucacuagaagaacuuggggacgggcuggcaauggggaucaugauacuaaagcugcuaacagacuuccagucccaucaauuaugggccacauuacucucgcuaacauuuaucaaaacaacguucucacugcacuaugcuuggaagaccauggcaaugguuuuaucaauagugagccucuucccccuaugccuaaguaccacgucacagaaaacaaccugguuaccagugcuauuggggucccuggguugcaaaccgcugaccauguuccucaucgccgaaaacaagaucuggggucggaaaagcuggccccucaacgagggcauaauggcagugggcaucgucagcauacuccucucuagcuuacugaaaaacgacgucccacuagcagggccccucauagcgggaggaaugcuaauagcaugcuacguaauauccggaagcagcgccgaccucagccucgaaaaggcggcagaagucaguugggaagaagaggcugaacacuccggcgccucacacaauauacuuguagaaguccaagaugaugggaccaugaagauuaaagacgaggaaagagacgacacguugacaauacugcucaaagcaacccugcucgcaguuaguggaguguacccacuaaguauaccggcaacccuauuugucugguauuuuuggcaaaagaaaaagcaacgaucagggguccugugggauacacccucgccuccagaaguagaacgagcgguccucgacgacggaaucuacagaauaaugcagagagggcuccucggucgcagccaggugggcguuggcguguuccaggagaauguuuuccauaccauguggcacgucaccagaggcgccguucugauguaccaagguaagagacuagagccuucuugggcgaguguaaagaaagaccuaaucucauacggaggaggauggaggcuucaaggcucguggaacacaggggaggaagugcaagugauagccgucgaaccggguaagaaucccaaaaacgugcaaacagcaccaggaacguucaagaccagugagggggaagugggggcgauugcccuagacuucaagccagggacuagcggauccccaaucguaaauagggagggaaagauagucggacucuacggcaacgguguggucaccacauccgggacuuacgugucugcaauagcacaagccaaagccagccaagaagguccguuacccgaaaucgaagacgagguauuccgaaaacgaaaucugacaauaauggauuugcaccccggcucgggcaagacgagacgcuaucucccugccauuguucgcgaagcaaucaaacgcaagcuccgcacauugauacuagcgcccacccgcguuguagcaagcgagauggcggaagcucuaaaaggcaugcccauacgguaccagacgacugccgugaaauccgaacacacaggcaaagagauagucgaucugaugugucaugccacguuuacgaugcggcuucuguccccagugagagucccaaacuacaacaugauaaucauggacgaagcccacuucaccgacccuaguucaauagcggcacgaggcuacauaucaacccgaguaggaaugggagaggccgcagccaucuucaugacagcaacaccaccaggguccguugaggcauuuccccaaucaaacgcugucauacaagacgaggagcgagacauaccggaaagaagcuggaacaguggcuaugaauggaucacggacuuccccgggaaaacgguaugguucgucccgaguaucaaaagcgggaacgacauagcaaacugccuuaggaaaaacgguaaaagaguaauccagcugagcagaaaaacauucgacacagaauaccagaaaacaaagaacaaugacugggacuauguagucacaacggauauauccgaaaugggugccaauuuccgggcggacagaguuauagacccaagaagaugccucaagccagucauauugaaggacggcccugaaagggucauacuggccgggccaaugcccgugacaguggccagcgcagcacaaagaaggggucgcaucggacgcaaccacaacaaagaaggcgaccaauacauuuauauggggcaaccacucaacaacgaugaagaccacgcccauuggaccgaagccaaaaugcuccuggacaacaucaauacaccagagggaaucauaccggcgcuguucgaaccagaacgugagaaaagcgcugccauagauggcgaauacaggcugagaggcgaagccaggaaaacauucgucgaacucaugaggcggggagaucuuccaguguggcucuccuauaaaguagccagcgaaggcuuccaguacucagaucgcagaugguguuuugacggggagcguaacaaccaaguccucgaagagaacauggacgucgaaaucuggaccaaggagggagagcgcaagaaacuaagaccccguuggcuggaugcaagaacguacucggacccccucgcucugcgugaguucaaggaguucgcagccggcaggcgaucaguuagcggagaccuuaucuuggaaaucggcaagcugccacagcacuuaacccagagagcacagaaugcccuagacaaccucgucaugcuacauaacuccgaacaagggggccgagccuaccgacaugcaauggaagaacuuccagauacaauugagacgaugaugcuacuggcccuaauagcgguacucacaggaggggucacccucuucuuccucucagggagaggguugggaaaaacaagcaucggcuuacuaugcgucauggccucguccguccuucucuggauggccagcguggaaccacacuggaucgcagcgagcauuauccuggaguucuuccucauggucuuacugauacccgaaccggauaggcagcggacaccccaggacaaucagcucgcuuauguggucaucgguuuacucuuuaugauccugacuguggccgcaaacgaaaugggucuacucgagacaaccaagaaagaucuaggcaucggccacgucgccguggaaaaccaccaccacgccgcuaugcuugauguggaccuccauccggcuagcgcguggacacucuaugcagucgcaacgacuaucauaaccccaaugaugaggcauacuaucgaaaacaccacugcuaauaucucguuaacagccauagccaaccaagcagcaaucuugaugggccuugacaaaggguggccaauaucaaagauggacauaggugucccccucuuagcccuagggugcuacagccaagucaaccccuuaacgcuuacugcagcaguccucaugcugguagcacacuaugcuauuaucggacccggucugcaggccaaggcaacccgcgaagcucaaaagcgcacagcggccgguauaaugaaaaacccgacgguggaugguauaguggccauagaccuagauccgguaguguacgacgccaaauucgagaaacagcuaggacaaauaaugcuccuaauccuuugcacaagccaaauauuacugaugcgaaccacaugggccuugugcgaguccaucaccuuagcaaccggcccacuuacgacauuaugggaagggagccccgggaaauucuggaauaccacaauagcaguaaguauggcaaauaucuucagagggagcuaccuagccggagcaggacuggcguuuucucugaugaagucacuuggcggcggucggcgugggaccggggcgcagggagagacgcucggggaaaaauggaaacgucaacucaaucagcuauccaaaagcgaguuuaacaccuauaagcgcagcggcaucauggaaguagacaggagugaagcgaaggaaggacuaaaaaggggagaaacgacuaagcaugccguaucgcgagggacagcgaaauuacgcugguucguggaacgaaacuuaguaaagccagagggaaaggucaucgaucugggaugcggacgagggggauggucuuacuacugcgccggccugaagaaggucacggaagugaaaggauacacgaagggcggcccggggcacgaagaaccgaucccaauggcaacuuacgguuggaacuuaguaaagcuccacucggguaaggauguauuuuucauuccacccgaaaagugugauacacucuugugugacaucggggaaucaagcccgaacccaacgaucgaagaggggaggacacuacgaguacuaaagaugguggaaccauggcuaagagggaaccaguucugcauaaagauacucaauccauauaugccgagugugguggaaacccuagagcaaaugcagcguaaacacgggggcauguuagucagaaacccucuaagucggaacucaacacacgaaauguacugggugucuugcggcaccggaaauauagucagugcagucaacaugacaagccgaaugcuauugaaucgcuucacuauggcucacagaaaaccuacauacgagcgagacguggaccuuggcgccgguacacggcacguggcaguagagcccgaggucgccaaccuggacauuauuggacagcgaauagaaaacauaaagcacgaacauaagaguacguggcauuaugaugaagauaacccguauaaaacuugggcguaucacggcuccuaugaaguaaaaccgagcgggucugcaagcucgauggucaacggaguagugaaacuucuuacgaagccuugggaugucauaccaauggugacacagauagccaugacagauacuacgccauucgggcagcagcggguuuucaaagagaaaguugacacacgcacgccaaaggcgaagcgaggcacggcccaaauuauggaagugacggccaaauggcucuggggauuccucagcagaaauaagaagccucggaucuguacacgagaagaguucacaagaaaaguucgcucuaacgccgcgaucggugcaguauucgucgacgaaaaucaauggaacagcgcaaaagaagcggucgaagaugaaagauucugggaccucguacacagggagcgggaacuacacaaacagggaaaaugcgcgacguguguguauaauaugaugggaaagcgcgagaagaagcuaggagaguucggaaaagcgaaaggaucccgagcaauaugguacauguggcugggagcacgcuuccuugaguuugaggcccugggcuuuaugaacgaagaucacugguucucgcgggaaaacucacuuucggguguggaaggggagggacuucacaaguuaggcuauauacuacgagacauaaguaagauaccgggcggaaacauguacgcagaugacaccgcgggaugggauacacgcaucacagaagaugaccuacagaacgaagcgaaaauaacagacaucauggaaccggagcacgcauuacuagcuaaaucaauuuucaaacuuacguaucagaacaagguggucaggguccagaggccagccaagaacggcacaguaauggacgugauaagccguagagaccaaaggggcagcggucaggucggaaccuacggccucaacacauuuacgaacauggaggcccaacucauccgacaaauggaguccgaggggaucuucucaccauccgaacucgagacacccaaccuagcccgaagggugcucgacuggcucgagaagcacggaguggaacgccucaaacgcauggccaucagcggcgacgacugcgucguuaaaccaaucgaugaccgguuugccacagcauugaccgcacucaacgacauggggaaggugagaaaggauaucccacagugggaacccucaaaaggauggaacgauuggcaacaagugcccuucuguagccaucacuuccaccaacuuaucaugaaagaugggcgggaaaucgucgugccgugccgcaaucaagacgagcugguaggacgcgcaagagugucacaaggcgcuggcuggucccugcgugaaaccgccugccuugguaaaucauacgcucaaauguggcaacuuauguauuuccacaggcgugacuuaagacuagcagcgaacgcuauuuguagugccgucccaguagacuggguaccaacaagcagaacaacuugguccauccacgcgcaccaccaauggaugacgacagaagacaugcuaagugucuggaauagggucuggaucgaggagaaucccuggauggaagacaaaacccauauuuccucguggggagacguuccguaccucggcaaaagggaagaccaauggugcggaagccugauugggcuaacggcacgggcaaccugggcaacaaacauacaggucgcgauuaaccagguuagacgacuaaucggcaacgaaaauuaccucgacuauaugacaagcaugaaaagguucaagaacgaaagcgaccccgaaggggcauugugguaa

SEQ ID NO: 24310 - RNA, 9879 nt, Artificial Sequence
  derived and/or modified CDS sequence (opt11) from DENV-1__GQ199799__SS-prME
ucggugaccaugcugcugaugcugaugccgaccgcccuggcuuuccaccugacaacacggggcggggaaccccacaugaucgugucaaaacaggaacggggcaagagccuacucuucaagacaucagccggggugaacauguguacccucaucgcaauggaccucggcgaauuuugcgaggauaccaugaccuacaagugcccgcggauuacggaggccgaacccgaugacguggacugcuggugcaaugcgaccgacacguggguuaccuacggaacuuguagccagacaggugagcaccgccgggacaagcgaucaguggcccuggcgccacacgucggccucggacuagagacgcgcacugagaccuggaugucuagugagggggccuggaagcagauccagagggucgaaaccugggcucugcggcacccuggcuucacggugaucgcccucuuccuggcgcaugccaucggaaccaguaucacucagaaggguaucauuuucauauugcucaugcuggugacgcccuccauggccaugagaugcguuggcauuggcucucgcgacuucguggagggucuaucaggcgccacguggguggacguaguccucgagcacgggagcugcgugaccacgauggcaaaagacaagcccaccuuagauaucgaguugcucaagacggaggucaccaaccccgcggugcuacggaaacugugcaucgaagccaaaaucucuaacacgacaacggacucacgcugcccaacgcagggcgaggcuacacucguagaggagcaagacgccaauuuugucugccggcguaccuucguggacagaggcugggggaacggcugcgggcuguucggcaaggggucucugaucacgugcgccaaguucaagugcgugaccaaguuagaaggaaagaucguccaguacgagaacuugaaguacucugugaucgugaccguccacaccggcgaccagcaccaaguggggaacgaguccacggaacauggcacuacugcgacgaucacuccccaggcucccucaacggagauccagcuaacugacuauggggccuuaacccuagauugcagcccgcggacgggcuuggacuucaacgagaugguacucuuaacaaugaaggaaaaguccuggcuggugcacaaacaaugguuucucgaccugccucugccguggaccagcggggcgagcaccagccaagaaaccuggaaccggcaggaccuccuggugacguuuaagaccgcgcacgcgaagaaacaggaggucgucgugcugggcagccaggagggagccaugcacaccgccuugaccggggccacggagauccaaaccagcggcacaacgacgaucuucgccggacauuuaaagugucgccuuaagauggacaagcucacucugaagggcauguccuaugucauguguacagggagcuucaaauuagagaaggagguggcggagacccagcaugguaccgugcucguccagaucaaguacgagggcaccgacgccccgugcaagaucccauucuccacgcaggaugagaaggggguaacacagaacggccggcugauaaccgccaaccccaucguaacugacaaagaaaagcccgucaacaucgaggcagagcccccuuucggggaguccuauaucgucaucggcgcgggcgagaaggcccugaaacuuucgugguucaagaaggggagcuccauaggcaaaauguucgaggcgaccgcccgcggggcucggcgaauggcgauccucggggacacggccugggacuucggaagcaucggaggcguguucacguccgucgggaagcuggugcaccagauuuucggcacugccuacgggguacucuucagcggcguuagcuggaccaugaagauugggauuggcguacuccugaccuggcugggccucaacagccgcuccacgagccuauccaugaccugcauugcuguaggguuagucacccucuaucugggcgugauggugcaggccgacagcgguugcgucaucaauuggaaggggagggagcugaaaugcgguucagguauauucguaaccaacgaggugcacacguggaccgaacaauacaaguuucaggcggacuccccaaagcgccucagcgccgcaaucggcaaggccugggaggagggggucuguggcauccgguccgcaacccggcuggagaacaucauguggaagcagaucagcaacgaacuaaaccacauccuccuggaaaacgauaugaaguuaaccguggucgucggggacguggcgggcauccucgcucaggggaagaagaugauccggccccaacccauggaguauaaguacuccuggaagucuuggggcaaagcaaagauaaucggcgccgacgugcagaacaccacuuucaucaucgacggaccgaauaccccggagugcccugacgaucaacgugccuggaacauaugggaggucgaggauuacgguuucgggaucuuuaccaccaacaucuggcugaagcugcgggacaguuacacccagguaugugaccaccgacucaugagcgccgccaucaaggauaguaaagcaguucaugccgacaugggcuauuggauugagagcgaaaagaacgagaccuggaaguuggcgcgggcuuccuucaucgaggucaaaaccugcaucuggcccaagagccacacccugugguccaacggcguguuggagagcgagaugaucauccccaagaucuacgggggaccgaucucucaacacaauuaucgacccggguauuuuacgcagaccgccggucccuggcaccuggggaagcuggaacucgacuucgaucuuugcgaaggcacgacaguggucguugacgaacacugcggcaaccgugguccgagcuuacgcacgaccaccgugaccgggaagauuauucaugagugguguugccgguccugcacgcugccgccucuccgauucaagggcgaggacggcugcugguacgggauggagauccgcccggugaaggagaaagaagaaaaccuggucaaaagcauggugagcgcaggguccggcgagguugacucuuucucccucgggcugcugugcaucagcaucaugauugaggaggugaugagaucucgguggagccgcaagaugcuuaugaccggcaccuuggcuguguucuuucugcucauuaugggacaacugaccuggaaugaccugauccggcuauguaucauggucggugcgaacgccucugaccgcauggggaugggcacgaccuaccuggcgcugauggccacguucaagaugcgaccgauguucgcuguggggcuuuuguucagacggcugaccagccgggagguccuccuacugacgaucgggcucucccugguagcguccgucgagcugcccaacucccucgaagaguuaggggacggccuggcaaugggcauaaugauccucaaacuguugaccgacuuucagccccaucaacucugggcgacccugcugagccucaccuucauacgaacgacuuucucccugcacuacgcauggaagacuauggcgauggucuuguccauagugucucucuucccgcuaugcuuaagcaccacaucucagaagacgaccuggcucccgguccugcuugguagccuaggguguaaaccccugaccauguuccugaucgccgaaaacaagauuuggggccguaaguccuggccccucaacgagggcauuauggcugucggcaucgugagcauccuccuguccucccuccugaagaacgaugucccccuggccgggccgcuaaucgccggcggaaugcugauagcaugcuacgugauaagcggcuccagcgcagaucugucccuugaaaaggccgccgaaguguccugggaggaagaggccgagcacuccggagcgagccacaacauccuggucgagguccaagacgacgggacgaugaagaucaaagacgaggagcgcgacgacaccuugaccauccuucugaaggccacgcugcucgccguguccggcguguacccgcuguccauccccgcuacgcuguucguaugguacuucuggcagaaaaagaaacagcgauccggggugcuuugggauacucccucgccgcccgagguugagcgugccguucuggaugauggcaucuaccguaucaugcagcggggccugcugggccggucccaggugggcgugggugucuuccaggagaacguguuccacaccauguggcacgugacccggggugcggucuugauguaccaggggaagaggcuggagcccaguugggccuccgugaagaaagaucuaaucucguauggcggcggguggcgccuucaaggcuccuggaacaccggagaggagguacaggucaucgccguggagccuggcaaaaacccgaaaaacgugcagacggcgccugggacguucaagaccagcgagggcgaaguuggagccauagcacuggacuuuaaaccggggaccucggguagcccuaucgugaaccgggaggguaagaucguggggcuguacggaaacggaguugugacgaccuccggcacuuacguguccgccaucgcccaggccaaggcgagccaggaggggccgcuccccgaaaucgaggacgaggucuuucgcaagcggaaccucaccaucauggaccugcaccccggcuccgguaagacgaggcgguaucuuccggcaaucgugcgcgaggccauaaaacggaggcuccggacccugauccucgcccccacucgcgucgucgccagcgagauggcggaggcccugaaggguaugcccauuagguaucagacaacggccgugaaguccgagcacaccggcaaggaaaucguagaccugaugugccaugccaccuucaccaugcggcuacuuagccccguccgcgugccgaauuacaauaugaucaucauggaugaggcacacuucacggaucccucuucuaucgcggcgcggggguacaucuccacccggguaggcaugggggaggcagccgccaucuucaugaccgcgacgccgcccggcagcgucgaggccuucccacaguccaacgcggugauccaggacgaagaacgggauauccccgagcgcagcuggaacuccggguacgaguggauuaccgacuuccccggaaagaccgugugguuuguucccagcaucaaguccggcaacgacaucgcaaacugccuucggaagaacgguaagcgcgugauucagcucagcagaaaaaccuucgacacagaguaccagaaaaccaaaaauaacgauugggacuaugugguuacaacugacauauccgagaugggcgcgaacuuccgagccgaccggguuauugacccgcgccggugccugaagccggugauacugaaggacgggcccgagcgcguuauccucgccggccccaugccggugaccgucgccagcgcggcgcagcggcgcggacggauuggccggaaucacaacaaggagggcgaccaguauaucuauaugggucagccccucaacaaugaugaggaccaugcgcacuggacggaggcgaagaugcuucucgacaacauuaacaccccggagggcaucauccccgcuuuauucgagccugaaagagagaaaagugcggcgaucgacggggaguaccguuugcgcggcgaggcccggaagaccuucguggagcucaugcgccgcggggaucugccuguguggcuaagcuacaaagucgcaucugagggcuuccaguacuccgaccgccgauggugcuucgacggcgagcgcaacaaccaaguccuugaggaaaacauggacguugagauuuggaccaaggagggcgagagaaagaagcugcgaccccgguggcuggacgccaggaccuacucugauccccucgcccugcgggaguucaaggaguuugcggccggccgccguucgguaagcggugaccugauccucgagaucggcaagcucccgcagcaccugacccaacgcgcccagaacgcccucgacaaccuagugaugcugcacaauuccgagcagggcgggcgggcguaucggcacgccauggaggagcuccccgacaccauagagacccugaugcuguuggccuugaucgccguauuaacggguggugugacccuuuucuuccugagcggccgggggcugggcaagaccuccaucggacuccucugcguaauggcuagcucugucuugcucuggauggcuaguguugagccccacuggauugcggccagcaucauccucgaguucuuccugauggugcuccugauccccgagccagaccgccagagaacgccccaggacaaccagcucgcuuauguggucauaggucugcuguucaugauccugacgguggcggcgaacgaaaugggcuuacuggagacgacaaagaaggaccuugggaucggccacguggccgucgagaaccaccaccaugccgcaaugcucgacguagaccugcacccugcgagcgcguggacccuuuacgccguggcgaccacgauuaucacaccgaugaugagacauaccauagagaacaccacggccaacaucucccucacugccaucgcgaaccaagccgccaucuuaaugggucuggacaagggguggcccauuucuaagauggacaucggcguaccccuccuagcccuggggugcuacucucaagugaacccgcucacccugacggcggcagucuuaaugcucgucgcccacuaugccaucauaggucccggguugcaagcgaaagcgacgcgcgaggcccagaagcggacggcagccggaaucaugaagaaccccacuguggaugggaucguggcgaucgaccuggaccccgucguguacgacgcgaaauucgagaagcagcucggccagaucaugcuacugauauugugcacuagccaaauccuacugaugcgcacgacuugggcccuuugcgaguccauuacccucgccaccggccccuuaacgacccucugggaggggagcccgggcaaguucuggaacaccaccaucgccgugucuauggcgaacauuuuucgggggucguaucuggcgggagccggccuggccuucagccucaugaaguccuugggcggagggcgccgggggacgggggcgcagggcgagacccugggcgaaaaauggaagcgccagcucaaccaguuaagcaaguccgaguuuaacaccuauaaacggucugguaucauggaggucgaccgcuccgaggcgaaggagggauuaaaacgcggcgagaccacgaagcacgcgguuucccgcggcacagccaaacuccggugguuuguggagcgcaaccugguuaagccggaggggaaaguuauagaccuggggugcggccgcggcggguggagcuacuacugcgccgggcugaagaaagucaccgaggucaaaggguacacgaagggcgggcccggacaugaggagcccaucccgauggcaacguacggguggaaccucguaaagcugcacaguggcaaggacguauuuuucaucccgcccgaaaaaugcgauacccuccuaugcgauaucggggaguccagccccaacccgacaaucgaggagggccguacccuucggguccugaagaugguggagcccuggcuacgcgggaaccaguucugcaucaagauccugaauccuuauaugcccuccguggucgagacccuggagcaaaugcagcggaagcacgguggcaugcuagugcguaauccguugagccggaacuccacccacgagauguauuggguaagcugcgguaccgguaacaucgucuccgcggugaacaugacuagccgcaugcugcucaaccgguucaccauggcccaccggaagccaaccuacgaacgcgauguggaccugggggccgggacccggcacgucgcaguugagccggagguggccaaccuagacaucaucggccagagaaucgaaaacaucaagcaugaacauaaauccaccuggcauuacgacgaggacaaccccuacaagaccugggcguaccacgggucuuaugaggugaagccgagcggcagcgccagcuccauggugaacggggucgugaagcuccugacgaagccaugggacguaauccccauggugacccagaucgcgaugaccgauacgacgccguucggccaacagcgggucuucaaggagaagguggacacgcgcacaccgaaggccaagagagggaccgcccagauaauggaggucaccgcgaaguggcucuggggcuuccucucacgcaacaagaaacccagaaucugcacccgcgaggaguucacacggaaagugcgcuccaacgccgcgauaggcgccguguucgucgacgagaaccaguggaacagcgcgaaggaggccguggaagacgaacgguucugggaccugguucaccgcgagcgggagcugcacaagcaaggaaaaugcgcaaccugcgucuauaauaugaugggcaaacgcgagaagaaacucggggaguucggcaaagccaaggggucucgggccaucugguacaugugguuaggcgcccgguuucucgaguucgaggcgcucggcuucaugaacgaggaccacugguucagccgggaaaauagccuuagcggggucgagggggagggccugcacaagcucggcuauauccugagggacauaucaaagaucccagggggcaacauguacgccgacgacacugccggcugggacacacggaucaccgaggacgaccuacagaaugaggcaaagauuacggacaucauggaaccagagcacgcucucuuggccaagagcaucuucaagcugaccuaccagaacaaggugguucgcgugcagcgcccugccaagaacgggaccgugauggacgucauuucccggcgugaucagagagguagcggccaaguaggcaccuacggccucaacacuuucacgaacauggaagcgcagcucauccgucaaauggaaagugagggcaucuucucacccucggaacucgagacucccaaucuugcagggcgcguucuagacuggcuggagaaacauggugucgaacgccucaaacggauggcuauaaguggugaugacugcguagugaaaccgaucgacgaucgcuuugcgaccgcucuuacugcccugaacgacaugggcaagguccggaaggacaucccccaaugggagcccucgaagggauggaacgauuggcaacagguccccuucuguagccaccauuuccaccagcucaucaugaaggacggccgcgagauagugguuccgugccguaaccaggacgagcuggucgggcgcgcacgggugagucagggcgcgggguggucccugcgugaaacggcaugucucggcaagagcuaugcccagauguggcagcugauguauuuucacagacgcgacuuacggcucgccgcaaacgccauaugcuccgccguccccguggacugggugccuaccagccgcaccaccugguccauccacgcccaccaccaguggaugacgaccgaggacaugcugagcguuuggaaccgaguguggauugaggagaaccccuggauggaggacaagacccacguaucuucuuggggcgacguuccauaccuggguaagcgcgaggaucagugguguggcucgcucaucggucugaccgcgcgcgcgaccugggcuaccaacauccagguggccaucaaccaagugcggcgccugcucgggaacgaaaacuacuuggacuacaugaccagcaugaagcgguucaagaacgaguccgauccggagggggcccuaugguga

SEQ ID NO: 24311 - RNA, 9879 nt, Artificial Sequence
  derived and/or modified CDS sequence (opt11) from DENV-1__GQ199800__SS-prME
ucaguaaccaugcuguuaaugcugaugcccaccgccuuagccuuccacuugacgaccagagguggggagccccacaugaucguguccaagcaggagcggggcaagagccugcuguucaagaccuccgccggugugaacaugugcacccuuaucgccauggacuuaggcgaguucugcgaggacaccaugaccuacaagugcccgcgcauuaccgaggccgaaccagacgaugucgacugcuggugcaacgccaccgacacaugggucaccuacgggaccuguagccagaccggugagcacagacgggacaaacggucgguggcucuggcgccccacgugggccuggggcuugagacacgcacggagaccuggaugucauccgagggcgccuggaaacaaauccaacgugucgagacgugggcacugcgccaccccggguucacagugaucgcccuuuuccuggcccacgcuaucggcacuuccaucacccaaaaagggaucaucuucauucuucucaugcuggucacccccucuauggccaugcgcugcgucggcaucggcagccgcgauuucgucgagggucuauccggcgcgacguggguagacgucgugcucgaacacgggagcugcguuaccacgauggccaaggacaaaccgacucuugacauagagcugcuaaagaccgaggucaccaaccccgcgguucugaggaagcugugcaucgaggccaagaucucuaacaccaccacggauucccgcugcccgacacagggcgaggccacguugguggaggagcaagacgccaacuucgucugucggcgaacguucguggaccggggcugggggaacggcugcgggcuguucgggaaggguucccucauuaccugcgccaaguucaagugcgugaccaagcucgagggcaaaaucguucaguacgagaaccugaaguacucugugaucgugaccguccacaccggggaccagcaucagguggggaaugaguccacggagcacggaacgaccgcaaccaucacgccccaggcccccagcacagaaauccaauuaaccgacuacggggcccucacacuggacugcagcccccggaccggccuggacuucaacgaaaugguucuccugacgaugaaggagaaguccuggcugguccauaagcagugguuccucgaucugccgcugccauggaccagcggggcuucaaccagccaggagaccuggaaccggcaggacuugcuugugacguucaagaccgcccacgcgaaaaagcaggaagucgugguucugggcucccaggagggggccaugcacaccgcccucaccggagccacggaaauccagaccagcggcaccacgacgaucuuugccggacaccuaaagugccgccuuaagauggacaagcucacccugaaaggcaugaguuacgucaugugcacagggucguucaagcuggagaaggagguggcagaaacucaacacggcaccgugcucguccagaucaaguacgagggcaccgacgcaccaugcaagauaccauuucugacccaagacgagaagggggugacccagaacggccggcugauuacggcaaacccgaucgucaccgacaaggagaagcccguuaacaucgaggcugaaccacccuucggggagaguuacaucgugaucggcgcgggcgaaaaggcccucaagcucucaugguucaagaaaggguccagcaucggcaagauguucgaagcaaccgcgaggggggcgcggaggauggcaauucuaggcgacaccgcuugggacuuuggguccaucggcgggguguucacgagcgucggcaaacugguucaccagauuuuuggcaccgcguacggggugcuguucuccggagucucuuggaccaugaaaaucgggauuggcgugcugcugacgugguuaggccugaacagccgcagcacgucccugagcaugaccugcaucgcgguggggcucgucacccuguaucugggugugauggugcaggccgacuccgggugcguuaucaacuggaagggccgggagcuuaagugcgggagcgguaucuucgugaccaaugagguccacaccuggaccgagcaguacaaauuccaggcggacucaccaaagaggcuauccgccgcuaucggcaaggccugggaggagggggucuguggcauacgaucagcgacccgccuggagaacaucauguggaaacagauuuccaacgagcuaaaucacauccugcuagagaacgacaugaaauucaccgugguugucggcgacguggcgggaaucuuagcccaggggaagaaaaugauccggccccagcccauggaguauaaauacucauggaaguccuggggcaaggccaagauuaucggcgcugaugugcagaacaccacguucauaaucgacgggccuaauaccccugagugucccgacgaccagcgggcguggaacaucugggaggucgaggacuacggcuucgggaucuucaccacgaacauuugguugaagcugcgggacagcuauacccaggucugcgaccacaggcucauguccgccgccaucaaggacagcaaggccguccacgcggacaugggcuacuggaucgaauccgagaagaacgagaccuggaagcuggcgcgggcgagcuucaucgaggucaagaccugcauuuggccaaagucccauacccuguggagcaacggcguacucgaguccgagaugaucauccccaagauuuacggcggcccgauaagucagcacaacuaccgcccgggguacuucacgcagacggccggccccuggcaccugggaaagcuggaguuagacuucgacuuaugcgagggcaccaccguggucguggacgagcacugcggcaaccgcggcccgucucugcgcacgaccaccgugacuggcaagaucauacacgaguggugcugccgcagcugcacgcugccgccccuccgcuuuaagggggaggacggcugcugguacgggauggaaauccggcccgugaaggagaaggaggagaauuuggugaaguccauggugagugcaggcagcggcgaagucgacuccuucagccuugggcuguuaugcaucagcaucaugaucgaggagguaaugcgcucucgauggucccgaaaaaugcucaugaccggcacccuggcuguuuucuuccuacucaucauggggcaguuaaccuggaacgaucugauucgguuauguaucauggucggagccaaugccagcgaccguaugggaaugggcacgacguaccuggcccugauggccacuuucaagaugcgcccaauguucgccgucgggcuccucuuccggcgccugacgagucgggaggugcucuuacugacaaucgggcuaagccuggucgcgagcguagagcuucccaacagccucgaagagcuaggcgaugggcuagccaugggcaucaugauccucaagcugcugaccgacuuccaaucucaccagcucugggccacccugcugagcuuaacguuuaucaagacgacauucucccuacacuacgccuggaagaccauggcgaugguucugagcauagugucccuauucccuuuaugccucagcaccacgucucaaaaaaccaccuggcuccccgugcuccugggcucucucggguguaagccguugaccauguuccuaaucgccgagaacaaaaucuggggccggaaguccuggccacucaaugaggggaucauggccgucggaaucgugaguauccugcugagcucccuccugaagaacgacgugccucuggccggcccucucauugccggcggcauguuaaucgcgugcuaugucaucagcgggucaagcgccgaccugagucuagagaaggcugcggaagugagcugggaggaggaggccgagcacuccggugcuucgcacaauauccugguggagguccaagacgaugguacgaugaagauaaaggacgaggagcgggacgacacucugaccauccuccugaaggccacgcugcucgccgugucaggcguguacccgcugucgauccccgccacgcuguucgucugguacuucuggcagaaaaagaagcagcgcuccggggugcucugggauacuccaucuccgccugagguagagcgggccguauuggacgaugguaucuacaggaucaugcagcggggccuguuggggcgcucccaggugggcgugggggucuuccaggaaaacguuuuccacacuauguggcaugugacuagaggcgcaguucucauguaccaggggaagcgcuuagaacccuccugggcguccgugaagaaggaccugaucagcuauggggggggguggcggcuccagggcuccuggaauacgggggaggaggugcaggucaucgcuguggagccuggcaagaaucccaagaacgugcagacggcccccgggaccuucaagaccuccgagggagagguuggcgccaucgcgcuggacuucaagccugggaccuccggcagccccaucguaaaccgcgaggggaaaauagugggccuauacggcaauggggucgugacgacaucuggcacauacguguccgccauugcgcaagccaaggcgagccaggaggggccgcucccggagaucgaggacgagguguuccggaaacgcaaccugaccaucauggaucuucaccccggcuccggaaagacacggcgauaucuccccgccaucgugagagaggcaaucaaacgcaagcugcgaacccugauccuugccccgacccgcguggucgccagcgagauggcugaggcucuaaagggcaugccuauccgcuaccagaccacggccgucaaguccgagcacacuggcaaggagaucguggaucugaugugccacgccacguucaccaugcgccuccugagccccguccgcgugcccaacuacaauaugaucauuauggacgaggcccauuucacggacccguccagcaucgcggcccggggguacaucuccacccgggugggcaugggggaggcugcagcgaucuucaugaccgcgacgccacccggcagcgucgaggcauucccccaguccaacgcggugauccaggacgaggaaagggacaucccggagcgcagcuggaacuccggauacgaauggauuacugauuuccccgguaagaccgugugguucguucccagcaucaaguccggcaacgacaucgccaacugcuuacggaagaacggcaagcgcgugauccagcucucacgcaagaccuucgacaccgaguaccagaagacgaagaacaacgacugggacuacguggucaccacggauauauccgagaugggggcgaacuuuagagccgaccgggugaucgacccccgccggugucugaagccgguuauccugaaggacggccccgagcgcguaauccucgccggcccaaugcccgugacugucgccagcgccgcacagcggcgcgggcggaucggucgcaaccacaauaaggagggagaucaguacauuuacauggggcagccgcugaacaacgacgaggaccaugcccacuggacggaggcaaagaugcuguuggacaacaucaacacccccgaggggaucaucccagcccuguucgagcccgagcgcgagaaguccgccgcgauugacggugaauaucgccuacgcggcgaggcuaggaaaaccuucguagagcugaugcgccguggggacuuaccaguguggcucagcuacaaaguugcaagcgaaggcuuccaguacuccgaccgccgguggugcuucgacggcgagcgcaacaaccaggugcucgaggaaaacauggacguggagauuuggacgaaggagggggagaggaaaaaacugcgcccgcggugguuagacgccaggaccuauagcgacccccucgcccucagggaguucaaggaguucgcggccgggcgcagguccgucagcggagaccucauccucgagaucggcaagcugccccagcaccugacgcagcgcgcccagaacgccuuagacaaccuggucaugcuucauaacucagagcagggcgggcgagcguaccgccacgccauggaggaacucccggacaccauugagaccuuaaugcugcucgcccugauugccgugcucacgggcggggucacccuuuucuuucugaguggccgcggacuggguaagaccucuauagggcuacugugcgugauggccagcuccguccugcucuggauggcgagcgucgagccccacuggaucgcggccuccaucauccuggaguucuuccugaugguguugcugauccccgagcccgauaggcagaggaccccgcaggacaaccagcucgccuacgugguuaucggguuacuguucaugauucugaccguggccgcgaacgagaugggccuccuugagacgaccaagaaggaucuggggauuggucacguggcgguggagaaucaucaccaugccgccaugcucgacguagaccugcaccccgccagcgcguggacuuuauacgccguggccaccacgaucauaacccccaugaugcgccacaccaucgagaacaccacggccaacaucagucucaccgccauugcgaaccaagccgccauacugaugggucuggauaaaggcuggccuaucagcaagauggacaucggcgucccccuccuggcccuagggugcuacucccaggugaauccccucaccuuaaccgcggccgugcucaugcucgucgcccacuacgccaucauaggcccaggacugcaggccaaggccacgcgggaggcacagaagcguacugccgccggcaucaugaagaacccuaccgucgacggcaucguugcgaucgaccuggaccccguuguguacgacgcuaaauucgagaagcagcucggucaaaucaugcuccugauucucugcaccagccagauucuccugaugcgcacgacgugggcgcucugcgaguccaucacgcuggcgacaggcccccugacgacccucugggaagguuccccggggaaguuuuggaacaccacuaucgcagugagcauggccaacaucuuccgggggaguuaccuggcgggcgccggccuggccuucagccucaugaagucacuaggcggcgggcgccgcgggacgggcgcccagggagaaacccugggcgagaaguggaagcgccaacucaaccagcugucaaagucugaguucaacacguacaagcguucuggaaucauggaggucgaccgcucagaggcgaaagagggcuuaaagcgcggagagaccacgaagcacgccgugagucguggcaccgcaaagcuccggugguuuguugagcguaaccuggucaagcccgagggaaagguaaucgaccugggcugcgggcgcggggggugguccuacuauugugcgggguugaagaaggugacugaggucaagggauacacuaagggcggucccggucacgaggagcccauucccauggccacguacggcuggaaccucgugaaacuucacagcggcaaggacguguuuuuuaucccaccugaaaagugcgacacucugcucugcgacaucggggaaaguagccccaaccccacaaucgaggagggccgcacucugcggguucucaaaaugguggagccguggcuccgugggaaccaguucugcaucaagauucugaauccuuacaugcccuccguggucgagacacuggaacagaugcagagaaagcauggcggaaugcucgugagaaacccccugagcaggaacuccacccacgagauguacugggugagcugcgggaccgguaacaucguguccgcaguaaauaugacaagcaggaugcugcucaaccgguucaccauggcccacaggaaaccuacguacgagcgugaugucgaccugggggccggcacgcggcacguagcgguggagcccgagguggccaaccuggacaucaucgggcagcgcauugagaacaucaagcacgagcauaaguccaccuggcacuacgacgaagacaaccccuacaaaaccugggcguaucacgggagcuacgaggucaagcccuccggcucggcaagcucuauggucaacggggucgugaagcugcucacuaagccgugggacgugaucccgauggugacccagaucgccaugaccgacacuacucccuuuggacagcagcggguguucaaggagaaggucgacacccgcacuccuaaggcaaagcggggcaccgcccagaucauggaggucacggcgaaguggcuguggggauuccuuucgcgcaacaagaagccgcggaucuguacacgcgaagaguuuaccaggaaagugcgcuccaacgccgcaaucggcgcaguguucguugacgaaaaccaauggaauagcgcgaaggaggccguggaggacgagcgguucugggaccuggugcaccgggagagagagcugcacaagcaggggaagugcgcgaccugcgucuacaacaugaugggcaagagagagaagaagcugggggaguuuggaaaagccaaggggucccgggccauuugguacaugugguuaggcgcccgcuuccuggaguucgaggcccugggguucaugaacgaggaucacugguuuagccgggagaacucccuguccgguguggagggcgagggucugcacaaacucggcuacauacugcgcgauauuuccaagauccccgggggcaacauguacgccgacgacacagccggcugggauacccguaucaccgaggacgaccugcagaacgaggccaagauaaccgauaucauggagcccgagcacgcgcuccuggcgaaaucaaucuucaaacugacguaccagaacaaggucguccgcgugcagcgcccugcaaagaacgggaccgugauggacgucaucucccgucgcgaccagcggggcagcggccagguggguaccuacggccuaaauaccuucacaaacauggaggcacaguuaaucagacagauggaauccgaggggauuuucucccccuccgagcuggagacccccaaccucgcgggccggguccuggacuggcuggagaagcacgggguggaacgccucaagcggauggcgaucagcggcgacgacugugugguaaagcccaucgacgaccgcuucgccaccgcccugacggcucugaacgacaugggaaagguccggaaggacaucccgcagugggagccgagcaagggcuggaacgauuggcaacagguccccuucugcagccaccauuuccaccagcuaauaaugaaggacggccgcgagaucgugguccccugccggaaccaggacgagcuaguggggcgggcuagaguaagucagggcgcggggugguccuuaagagagacggcgugucucgguaaaagcuacgcccagauguggcagcuaauguacuuccaccggcgcgaccugcggcucgccgccaacgccaucuguuccgccgugccgguggacugggugcccaccagccgcaccaccugguccauccacgcucaccaccaguggaugacgaccgaggauauguugucggucuggaaccgcguguggauagaggagaaccccuggauggaggacaagacccacauauccagcuggggagacgugcccuaccuagguaaacgcgaagaccaauggugcgggucucucaucgggcugacggcccgggcgacaugggccacuaacauucagguggccaucaaccagguacgacgccugaucggcaacgagaacuaccucgacuacaugacuagcaugaaacgguucaagaacgaguccgauccugagggugcccugugguga

SEQ ID NO: 24312 - RNA, 9879 nt, Artificial Sequence
  derived and/or modified CDS sequence (opt11) from DENV-1__FJ882548__SS-prME
uccguaacaaugcucuugaugcugaugccuacggcguuagccuuucaucucacaacgagagggggagaaccucacaugauagugucaaaacaagaacgcggaaaauccuugcuguucaaaaccagcgcgggcguaaacaugugcacccuuauagcuauggauuuaggagaacugugcgaagauacaaugacauacaaauguccccgaaucacggaagcggaaccggaugacguagacugcuggugcaaugccacagacacgugggugaccuacggaacuuguucacaaacgggcgaacaucgacgagacaaaagaagcguugcccuggcgccccauguaggccuggggcuggaaacgcgcacagaaacauggaugagcagcgaaggcgcauggaaacaaauacagcguguugaaacaugggcgcuacgacacccuggcuucacgguaaucgcgcuauuuuuagcacacgcaauugggacgucgauaacccaaaaaggaaucaucuucauacuauuaaugcuagugaccccaagcauggcgaugcguugcguggggaucgggagcagggacuucgucgaaggacuuuccggagcgacauggguagacguaguccuggaacauggcagcugugugacaacaauggccaaagacaaaccaacccuggacaucgaauuauuaaagacagaagucacgaaccccgccguccuucggaaacuaugcauugaagcgaagauaaguaacaccacaacagacagucgcugccccacacagggcgaagcuacacuuguagaggaacaggacgcgaacuucgucugccguagaacuuucguugaucgaggauggggaaacggauguggucuguucggaaagggaucacuuaucacaugcgcaaaauuuaaaugugucacgaaacuagagggaaaaauaguccaguacgaaaaccuuaaauacagcgugaucgugacgguucacaccggugaccagcaccaaguaggcaacgagucgacugaacacgguacaacggcuaccaucaccccgcaagcgccaacuacggagauacaacuaacugauuacggagcccugacgcuagacugcagcccacgaacaggacucgacuucaaugagauggugcuccuaacgaugaaagagaaaucauggcuaguacacaaacaaugguuucuggaucugccacuacccuggacuucgggggcgucgaccagccaagaaaccuggaaccgacaggaccuacucgugaccuuuaagacggcccacgcuaagaaacaggaggucgucgugcuggggucacaggaaggagcaaugcacacugcgcugacaggcgcgacggaaauacagacgagcggcacuacgaccaucuucgccggccaucucaaaugccgccuuaagauggacaaacuuacacugaaaggaaugucuuacgugaugugcacgggcagcuuuaaacuggagaaagaaguagcugagacccaacaugguacaguccuaguccaaauaaaguacgagggcacggacgcgcccugcaagauuccguucuccacccaagacgaaaagggggucacccaaaacggaagauugauaacagcaaauccgauugucacggacaaggaaaaacccgugaauaucgaggcagagccgccauuuggggagucauacauagugaucggagcaggcgaaaaggcacucaaacuaagcugguuuaaaaaggguaguuccauagguaaaauguuugaagcgacagcccgcggcgcacggaggauggccauacugggcgacacagcaugggacuucggcucgaucggcggaguguucaccuccgucggaaaacuaauacaucaaaucuucgggacagcauacggggucuuauucucaggcguguccuggacuaugaaaaucggcauuggcguacuguuaacauggcugggacugaacagucguagcacuagccuaagcaugacgugcauagcggugggucuaguaacccucuaccucggcgucaugguccaagcggacagcggguguguaauaaacuggaaagggagggaacuaaaaugcggcuccggaaucuucgucacgaaugaaguccacaccuggacggaacaguacaaauuucaagcagauagcccgaaacgacuauccgcggccaucggcaaggcuugggaggagggugucugcggcauacgaucugcaacgcggcuagaaaacauaauguggaaacaaauaagcaacgaacuuaaucacauccuucuagaaaacgacaugaaguuaaccguaguaguaggcgaugucgcgggcauacucgggcaagguaagaaaaugauucgaccgcagccaauggaauacaaauacagcuggaaaucauggggaaaagcaaagaucaucggggcggacgcucagaacaccacauucauaaucgacggaccaaauacaccggaauguccggacgaccaacgcgcauggaacauaugggaaguagaggauuaugguuucggaaucuucaccacaaauaucuggcuaaaacuucgggauagcuacacgcaagucugcgaccaccgccucaugagcgccgcaauuaaggacaguaaagcaguacacgcagacaugggauacuggaucgagagugaaaagaaugaaacguggaagcuggcccgagcauccuucauugaggucaagacgugcauuuggcccaagagucacacgcuauggagcaauggcguacuggagagcgaaaugauaauucccaaaauauacggcggaccuauaagccaacacaacuauagaccggguuacuucacccaaacagcuggccccuggcaccuagggaaacucgaguuagacuucgaccugugugagggcacaaccguagucguagacgagcacugcgggaaucggggccccagccuacguacaacuacugugacgggaaaaaucauacacgaguggugcugccgaagcuguacgcuacccccgcucagguuccgcggcgaggacggcuguugguauggaauggaaauccgcccagucaaggaaaaggaagaaaaccuaguaaaaagcaugguaagcgccggauccggagaaguggacuccuucagcuuaggacuacugugcaucagcauaaugauagaggaagugaugagaucucgauggucacgaaaaaugcucaugacaggaacgcucgccguauucuuccuucucauaauggggcagcucacuuggaacgaccucaucagacuaugcauaaugguaggugcuaacgcguucgaccguauggguaugggcacgaccuaccuagcucugauggcgaccuuuaaaaugagacccauguuugcggucgggcuccuauucagaagacuaacuucacgagagguacugcuacugaccauuggacugagccuugucgcaucggucgaacugccuaacagccuugaagaacugggagaugggcuggcaaugggaauaaugaucuuaaagcuacuaaccgacuuccagucacaccagcuuugggcaacccugcuuagccugacauucauuaaaaccacguucucgcuucacuacgccuggaaaaccauggcuauggucuugagcaucguaucucuauugccacucuguuuaucaacgacaucccagaaaaccacauggcugccggugcugcuggggucccuaggcugcaaaccccuaacaauguuucugauagccgagaacaagaucuggggccggaaaagcuggccccugaacgaggggauuauggccguuggaauugugagcauacuccuaagcucauuacugaagaacgacguaccccuggcggggccucucaucgcagggggcaugcuuauagccuguuacgucauaagugggucgagcgccgaccuuucccuggagaaagcugccgaggucucaugggaggaggaagcagaacacagcggcgcgucacacaauauccucguggaggugcaagacgacgguaccaugaagaucaaggacgaggagcgagacgauaccuuaacaauccuccugaaggcaacacucuuagccgucucgggcgucuauccacucuccauacccgcgacgcuauucgucugguauuuuuggcagaagaagaaacaaagaucaggaguccuaugggacacaccaucaccuccggaagucgaacgagcggucuuggacgacggaauauaccgcauuaugcagaggggccuauuaggacggagccaaguggggguaggcguauuccaagagaaugucuuccacaccauguggcacguaacgcgaggggcaguguugauguaccaagggaagagauuagagcccagcugggcaagugucaagaaagaccucauuuccuauggagggggcuggagacuacgaggaagcuggaacacuggggaggaaguucagguaaucgcagucgagcccggcaaaaauccgaaaaacguucagaccgcgccggggacauucaaaaccccagagggcgaagugggcgcaaucgcgcuagacuucaaaccagggacauccgggucccccauugucaaccgggaaggcaagauagucggacuauacggcaacggagugguaacaacuucuggaaccuacguuucagccauagcgcaggccaaagccucacaggaaggcccacuacccgagauagaagaugaggucuuuaggaagcgaaaucugacuaucauggaccugcauccuggcagcggcaaaaccaggcgcuaccuaccagcgaucguacgcgaggcaauuaagcgaaagcugcgaaccuuaauccuugcaccaacacgugugguagccuccgagauggccgaggcgcugaaaggaaugccaauucgcuaccagacaacggcagugaaaagcgaacacacugggaaagagaucguagaccugaugugccacgcgacguucaccaugcgccugcuaagcccgguacgagucccaaauuauaauaugaucauuauggacgaagcgcauuucacagaccccagcagcaucgcagccagaggauacaucagcacaagagugggcaugggggaagccgcagcaaucuucaugacugccacgcccccgggaucagucgaagccuucccccaguccaaugcggugauacaagacgaagaacgagauaucccugaaagaucuuggaacucaggccacgaauggauaacagacuuuccagggaaaacggucugguuuguccccagcauuaaaucgggaaacgauauagccaacugcuugcggaaaaacggcaagcgaguuauucaacuaagcagaaagacauucgacacggaauaccaaaagacgaagaacaacgauugggacuacguggucaccaccgacaucucggaaaugggagcaaacuuucgcgcggaccgagucaucgacccgagaaggugcuugaaaccgguaauauugaaagauggccccgagagagugauccuggccgguccgaugcccgugacugucgcaucggcagcacaacggcggggacggaucggucgaaaccacaacaaggagggagaucaauacaucuacaugggacagccacuaaacaacgaugaggaccacgcccacuggaccgaagcgaaaaugcuccuggauaacauaaacacaccagagggaaucauaccugcacucuucgaaccagaacgagagaaaagcgcugccguagauggggaauacaggcuuagaggagaagcaagaaaaacguucgucgaauuaaugcgacggggcgaccugccgguauggcucagcuacaagguagccuccgagggguuccaauauucagaccgcagauggugcuucgacggcgaacggaacaaccagguauuggaagagaacauggacguggaaauauggacaaaggaaggcgaaagaaagaaacugcgaccgcgaugguuagacgcgagaacuuauucugacccacuagcguugcgagaguucaaagaguucgccgcaggccggcgcuccgugagcggagaucuaauacuugaaauagggaaacuaccacaacaccugacgcaacgcgcacaaaaugcccucgacaaccugguaaugcuccacaacuccgagcaaggcggccgagccuaccgccacgccauggaggaauuaccagacaccauugaaaccuugaugcugcuagcacucauagcgguacugaccggugggguaacguuauucuuccucaguggccgaggacucgguaaaaccucuauaggauugcucugcgucauggccagcagcgucuuacucuggauggcgucaguagagccgcacuggauagccgcaaguauaauccuagaguucuuccugaugguuuugcugauaccugagccggauagacagcgaacgccgcaagauaaccagcuagcguacgucgucauaggacuccuguuuaugauacucaccguugcggcgaaugaaaugggauugcucgaaacgacgaagaaagaccucggaauaggucacguggccgucgaaaaccaucaccaugcagccaugcucgauguggacuugcaucccgcgagcgccuggacccucuacgcaguagcgacuacaauaaucacgccgaugaugcgccacacaauagaaaacacgacggccaacauaagccugacugccauagcuaaucaggccgcgauacuaauggguuuggacaaagguuggccaaucucaaagauggacauaggcgugccgcuccuggcacucggcugcuauagucaaguaaauccgcugacgcugaccgcagcuguacuaaugcuaguagcgcacuacgcaauaaucgggccaggacuucaagcgaaagcaacgcgugaggcgcagaaaagaacagccgcagguauaaugaagaacccgacagucgacggaauaguagcaauagaccuagacccaguagucuacgacgccaaguucgaaaagcaacuaggacagauaauguugcuuauauuaugcacgucccagauccuacuuaugcgcacgaccugggcccuaugugaaucaauaaccuuggcaacgggaccgcucaccacgcuuugggaaggcuccccagggaaguucuggaacaccacuauugccgucagcauggcgaauaucuuucguggcucauaccucgcgggcgccggucucgcuuuuagccuaaugaaaucguuagggggagggaggcggggaacgggugcacagggagagacacugggcgagaaauggaagaggcaacucaaccaacugagcaagucagaguucaauaccuauaagcgcucagggauaauggagguggaccggucagaagcgaaggaaggccugaagcggggagaaaccacaaagcacgcagucagcaggggaaccgcgaaacuuagaugguucguagagcgaaaucucgucaaaccugaaggaaaggucaucgacuuaggaugugggagagggggcuggucguacuacugugcaggccucaagaaagucacggaagugaaaggguauacgaaagggggcccuggacacgaagaaccgauaccaauggcuacguauggcuggaaccucgucaaacuacacucggguaaagacgucuucuucauaccgcccgaaaagugcgacacccuacugugugauaucggcgaaucuucaccaaacccgacaaucgaggaggguaggacgcuucguguccucaaaaugguagaaccuuggcuaaggggaaaucaguucugcauuaaaauacuaaacccguacaugccaucaguaguggagacgcuagaacaaaugcaaagaaaacacggagguaugcugguucgaaauccgcuaagccgaaacaguacacacgaaauguacuggguaaguugcggaacggguaacauaguuagcgcaguaaauaugacgagccgcaugcuccucaaccgauucacgauggcccaccgcaagccgaccuacgaacgagacguggaucugggaacgggaacacggcacguugcuguggaaccggagguagcuaaucuggacauaaucggccaacgaauagaaaacaucaagcacgaacauaagucaacuuggcacuacgacgaggacaauccauauaagacgugggcauaccacggauccuaugaagucaaaccaucaggaagcgcgagcucaaugguaaacggagucguaaaacuucucacgaagccaugggacguaaucccuaugguaacacaaaucgcuaugacggauacaacaccuuuuggacagcaacggguuuuuaaggaaaaagucgacacgcgaacgccaaaggcgaaacgaggaaccgcacagauuauggaaguaacggcuagaugguuguggggauuccuaagucggaauaagaaaccgaggauaugcacacgcgaagaguucacacgcaaaguucgcagcaaugcagccauaggugcgguguucguagacgaaaaccaauggaacucugccaaggaagcggucgaagacgagagauucugggaccuagugcauagggaaagggaauugcacaagcaggggaagugcgcaaccugcguauacaacaugauggguaagcgagagaagaaauuaggugaauuugggaaagcaaaaggcucgagggcgaucugguacauguggcugggcgcgcgauuucucgaguucgaagcccuaggauucaugaacgaggaucacugguuuucacgcgaaaauucauuaucgggcgucgagggggaggggcuacauaaacucggguacauccuacgcgauauaagcaaaauacccggaggaaacauguaugccgacgacacggcuggaugggauaccaggauuacggaagacgaccuccaaaacgaagcgaagauuacagacauaauggagccagaacacgcauuacuagccaaggcaauauucaaacuaacauaucaaaacaaggucguaagggugcaacgcccagccaaaaacggaaccgugauggacguaauaagucgacgggaccagcguggaucaggacagguggggacuuacggacuaaacacguucacaaacauggaagcacagcucauaagacaaauggaaagcgaaggcaucuucagucccucggaacucgagacaccaaaccucgccgaacgcgcucucgacugguuagagaaguacggcgucgaaagacucaagagaauggccauaaguggagaugacugcguagucaaaccgaucgaugacagauuugccacggcacucacagccuuaaaugauaugggcaagguacgaaaggacauuccgcagugggaacccucgaaggguuggaacgacuggcaacaaguaccauucuguagccaccauuuccaccaguugaucaugaaagacgggcgagagauaguaguacccugccgcaaccaagacgaacuugugggucgggcgcggguaucgcaaggagcuggguggucccuccgagagacggcaugccucggaaagucauaugcacagauguggcagcucauguacuuccacagacgagacuuacgauuggccgccaacgcuauaugcagcgcaguaccaguugauuggguuccgaccagucgcaccacauggucgauacacgcccaccaucaauggaugaccacggaagacaugcuuucaguauggaaccgugucuggaucgaggaaaacccauggauggaagauaagacacauaucagcaguugggaggacgucccauaccuggggaagcgggaggaccaauggugcggcucccuaauaggacugacagcgagagcaacaugggcaaccaacauccagguagcgaucaaccaggucagaagguugauaggaaacgaaaauuaccuugacuacaugaccuccaugaagcgcuuuaagaacgaaagcgacccagaaggagcgcugugguaa

SEQ ID NO: 24313 - RNA, 9879 nt, Artificial Sequence
  derived and/or modified CDS sequence (opt11) from DENV-1__GQ199801__SS-prME
ucaguuacgauguuacucaugcuaaugcccacagcauuggcguuccaccugacgacuagagggggugaaccucacaugaucgugucaaaacaagaacggggcaaaucacuacuauucaaaacuuccgccgguguaaacaugugcacgcucauugcaauggaccugggggagcugugcgaagauacaaugacguacaaauguccccggauaacggaagccgagcccgacgacguggacugcuggugcaaugcaacggacacguggguaacguaugggacaugcucccaaacaggggaacacaggcgugauaaacgaucaguagcccuagcaccccacguaggguugggccuggaaacaaggacugagaccuggaugagcuccgaaggcgcuuggaaacaaauccaacgggucgaaaccugggcacuucggcacccgggcuuuacggucaucgcucucuucuuggcacaugcaauagggacgaguauaacacaaaaaggcauaauauucauacuacuaaugcuagucacucccucgauggcaaugagaugcgucggaauaggcagccgggacuuugucgagggccuaagcggcgccacaugggucgacguaguauuagagcacggcagcugugucacaaccauggcaaaagacaaaccaacacuagacauagagcugcucaaaacggagguaacgaacccagcggugcugagaaaacugugcauugaagccaaaauaucaaauacuaccacagacucccgaugcccuacccaaggcgaggccaccuuagucgaggagcaagacgcaaacuucguuugccgacggacuuucguagacaggggguggggcaacgggugcggucuauucgggaaaggaucgcucauaacgugcgccaaauuuaaaugcgugacacgcuuagaagggaagaucguccaguacgagaaucuaaaguauagugucauagugaccgugcacacgggagaccagcaccaaguaggcaaugaaucgaccgaacacgggacaacugcgacaaucacaccgcaagcaccuaguacugaaauccagcuuaccgauuacggagcacuaacgcuggauuguagcccgcguacaggacuagacuucaacgaaauggucuuacugacaaugaaagaaaaauccuggcucguucacaaacaaugguuucuagaccuaccgcuaccuuggacaaguggcgcguccacaagccaagagacauggaaccgccaggaccucuuagucaccuucaagacagcccacgccaagaaacaagagguaguaguccucgguucccaagagggcgcgaugcacaccgcacuuaccggcgcaacagaaauucaaaccagcggaacaacgacaaucuucgccggucaucuuaagugucgacuuaagauggacaaacucacacuaaagggaaugaguuacguuaugugcacgggcucguucaaacuugagaaggaggucgccgaaacacaacacgggacgguacuuguccaaaucaaguaugaaggaacagacgccccuuguaagauucccuucagcacccaggacgaaaagggcguaacccaaaacggucggcuaauaaccgccaauccgaucguaaccgacaaagaaaagcccgucaacauagaagccgaaccacccuuuggggagagcuacauuguaaucggggccggagaaaaagcccucaaauuauccugguucaagaaaggaagcucgauaggcaaaauguucgaagcaacggcaagaggggcacggcgcauggcgauccucggagacacagcaugggauuucggcuccaucggcggcguauuuacuuccguagggaagcuaguacaccagauauuugguaccgcauauggcgucuuauuuucgggcgucucguggacuaugaagauaggcaucgggguccuacuuaccuggcuuggacugaacucgcgaucaaccucgcuaucgaugacauguaucgccguggggcuggucaccuuguaccucggagucaugguacaggcugacagugggugcgucaucaauuggaaaggacgcgaguuaaagugcggcucgggaaucuuuguuacgaacgagguccauacguggacugaacaguauaaauuucaggccgacucaccuaaacgcuuaagcgccgcuauuggcaaggcaugggaagaagggguaugcggcauacggagcgcaacgagauuggagaacauaauguggaaacaaauaagcaacgagcucaaccacauccugcuggagaaugacaugaaguucacaguagucguaggugacguugccgggauccuagcucaaggcaagaaaaugauccgcccacaaccgauggaauauaaauacucauggaaaagcuggggcaaagcaaagauuaucggcgcagacgugcaaaacaccaccuucaucauagacggaccaaacacacccgaaugcccagaugaccaaagggccuggaauaucugggaaguggaagacuauggcuucgggauauucacuacaaacauuuggcuaaaauuacgugacucauauacacaagucugcgaccacaggcuaaugagcgcggccauaaaggacuccaaggcuguucaugcugacaugggauacuggaucgaaagugagaagaacgaaacguggaaacuggcccgagcaaguuuuaucgaaguuaagacuuguauauggccaaaaucacacacacucuggagcaacggcgucuuagaauccgaaaugaucauccccaagaucuacggcggcccaauaagccaacacaauuaccgacccggcuacuucacccagaccgcaggccccuggcauuuaggcaaacucgaauuagacuucaaucuaugcgaagggacgacagucguaguugaugagcacugcggaaacaggggcccgagccuaagaaccaccacugucacaggaaagauaauacaugagugguguugcagaaguugcacacuacccccacuaagguuuaaaggcgaagauggcugcugguacgggauggaaauccgaccaguaaaagagaaggaagagaaccucgugaaaucgaugguaucggcggggucgggagaaguagacucguucucacucggccuacucugcaucucaauaaugauugaggaagugaugcgcucacgcuggagcaagaaaaugcugaugaccgggacguuggcaguauucuuccugcuaauaaugggucaacuaacuuggaaugaccucauaagacuguguaucaugguaggcgccaacgccagcgaccgcaugggaaugggaaccacauaucucgcccuaauggccacuuucaagaugaggccuaugcuggccgucgggcuuuuauuccggagacucacgucccgagaaguccuauugcucacuauagggcugucccucguggcgagcguagaacugccgaacagccucgaggaauuaggcgacggacucgcgaugggcaucaugauacuaaagcuccugacagacuuccaaucacaccagcuaugggcaacgcuacuuagccucacauucaucaaaacuacauacagccuucacuaugcuuggaaaacuauggcgaugguccucucgauagucagucuguucccgcucugccucuccaccacgucacagaaaacgacauggcucccgguauuacuggggucgcucgggugcaaacccuuaaccauguuccugauagcggaaaauaaaauaugggggcgcaaguccuggccacuuaacgaagggaucauggccguagguaucgucaguauccuccucucaagccuacugaagaacgauguaccccuagcgggaccacucaucgccgggggcaugcugaucgcuugcuacguaauaucaggaucuucggcagaccugucacuugaaaaggcagccgaagucaguugggaggaagaggcagaacacagcggagcaagccauaacauucugguagaggugcaggacgauggaaccaugaagaucaaggacgaggagcgugacgauacgcuaacaaucuuguugaaggcgaccuugcuggcaguaagcgguguauacccacuaagcaucccggccacacuuuuuguuugguacuucuggcagaaaaagaaacaaagguccggaguacugugggacacccccucuccacccgaaguagaacgcgcggucuuagacgacggaauauaccgcaucaugcaacguggacuccucgggcggucacaagugggcguaggagucuuccaagagaaugucuuucauaccauguggcacguuacccggggcgcugucuugauguaucagggaaaacgauuagagccuucaugggcgagcgugaagaaagaccucauuucauaugggggaggauggagacugcaaggaaguuggaauacaggagaagaaguccaaguaauugcagucgagccggggaagaauccuaagaacguacagaccgcaccgggaacauuuaaaacaucugaaggcgaaguaggcgccauagcgcuagacuucaagcccggcacuucagguaguccuauagucaauagagaggggaagauagugggacuauacgggaacggugucgugacaacaucaggaaccuacguuagcgcaaucgcgcaagcgaaagcaucgcaagaaggaccccuaccggagauagagaaugaggucuuucgaaaaaggaaccuaaccauaauggaccugcaccccggcucaggcaaaacgcggcgauaccuccccgcaaucguacgugaagccauaaagcggaaguuacgcacccuuauacucgcaccgacacgcguaguagcuuccgaaauggcagaggcucuaaaaggaauaccaauccgauaccaaacuacggccguaaaaucugaacauaccgguaaagagauaguggaccucaugugccacgccacguucaccaugagacuauuaucaccagugagagugccaaacuacaacaugauuaucauggacgaagcgcauuucacggacccgaguucgaucgccgccaggggauacauaucuacccgagucggaaugggggaagcggccgcaauauucaugacugccacgccuccaggguccgucgaagccuucccucaauccaacgcggucauccaagacgaggaaagagacauacccgaaagguccuggaacuccgguuaugaguggaucaccgauuucccaggcaaaacagugugguuuguccccuccaucaagucaggcaaugacauagccaacuguuuaagaaagaacggcaagcgcguuauacaacucaguaggaagacguucgacacugaauaucagaaaaccaagaacaaugacugggauuacguaguaacuacagacaucucggagaugggagcaaacuuccgagcggaccgaguaaucgacccaaggcgcugccugaaaccgguaauacuaaaagacggaccagagcguguaauccuagcaggaccaaugccagucacagucgcaagcgcagcccagcgacggggccgaauagggaggaaucacaacaaggaaggggaccaauacaucuacaugggacagccgcuaaacaacgacgaggaccacgcucacuggaccgaagcaaaaaugcuacuugauaauauaaacacgcccgaagguauaauacccgcccuauucgagccagaaagggagaaaagugcagcaaucgacggcgaguaccgucuaagaggagaggccaggaagaccuucguggaacucaugagaaggggugaccuccccguauggcucucguacaagguagcaagcgaaggauuucaauacuccgaucgaagauggugcuuugauggcgaaagaaauaaccaggugcuagaagagaacauggacgucgagauauggaccaaagaaggugagaggaagaaacuacgcccacgguggcuugacgcacggacauauagugauccccuggcauuacgcgaguucaaagaauuugccgccggacggcgcuccgucucgggagaucucauacucgaaauaggcaaauuaccccaacaccuuacacagcgagcgcaaaacgcccuagacaaccuggugaugcuccacaauagugaacaaggagggcgcgccuaucgccacgcgauggaagaacuccccgacacaauagagacgcucauguugcucgcauugauagcuguccugacaggcggagucacgcuauucuuucugagcggcagagggcuuggcaaaaccagcaucgggcugcuaugcguaauggccaguuccgugcuacuguggauggccuccgucgaaccccacuggauagcggccaguauuauccucgaguuuuuccucaugguucuacugauaccagaaccggaccggcaaagaacaccacaggacaaucaauuagccuacguggucaucgguuugcuauucaugauccucacgguugcggcgaacgagaugggucuccucgaaacaacgaaaaaggacuugggcauaggacacguagcagucgagaaccaucaccacgcggccaugcuggacguagaccuccaccccgcuucagccuggacacucuaugccgucgcaacaaccaucauaacgccaaugaugcgccacacaauagagaacacaacagcuaauaucucccucacagccauagccaaccaagcagcaauacuuaugggccucgacaaaggcuggccgauuagcaaaauggacaucggggugccguugcuagcgcuagggugcuauucucaagugaacccgcuuacccuuacugcagcugugcucaugcugguagcacacuacgccauuaucgggcccggccuucaggcgaaggccacgagagaggcacagaaaaggacugcagcagggauuaugaagaacccuacgguugacggaauagucgcaauagaccucgaccccguaguuuacgacgcaaaguuugaaaaacaacuagggcaaaucaugcugcuuauacucugcacaagccaaauccugcucaugcgaacaacgugggcacucugugaauccauuaccuuggccacaggaccgcucacaacccugugggagggaagccccgguaaauucuggaauacaacaaucgcaguaagcauggcgaacauauuucgaggcagcuacuuagccggugcaggucucgcuuucagucugaugaaaucacuugggggaggccgcagggggacgggagcccagggcgaaacguuaggcgagaaguggaagcgccaacuuaaccagcuaagcaaaagcgaguucaacacguacaaaagauccggaauaauggaagucgauagaucggaggcgaaggaaggccuaaagaggggagagacgaccaagcacgccgucucccgaggaacagcuaagcuaagaugguuuguagaaaggaaccuaguaaaaccggagggaaaggugaucgaccuaggcugcggacgaggggguuggagcuacuacugugcgggacuaaagaaggugacggaagucaaaggcuauacuaaagggggccccggccacgaggaacccaucccuauggccacuuacggcuggaacuuagugaaauuacacuccggaaaagacguauucuucauuccaccagagaaaugcgacacauugcuaugugauauaggcgaaagcagcccaaauccaacaauugaagaagggcguacgcugcgagugcuaaagaugguggagccguggcuccguggcaaccaauucugcauaaaaauccuaaacccuuacaugccuucggucguggagacccuagaacagaugcagcgcaagcacggaggaaugcucguaagaaauccucucucucgaaauagcacacacgaaauguauugggugaguugcggaaccggaaacaucgugagcgccguuaauaugacguccagaaugcuauuaaaccgauucaccauggcucacagaaaaccgacguacgagcgggacgucgacuugggggcuggaacacgccauguagccguagagccggagguggcgaaccucgacaucauuggacagagaauagaaaacauaaagcacgaacacaagaguacguggcauuacgacgaggacaacccguacaaaacgugggccuaccauggcagcuaugaagucaaaccgagcggaucagcaucaucgauggugaauggggucgucaaacucuuaacaaaacccugggacguaaucccaaugguuacacagaucgccaugacggacacuacgccauucgggcagcaacgaguauucaaagaaaagguagauacucgaacaccaaaagcgaagcggggcacagcgcagauaauggaggucaccgcgaaguggcucuggggguuccucagcaggaacaagaaaccacgaauaugcacuagagaagaauuuacacgcaagguacgcucaaacgccgcaauaggagcuguauucguugacgagaaccaauggaacagcgcgaaggaagcggucgaggacgaacgcuuuugggaccucguacaccgagaacgggagcuucacaaacaaggcaaaugcgcgacgugcguauacaacaugauggggaaaagagaaaagaagcuaggagaguucggcaaggcuaagggaagucgagcaauaugguacauguggcugggagccagauuucucgaguucgaagcgcucggcuucaugaacgaagaucacugguucucacgcgaaaacagccugucggguguugaaggugagggccuccacaaacuuggguacauccugagagacauuagcaaaauuccugggggcaacauguacgccgacgacaccgcggggugggacaccagaauaaccgaagaugaccugcaaaaugaggccaaaauaacugacauaauggaacccgaacaugcccuguuagccaagagcauuuuuaaacuaacauaccagaauaagguuguccgaguucaacgccccgcgaaaaaugggacagugauggaugucaucagucgucgagaucaaagaggcagcggacaaguuggaacauacggacuaaacacguucacgaacauggaggcacaacuuauccggcaaauggagagcgaaggaauuuucagccccucggagcuggagacgccaaaccucgcaggcagaguuuuggacuggcuugaaaaacacggcguggagcgacucaaaaggauggcuauauccggugacgacugcguagugaagccaauagacgaccgcuucgccacagcacuaaccgcccuuaacgacaugggaaaagucagaaaagacaucccccaaugggaaccgucaaaaggguggaaugacuggcaacaagucccauucugcagccaccauuuccaccaacucauaaugaaggauggccgggaaaucgugguaccgugccggaaccaagacgagcuggucggcagggcacgaguuucacaaggagcaggauggucucuacgugagacagccugccucgguaagagcuaugcacaaauguggcaguuaauguacuuccacagacgcgaccugcgguuagcagcuaacgcaaucuguagugcuguaccggucgauuggguccccacuagccgaacaacguggaguauccacgcacaccaccaauggaugacaaccgaagacaugcuauccgucuggaaucggguauggauagaggaaaaccccuggauggaggacaaaacccacaucagcaguuggggagacguccccuaucucggaaaacgggaagaccaauggugcgggucacucauuggccucacggccagagccacgugggcgaccaacauccaaguggccauaaaccaggugagacgcuugaucgguaaugaaaacuaucucgacuauaugacuagcaugaagcgguuuaaaaacgaauccgacccggaaggcgcgcuuugguaa

SEQ ID NO: 24314 - RNA, 9879 nt, Artificial Sequence
  derived and/or modified CDS sequence (opt11) from DENV-1__GQ199802__SS-prME
agcgugacaauguuacucaugcugaugcccaccgcccuggccuuccaccucacaacacggggcggggagccccacaugaucguaagcaagcaggagcggggcaagagucugcuguuuaagaccagcgccggcgugaauaugugcacccucaucgcuauggaccuaggagaacugugcgaggacaccaugaccuacaagugcccucggaucaccgaaacugagcccgacgacguggacuguugguguaacgcaacggacaccugggugacguaugggaccuguagccagacgggcgaacaucggcgcgacaagcgcuccguggcccucgcgccccacgugggccucgggcuggagacgcgaaccgagaccuggaugucuucugagggcgcguggaagcagauucagaggguagagacgugggcccuucgccaccccggguuuaccgugaucgcccuguuccuggcccacgcgauagguaccaguaucacccaaaaggggauuauuuucauucuacugaugcucgugacgcccuccauggccaugcggugcgucggcauuggcucacgcgacuuuguggagggacucucgggggccaccuggguggacgucgugcuggagcaugggagcugugugaccaccauggcuaaggacaagcccacgcuggacaucgagcuccugaaaaccgaggucaccaaccccgccguguugcggaaacucuguaucgaggcgaagaucaguaacacgacgaccgacagccggugcccgacccaaggcgaggccacccugguggaggagcaggaugccaacuucguaugccggcgcacguucguagaccggggcugggggaauggcugcggccucuucggcaaagggucccuuaucacgugugccaaguucaagugcgugaccaagcuggagggaaagauuguccaguacgagaaccugaaguacucugugaucgucaccgugcacacgggcgaccagcaccagguggggaacgaguccaccgagcauggcaccaccgccaccauaacgccccaagcgcccaccacggagauccagcucacugacuacggggcccucacccuggacuguagcccccgcacgggccucgacuucaacgagaugguccugcuuaccaugaaagagaaguccuggcucgugcacaaacagugguuccucgacuuaccccucccguggacuagcggggccagcacuucucaggagaccuggaaccggcaggaccugcuggucaccuuuaagacggcccacgcaaagaagcaggaggucguggugcucggcagccaggagggcgcgaugcauacggcucugaccggggcuaccgagauccaaaccucggggacuacgaccaucuucgccggacaccugaagugcagacucaagauggacaagcugacccugaagggcaugagcuacgucaugugcacggggucuuucaagcuugaaaaggagguugccgaaacccagcacggcacggugcugguccagaucaaguacgaaggcaccgacgcucccugcaagauccccuucagcacgcaggaugagaagggggugacgcagaacggccgguuaaucaccgccaacccgaucgugaccgacaaagagaagcccguaaacaucgaggccgagccgcccuucggggagucuuacaucgugaucggcgcaggcgagaaagcgcugaagcuuagcugguucaagaagggguccagcaucggcaagauguucgaggccacggcgagaggggcccggcgcauggccauacugggcgauaccgcgugggacuucggguccaucggcggcguguucaccucagucgggaaacuggugcaccagauauuuggcacagccuacgguguguuguuuuccggagucagcuggacaaugaaaaucgggaucggcgugcuacugacauggcucggacugaacagccguucgaccagucugagcaugaccugcaucgccgugggccucgucacgcuguacuuaggcgugaugguccaggccgacucggggugcgucaucaacuggaagggccgggagcucaagugcggcucaggcaucuuugugacaaacgaaguucauacguggaccgagcaguacaaauuucaggcagacucaccgaagcgccuguccgcagcuaucggcaaggcgugggaggaggggguaugcgggauccggagcgccacccgccuggagaauaucauguggaagcagauaucaaacgagcuaaaccacauccugcuggagaacgacaugaaguucacgguaguggucggcgacguagccggcauccucgcgcaggguaagaaaaugauucgaccccagccuauggaguacaaguacagcuggaaguccuggggaaaggcuaagauuaucggcgcagacgugcagaacaccacauucaucaucgacggccccaacacacccgagugccccgacgaccagcgugccuggaauaucugggaaguggaggacuauggcuucggcauauucacuacaaacaucugguuaaaacugcgcgacagcuacacccaggugugcgaucaccgccucauguccgccgccaucaaggacuccaaggccguacacgccgacaugggcuacuggauugaguccgagaagaacgaaacauggaaacuggcucgggcgaguuucaucgaggucaagacgugcaucuggcccaagucacacacccuguggagcaaugguguauuggaguccgagaugaucauccccaagauauacgggggccccauuagucaacacaacuaccgccccggguacuucacucaggcagccggcccuuggcaccuggggaagcuggagcuagacuucgacuuaugcgaggggaccacgguggucgucgacgagcauuguggcaaccggggccccucccuucgaaccaccaccgugacuggcaagaucauucaugagugguguugcagaagcugcacccuaccgccguugcgcuucaagggggaggauggcugcugguacgggauggagauccggcccgucaaggaaaaggaagagaaucuggugaaauccauggugucagcuggaaguggcgagguugacagcuucagcuuagggcugcugugcaucucgaucaugaucgaggaggugaugcgcagccgguggucccgccggaugcucaugaccggaacccuggccguguucuuccuguuaaucauggggcaacugacguggaacgauuugauccgucucuguaucaugguuggcgcgaacgcaucugaccgcauggggaugggcaccacuuaccuggcgcugauggccaccuuuaaaaugcggccuauguucgcagugggccuccuauuccgccggcugacgucuagagaaguauugcugcugaccaucgggcucagcuuggucgcgagcguggaacugcccaacagccucgaagagcucggcgacggccuggccaugggcaucaugauccucaagcugcugacugacuuccagucccaucagcuuugggccacccugcugagccucacguucaucaagacaacauucucgcugcacuacgccuggaaaaccauggcgaugguacucagcaucguaagucucuucccccugugccugaguacgaccagccagaagaccaccugguuaccgguguugcugggcagccucgguugcaagccgcugacgauguuccugauagcagagaacaaaaucuggggccggcgcagcuggccccucaacgaggggaucauggcagucggaaucgugucaauccugcugagcucccuccugaaaaacgaugugccccuggcugggcccuugaucgccgggggcaugcugaucgcuugcuacgucaucagcgggucuagcgcggaccucucccucgagaaggccgccgaggugagcugggaggaggaggccgagcacuccggugcgucgcacaacauccugguggaaguccaggacgacggcaccaugaagauaaaggacgaagagcgggacgacacccugaccauccuccugaaggccacccuguuggcugugagcggaguguauccgcugagcauccccgccacucuguuugucugguauuucuggcagaagaagaagcagcgcagcgggguccucugggacacucccagcccgcccgagguggagcgggcgguccuugacgacggcaucuacagaaucaugcaacggggacugcugggccgcucucaggugggcguggggguguuccaggagaacguguuucacaccauguggcaugugacccggggcgcgguucucauguaccagggaaagcggcuggagcccaguugggccagcgucaagaaggaccucaucuccuacggaggcggguggaggcuccaaggcuccuggaacacgggggaggaagugcagguaaucgccgucgagcccggcaagaaccccaagaacguucagaccgcacccgggaccuucaagaccccugagggggaagugggcgccauugcgcucgacuucaaacccggcacgagcgguuccccaaucgugaaccgcgaggguaagauugugggccuguacggaaacggugucguuacgaccagcggcaccuacgugucggccaucgcccaggcuaaggcgucgcaggaggggcccuuacccgagaucgaggacgaggucuuccggaaacgcaaccuaacgauaauggaccugcaccccggcucagggaagacgcggcgcuaucuuccagccaucguucgggaggccaucaagcgaaagcuccgcacacugauccucgcaccgacgcggguggucgccucggagauggcugaagcacugaaggggaugcccauccgguaccagacgaccgccgucaagagcgagcacaccggcaaggagaucguggaccugaugugccacgccaccuuuacgaugcgguuauugucccccguccgcgugccgaacuacaauaugauuaucauggaugaggcucacuucaccgaucccagcuccauagcugcccggggguacauuagcacccgcguuggcaugggagaagccgccgccaucuucaugaccgcaacgccgcccggcuccgucgaggccuucccgcagucaaacgccguuauacaggacgaggagcgagauauccccgagagauccuggaacagcggguaugaguggaucaccgacuuucccggcaaaaccgugugguuuguccccuccaucaagaguggcaacgacaucgccaauugccugcggaagaacgggaagcgcgugauccagcucucgaggaagacauucgacacggaguaucagaagaccaagaacaacgauugggauuacguggucaccaccgacaucagcgagaugggugcgaacuuucgcgcagaucgggugaucgacccgagacggugccugaagccugugaucuuaaaggacgggcccgagcgcgucauacucgccggacccaugccggugacagucgccuccgccgcgcagcgacgcgggcggauaggccgcaaccauaacaaggagggcgaccaguacaucuacaugggucagccauugaacaacgacgaggaccacgcccacuggaccgaggccaagaugcugcuugacaacaucaacacgcccgagggcaucaucccggcccuauucgagccggagcgugaaaaguccgcggcaauagacggggaauaccgucugcguggugaggccaggaaaaccuucguggagcucaugcggcgcggggaccugcccguauggcuguccuacaaggucgcuucggagggcuuucaguacagcgaccgucgguggugcuucgacggcgaacgcaacaaccaggugcucgaagagaacauggauguugagauuuggacgaaggagggggagcggaagaagcugcggccccgguggcuggacgcccgcaccuauagugacccccuggcccugcgagaauucaaggaguucgcggcuggccgccggagcgucucgggggaccugauccucgagaucggcaaguugccgcaacaccuuacccaaagagcucaaaacgcccucgacaaccuggugaugcuucacaacucugagcagggcgggcgggcuuaucgucacgcgauggaagaacucccagauacgauagaaacgcugaugcuguuagccuuaauagccguacugaccgggggggucacccuguucuuucucuccggucgugggcugggcaagaccagcaucggccuacuguguguaauggccuccagcguguuauuguggauggcuuccgucgagccucacuggauugccgcaucuaucauccuggaguucuuccugaugguccuccugauccccgaaccggaccgucaacggacgccacaggacaaccagcuggccuacguggucaucgggcuccucuucaugauccugacgguggccgcgaacgaaaugggacugcuggagacaaccaagaaggaccuggggaucggccacguggccguggagaaucaccaccacgccgcuauguuagacguggaccugcaccccgccuccgcguggacucuguacgccguggccacuaccauuaucaccccuaugaugcgccauaccaucgagaacacgaccgcuaacaucagcuugaccgccaucgcgaaccaggccgccauucugauggggcuggacaagggcuggccaaucuccaagauggacaucggagucccccucuuggcccuuggcuguuacagccaagugaauccccucacccugacagccgcugugcucaugcuugucgcccacuaugcaaucaucggcccggggcuacaggccaaggcuaccagagaggcccagaaacggaccgccgccgguaucaugaagaacccuaccguggacgggauaguggccaucgaccuggaccccguuguguacgaugcgaaguucgagaagcagcucggccagaucaugcuucugauccucuguacgucccagauccuacugaugcgcacaaccugggcccucugcgagucgaucacucuggccacaggcccccucacaacccucugggaagggaguccgggcaaauucuggaacacgacgauugccgugagcauggccaacauuuuucggggcuccuacuuagcgggcgccggccucgccuucagcuuaaugaagucguuggggggggguaggcgggggaccggggcccaaggcgagacgcuaggagaaaaguggaaacgccaguugaaccaacuuuccaagagcgaguuuaacaccuacaaacgguccgggaucauggagguugauaggucugaagcaaaggagggccugaagaggggggaaacgaccaagcacgccgugucccgcgggacagcgaaguuacggugguuuguggagcgcaacuuagucaaaccagaagguaaggugaucgaccucggcugcggccgcggcggcuggagcuacuacugcgccgggcugaagaaggugaccgaggucaagggguacacuaagggcggccccggccacgaggagccuauuccgauggcuaccuaugguuggaaccucgugaagcugcacuccggcaaggacguuuucuucaucccgcccgaaaagugcgacacacugcucugcgacaucggggagagcuccccuaacccgaccaucgaggaggggcgcacgcuucgggugcugaagaugguagaaccguggcugcgugggaaccaguucugcaucaagauauugaaccccuacaugccgagcguagucgagacucuggaacagaugcagcgaaagcacgggggcaugcucguaaggaacccgcugucgcggaacagcacccacgagauguacugggugucgugcgggaccggcaacauuguuucagcggugaauaugaccucccgcauguuacucaaccgcuucacgauggcgcaccgaaagcccaccuacgagcgcgacguggaucugggggccggaacccggcacgucgcgguggagccugagguugccaaccucgauaucaucggccagagaaucgagaacauuaagcacgagcacaaaagcacuuggcacuacgaugaagacaaccccuacaagacgugggcguaccacggaaguuacgaggucaaaccgagcggguccgcaagcucuauggugaaugggguaguaaagcucuuaaccaaacccugggacgugauccccauggucacccagauugccaugaccgacacgaccccuuucggccagcagcggguguucaaggagaaggucgauacccgcaccccgaaagccaagcgggggacggcccagaucauggaggucacagcgaaguggcucuggguauuccucucccgcaacaaaaagccgcggauaugcacccgcgaggaguucacaaggaagguucgcucgaaugccgccaucggugccguuuucguggaugagaaccaguggaacagugcgaaggaggcgguggaggacgagcgguucugggaccuggugcaccgcgagcgggaacugcacaagcagggaaagugcgccacaugcguauacaacaugaugggcaagcgcgagaagaagcuuggcgaguuugggaaagcaaagggcagccgggccauuugguacauguggcugggggcgcgcuuucuggaauucgaggcccugggcuucaugaaugaggaccacugguuuagccgggagaacagcuuguccggaguggagggggagggcuugcauaagcucggauacauucugcgcgauauuagcaagaucccaggagggaacauguacgccgacgacaccgccggcugggacacccggaucaccgaggaugaucuucaaaacgaggcacgcaucaccgacaucauggagccggagcaugcgcuacuggcaaaguccaucuuuaaacugaccuaccagaacaaggucgugcgcguacaacggccugccaagaacggcaccgucauggacgugaucagccgccgggaccaacgcggauccggccaaguggggaccuacggucucaauaccuucaccaacauggaggcgcagcuuauccggcaaauggagagcgagggcauauucucccccagcgaguuggaaaccccaaaccucgccgaacgcguauuagacuggcuggagaaguacggcguggagcgguuaaagcguauggcgauauccggcgacgacugcgugguuaagcccauagacgaccgguucgccacagcccugacggcccugaacgacauggguaaggugcgcaaggacauaccccagugggaaccaagcaaggguuggaacgacuggcagcaggucccuuucugcagccaccacuuccaccagcucaucaugaaggacgggcgggagaucgucgugccgugccguaaucaagacgagcuggugggccgcgcccgcgucagccagggcgcgggguggagcuugcgggagacggccugcuuagguaaauccuacgcccaaauguggcagcugauguacuuccaccgccgggaccugcgacucgccgcgaacgccaucugcagcgccgugcccguggacuggaucccaacuucacggaccacguggagcauacacgcccaccaccaguggaugaccaccgaggacaugcugucuguuuggaaccguguguggaucgaggagaaccccuggauggaggauaagacccacauaagcuccuggggcgacgugccguaccugggcaagcgcgaggaccaguggugugggucacucauuggccugacggccagggcgaccugggccaccaacauccaggucgccaucaaccagguacgccgguuaaucggaaacgagaacuaccuggacuauaugacauccaugaagcgcuucaagaacgagagcgaccccgagggggcacugugguga

SEQ ID NO: 24315 - RNA, 9879 nt, Artificial Sequence
  derived and/or modified CDS sequence (opt11) from DENV-1__JF937597__SS-prME
agcgugaccaugcugcucaugcugaugcccaccgcccuggccuuccaccucaccacgaggggcggggagccucacaugaucgucagcaaacaggaacggggcaagagccugcuguucaagaccagcgccggggugaacaugugcacccucauagcaauggaccugggggagcugugcgaggauaccaugaccuauaaaugcccccgcaucaccgaggcugagccagacgacguggauuguugguguaacgccaccgacacguggguuaccuaugggaccugcagccaaaccggcgagcaccggcgagauaagcgguccguggccuuagcgccucacgugggccucgggcuggagaccaggaccgagaccuggaugagcuccgagggcgccuggaagcagauccagcggguggagaccugggcccuccgccauccaggguuuacagugaucgcccucuuucuggcgcaugcuaucggcaccagcaucacgcagaaggggaucaucuucauccuccugaugcuggugaccccuuccauggccaugagaugcgucggcauaggcagccgcgauuucguugagggccucuccggcgccacguggguggacgucgugcuggaacacgggagcugcguaaccaccauggccaaggauaaacccacccuggacaucgagcucuuaaagaccgaggucacgaaccccgcgguauugaggaagcugugcaucgaggcaaagaucucaaacaccaccacggacaguaggugcccgacccagggagaggcuacccugguggaggagcaggacgccaauuucgucugccggcgcaccuucguagacagaggcugggggaacggaugugggcuuuucgguaaggggucccucaucacgugcgcuaaguuuaagugcgugaccaagcuggagggaaaaaucguucaguacgagaacuugaaguacagcgugauagugaccguccacaccggugaucagcaccagguggggaacgaguccacggaacacggcaccaccgcgaccaucacgccgcaggcacccacgacagagauccagcucacagacuacggggcccugacacuggacugcagcccacgcaccggccucgauuucaacgagaugguccugcugaccaugaaagagaaguccuggcucgugcacaagcagugguuccuggaccugccccuccccuggaccagcggggccagcaccucccaggagaccuggaaccgucaggaccugcuggugaccuucaagaccgcacacgcgaagaagcaggaggucguggugcucggcagccaggagggcgccaugcacaccgcccuaacgggggccaccgagauucagaccucaggcaccacgaccauauucgcggggcaccuaaaaugccgccugaagauggacaagcucacccugaagggcaugagcuaugucaugugcacagggucauuuaaguuagagaaggaggucgcggagacgcagcacggcaccgugcugguccaaaucaaauacgaagguacagacgcucccuguaagauucccuucagcacccaggacgagaagggggugacacagaacggaagacugaucaccgcuaacccuaucguuaccgauaaggaaaagcccgucaauaucgaggcugagccacccuucggcgagucauacaucgugaucggcgcgggcgaaaaggccuugaaguugucuugguucaagaaagggucuagcaucggcaagauguucgaggcuaccgcccguggggcccggcgcauggcaauccugggcgacaccgccugggacuuuggauccauaggcggcguguucacuagcgucgggaagcuggugcaccagauuuucggcaccgccuacgggguccucuucucuggcguaagcuggacuaugaaaaucgggaucgggguacugcugacguggcucggacugaacucgcgcagcaccucccugucuaugacuugcaucgcggucggguuagucacccuguaccugggcgccauggugcaagcggauucggggugcgugaucaauuggaaggggcgggaguuaaagugcgggucgggaauuuuuguaacaaacgaggugcacacuuggacagagcaauacaaguuccaggcugacagcccaaagcgucugagugccgccaucggcaaggccugggaggagggaguuugcggcauccgguccgcgacacgcuuggagaacauuauguggaaacagaucuccaacgaguugaaccauauccugcuggagaacgacaugaaacucaccgucgugguaggggaugucgcuggcaucuuaggucagggcaaaaagaugaucaggccccagcccauggaguacaaguacagcuggaaguccuggggcaaagccaagaucaucggggccgacgcgcagaacacgacguuuaucaucgacggccccaacacaccggaaugccccgacgaccaacgcgccuggaacaucugggaaguggaggacuauggauucggcaucuucaccacgaacaucuggcuuaaacuccgcgacuccuacacccaggugugcgaccaccgccugauguccgcggccaucaaggauagcaaggccguccacgcggacaugggcuauuggauagaguccgagaagaaugagaccuggaagcucgccagggccagcuucauugaggugaagaccugcaucuggcccaagucgcacacgcucuggucgaacgguguguuggaaagcgagaugauuauccccaagaucuacggcggacccaucagccagcacaacuaccgacccggcuauuucacccaaacagcagggcccuggcaucuuggcaagcucgaguuagacuuugacuuaugcgaagggaccacggucgugguggacgagcacugcggcaaccguggcccaucccuccgcaccaccacggucacggggaagaucauccacgaguggugcugccgaucuugcacccuaccgccccugcgcuucagaggcgaggacggaugcugguacggcauggagaucaggccagugaaggagaaggaggaaaaccucgugaaguccaugguuucagccggcagcggggagguggacuccuuuagccuaggacugcucugcauauccaucaugauugaggaggugaugcggucacgcuggucccggaaaauguuaaugaccggaacccuugcggucuuuuuccugcugaucaugggccaguuaacauggaacgacuugauacgccugugcauaauggugggggccaacgccagcgaccggaugggcaugggcaccaccuaccuggcucucauggccacuuuuaagaugcggccgauguucgcgguggggcugcuguuccgccgucucacuucgcgcgagguccugcugcuaaccaucggauugagccuagucgccuccguggaacuacccaacucucuggaggagcuuggggacggccuagcuaugggaauuaugauccugaagcugcuuaccgacuuucagucucaccagcugugggcaacccugcugagccugacguucaucaagacgaccuucuccuuacauuacgcguggaagaccauggccaugguguugagcaucgugucccuguucccccugugcuuaagcacgacgucccagaagaccaccuggcugcccguacugcugggaagccugggcugcaagccgcugaccauguuccucaucgcugagaacaagaucugggguagaaagucguggccccugaacgagggcauaauggccgucgggaucguuaguauccugcucagcucccugcugaagaaugaugucccccucgccggcccccucaucgcgggugggauguugauagccugcuacgugaucagcggcaguagcgcagaccugucccuggagaaggcugccgaggugagcugggaagaggaggcggagcauuccggggcuagccauaacaucuuagucgaagugcaggaugacggcaccaugaagaucaaggacgaggaaagggaugacacccucacgauucugcugaaggccacccuccuggccgugucugggguauacccgcugagcauccccgcgacucucuucgugugguacuucuggcagaaaaagaaacaacgguccggcgugcugugggacaccccuucaccacccgaggucgaacgcgcuguucuggacgacggcaucuaucggaucaugcagcgagggcuccucggacggucccaggucgggguugggguguuccaggagaacguguuccacacuauguggcacgucacgcguggggccgugcugauguaccaggguaaacggcuggagcccagcugggccucagugaagaaggaccuaaucucguacggagggggcuggcggcuaagaggguccuggaacacgggagaagagguccaggugaucgccguggagcccgggaagaacccgaaaaacguccagaccgccccuggcaccuucaagacccccgagggagaggugggggcgaucgcccuggacuucaagcccggcacgaguggguccccgaucgugaaccgggaggggaaaauagucggucucuacgggaauggcguugugacgaccucugggacguacguuagcgccaucgcgcaggcaaaggccucgcaggagggcccccugccggagaucgaggacgagguguuccguaagcgcaacuuaacgauaauggaccuccaccccgguagcggcaaaacccguagguaccuaccagccaucgugcgggaggccaucaaacgcaagcuacgcacucucauccucgcucccacccgggucguggcgucagagauggcugaggcccugaagggcaugcccauccgcuaccagacgaccgcugucaagagcgagcacaccgggaaggagaucgucgaccucaugugccacgccaccuucacgaugcgccuucuguccccagugcgcgugccgaacuauaacaugaucaucauggacgaggcgcacuucaccgaccccucguccauugcugcucggggcuacauaagcacacgcguagguaugggcgaggccgccgcgaucuuuaugaccgccacaccgccuggguccguggaggccuuuccgcagucuaacgccgugauccaggacgaggagcgggacauccccgagcgcuccuggaacagcgguuacgaguggaucaccgacuuucccgguaagacagucugguucgugcccuccaucaagagcgggaacgauaucgcgaacugccuucguaagaacggcaagagagucauccagcuaucccggaagacuuucgauacggaguaccagaagaccaagaacaacgacugggauuaugucguuaccacagacaucagcgagaugggggcgaacuuccgcgccgauagaguaaucgacccgcgccgguguuugaagccuguaauccuaaaggauggccccgagcgcgugauccuagccgggccaaugccggugacggucgccuccgcggcccagcggcgcggccggaucggccgcaaccacaacaaggagggcgaccaguacaucuacaugggccagccccuaaauaacgacgaggaccacgcccauuggaccgaagcaaagaugcuacuggacaauauaaacacccccgaggggaucauccccgcgcuauucgagcccgagcgcgagaaguccgcggccguggacggugaguaucgguuacgcggggaggcccgcaagaccuuugucgagcucaugcgucggggcgaccuaccaguguggcuuucguacaagguggcaagcgagggcuuccaguacucggaucgaagauggugcuucgacggggaaagaaacaaccagguccuggaggagaacauggacguagagauauggacgaaagagggcgaacggaagaagcuacgcccccgguggcucgacgcccguaccuacuccgacccccuggcguuacgggaguuuaaggaguucgcagccggucgccggagcgugucaggggaccucauacuggaaaucggcaagcucccucaacaccucacccagcgcgcccagaacgcgcuggacaacuuagucauguuacacaacagcgagcaaggcggccgagccuaccgccacgccauggaggagcuacccgacacuaucgaaacgcugaugcuccuggcccugaucgccgugcugacagggggugucacccuguucuucuugucaggccggggccucggcaagaccucuaucgggcugcucugcgucauggcguccagcgucuugcuguggauggccaguguugaaccccauuggauugccgccagcaucauccuggaguucuuucucaugguguugcugauuccagagccugacagacagcggacgccccaggacaaccagcuagccuacguuguaaucggccugcuguucaugauccucacggucgcggccaacgagaugggccuguuggagaccaccaagaaagaccuugggaucgggcacguggccguggagaaccaccaccaugccgcgaugcuagacguagaucugcaucccgcuuccgccuggaccuuauaugccgucgccacgaccauuaucaccccgaugaugcgccacacuauagagaacacaaccgccaacauuagccuaacagcaauugcuaaccaggcugccauacugaugggccuagacaagggcuggccgaucuccaagauggacaucggggugccccugcuggcgcucggcugcuacagccaggucaaccccuugacccugacagccgcugucuugaugcuugucgcccauuaugcuauaauugggccaggccuccaggcgaaggccacccgugaggcucagaagcguaccgccgcggggaucaugaagaacccaaccgucgacggcaucguggcgaucgacuuggaucccguggucuacgaugcuaaguucgagaaacagcuuggccagaucaugcugcugauccugugcacgagccagauccugcucaugcguaccaccugggcccugugcgaauccaucacgcuagcaacggggccccucaccacgcugugggagggcuccccggggaaguucuggaacaccacgaucgccgugagcauggcaaacauauuccggggcuccuaccuggccggcgccgggcucgccuucagccugaugaagucgcugggcggaggccgccgggguaccggcgcgcagggcgagacccucggggagaaguggaagcgccaacugaaccaauuauccaagagcgaguucaacaccuacaagcggucggguaucauggagguggaccgcagcgaggccaaggaggggcucaaacggggcgagacgacuaagcacgcugucucccgcgggacugccaagcugaggugguucguggagcgcaaccuggugaagcccgagggcaaagucaucgacuuagguugcgggcgaggcggguggucguacuacugcgcaggccucaaaaaggugaccgagguaaagggguacacaaagggcggccccgggcacgaggagcccaucccgauggcgaccuacgguuggaaucuagucaagcuccacuccgggaaggacguguucuuuaucccgccagaaaagugcgacacccuguuaugugacaucggcgagagcucccccaacccgacaauugaggaggggcgcacccugcgcguucucaagauggucgagccguggcugcgcggcaaccaguuuugcauuaagauccugaaccccuacaugccuagcgugguggaaacccucgagcagaugcagcggaaacauggcgggaugcuggugcgcaacccgcugucccgaaacagcacccacgagauguacugggucuccuguggcacagguaacaucguuucugccgucaacaugacuucccgcaugcuauugaaccgcuucacaauggcccaucggaagcccaccuacgagcgcgacguggaucuaggcacaggcacucggcauguggccguugagccugaggucgccaacuuggacauaauugggcagcgcaucgagaacaucaagcaugagcauaaaagcacguggcacuacgacgaggauaaccccuacaagaccugggcguaucauggguccuaugaaguuaagccgagcggguccgcaagcagcauggucaauggcguggugaaauuacugacuaaacccugggacgugaucccaauggugacccagaucgccaugacagauacgacacccuucgggcaacagcgugucuucaaggagaaggucgacacccggaccccgaaggccaagcgggggaccgcccagauuauggaggucacugcccgcuggcucuggggcuuccugucccgaaauaagaagcccagaaucugcacccgggaggaguucacccgaaagguccggagcaacgcagcaaucggggcaguguucguggacgagaaccaguggaacuccgcgaaagaggcgguugaggacgaacgcuuuugggaccuggugcacagagagcgggagcuacacaaacagggcaagugugcgaccugcguuuacaacaugauggggaagagagagaagaaguugggagaguucgggaaggccaaaggcucacgcgccaucugguacauguggcugggagcgcgguucuuagaguucgaagcccugggguucaugaaugaggaccacugguuuucccgcgagaacucacuguccggcgucgagggggagggauugcacaaacugggguauauucugcgagacaucuccaagaucccuggcgguaacauguaugccgaugacacagccggcugggacaccaggaucacagaggacgaccuccagaacgaagcuaagaucaccgauaucauggagccggagcaugcacugcuggcuaaggcuauauucaagcucaccuaccagaauaaggugguucguguccagcggcccgcuaagaacggcacggucauggacgugaucagucgccgggaccagcgcggaagcggccaagucggcacguacgggcugaacacauucaccaauauggaggcccagcugauacggcagauggagucagagggcauuuucagccccagugagcuugagacccccaaccuggcggagagagcacugaacuggcucgagaaguacggaguggagcggcucaagcgcauggccauuagcggcgaugacugcguggucaagccgaucgacgaccgguuugccacggcacugaccgcacucaacgauauggggaaggugcgcaaggacaucccucagugggagcccuccaagggcuggaacgacuggcagcagguacccuucugcagccaccauuuccaccagcugaucaugaaagacggccgggaaaucgucgugccgugccgcaaccaggacgagcuaguggggcgggcccgcgucagccagggugccggcuggagccugcgggagaccgccugccuggggaaguccuacgcgcagauguggcagcugauguacuuucaccgccgugaucuccgccuggccgccaacgcgaucuguuccgccguucccguggacuggguccccaccucuagaaccacaugguccauacacgcgcaccaucaguggaugaccaccgaagacaugcuguccguuuggaacaggguguggauagaggagaaccccuggauggaggacaagacucauauuagcagcugggaggacguuccguaucucgggaagcgcgaagaccaguggugcggcucacugaucggacugacggcccgggccacuugggccaccaacauccagguggccaucaaucaagugcgccggcucauagggaacgagaacuaucuggauuauaugacaagcaugaagcgauucaagaacgagucagaccccgagggcgcgcugugguga

SEQ ID NO: 24316 - RNA, 9879 nt, Artificial Sequence
  derived and/or modified CDS sequence (opt11) from DENV-1__GQ868609__SS-prME
uccgucaccaugcugcugaugcugaugccaaccgcuuuagccuuccaccucacgacccgcggcggugagccgcacaugauagucaccaagcaggagcggggcaagagccuguuguuuaaaacgagcgccgguguuaacaugugcacguuaaucgcuauggacuuaggagaguugugcgaggacaccaugaccuauaagugccccagaaucacggaggccgagcccgacgacguggacugcugguguaacgccaccgauacgugggugaccuacgggacuugcucccaaacaggcgaacaccggcgcgacaagcgcagcguggccuuagcaccccacgugggccugggucuugagacccgcaccgagacuuggauguccucagagggcgcguggaagcaaauacaacgggucgagacaugggcccuccgccaccccggauucacuguuaucgcccuguuccuggcgcaugccaucgguaccucuaucacccaaaaggggaucaucuuuauccugcugaugcugguuacgcccagcauggccaugcguugcgucggaaucggcucccgcgacuucguugaagggcuaagcggcgcuacuuggguagacgucguucuggaacauggguccugcgucaccaccauggccaaggacaagcccacgcuggauauugaacuccugaagaccgagguuaccaacccugcgguacugcgcaaacucugcauagaggccaaaauuagcaacaccacgacggacaguaggugccccacgcagggagaagcgacccugauggaggagcaggacgccaacuucgucuguaggcgaacguuuguagaccggggauggggcaacgggugcgggcuguucggcaaggggucuuugauaacgugcgccaaguuuaagugcgugaccaagcuagaaggcaagaucguacaauacgagaaccugaaguacucggugaucgugacagugcauaccggagaccaacaucaggucgguaaugagagcaccgagcauggcacuaccgcgacaaucacgccgcaggcgcccaccuccgaaauccaauuaacggacuacggggcccucacccuggauugcagcccccgcacggggcucgacuuuaacgagaugguccugcugacuaugaaggagaaaagcuggcucguccacaaacagugguuccucgaccucccgcuccccuggaccuccggcgcaaguacuucccaggagaccuggaaccgacaggaccugcuggugacguucaaaaccgcacaugcaaagaagcaggaggugguagugcucggcagccaggagggcgcgaugcacaccgccuuaacaggggccacagagauucaaacauccggaaccacgacaaucuucgccggccauuugaagugcaggcugaagauggacaaguuaacacucaaggguaugagcuacgugauguguaccggguccuucaaacuagagaaggaggucgcggagacgcagcauggcacaguccuggugcagaucaaauacgagggcacggacgcgccguguaaaauccccuucucaacucaggacgagaagggcgucacucaaaacggccgacugaucacagccaaccccaucgugaccgacaaggagaagccagugaauaucgaagccgaaccgccauucggggaguccuacaucguuaucggcgccggggagaaggcccuuaaauuguccugguucaagaaagggucaagcaucggaaagauguucgaagcuacagcccguggggcgcggagaauggcgauccugggugauacggccugggacuuugggucugugggcggggucuuuacgucuguggggaagcucguucaccagaucuucggcacugccuaugguguauuauucucgggcgugagcuggacgaugaagaucgggauaggcguacuccuaacgugguuaggacugaacucccgaagcaccucccugucgaugaccugcaucgccguuggcuuagucacacuguaccuggguguuauggugcaggcggacuccgggugugugaucaacuggaaaggccgggaguugaagugcgggagcggcaucuucgugacgaacgaggugcacacuuggacggagcaauacaaauuccaagcagacagcccgaagcgccuauccgcugccaucgggaaggccugggaggaaggagucugcggcauccgcagugcgacccgccucgagaauaucauguggaaacagaucuccaaugagcucaaucacauccuguuggaaaacgacaugaaguuuacuguuguggucggggacguggugggcauccucgcgcaggggaagaaaaugauucggccccagccgauggagcacaaguacaguuggaagaguuggggaaaagccaagauaauuggcgcugauguacagaacaccaccuucaucaucgauggacccaacaccccggagugccccgaugaucagcgcgcguggaacauaugggagguggaggacuaugguuuuggaaucuuuacgacuaacauauggcugcggcugcgcgacucauauacccagguaugcgaccacaggcugauguccgcggccaucaaggacucuaaggccguucacgcagacaugggcuacuggaucgaauccgaaaagaaugagacguggaagcuggcccgugcgucauucaucgaggucaagacauguaucuggcccaagucccacacauuguggaguaacggcgugcuugagagugagaugaucauuccuaagaucuacgggggcccgaucagccagcacaacuaccggcccggguacuucacgcaaaccgccggcccuuggcaccuagggaagcuggagcucgacuucgaccugugcgaaggcaccacagucgugguggacgagcauugcggcaaccgcgggccgucacugcguacaaccaccgucacgggaaagaucauccacgaguggugcugccgaagcugcacgcugccuccgcuccgguucaagggugaggacggcugcugguacgggauggagauccggcccguaaaggagaaggaagagaaccuggucaagagcauggucagcgccgggaguggcgagguagauagcuuuagccucggguuacugugcaucucuaucaugaucgaggaagugaugcggucacguuggucacggaagaugcucaugaccggcacccuggccgucuuucuucuccuuaucauggggcagcugacguggaacgaccucauccgcuuaugcaucaugguuggcgccaaugcgucagacaggauggguaugggcacuaccuaccuggccuuaauggccaccuucaaaaugcggccgauguuugccguaggccuccuguuucgcagacuaacuuccagagagguccuguuacucaccaucggucuuagccugguggccucugucgagcuccccaauagccuggaggaguugggcgacgggcucgcgaugggaauuaugauucuuaagcuacugaccgauuuccagucccaccagcugugggccacucuacuaucguugaccuucaucaaaaccaccuuaucccuucacuacgcauggaagaccauggccauggugcuaucgaucguguccuuguucccccucugccucucgacgacgucccagaagaccaccuggcugcccguccuccugggaagccuaggaugcaagccguuaacgauguuucugauuaccgagaacaaaaucugggguagaaagagcuggccccugaacgaggguaucauggcggugggaguggugaguaucuuacucagcucccuguugaaaaacgacgugccccuagccgguccgcugaucgcaggcggcaugcucauugccugcuauguaaucagcgggucaagcgcugaccugucccuagagaaggcggcggaaguuuccugggaggaggaggccgagcacuccggagccagccauaacauccugguggagguccaggaugacgggaccaugaagauuaaagacgaggaacgcgacgauacucuaacuauccuguugaaagccacgcuccuagccguguccgggguguacccgcuaucuauccccgccacccuguucgugugguauuucuggcagaagaagaagcagcggucgggggugcugugggacacaccaagcccgcccgagguagagcgugccgugcuggaugauggcaucuaccgcaucaugcagcggggccuacuggggcggucccaggucgguguggggguauuccaagaaaacgucuuccauacgauguggcacgugacgcgcggugccgugcugauguaccaggggaagcgguuggagcccagcugggcauccgucaagaaggaccugaucagcuauggcggcggguggcgucugcagggcucguggaacaccggggaggagguccaggugaucgccgucgagcccggcaagaaccccaagaauguucagaccgcacccgggaccuucaagacgcccgagggggaggugggugccaucgcccucgauuucaagcccggcacuucggguucccccaucgucaaucgggaggguaaaaucgugggccuguacggcaaugggguggucacgaccucaggcaccuacgugucagcgaucgcgcaggccaaggccucucaggaggggccucugcccgagauagaggacgagguguuccgcaaacgaaaccucaccauuauggacuugcaucccggcaguggcaaaacgcgccgguaccuuccggcuaucguacgcgaggcaauaaagcgaaagcuucgcacacuuauccuggcccccacgcgcgugguggccagcgagauggccgaagcucucaagggaaugcccauccgguaucagaccacggcggugaagagcgagcacaccggcaaggagaucguagaccugaugugccacgccacguucaccaugcgccugcucucucccguccgugucccgaacuacaacaugauaaucauggacgaagcccacuuuacugaucccagcucuauugcagcccgcggguauaucucuacucggguggguaugggcgaggcggccgccaucuucaugacagccacgccgcccggcuccguagaggccuucccgcagagcaaugccgucauacaagaugaagagcgggacauccccgagcggucauggaacucggguuacgaguggaucaccgacuuuccgggcaagacaguuugguuuguacccuccauuaaguccggcaacgacaucgcgaacugccuuagaaagaacggaaaacgagucauccagcugucccgaaagaccuuugauacugaguaccagaagacaaagaauaacgauugggacuacguggugaccacggacaucagugagaugggcgccaauuucagagccgaccgcgucaucgauccgcggcgcugccuaaagcccguaauccucaaagacgggcccgagagggugauccucgcggggcccaugccugugaccguggccagcgccgcgcagcgccgggggcggaucggccggaaccauaauaaagagggcgaccaguacauauauauggggcagccccucaacaacgacgaggaccacgcacacuggaccgaggcgaaaaugcuguuagacaauauuaacacccccgagggcaucauucccgcccucuucgaaccggagcgcgaaaaauccgccgccauagacggagaguaccgucugcggggagaagccagaaagacguuuguugaguugaugagacgcggggaccuacccgugugguuauccuauaaaguggcuagcgagggcuuccaguacuccgauagacgcuggugcuucgacggcgaacggaacaaucagguccuggaggagaacauggauguggaaauuuggaccaaagagggggagcguaaaaaacuaaggcccagauggcuugacgcacguaccuacuccgacccccucgcauuacgcgaguucaaggaguucgcugcgggccggcgcagcgugaguggagaccucauccuggagaucgguaagcucccacagcacuuaacccagcgggcgcagaacgcacuggacaacuuagugaugcugcacaacagugagcagggcggucgcgcguacaggcacgccauggaggagcugcccgacacgaucgaaacccucaugcuguuggcucucauagccgugcugacuggcgggguuacucuguucuuccucucuggccgcggacuuggaaaaacuucuaucggccuccuaugcgucauggccuccagcgugcuguuauggauggccaguguggaaccccauuggaucgccgcgagcauaauccucgaguuuuuccugauggucuugcuaauccccgaaccggaucgucagcgcaccccccaggacaaccagcuggccuacgugguuauugggcuucuguuuaugauacugaccguggccgccaacgagaugggucuccucgagacgacaaagaaggauuuagggaucgggcacguggcgguugagaaucaccaccacgcgacgaugcuggacgucgaucuccaccccgccuccgccuggacgcuguacgccguugccaccaccaucauaacgcccaugaugcggcacaccaucgagaacaccaccgcgaacaucagcuugacggccaucgcuaaccaggccgcaauccugaugggucuggacaaggguuggcccaucucaaagauggacaucggcgucccccuccucgcacugggguguuacucacagguuaacccacugacccucaccgccgccguguugaugcugguggcacauuacgcgauaauuggcccugggcuccaggccaaagccacacgagaggcgcagaagcgcacggccgcaggcaucaugaagaaccccaccgucgacggcaucguggccaucgaccuggaccccguggucuacgacgcaaaguucgagaaacagcugggacagaucauguuguuaaucuuaugcaccucacaaauccuccucaugaggaccacgugggcccuaugcgaaagcaucacccuggccaccggaccccugaccacgcugugggagggguccccgggcaaguucuggaauacaaccaucgccguaagcauggcuaacaucuucaggggguccuaucucgccggugccggccuagcguucagccugaugaagagucuagggggcggucggagaggcaccggugcgcaaggcgagacguuaggugagaaguggaaacgacagcugaaccagcucuccaagucagaguuuaacaucuauaagaggucugggaucauggagguugaccggagcgaggccaaggagggcuugaaaaggggugagacuacacgucaugccgugagccgcggaacugccaagcugcguugguuugucgaacgcaaccuggugaagcccgaggggaaggucaucgaccucggcugcggccgagguggguggagcuacuacugcgccggguugaagaaggucaccgagguaaagggguauaccaaaggcgggcccggucaugaggagccgaucccgauggccaccuacggguggaaccuggucaagcuccacucugguaaggauguguucuuuacgccaccagagaagugcgacacgcuguuaugcgacaucggcgaaaguucccccaauccgaccauagaggaaggccgaacccucagggugcugaaaauggucgagcccuggcugcgcgggaaccaguucuguaucaagauccucaaccccuacaugcccagcguggucgaaacccuggaacaaaugcagcgaaagcauggcggaauguuagugcggaacccccucucccggaacagcacccacgagauguacuggguauccugcgggacgggcaauaucguaagcgccgucaauaugacuucgaggauguuacuuaaccguuucaccauggcccaccggaagcccaccuacgaaaaggauguugaccuuggagccggcacgcgccacguugccguagagcccgagguugccaaucuggacaucaucggccagagaaucgagaacaucaaacacgaacacaagagcaccuggcacuacgacgaggacaaccccuauaagaccugggccuaccacgggucauacgaggucaagccuuccggcucggccuccagcauggugaaugggguuguuaagcuacucacgaagccgugggacgugaucccgauggugacgcagauagccaugacggauacaacccccuucggacagcagcgagucuucaaggagaagguagacacucggaccccgaaggccaagcgugggaccgcgcagauaauggaggucacggcccgguggcuguggggcuuccugucacguaacaagaaaccccggauuugcacgcgagaggaguuuacgcggaaaguccguucaaacgccgcgaucggcgcgguguuuguggacgagaaucaguggaauuccgccaaggaggcggucgaagacgagcgguucugggauuuggugcaaaaggagagggaacuacauaagcaaggcaagugcgcaaccugcguguacaacaugaugggcaagcgggagaagaagcugggugaguucggcaaagcgaaggggagccgcgccaucugguacauguggcucggcgcucguuuccucgaguucgaagcucucggcuucaugaacgaggaccacugguuuagccgcgagaacucacucuccggggucgagggcgagggacugcacaagcuuggauacauccugagagacauaucuaagauccccgguggcaauauguacgccgacgacaccgcuggcugggacacccggaucacggaggacgaccugcaaaaugaggccaaaaucaccgacauaauggaaccugagcacgcucugcuagccacaagcaucuucaagcugacguaucagaacaagguagugcggguccagcgaccugccaagaauggcaccgugauggacgucaucagucgccgggaccagcgcggauccgggcaggucggcaccuacggccugaauaccuucacgaacauggaagcgcaguuaauucggcagauggagagcgagggaauauuccuccccuccgagcuugagacccccaaccuagccgagcggguccuagauuggcuggagaaauacgggguugagcgucucaaaaggauggccauaaguggggacgacugugucguaaagccuaucgaugacagguuugccacugcgcuuaccgcgcugaacgacaugggcaaggugcgcaaggacauaccacagugggagccaagcaagggcuggaacgacuggcagcagguucccuucugcucgcaucacuuccaucagcucaucaugaaggacggccgugagauuguggucccaugccgcaaccaggacgaacuggucgggcgggcccgcgugagucagggcgccggguggagccugagggaaacggcuugccucgguaagagcuacgcccaaauguggcagcuaauguacuuccaccggcgggaccugcgucucgcugccaacgcaauuugcucugccgugcccgucgauuggguucccacaagccgcacgaccugguccauacacgcgcaccaccaauggaugacuaccgaagacaugcugucuguuuggaaccgcgucuggauagaagagaaccccuggauggaggacaagacccacguuuccucuuggggcgacguaccguacuuagggaaacgggaagaccaguggugcgguucgcucaucggccugaccgcgcgcgccacuugggcaaguaauauccaggucgccaucaaccagguucgcaggcugaucgggaacgagaacuaccucgacuacaugaccuccaugaagcgcuucaaaaacgagggcgaccccgagggcgcccugugguga

SEQ ID NO: 24317 - RNA, 9879 nt, Artificial Sequence
  derived and/or modified CDS sequence (opt11) from DENV-1__GQ199803__SS-prME
ucggucaccaugcuccucaugcucaugcccacggcauuagcguuccaccuaacgauaagaggaggagaaccacacaugaucgugucgaaacaagaacggggcaagucauuacucuuuaaaacuagcgcgggagucaauaugugcacgcuaauugccauggaucuuggcgaacugugcgaagauaccaugaccuauaagugccccaggaucaccgaagcugaaccggaugacguagacugcugguguaacgcgaccgacaccuggguaaccuauggaacgugcagccaaaccggagaacauaggagggacaagaggagcguagcacuagcaccacacgucggccucggcuuagaaaccagaaccgaaaccuggauguccucugaaggggcguggaagcaaauccaacggguugaaaccugggccuugcgccaccccggcuucacggucaucgcauuauuccuagcacacgcgauaggcacgagcauuacucaaaagggaauaaucuucauauuacugaugcuaguaacuccguccauggcaaugagaugcgucgggauuggcucgagggauuucgucgaaggucugucuggggcuacguggguggacgucguacucgagcauggaaguugcgucaccacaauggccaaggacaagccaacguuagauaucgagcuccugaagacagaaguaacgaauccggccguacuucgaaaacuaugcaucgaggcuaagauauccaacacuacaaccgacuccaggugcccaacucaaggagaggcaacccuaguagaagaacaagacgcgaacuucguaugccggcguacguucgucgaccgcggcuggggcaacggguguggacuauuuggaaagggcucauuaauaaccugcgcgaaauucaaaugcguuacaaaacuugaagggaagaucguccaguacgagaaccuaaaguauagcgugaucgugacaguccauaccggugaccagcaccaggugggaaacgaaagcacugagcaugggacgacagcaaccauuacgccgcaggcuccaacgaccgaaauucaacucacggacuauggcgcccucacuuuagacugcaguccacguacuggacucgauuucaacgagaugguacuccucaccaugaaagaaaaguccuggcugguccacaagcagugguuucucgaucugccacuaccauggacaucaggagcaagcacaucccaagagacauggaaccgccaagaccugcuaguaacguucaaaaccgcccacgccaagaaacaagaaguggugguacucgggagccaggagggcgcaaugcacacggcacugacgggcgcuacagagauucaaaccucggguacaacaacaauuuucgcgggccaccucaaaugccgccucaagauggacaaguuaacacugaagggcaugucguacgugaugugcaccggaucguuuaagcuagagaaggaaguugccgaaacccagcacggcaccguccucgugcaaauaaaauacgagggaaccgacgcaccgugcaagaucccauucuccacacaagaugaaaaaggcgugacccagaauggaaggcugauaacggcgaaccccaucguuaccgacaaggaaaaaccaguaaauauagaagccgaacccccguuuggcgaaucuuacauaguaauuggcgcuggagagaaggcccucaaacugaguugguuuaagaagggcucgagcaucggaaagauguucgaggcuacagcaagaggagcacgccgcauggccauacuaggagauaccgcgugggacuucgggucgauaggcgggguguuuacgucgguuggaaagcucguacaccaaauuuucgguacugccuacggaguacuguuuaguggcguaucguggacaaugaagauagggauuggggugcuacugacauggcuuggacucaacaguagauccacaucgcucuccaugaccugcauagcuguaggccuagugacccuuuaucugggaguuaugguccaggcagacaguggauguguaaucaauuggaaaggacgagaguugaaaugcggaagcggaauuuuuguaaccaacgaaguccacacauggacggagcaauauaaguuccaggcugacagcccuaagagacugucagccgcaaucgggaaagccugggaggaaggcguuugcgggauacgaagcgcgacgcgacuagagaacauaauguggaaacagaucagcaaugaacuaaaccacauccuacuugaaaacgacaugaaguuaacggugguaguuggagauguggcuggcauacuagggcaggggaaaaagaugauccgcccgcagcccauggaguacaaauacucauggaaaagcuggggaaaagcgaaaauuauaggcgcggaugcccaaaacaccaccuucaucaucgacggccccaacacaccggaaugcccugaugaccagcgagcauggaacaucugggagguagaggacuauggguucggaaucuucacgaccaacaucuggcucaaacuacgagacagcuacacgcaagugugcgaucauagacucaugagcgcugcaauaaaagacagcaaagccguucacgcugacaugggauacuggaucgagagcgagaaaaacgagacuuggaaacuugcccgggcaucauucaucgaagucaagaccuguauauggccgaaaagccacacauuauggagcaauggggugcuagagagcgaaaugauaauucccaaaaucuacggcggcccuauuucacaacacaacuaccgcccaggauauuucacgcagaccgccgggccguggcaccucggcaaacuggaguuggauuucgaucuaugcgaaggcacuacgguagugguagacgagcacuguggaaaccgaggccccucgcuccgcacaaccacgguuacuggaaaaaucauucacgaguggugcuguagaucgugcacucuacccccacugagauucagaggggaagacggauguugguauggaauggagauccgacccguuaaagagaaagaggaaaaccuugugaaauccaugguauccgcgggcucgggcgagguggacucguucucgcucggucugcugugcaucucgauaaugauagaggaagugaugcgaaguagguggagccggaagaugcucaugacaggaacacucgcagucuucuuccuacuaauaaugggacaacucaccuggaaugaucuaauccgacuaugcaucaugguaggcgccaacgcaagcgacaggauggguauggggaccacuuaucucgcucucauggcuacuuucaagaugcggcccauguucgcggucggucuccucuuccgcagacucaccucgcgggagguacugcuucuaaccauaggccuaagccuuguugccuccguugagcuccccucaaguuuagaggagcucggggacggccucgcgaugggaaucaugauacuaaagcugcuuacagacuuccaaucacaccagcuaugggcaacacuacuaagccuaacauucaucaaaaccgccuucucacuacacuacgccuggaaaacaauggcaauggugcucuccauagugagucuuuucccucuaugccuaagcacuacaucccagaaaacaacguggcugccggugcugcuaggaucacucggcuguaagccgcucaccauguuccucauagcagagaacaaaaucugggggcggaagucauggccgcucaacgaaggaauaauggcagucggaaucguuuccauccuccuaucaucauugcuaaagaaugacguaccacucgccgggcccuuaaucgcgggaggcaugcucauagccugcuacgucauaaguggcuccagcgccgaucugucccuugaaaaagccgcggaagucuccugggaagaagaagcagaacacagcggagcaucgcacaauauccuaguagaaguucaagacgacggcacaaugaagauuaaggacgaagaacgcgacgacacacugacgauacuacuuaaagcgacuuuacuugcugugagcggggucuacccccugucgauuccagcuacacucuucgugugguacuucuggcaaaagaagaaacaacgaucaggcguucugugggacacacccucaccuccggaagucgagcgugcaguucucgacgauggcaucuacagaauuaugcaacgggggcucuuaggaagaagccaaguaggaguagggguguuccaagagaacguauuccacacuauguggcacgucacacgaggagcaguccuaauguaccagggcaagagacuggaaccaagcugggcgagcgucaaaaaggaccucauauccuacggagguggauggcgacugaggggaucauggaacacgggagaagaaguccaaguaaucgccguggagccggggaaaaaucccaaaaacguacaaacagcgccugggacauucaaaaccccggaaggggagguaggggccauagcacucgacuucaaaccaggcaccagugggagcccgauaguaaaccgagaaggaaagauaguaggccucuacggaaacgguguggugaccacaaguggaacguacguuucugccaucgcccaagccaaggcgagccaagaagggccgcucccagaaauugaagacgaaguuuuucgaaaacggaaucuaacaauaauggaucuacauccgggaucagggaaaacuagacgcuaccucccagccaucgugcgagaagcuauaaagagaaaacuuagaacucuaauacucgcgcccacgagaguggucgccucggaaauggccgaggcccuuaaaggcaugcccaucagauaccaaacgacggccgucaagucggagcauaccgguaaggagauaguagaccugaugugccacgcuaccuuuacuaugagacuacucucacccguccgagugccuaacuacaacaugauaauaauggacgaagcccauuuuacagacccgagcucuauugcagcacggggauauauaucuacccgaguaggcaugggggaagcugcggcgaucuucaugacagcaacgccacccgggucgguugaggccuucccacaaucaaaugcuguaauccaggacgaggaaagagauauaccggaaagaucguggaacagcggcuaugaauggauaacagacuucccaggaaaaaccgugugguucguaccauccauaaaaagcggaaacgacaucgcgaacugccugcggaaaaaugggaaaagagucauacaacucucucgaaaaacuuucgacaccgaguaccagaaaaccaaaaacaacgauugggauuaugucguaaccaccgacaucuccgaaaugggagcaaacuuccgcgccgacagaguaaucgauccacgacgcugucugaagcccguaauccuuaaagacggcccugagcgcgugauccucgcggggcccaugccugugacagucgccagugcagcacagcgacgaggccgaauagggagaaaucacaacaaggaaggagaucaguacauauauaugggacagccacuaaauaacgacgaagaccacgcacauuggaccgaagcaaaaaugcugcuagacaacaucaacacucccgaggggaucauaccggcgcuguuugagccagagcgugagaaaagcgcggccguagacggggaguaccgcuugcgaggcgaagcccgaaagacguuuguagaacuuaugagaagaggagaccuaccgguauggcuaucauacaaaguggccucagaaggguuccaauacagugaucgaaggugguguuuugacggcgaacgaaacaaucagguacuugaggagaacauggacgucgagaucuggacuaaggagggagaccggaagaagcugagacccagguggcucgacgcacggaccuacucagacccacuugcccuccgagaguucaaagaguucgcagcaggcagacggaguguaagcggcgacuuaauccuagaaauuggaaaacucccucaacacuugacucaacgggcacaaaacgcucuggacaaccuagugaugcuccacaacagcgaacaagggggccgggcauacaggcacgccauggaagaacugccggauaccauagagacccuuaugcuccucgcccuaauagccguacuaacuggaggcgucacauuguuuuucuugucggggcgugggcucggaaaaacgagcauuggguuacuaugcguaauggcaagcucagugcuacuguggauggcaagcgucgagccgcacuggaucgcugccucaauaauacuagaguucuuucuaauggugcuccucaucccggagccagacagacaacgcacaccccaagacaaccaacuugcauacgucgugaucgggcuucucuuuaugaucuuaacaguugcugccaacgagaugggucuacuugaaacgaccaagaaagaccuaggcauagggcacgucgcaguggagaaccaccaccaugcugccaugcucgacguugaccugcaccccgccucggccuggacacuguacgcgguggcaacuacaaucauaacaccaaugaugcgucacacaauagaaaacaccacagcgaacauaucuuuaacggccauagcaaaccaggcagcaauccuaaugggccucgacaaaggcuggccgauaaguaagauggacaucggagugcccuugcuagcccugggaugcuauagccagguaaauccgcucacccuuacagccgcuguacuaaugcuaguugcgcacuaugcaauuauugguccaggacugcaagcuaaggcaacgcgggaggcccagaaaaggacagcagcggggauaaugaagaaccccaccguggacgggauaguagcuauagaccucgauccgguaguguaugacgccaaauucgaaaagcagcucggacagauaaugcuauuaauacucugcacgucacaaaucuugcucaugagaacaaccugggcucucugugaaucaauaacacuagccacugguccacuaaccacacuaugggagggaucacccggcaaguucuggaauacuacaaucgcagugagcauggcgaacaucuuucggggcagcuacuuggccggcgcgggauuagccuucagccuaaugaagucguuaggcggcggacgaaggggcacuggugcacaaggggaaacccugggcgaaaaguggaaaagacaguuaaaccaacucagcaaaagcgaguucaacacguauaagagaagcgggauaauggaagucgacaggagcgaagcaaaggagggccucaagcgcggggagacgacgaaacaugccguaucccguggcacugcgaaauuaagaugguuuguagaaaggaaccucguaaaaccagaagguaagguaauagacuuaggcugugggcgaggaggauggucauacuacugcgcgggacuaaagaaagugacggaaguaaagggcuacacgaaaggagggcccggucacgaagaacccaucccuauggccacauacggguggaacuuggucaaacuacacucagguaaggaugucuucuucaucccaccagaaaagugcgacacccugcuuugugacauaggggaaucuucacccaacccgaccauagaagaaggucgcacacuccgaguccugaagaugguagagccuuggcuccgcgggaaccaauucugcaucaaaauucucaacccguauaugccauccguaguagaaacgcucgaacagaugcaacggaaacacggcggcaugcucguccguaacccacuaucgcggaacagcacacacgaaauguauuggguuagcugcggcaccgggaacaucgucagugcagucaacaugaccaguagaaugcuacugaaccgcuucaccauggcccaccgaaaaccaacauacgagcgcgacguggacuuaggaacgggaacacgacauguggcggucgagccagagguugcuaacuuggacaucaucgggcaaagaaucgaaaacaucaaacaugaacacaagaguaccuggcacuacgaugaagacaacccauacaagaccugggccuaccauggaucguacgaggucaaaccgucaggauccgcgucaucaauggugaacggggucguaaaauugcucacaaagccaugggacguaauaccuauggucacacagauagcgaugaccgacacaacaccauucggacaacaaagaguguucaaggagaaagucgauacccgcacaccaaaggcaaaacgcggaacggcccaaauaauggaagucacagcuagauggcuauggggcuuucuaagucgaaacaagaagccacgcauuuguaccagagaagaguucaccagaaagguacgauccaaugcagcgaucggggcgguguucguggacgaaaaccaauggaacagugccaaggaagcaguagaagacgaaagguucugggaccugguacaccgggagagggagcuacacaaacaggggaaaugcgcaaccugcguauauaauaugaugggaaaaagagagaagaaacuaggggaguucggcaaagccaaagguucccgagcaauuugguauaugugguugggggcgagauuccuagaguucgaagcucuaggguucaugaacgaggaucauugguucagucgugaaaacagccugagcggcguggagggugagggcuugcauaagcucggguacauccugagagacaucucgaaaauacccggggguaacauguacgcagacgacacagcagggugggacacaaggauaaccgaagacgaccuacaaaacgaggcaaagaucaccgauaucauggaacccgaacacgcacuacucgccaaagcuauauuuaaguuaacauaccagaacaaagucgugcggguucaacggccugcaaagaacggcaccgugauggacgucaucuccagaagggaccagcgcggaucaggacaagugggcacauacggccugaauacguuuacaaacauggaagcgcaacucauucgacagauggaaagcgaagguaucuucucuccaagugagcuugaaacgccgaauuuggcggagcgagcguuagacuggcuggaaaaauaugggguggagagacucaagcgcauggcaauuagcggcgaugacuguguaguuaagccaauagacgauagauuugcgacugcccuaacagcgcuaaacgacauggggaaaguaagaaaagacaucccccagugggaacccucgaagggauggaacgacuggcaacaaguaccuuucugcucgcaucacuuccaccaacucaucaugaaggaugggcgcgaaaucgucgucccaugccgaaaccaggacgaacucgucggucgggcacgcguuucucaaggcgcaggauggaguuuacgugagacugcuugccucggcaagucauacgcucaaauguggcagcuaauguauuuccaccgacgcgaucugagauuggcagcgaaugccauuugcucagccgucccaguugacuggguaccaacgagucggacaacauggagcauacacgcgcaccaccaauggaugacuacugaagacaugcugaguguauggaauagaguuuggauagaagaaaacccauggauggaagauaaaacucacauuuccagcugggaggauguaccuuaucuaggaaagagagaggaccaaugguguggaagccuaauaggucuaacggcacgcgccacuugggccaccaacauucaaguagcuaucaaccaggucaggcgccugaucggcaaugagaauuaucuugacuacaugaccuccaugaaaagguucaaaaacgagucagaccccgaaggcgcguugugguaa

SEQ ID NO: 24318 - RNA, 9879 nt, Artificial Sequence
  derived and/or modified CDS sequence (opt11) from DENV-1__GQ199804__SS-prME
agcgugaccaugcugcucauguugaugcccaccgcacuggccuuucaccucaccacgcggggcggggaaccccacaugauagugagcaagcaggaacgcgggaaaucgcuccuguuuaaaaccagcgccggcgugaacauguguacccucaucgcaauggaccugggcgaacucugcgaggauaccaugacguacaaaugucccaggaucaccgaaaccgagccagaugacguggacugcuggugcaacgccacggauaccugggugacguaugggacgugcagccagaccggcgagcaucggcgggacaagcggucuguggcccucgcgccacacgugggauuagggcuagagacacggaccgagacauggaugagcuccgagggcgcauggaagcagauccagcgugucgagacgugggcccuccgucaucccggguuuaccgugaucgcccuauucuuagcacacguaaucggaaccucuaucacacagaaaggaauaauauucauccuccugaugcuggucacacccuccauggcgaugcggugcguuggaaucggcagccgcgacuucguagaggggcucuccggggccacgugggucgacgucgugcuagagcacggaagcugcgucaccacgauggcgaaggacaagcccacgcuggauaucgagcuccugaaaaccgaggucaccaaccccgcagugcugcggaagcugugcaucgaggccaaaaucuccaacaccacgaccgacagccguugcccgacgcagggcgacgccacccuagucgaagaacaggacgcaaauuucgugugccggcgcacguucguggaccgaggcugggggaacggcugcgggcuauucggcaaggggagccucaucacgugcgccaaguucaagugcgucaccaaacuggaggggaagaucgugcaguaugagaaccugaaauacagcgugaucguuaccgugcacacgggcgaccaacaucaggucgggaacgagagcacggagcauggcacaacggccaccaucacgccacaggcccccaccaccgagauucagcucacggacuacggugcucucacgcuggacugcagcccccgcaccggccucgacuucaacgagaugguguuguuaaccaugaaggaaaagagcuggcucgugcacaagcagugguuccuggaccuuccccugccuuggaccagcggggccagcacgucccaggagacguggaaucggcaagaucugcuggucaccuuuaagaccgcccacgccaagaagcaggaggugguggucuugggcucgcaggagggcgcgaugcacacggcgcugaccggcgcuaccgaaauccagacauccggcacgaccacgauuuucgcaggucaccugaagugccgacucaagauggacaaacugacccugaaaggcaugagcuacgugauguguacuggcuccuucaagcucgagaaagaaguggccgagacccagcauggcaccguccugguucagaucaaguacgagggcacggacgcucccugcaagauucccuucagcacgcaggaugagaagggggugacccagaacggccggcugaucaccgcaaacccgaucgucaccgacaaggagaagcccgugaacaucgaggccgagccgcccuucggagaaucguacaucauuaucggcgccggcgagaaagcccugaaacuuuccugguucaagaagggaucgagcaucgggaagauguuugaagcaacggcccgcggggcccggcgcauggccauauugggugauaccgccugggauuucggguccaucggcgggguuuucacuucagucgggaaauugguccaccagaucuucgguaccgcguaugggguguuguuuuccggcguuagcuggacuaugaagaucggaaucggcgugcugcugacgugguuaggucugaacuccaggagcaccagucugagcaugaccuguaucgcaguggggcucgucacucuguaccugggcgugaugguucaggccgacuccgggugcguuaucaacuggaaaggccgggagcucaagugugggucaggcaucuucgugaccaaugagguucacaccuggaccgagcaguacaaguuccaggcggacuccccgaagcgccugagugccgcgaucggcaaggcuugggaggaaggggucuguggcauccggagcgccacucgccuggagaacauuauguggaagcagaucuccaacgagcucaaccacauccuccuggagaaugacaugaaguucaccgucguugucggggacguggcuggcauccuagcacaggggaaaaagaugauccggccccaacccauggaguacaaauacagcuggaaguccuggggcaaggcgaagauaaucggugccgacguccaaaacacgaccuuuaucaucgacggucccaauaccccagagugccccgacgaccagcgcgccuggaauaucugggaggucgaggacuacggcuucgggaucuucacgaccaacauauggcucaagcugcgggacagcuacacccaagugugcgaccaccgccucauguccgccgcuaucaaggacagcaaggccgugcacgccgacaugggguacuggaucgaguccgagaagaacgagacguggaagcucgcccgugccagcuucaucgaggugaagaccuguaucuggcccaagucccacacccuguggagcaacggcguccucgagucugagaugaucauccccaagaucuacgggggcccaaucagccagcacaacuaccggcccggguacuucacgcagacagcgggaccguggcaucugggcaagcuggagcucgacuucgaccugugcgaggguacgaccguggucgucgacgagcacugcggcaaccggggaccuucccuuaggacaaccacgguaaccgguaagaucauucacgaauggugcugccgaagcugcacccugccgccccuucgcuuuagaggggaagacggaugcugguacggcauggagauccgcccugugaaggagaaggaggagaaccuggucaaguccauggugagcgccggcagcggggaggucgacuccuucagccugggcuuacugugcaucuccaucaugauugaggaaguuaugcggaguagguggucccgcaagaugcucaugaccggcacgcuggccguguucuuccuguuaauuaugggacaguugacuuggaacgaccugauccggcucugcaucaugguuggcgccaacgccucugaccgcauggggaugggcaccaccuaccuggcccugauggcuacguucaagaugagaccgauguucgccguggggcuacuguuccgccggcugaccucccgcgagguucuccuuuuaaccaucgggcucagccuggucgcauccguugagcugccgaacagcuuggaggagcugggcgacgggcuggccauggguauuaugauccucaaacuccucaccgacuuccagucccaccagcucugggccacacugcugucucucaccuucauuaagacaaccuucagucugcacuacgccuggaaaacgauggcuaugguacugagcaucgugucgcuauuccccuugugccucucuaccacgucgcagaagaccacguggcucccaguucuucuaggcucucucggcugcaagccgcugaccauguuccugaucgccgaaaacaaaaucugggggcggcgcuccuggccccucaacgaggggauuauggcggugggcauuguuuccaucuuacugucuuccuuacucaaaaacgacgugccccuggccgguccccugaucgccgguggcaugcugaucgcgugcuacguuauaagcggguccagcgcggaucugucccucgagaaagcggccgagguaagcugggaggaggaggcugagcacuccggcgccucucacaacauccugguggagguacaggaugacgggacaaugaagaucaaggacgaggagcgggacgacacccugaccauccuccugaaggccacgcugcucgcggucuccggcguguacccguugagcauccccgccacucuguucgucugguacuuuuggcagaagaaaaagcaacgcagcggggugcucugggauaccccuagcccaccugagguggaacgggccguccuggacgacgggaucuaucgcaucaugcagcggggccuacuggggaggucccaggugggcgugggaguuuuccaagagaauguguuccacacaauguggcaugugacacgaggcgcaguccucauguaccaggguaaacgacuggagcccucgugggccuccgugaaaaaggaucugauaagcuacggcggcggguggcggcuccagggauccuggaauaccggggaggaagugcaggucaucgcgguugagcccggcaagaaccccaaaaacguacaaaccgcccccggcaccuucaagacccccgagggcgagguuggcgccauugcgcuggacuucaagccagggaccagcgguucccccaucguuaaccgcgaggggaaaaucgugggccuuuacggcaacggagucgugaccaccucaggaaccuacguguccgccaucgcgcaggccaaagccucacaggagggcccgcuccccgagauagaggacgagguuuuccggaagcgcaaccugaccaucauggaucuacacccgggcagcgggaagacccggcgcuaucucccggcgaucgugcgggaggcgaucaagcggaaacuucguacccugauccucgcccccacgcggguugucgcgucggagauggccgaggcgcugaagggcaugcccauccgcuaccagaccaccgcgguuaagagcgagcacaccgguaaggagaucguggaccugaugugccacgccacguucaccaugcgacuccucucgcccguccgggugccaaacuacaacaugaucaucauggacgaggcccacuucaccgaccccagcuccaucgccgcgcggggguacaucagcacucgagugggcaugggcgaggcggccgccauuuuuaugacggcaacgccgccaggcuccguugaggcguucccucagucaaacgcaguaauccaagacgaggagagagacaucccagagcgcuccuggaacagcggguacgaguggauuaccgacuuccccggcaagacagugugguucguuccuucgauaaagagcggaaacgacaucgccaauugccugcggaagaacgggaagcgcgugauucagcucucccgaaagacauucgacaccgaauaccagaagaccaagaacaacgacugggacuacguggucacuacugauauuucugagaugggcgccaacuuccgcgccgaccgggugaucgacccgcguagaugccugaagcccgugauccugaaggacgggccugagcgcgucauccucgcuggccccaugccaguaaccgucgccuccgcugcacagaggcgcgggcggauaggccgcaaccacaacaaggagggcgaucaguauauuuauauggggcagccccugaacaacgacgaggaccacgcgcacuggaccgaggccaagaugcugcucgacaacaucaacacccccgaggguauaaucccugcccuauucgagccggaaagagaaaagagcgcagcuauugauggggaauacagauugcgcggcgaagcccggaagacguucguagagcucaugcgccgcggagaccugcccguguggcugaguuacaaaguggcgucggagggauuccaguacucugaccgccggugguguuuugacggcgagcgcaacaaccagguacucgaggagaacauggacguagaaaucuggaccaaggagggggagcggaagaagcugcgcccccggugguuggacgcccgcaccuacuccgaccccuuggcccuucgggaguucaaggaguucgcagcugggcgccggagcgucuccggagaccugauccucgaaaucggcaagcugccgcagcaccugacccagcgggcgcagaacgcgcucgacaaccuggugaugcugcacaacagcgagcagggcgggcgggcuuaccgccacgccauggaggaacucccggacacgaucgagacccuaaugcugcucgcacugaucgcugugcuuaccggcggugugacgcuauucuuccuguccggccgggggcugggaaaaaccagcauuggacuccugugcgugauggccuccaguguucugcucuggauggccuccgucgagccccacuggaucgccgcgagcaucauccuggaguucuucuuaauggugcuccugauccccgagccggaccgccagagaacgccccaggacaaccagcuggcauaugucgugaucggacuccuguucaugauccugaccguagccgccaacgagaugggccucuuggagaccaccaagaaagaucuggguaucggacacguugccgucgagaaucaccaccaugcugccaugcucgacguggaucugcaccccgcuuccgcguggacgcuguacgcgguggcgaccaccauuaucaccccgaugaugcgccacacaaucgagaacaccacggccaacaucucacucaccgccauagccaaccaggcggcgauacugauggggcuggacaagggguggcccaucucuaagauggacaucggcgucccauugcuggcccuaggguguuacagccaggugaacccccucacguugacugcugccguacugaugcuagucgcgcauuacgccaucaucggcccggggcugcaagccaaggccacccgagaggcccaaaagcggaccgcggccggcaucaugaagaaccccacgguggacgguaucguggccaucgaccuggacccugucguuuacgacgccaaguucgagaagcagcucggacagaucaugcuccuaauacucugcaccucccagaucuuacugaugcgcaccacuugggcucucugcgagagcaucacgcuggcgacaggcccacugaccacacucugggaaggguccccgggcaaguucuggaacacgaccaucgccgugagcauggccaauaucuuccggggguccuaccuggccggcgccggucuggcguucuccuuaaugaagucccugggcggcgggcgccgggggaccggggcccagggcgagacccugggagagaaguggaagcgucagcucaaccagcucuccaagagcgaguucaacacguacaagcgguccgggauaauggagguggaucggucugaggccaaggagggccugaagcgcggggaaacgaccaagcacgcugugucccgcggcacggcgaagcuaaggugguucguugagcgcaacuuagucaagcccgaggggaaggugaucgaucugggcugcggcagaggaggcuggagcuacuacugcgccgggcugaagaaggugacggaggucaagggcuacaccaaaggcggucccggccacgaagaaccaauuccgauggccaccuacggguggaaccucgucaaacugcacuccggcaaagauguguucuucaucccacccgagaaaugcgauacccugcucugcgacaucggggaaucaagucccaauccgacgaucgaggaaggccgaaccuuaagaguacucaagaugguggaacccuggcuccgcgggaaccaauucugcaucaagauucugaaccccuacaugccgagcguggucgagacccuggagcaaaugcagcggaagcacggggguaugcucgugcgcaacccgcuuucgcgaaauucaacccacgagauguacugggugucuugcgggaccggcaacauugucagugccguaaacaugaccucccgcaugcugcucaaccgcuuuacuauggcccaccggaaaccgaccuacgagcgagacguggaccugggggcgggcacgcggcacgucgcaguggagcccgagguggccaaccucgacaucaucggccaacgcaucgaaaauauuaaacacgagcacaagaguacguggcacuaugaugaagacaaccccuacaagaccugggcguaccauggguccuacgaggugaagccgagcggcuccgccagcagcauggugaacggagucgugaagcuccugaccaagcccugggacgugaucccuauggucacucagaucgcgaugacggauacaacgccguuuggccaacaacggguguuuaaggaaaagguggacacccgcacgccgaaggccaagagggggaccgcccagaucauggaggucacugccaaguggcuguggggcuucuugucccgcaacaagaagccgcggaucugcacccgcgaggaguucacucguaaggugcgcuccaaugccgcuaucggcgcugucuucgucgaugagaaccaguggaacuccgcuaaggaggccgucgaggaugagcgauucugggacuugguacaccgcgagcgggagcuacacaagcaggggaagugugcgaccugcgucuauaacaugaugggaaagcgcgagaagaagcucggggaguucggcaaggccaagggaucacgugccaucugguauaugugguugggcgccagguuccucgaguucgaggccuuaggcuucaugaacgaagaucauugguuuucccgugagaacagcuuaagcggggucgagggcgagggucugcacaagcucggcuacauccugcgggacaucagcaagaucccagggggcaauauguacgccgacgacaccgcuggcugggacacccgaaucacggaggacgaucugcagaaugaagcccgcaucaccgacaucauggaaccggagcacgcccucuuagcaaaguccaucuuuaagcugaccuaccagaacaaggugguccgggugcagcgucccgcgaaaaacgggaccgugauggacgucaucagccgacgggaucagcgcggcucggggcaaguggggacguacggccucaauacguucaccaacauggaagcucagcuaaucagacagauggagagcgaggggauuuucucccccuccgagcuggagaccccuaaccucgccgagagagugcuggacugguuggagaaguacggcgucgaacgguugaagcgcauggccaucuccggggaugacugcguggugaagccgaucgaugaccgguucgccacggcgcugaccgcccugaacgacaugggcaagguccgcaaggacaucccccagugggagcccaguaagggguggaaugacuggcagcagguucccuucugcucgcaucacuuccaccaacucaucaugaaggacggccgggagauugugguccccugccgcaaccaagacgagcuggugggucgagccagagugucgcagggagccggcuggagccugcgggagaccgccugccucggcaaguccuacgcgcagauguggcaguugauguacuuucaccggcgagaccugcgccucgcugcuaaugcaaucugcagcgcggucccuguagacuggauucccacuucccggacgacguggaguauccacgcccaccaccaguggaugaccacagaagacauguuaucgguauggaaccgggucuggaucgaggagaauccguggauggaggauaagacucacaucaguuccuggggagacguaccguaccuggggaagcgcgaagaccaguggugcggcagccucauaggccugacagcacgagccaccugggccaccaacauacagguggccaucaaccagguccgccggcugauugggaacgagaacuaccuugacuauaugacguccaugaagcgcuuuaagaacgaaucggauccugagggagcucuaugguga

SEQ ID NO: 24319 - RNA, 9879 nt, Artificial Sequence
  derived and/or modified CDS sequence (opt11) from DENV-1__GQ199805__SS-prME
agcguuaccaugcuguugaugcugaugccuacagcccuggccuuccaucucacuacgagagggggcgagccccacaugaucgugaccaagcaagaacggggcaagagccuccuguucaagaccagcgcuggggugaacaugugcacccucauugcgauggaccugggggagcugugcgaggacaccaugaccuacaaguguccccggauaaccgaagccgagccggacgacguggacugcuggugcaaugccacugacaccugggugacuuaugggacaugcagucagacgggcgagcaccggcgcgacaaacggucgguagcccuugcuccacacgugggguuagggcuggagacccgcaccgagaccuggauguccagcgagggugccuggaagcaaauccaacgggucgagacgugggcacuucgccauccuggguucaccgugaucgcccuguuccuggcacacguaaucgggaccucaaucacccaaaagggcauaaucuucauacuccugaugcuagucacgcccucgauggccaugcgcugcguggggaucggcucccgagacuucguggagggguuaagcggcgcgaccugggucgacgugguguuagagcacgggagcugcguaaccacgauggccaaggauaaacccacccuggacaucgagcuccugaagaccgaggugaccaacccagccgugcugcggaagcucugcaucgaggcuaaaaucucaaacaccacaaccgacucccguugcccuacccaaggugaggccacccugauggaggagcaggaugcuaacuucguuugccggcgcacguucguggaccggggcugggggaauggcugcggucuguucggaaaggggagccucaucacaugugcaaaguucaaaugcgugaccaagcuggagggcaagaucguccaguacgagaacuugaaguacuccgugaucgugaccguccacacgggagaccagcaccaggucgggaaugaaagcaccgagcacggcaccaccgccaccaucacaccccaggcuccuaccuccgaaauacagcucaccgacuacggggcccugacacuggacuguucacccagaacgggccucgacuucaaugagaugguccuccucacgaugaaggaaaaauccuggcucguacacaagcaaugguuucuggaucuuccgcuccccuggaccagcggggccagcacgucgcaggagacguggaaccggcaggaccugcugguuaccuucaagaccgcccacgccaagaagcaggaggucguggugcucggcucgcaggagggcgcaaugcacaccgcccugacgggggccaccgagauccagaccagcggcaccacgaccaucuucgccgggcaccugaagugccgccucaagauggacaaacuuacccugaagggaaugaguuacgucaugugcaccggauccuucaaguuggagaaggagguagcagagacgcagcacgggaccgugcugguccagaucaaguacgaggguaccgacgcgcccugcaaaauccccuuuagcacucaggacgagaagggugugacgcagaacggccggcugaucacagccaauccgauaguaaccgacaaagagaagcccgugaacaucgaggcugagccgcccuucggggagaguuauaucgugaucggcgcuggcgagaaggcgcuaaaacuuagcugguuuaaaaaggggaguucuaucggcaagauguucgaggccaccgcccggggagcucggcgcauggccaucuugggagacacggcgugggauuuuggguccaucggcgguguguucaccucuguugggaaacugguucaccagaucuucgguaccgccuacggugugcuguuuuccggugucagcuggaccaugaaaaucgggcugggcguguuacuaacauggcucggccuuaauucccgcucgacguccuuaagcaugaccuguauugcuguugggcuggucacccuguaccucggugugauggugcaggccgacucugggugcguaaucaauuggaaaggucgggagcuaaagugcgggagcgggaucuucguaacgaacgaaguacacaccuggacggagcaguacaaguuccaggccgauucgccaaagcgccuguccgcggccaucggcaaggcaugggaggagggggucugcggcaucaggagcgccacccgacucgagaacauuauguggaagcaaaucuccaacgaacugaaucacauucuucucgaaaacgacaugaaguuuacggugguggucggcgacguggugggcauccuggcacaagguaagaagaugauccggccccaacccauggagcacaaguacagcuggaaguccuggggcaaggcgaagauaauuggagccgaugugcaaaacacgaccuucaucaucgacgggcccaauaccccugaaugccccgacgaccagcgggccuggaacaucugggaaguugaggacuacggauuuggcauuuucaccacuaacauauggcugaaacucagggacagccacacccaggugugcgaccaucggcugaugagugccgcaaucaaggacucgaaggccgugcaugccgauaugggcuacuggauagaauccgagaagaacgagaccuggaaguuagccagggccagcuucaucgaggugaagaccugcaucuggcccaaaucccacacguuauggucaaacggcgugcuggaguccgagaugaucauccccaagaucuacggagguccgaucagccagcacaacuaccgucccggguacuucacccaaaccgcgggaccguggcaccuggggaagcucgaacuggacuuugaccugugcgagggcacaacugucgucguggacgagcacugcgggaaccgggggccgucccuccggaccaccaccgucacggguaagaucauccacgaguggugcugccggucuugcacgcugccgccccugcgcuuuaagggggaggacggcuguugguacgggauggagauccggcccgugaaggagaaagaagagaaccuagugaagucaauggucagcgcaggcucgggggagguugauagcuucagccuaggguugcuuuguaucucuauuaugaucgaagaggugaugcgcucacguugguccaggaaaaugcuaaugacgggcacgcuggccgucuuccuccugcuuauaaugggacaauuaacguggaacgaccugacccggcuuuguauaaugguuggagcaaacgccucggaccgcauggggaugggcaccacauaccucgcauuaauggccaccuucaaaaugaggccgauguucgcgguaggccuccuguuucgccguuuaaccucccgggagguccugcuccugaccauuggucugagccucguggcaagcguagagcugcccaauagccuggaggaacucggagacgggcuggcuaugggcaucaugauucugaagcuccugaccgacuuccagucucaccaguuaugggcgacucuccuuagcuugacuuucauuaagacgacccucucccugcacuacgccuggaagacgauggcaauggugcugaguaucgucuccuuauucccccugugccuguccacuaccucccaaaagaccacguggcuacccgugcuacugggcucacucgggugcaagccgcuggcuauguuccugaucgccgagaacaagaucugggggagaaagaguuggccccucaacgaggggauaauggccgucggcguggucucaauccuucugagcuccuuacugaagaacgacgugccacuggccgggccccucauugccggcggcaugcugaucgccugcuacgugaucaguggguccucagcagaccugucuuuggagaaagccgccgaagugagcugggaagaggaggcggagcauuccggcgcaagccacaacauccugguggaggugcaggaugacggcacuaugaagauaaaggaugaggagcgcgacgacacucugaccauucuccugaaggcgacccuguuagccgucuccggcguguacccgcugagcauccccgccacgcuuuucgugugguauuuuuggcagaagaagaagcagcguuccgggguucugugggacacacccagcccgcccgagguggaacgggccguucucgaugacgguaucuaccgcaucaugcagcgcggcuuacuggggcgaagucaggucggcguggggguguuccaggagaacgucuuucauacuauguggcacguaacccgaggcgcagugcucauguaccaggggaagcgccuggaacccagcugggcuuccgugaagaaagaccugauuagcuacgguggcggguggcggcuccagggcuccuggaacacaggggaagaagugcagguuaucgccguagaacccggcaagaacccgaagaacguucaaaccgcuccugguaccuuuaagacccccgagggggaggugggcgccaucgcccuggauuucaagcccggcacuagcggaagcccaaucgucaaccgcgaggggaagaucgugggccuguauggcaaugggguggucacgaccagcgggaccuacgugagcgcgaucgcacaggccaaggccucccaggaggggccgcuccccgaaauugaggacgagguguuccggaagcggaaccugacgauuauggaccugcacccgggcagcgggaaaacccggcgcuaccucccggcgaucguccgugaagccaucaaacgcaaacugcgaacccugauucucgccccaacacgggugguggccuccgagauggccgaagcgcugaagggcaugcccauccgcuaccagacuacagcagucaagagugaacauacgggcaaggagaucgucgaccuuaugugccaugccaccuucacgaugcggcuccugucgcccgugcgcgucccuaauuacaacaugauaaucauggacgaggcccacuuuaccgaccccagcuccaucgcggcgcgaggguacaucagcacaagggugggcaugggagaagccgcugcuaucuucaugacggccacgccgccaggcucuguggaggcguuuccgcagucaaacgccgucauucaggacgaagaacgggacaucccagaacgcuccuggaacagcggguaugaguggaucacggacuuccccggcaaaaccguaugguucguacccuccaucaagucagggaacgacaucgcaaacugccugcggaaaaacgggaagcgagugauacagcugucccguaagacguucgauacggaguaccagaagacaaagaauaacgacugggacuacguggugaccaccgauaucagcgagaugggcgcuaacuuucgcgccgaccggguaaucgacccgcgacggugcuuaaagccugugauacugaaggaugguccagagcgcguaauccucgccggcccuaugcccgugacggucgccuccgcagcccagcggcgcggucggauuggcaggaaccacaacaaggagggggaccaguauauauacauggggcagcccuugaacaacgacgaagaccacgcgcacuggacggaggccaagaugcuguuagacaacaucaauacccccgagggcaucaucccggcccuguucgagccugaacgggagaaguccgccgccaucgauggggaguaccgccugcgcggcgaggcacggaagaccuucgucgagcuuaugaggcgcggggaccuuccuguguggcuguccuacaagguggccucugagggcuuccaguacagugaccgccgguggugcuucgacggggagagaaacaaccagguacuggaagagaauauggacguugagaucuggacgaaggagggggagaggaagaagcugcguccccgguggcuggacgcccgcaccuacuccgacccccucgcgcugcgggaguucaaggaguuugccgccggcaggcguucaguauccggugaccuuauccucgagaucggcaagcugccgcagcaucugacccagcgcgcccagaacgcccucgauaauuuggucauguugcacaacagcgagcaaggaggccgggccuacagacaugcuauggaggaguuacccgacaccaucgagacucugauguugcucgcgcugauagcaguguugaccgguggagugacccucuucuuuuuaagcggccgggggcugggaaaaaccagcaucggccuccugugcgucauggccuccagcguauuguuauggauggccuccguggagccacauuggaucgcugccagcaucauccuggaguucuuccugaugguccuccugauuccggagccggaccgccagcggacuccccaagacaaucagcuggccuacguggucauagggcuacucuucaugauccugacaguagccgcaaaugagauggguuuacuggagaccaccaagaaagaccuggggauuggccacguugcgguggaaaaccaccaccacgcgaccaugcuugacgucgaccugcaucccgccucugcauggacgcuguaugcgguggccaccaccaucauaaccccgaugaugaggcacaccauagagaacaccaccgcgaacauaagccucaccgccaucgccaaccaggccgcuauacugauggggcuggacaagggcuggcccauuuccaagauggacaucggcgucccccuccuggcucucgggugcuauagccaggucaacccauugacccugacggccgccgugcugaugcucguggcgcacuaugcaaucaucggcccgggacugcaagccaaggccacucgcgaggcccagaagcgcacugcggccggcaucaugaagaauccaacgguggacggaaucguugccaucgaucucgacccagugguguacgacgccaaguucgagaagcagcuaggccagaucaugcuguugauucucugcaccucccagauucugcuuaugcgcaccaccugggccuugugugagaguauuacguuggccaccggcccccugaccacccucugggagggguccccggggaaguucuggaacacgaccauagccgugucgauggcgaacaucuuccgaggcuccuaccuagcuggcgccggccuggcguucagccuuaugaaaucccucgggggaggccgcagagggacuggggcccagggcgagaccuugggcgagaaguggaagcgccagcugaaccagcugaguaaaagcgaguucaacaucuacaagcgguccgguaucauggagguagacagaucugaggccaaagagggcuuaaagcgcggggagacuacccgccaugccgucucccgagguaccgcgaagcugaggugguucguggaaaggaaccucgugaagcccgaggggaagguaaucgaccugggcugcggccgcgguggcuggagcuacuacugugcggggcucaagaaagucaccgaggugaaggguuauacgaaaggagggccuggccacgaggaaccuauccccauggccaccuacggguggaaccucgucaaguugcacaguggcaaggacguauuuuucacuccgccggagaagugcgacacucugcucugcgauaucggggagagcuccccgaauccgacgauugaggagggacggacccugcguguuuugaagauggucgagcccugguuacgggggaaccaguuuugcaucaaaauccugaaccccuacaugcccucggugguggagacgcuggagcagaugcaacgcaagcacggggguauguuagucaggaacccauugucacgcaacagcacccaugagauguauugggucuccugcgguacagguaacaucgugucggccgucaacaugacaucgcgaaugcugcucaaucgcuucaccauggcccaccgaaagcccacguacgaacgggacgucgacuugggugcgggcacccgccauguugcugucgagcccgagguugccaaccucgacaucauuggucaacggaucgagaauaucaagcacgagcauaagagcacguggcacuacgaugaggacaacccauacaaaaccugggccuaucacggguccuacgagguaaaaccgagcggcuccgcaucaagcauggugaacggagugguaaagcuccuuacgaagcccugggacgugauccccauggugacccagaucgcgaugacggauaccacucccuucggucaacagagggucuucaaggaaaaaguggacacccggacgccgaaggcaaagagagggaccgcccagauaauggaggugaccgcccgguggcuguggggcuuucucucccggaacaagaagccgaggaucugcacccgcgaggaguucacgaggaaaguccgcucaaacgccgccaucggcgccguuuucguggacgagaaccaguggaacagcgcaaaggaagcaguugaggacgaacguuucugggaucuggugcaaaaggagagagagcuccacaagcagggcaaaugcgcgaccugcguguacaacaugauggggaaacgggagaagaaguuaggcgaauuugguaaagccaaagggagcagggccaucugguacauguggcugggggcccgguuccuggaguucgaagcccucggcuucaugaacgaggaccacugguucucgcgcgagaacagccugucugggguagagggcgaaggacuucacaagcucggauauauauugcgggacaucuccaagauccccgggggcaacauguaugccgacgacaccgccggcugggacacccggauaacggaggacgaucugcagaacgaggcucggaucacugacaucauggagccggagcacgcccuccuggccacuuccauauuuaaacuuacguaccagaacaaggugguuaggguccaacgccccgcaaagaacgguacugugauggaugucauaagcaggagggaccagcggggaagugggcagguuggcacguacggccuaaacaccuucacgaauauggaggcccagcugauucgccaaauggagagcgaaggaauuuuucugcccuccgaguuggagacccagaaccuggcggagcggguguuggacuggcuugaaaaguacggcguggagcggcugaagcggauggccauuagcggggacgauugcguugucaagcccaucgacgacagguuugcgacagcgcuaaccgcccucaacgauaugggcaagguacggaaggauauuccacagugggagcccucgaagggguggaacgauuggcaacaagugccuuucugcucccaccacuuccaccaacugaucaugaaggacggacgcgaaaucguggugcccugccgcaaccaagacgagcuggucggcagggcccgggugucccagggggccggcuggucccuccgcgagaccgccugccucggcaagaguuacgcgcagauguggcagcugauguacuuccaccggcgcgacuugcggcuggcggccaacgccaucugcuccgcgguaccaguugacugggugcccacaagccggaccaccugguccauccaugcucaccaccaauggaugaccacugaggauauguugagcgucuggaaccgugucuggaucgaggagaaccccuggauggaggacaagacccacgugucaagcuggggcgaugugccauaccucgggaaacgugaggaccaguggugcggcucgcugaucggacugaccgcgagagcuaccugggcuagcaacauccaagucgccaucaaccagguucggcgccucaucggaaacgagaacuaccuggacuauaugacuagcaugaagagguuuaagaacgaaggagacccggagggggcccuuugguga

SEQ ID NO: 24320 - RNA, 9879 nt, Artificial Sequence
  derived and/or modified CDS sequence (opt11) from DENV-1__GQ199806__SS-prME
ucuguaacaaugcuccucaugcuaaugcccaccgcgcucgcauuccaccucaccacccgggggggcgagccccacaugaucguaucaaagcaagaacggggcaagagucuauuguucaagaccagcgcaggggucaacaugugcacacugauagcgauggaucuuggcgaguuuugcgaggauaccaugacauacaagugcccucgaauaaccgaagcggagccagacgacgucgauugcuggugcaaugcuacggauaccuggguaacauacgguaccugcucccagaccggcgaacacagaagagacaaacggaguguagcccuggcaccccacgugggacugggacuugaaacaagaacggaaaccuggaugagcuccgaaggagcuuggaaacagauucaacgaguagaaacuugggcccugagacacccaggauuuacuguaaucgcguuguuuuuagcucacgcgaucgggacgagcaucacacaaaaggggauuauuuucauacugcuaaugcucguaacaccguccauggccaugcgcugcguagggaucgggagccgagacuuuguagaagggcugagcggcgccacaugggucgacguaguacuagagcacggcucaugcgugaccacaauggcgaaggacaaaccaacgcucgacauagagcucuugaaaacggaggucacaaaccccgcaauacuccgaaaacugugcauagaagccaaaaucagcaacacaacaacggauaguagaugcccaacccaaggcgaagccacgcuaguagaggaacaggacgcuaauuuugucugcagaagaaccuucgucgaccgaggcuggggaaacggcuguggacuauuuggcaaaggaagccuaaucacaugugcaaaauucaagugcgucacaaaacuggaggggaagauaguacaguaugagaaucucaaguacagugucauagucacagugcacacaggcgaucagcaccaggugggaaaugaaucgacagagcacggaacgacagcgacgauuacgccacaagcacccagcacggagauccaacuaaccgacuauggggcccugacauuggacuguaguccgagaacgggacuugacuucaaugaaaugguucugcuaaccaugaaggaaaaaagcugguuaguccacaaacaaugguuccucgaucucccgcugccauggacuuccggugcaucaacgucgcaggagacauggaaucgcaaagaucuacuggugacguucaaaaccgcucacgcgaaaaaacaggaagcagugguccuugggagccaagaaggcgcgaugcacaccgcccuaaccggugccacugaaauccagaccuccgguacuaccaccaucuuugcgggccaccugaaaugccggcugaaaauggauaaacucacacucaaaggaaugucauacgucaugugcacagguucguucaaacuagaaaaagagguagccgagacccaacacggaacgguacuuguccagauaaaauacgaaggcacggaugcgcccugcaagauaccguucagcacccaggaugagaaagggguaacgcagaacgggcgccucauaacugccaacccaaucguuacagacaaggagaagccggucaacaucgaagcggaaccccccuucggagaaucguauaucguuauaggagcgggagaaaaggcccuaaaacuaaguugguucaagaaaggaucaaguaucggcaagauguuugaagccacggcucguggagccagacgaauggccaucuugggagacaccgcgugggacuuuggcagcauagguggagucuucacauccgugggaaaguuaguacaucaaauauucggaacagcauacgggguccuuuucagcgguguaaguuggacaaugaaaauuggaauuggggugcugcuaaccuggcucgggcuaaacucccgaucgacuucucuaagcaugacaugcauaguggucggcuuaguuacucucuaccugggagugaugguccaggccgauucugguugcgugauaaacuggaaggggcgcgaacucaaguguggcagcgggauauuugucacgaacgaaguccacacauggaccgaacaauacaaguuccaagccgauuccccuaaacgacuguccgcggcaaucgguaaggcuugggaagaaggagucuguggaauaagaucugccacccgccuggaaaacauaauguggaaacagauuucaaaugaacuaaaucacauacuacuagaaaaugacaugaaguuuaccguaguagucggagaugucgcgggaauccucgcucaaggcaaaaagaugauccgcccccaaccaauggaauauaaauacucguggaagucaugggggaaagcgaagauuaucggcgcagacguccaaaacaccaccuuuauuaucgacggccccaauaccccagaauguccugacgaccagagggcauggaacaucugggaagucgaggacuauggguuugggaucuuuacaacaaacaucuggcucaaauugcgcgacucguacacccaggucugcgaccaccgacugaugagugccgccauaaaagacagcaaagcaguacacgccgauaugggauauuggauagaguccgagaaaaaugagaccuggaaacucgcucgggcguccuucauagagguaaaaacauguauauggccaaagagccacacacugugguccaauggaguacucgaaucugagaugauaauuccuaagauuuacgggggaccaauaagccaacacaacuaucgaccgggguacuucacacaaacggcggggccauggcaccugggcaaacuggaauuagacuuugaucuaugcgaagggacaacagucguaguugacgagcacugcggcaacaggggucccucccuccggaccaccacugucacagggaagauaauccacgaauggugcuguagaucaugcacucugccaccacugcgguucaaaggcgaggacggcugcugguacggcauggagauucgaccagugaaagaaaaagaggaaaauuugguaaaaagcauggucuccgcggggagcggugagguugacaguuucagccucggacuccucugcauuucgaucaugauugaagaggugaugcggucaagguggagccgaaagaugcucaugacugguacccuugcaguguuuuuccugcucaucaugggccagcugacguggaacgaccuaauccgauuauguaucauggucggcgcgaacgccagugaccggaugggaaugggcacaacauaccuugcacuaauggccaccuucaagaugcggccaauguucgcagucggacuccuauuuagaaggcucacgucacgagaagugcugcuucuaacuaucggccugagccucgucgcgagcgucgagcucccaaacucccuggaagaacuaggagacgggcucgcaauggguauaaugauauugaaacucuugaccgauuuucagucacaccagcuaugggcaacgcuguugagcuugacuuucaucaagaccacguucucacuccauuacgccuggaaaacaauggccaugguccugucgauagucagucucuuuccacuaugccucagcacaacuucgcagaaaacaacauggcuaccgguucuccugggaagccucggcugcaaaccccuaacgauguucuugauagccgagaacaaaaucuggggucggaaaagcuggccucucaacgaaggaaucauggcugucgggauaguguccauacuccugagcucacuucugaaaaaugacguaccauuggccggcccgcucauagcaggcggcaugcugaucgcgugcuaugucauaucagggucaucggccgaccuaucucuagagaaggccgccgaagucagcugggaggaagaagccgagcauagcggcgcaucccauaauauccuaguggaaguacaagacgacggaaccaugaagauuaaggacgaagagagagacgacacccugacaauucuacucaaagccacauuauuggcagucaguggcguguacccccugucaauacccgcaacacuauuugucugguacuucuggcagaagaaaaaacagcgaucaggcgugcucugggacacgcccagcccuccggagguagaaagggcaguacuagacgacggcauauacaggauaaugcagaggggccuucuaggaaggucccaggucggggucggcgucuuccaagaaaauguauuccauacaauguggcaugugacacgcggugcgguacuaauguaccaaggcaaaaggcucgaacccuccugggcaucuguaaagaaggaucucauaucauauggagguggauggaggcugcaggggagcuggaacaccggggaagaaguacaagugaucgcgguggaaccgggaaagaaccccaaaaacguccagacagcacccgggacguuuaaaacaucggaaggagaagucggggcgaucgcccuggacuucaagccaggcaccucggguagcccgaucguaaaccgcgaaggcaaaauugucggacucuacggcaacgggguggugacuacgagcggcaccuaugucagugcgauagcgcaggcgaaagccucccaggacggaccucuaccggaaauagaggacgaaguauucagaaagagaaaccuuaccauuauggaccugcacccaggaucagggaaaaccagacgauaucuacccgcaaucgugagagaagcgauuaaacgcaagcuucgcacauuaauacuagcuccuacccgugugguagccuccgaaauggcugaggcucucaagggcaugcccaucagauaucagaccacagccgucaaaagcgaacacacaggaaaggaaaucgucgaccucaugugccacgcuaccuuuacaaugcgccuccucaguccuguccgaguccccaacuauaacaugauaauaauggaugaagcgcacuuuacagaccccagcucaaucgccgcgcggggauacauaucgacgagagucggcaugggggaagccgccgccauauuuaugaccgcaacacccccaggaucgguugaggcauucccacagagcaacgcaguaauccaagacgaagaacgcgacauaccugaacggucguggaacagcggcuacgaauggaucaccgacuuuccaggcaaaaccgucugguucgugccgagcauaaaaagcgggaaugacaucgccaacugucugaggaaaaaugggaaaagagugauucaacucagucgcaaaacauucgacaccgaguaccagaaaaccaagaacaacgauugggacuaugucguaacuacugacauuagcgaaaugggggcaaauuucagagcggaucgcguuaucgauccccggcguugcuugaaaccgguaauccucaaagacgggccugaacggguaaucuuagcaggcccuaugcccguaacgguggccucagccgcgcaaaggagagggcgaauaggcaggaaccauaacaaagaaggggaccaauauauuuacaugggucagccucugaauaaugacgaggaucacgcacauuggacagaagccaaaaugcuccuagauaacauaaacacacccgagggaaucauaccagcacuguucgagcccgagcgcgaaaaaucggcagccaucgacggggaguaccgcuugagaggagaggcacgcaagacauucguggagcucaugcgccggggagaccugcccguauggcugucuuacaagguagcaucagagggcuuucaauauuccgaucggcgcuggugcuucgacggcgagcggaauaaccaaguucuagaggaaaacauggacguagaaaucuggacgaaggagggagagcggaaaaaguugagaccuaggugguuggacgccaggacguauagugacccauuggcacugcgcgaauuuaaggaauuugcagcagggaggcggucgguuagcggcgaccuaauucuggagaucgggaagcuuccucaacaccugacucagcgagcgcagaacgcacucgauaaccucguuaugcuucacaauagcgagcaaggcggaagagcguaccgucacgccauggaagaacucccggacaccauagaaacccuaaugcugcucgcgcuuauugcaguccuuaccggaggagugacucuguuuuuucuuagcggacgcggguuagggaaaacaaguauaggucuccucuguguaauggccucuucuguccugcuauggauggcauccguugaaccgcauuggaucgcugcgucgauaauauuagaauucuuccuaaugguucuccuaauuccagagccagaucggcaacgcacaccccaggauaaucaacuugccuacgugguaauaggccuacuauucaugauacucaccguggcagcgaaugaaaugggcuugcuagaaaccacaaagaaagaccuggguauugggcacguugcaguagagaaccaccaccaugcagccaugcuggacgucgaccugcacccagccucagccuggacccuauacgcagucgcaaccacgauaauaaccccgaugaugcgucauaccauagagaacaccaccgccaauauaucgcugacggcaauagccaaccaagccgcgauacuuaugggccuggacaaagguuggccuauuuccaaaauggacaucggcgucccauuauuagcacuagggugcuacagccagguaaacccacuaacacugacggcggcaguauuaauguuaguggcccauuacgcaauaaucggucccggacuccaagcuaaggcaacacgggaggcccagaaacgaaccgccgccggaauaaugaaaaaccccaccguggacgggauagucgcuauagaccuugauccggugguuuacgacgccaaauuugagaaacagcuagggcaaauaaugcuccugauacuguguaccagccagaucuugcuaaugcguacuaccugggcccuaugugagaguauaacccuugcgacuggcccguugacgacgcuaugggagggcagcccaggaaaauuuuggaauacaacgauugcggugucgauggcgaacauauucaggggcucuuaccuggcaggggcgggucucgccuucucacucaugaagucgcucggagguggcagacggggcacgggggcacagggcgaaacccuuggagaaaaguggaaacggcaacucaaccaacuaagcaaaagugaguucaauaccuacaaacgcagcggaauaauggaaguggacaggagcgaggcaaaagagggacugaaacggggugaaacuaccaaacaugcaguuagcaggggcaccgcaaaacuacggugguuuguggaaagaaaccugguaaaaccagaaggaaagguaauagaccucggguguggacguggagguuggagcuacuauugugcgggauuaaaaaaagucacggaagugaagggauacaccaagggcgguccaggccaugaggagccuauacccauggccacguacggauggaaucugguaaaacugaacuccgggaaagacguguucuuuauaccgccagagaagugcgacacgcuccugugcgauauaggcgaaaguucacccaacccgacgauagaggaagggcgcacccugcgugugcuuaaaaugguagaaccauggcuaagaggcaaccaguucugcaucaagauccugaauccauacaugccaagcgugguagagacacuagaacaaaugcaacggaagcacggggggaugcugguacgcaacccacucucaaggaacucuacacaugaaauguacugggugucaugugggacuggaaacaucgucagcgcugucaauaugacaagccgaauguugcuaaaccgguucaccauggcacacagaaagccuacuuacgaacgggacguggaucuuggggcgggcaccaggcacgucgcgguagaaccagaaguagccaauuuagacauaauagggcagcgaaucgaaaacaucaaauacgagcacaagagcacauggcauuacgacgaagacaacccauacaagaccugggccuaccacgggagcuacgaagucaagccgucaggcucugcgagcagcauggucaacggugucguuaagcuacucacaaaaccaugggacguaauacccauggugacccagauagcaaugaccgauacuacgccauucggacaacaacgcgucuucaaggaaaagguugacacccgcacaccaaaagccaagcgaggcacagcccaaauaauggaggugacggccaaguggcugugggguuuccuuagccgaaauaagaagccacgaaucugcacgagggaggaguucacaagaaagguacgcaguaacgcggccauuggggcugucuucguagacgaaaaccaauggaacuccgccaaagaagccguagaggacgaaagauucugggaccucguccacagagaaagagaacugcacaaacaagggaaaugcgcaacaugcgucuauaacaugaugggaaaacgcgaaaaaaaacuaggggaauucgguaaggcgaagggaagcagggcgaucugguacauguggcuaggagcaagauuccuagaguuugaagcgcuggguuucaugaaugaggaccacugguuuucacgugagaacagccuaagcggcguagaaggagaaggacugcauaagcugggguacauccuacgggauaucuccaaaaucccggggggcaacauguacgcagacgacaccgcgggcugggacacccgaauuacggaagacgaccuacaaaacgaagcuaagauuaccgauauuauggagccggaacaugcacugcuugccaagucuaucuucaaacuuaccuaucaaaacaagguagucagaguccagaggccagcaaagaacggcacagucauggacgucaucagccgccgggaucaacggggaagcggacaggucgguacauacggcuugaacacauucacaaauauggaagcccaacuuauacgacagauggagagcgaaggaauauuuagcccaagcgagcuugaaacacccaaucuggcagggcgaguccucgacugguuagagaagcacggcguggagcgccuaaaacgcauggcaaucagcggggaugauugcgugguuaagccaaucgacgacagguucgcaacugcacuaaccgcgcuaaacgacauggggaaggugcgcaaggacauaccccagugggagcccucaaaaggcuggaaugacuggcagcaagucccauuuugcucgcaucacuuccaucagcuuauaaugaaggaugggcgcgagaucguugucccgugccguaaccaggacgagcuggucggucgggcgagggugagucaaggcgccggcuggagucucagggaaacagccugccuaggaaagagcuacgcacaaauguggcagcugauguacuuccauagaagagaucuacggcucgcagcaaaugccaucuguucggcagugccaguagauugggucccuacgucccgaacaaccuggagcauccacgcccaccaccaguggaugacgacggaggacaugcugucaguauggaaccgggucuggauagaagaaaaccccuggauggaggauaaaacacacaucucaagcugggaagauguaccauaccuuggcaaacgcgaagaccaguggugcggcagccugauaggccugacugcaagggccacgugggccacaaauauacaggucgccauuaaccaggugcggcgccucauagggaacgaaaacuaccucgacuacaugacuagcaugaagagauuuaaaaacgagagcgacccagaaggcgcacugugguga

SEQ ID NO: 24321 - RNA, 9879 nt, Artificial Sequence
  derived and/or modified CDS sequence (opt11) from DENV-1__GQ199809__SS-prME
ucggugacuauguugcucauguugaugcccacagcccuggcguuccaucucaccacccguggcggggagccccacaugaucguaaccaagcaggaaaggggcaaaucccuucuguucaaaaccagcgcgggggugaacauguguacccucaucgccauggauuugggugagcugugcgaggacaccaugaccuacaaguguccccggaucaccgaggccgagcccgacgacguggacuguugguguaacgccacugacaccugggugacguacgggaccugcagccagaccggugaacaccgcagggacaaaagaagcgucgcucucgcgccacacgucgggcuggggcuggagacucgcaccgagaccuggaugucgagcgagggugccuggaagcagauccagaggguggaaacuugggcucuccgccaccccggguucaccgugauugcuuuauuccuggcucacgcaaucgggacuaguaucacccagaaggggaucauauucauccuacucauguuaguaacaccaagcauggccaugcguugcgugggcaucggcucgcgcgacuucguagagggcuugagcggagccacguggguugaugucguacuggaacacggguccuguguuaccaccauggccaaagacaagccuacgcucgacaucgaacucuuaaagacugaaguuaccaacccggcgguucugcggaagcucugcaucgaggccaagauaagcaacacuacgaccgacucccgcuguccaacccagggugaggccacccugauggaggagcaggacgccaacuucgugugccgucgaaccuucgucgaccggggcugggggaacggguguggguuguucggcaaggguucucucaucacaugugcaaaguucaagugcgucacgaaguuggagggaaaaauugugcaauacgagaaccugaaauacuccgugaucgugaccguucacacgggcgaccagcaccaggucgggaaugagagcaccgagcacggaaccacagcgaccaucacgccccaagcccccacuucugagauccagcucacugacuacggugccuuaacccuagauugcuccccacgaacaggccuagacuuuaacgaaaugguauugcugaccaugaaggagaagucuuggcucguccacaagcagugguuccucgaccugcccuugcccuggaccuccggggcuagcacgucccaggagaccuggaaucggcaagaccuccuggucaccuuuaaaacagcgcaugcuaaaaaacaggaaguggucgugcucgggagccaggagggggccaugcacacggccuugacgggggcuacggagauacagaccuccggcaccaccaccauauucgccgggcaccugaagugccgguuaaagauggacaagcugacacugaaaggcauguccuacgugaugugcacuggauccuuuaaguuggagaaggaaguagcggagacacagcauggcacggugcuggugcagaucaaauaugagggcaccgacgcaccaugcaaaauccccuucucuacacaggacgagaaggggguuauccagaaugggcggcugaucacggccaacccgauuguuaccgacaaggagaaaccgguaaauauagaagccgaaccgcccuucggggagucauacaucguuaucggagugggcgagaaggcgcugaagcucagcugguucaaaaaaggguccagcaucggcaagauguucgaagccaccgcacgcggagcccggcgcauggccaucuugggcgacaccgcgugggacuucggguccaucggaggcguguucacguccgucgggaagcuaguccaucagauauuugggacagccuaugggguucuguucaguggcgucucguggacgaugaaaaucggcaucggcguucuccugaccugguugggccugaacucccgcagcacgucccugaguaugacaugcaucgccguggggcucguuacacuguaucugggcgugauggugcaggccgacucaggaugcgucaucaacuggaaagggcgggaacucaaaugcgggagcggcaucuucgugacaaacgaggugcacacuuggacugagcaguacaaguuccaagccgacucuccgaaacgccuguccgcugcaaucggcaaggccugggaagaaggcguguguggcauccggucgguaacacgccuggagaacauuauguggaaacaaauauccaacgagcucaaccacauccugcuggagaacgacaugaaguuuacagucgucgugggcgacguggucggcauacucgcccaaggaaagaaaaugauccggccccagccuauggagcacaaauauagcuggaagucguggggcaaggcgaaaaucaucggugcggacguacagaacaccacguuuaucaucgacggccccaauaccccggagugccccgacgaccagcgcgccuggaacauaugggagguggaggacuacggcuucggaaucuuuaccaccaacaucuggcuaaagcugcgggacagcuacacccaggcgugcgaucaccgccucauguccgcggccaucaaggauucaaaagccguccaugccgacaugggcuacuggauugaguccgaaaagaacgagacuuggaagcucgcccgggccucguuuaucgagguuaagaccugcaucuggcccaagucccauacucuauggagcaacggugugcucgaguccgagaugguuauccccaagaucuacgguggccccauuagccagcacaacuaccgccccggcuacuucacacagaccgcaggccccuggcaccuugggaagcuggagcucgauuuugaccugugcgaaggcaccacagucguggucgacgagcacugcgggaaccggggaccgucucuacgcacgaccacagugacuggaaaaaucauccacgaguggugcugccguagcugcacucugccuccccuccgcuucaaaggcgaggacggaugcugguacggaauggaaauccggcccgugaaggagaaggaggagaaccugguaaaguccaugguguccgccggcucgggcgaaguugauucguucagccuuggucuccugugcaucucaauuaugaucgaggagguuaugcgaagccgguggucccgcaagaugcucaugaccggcacguuggcaguguuccuguugcugaucauggggcaacugaccuggaacgaccucauccgacugugcaucaugguuggugccaaugcuagcgacagaauggggaugggcacgaccuaccuggcgcucauggcaaccuucaagaugcgcccuauguucgccgucgggcugcuauuccgccgacucaccucccgggaggugcugcuacugacaaucgggcugagccuugucgcauccguagagcugccuaacagccuggaggaguuaggcgacgggcucgccaugggcauaaugauccugaagcugcuuaccgacuuucagucccaucagcugugggcuacacugcucagccugaccuucauaaaaaccacacuaaguuugcacuacgccuggaaaaccauggccauggugcuuagcaucguuucucuguucccguuaugccugagcaccacaucccagaagaccaccuggcugccggugcuccugggaucacuggguugcaagccgcuuacgauguuccugaucgccgagaauaagaucuggggucgcaaguccuggccccuaaacgaggggaucauggccgugggcgucgugagcauccuucugagcucauugcucaaaaacgaugugcccuuggcggggccccugauugccggcgguaugcugaucgcaugcuacguuauuaguggauccagcgccgaccugucacuagagaaggcggccgaggucagcugggaggaggaggccgagcauuccggcgccagucacaacauucucguugagguacaagacgacggaacaaugaaaaucaaagacgaggagcgagaugauacccugacaauccugcucaaagccacccugcuggcgguguccggcguguauccgcuaaguauaccugcgacccuguucgucugguacuucuggcagaagaagaaacagcgcucuggcguguuaugggacacgcccagcccgcccgagguggagcgggcaguccuggacgacggcauuuaccgcauaaugcagcggggccuccuggggcgcagccaagugggaguggggguuuuccaggagaacguguuccauacaauguggcacgugacccggggagcaguucugauguaccaaggcaagcgacucgaacccagcugggcgagugugaagaaggaccugauaucauauggaggcggguggcggcugcagggcuccuggaauacgggggaggagguccaagucaucgcgguagagcccggcaagaacccaaaaaacgugcagacggcccccgguaccuucaaaacuccggagggcgaggucggagccauugcccucgacuucaagcccgggaccagcggauccccuaucguaaaccgugaggggaagaucgugggucuguauggcaaugggguagugacgacguccggaaccuacgugagcgccaucgcgcaggccaaagcaucccaggagggcccacugcccgagauagaagacgaggucuuuagaaagcguaaucucaccauaauggaccuccacccuggcagcgggaagacucggagguacuuaccagcgaucgugcgagaagccaucaagcgaaagcuccggaccuugauccuugccccgacgcgcgugguggcgucagagauggccgaggcccuuaaaggcaugccgauccgcuaccagaccacggcgguuaaaagcgagcacacaggcaaggagauaguggaccugaugugucacgccacauucacgaugagauugcuaucucccguucgcguuccgaauuacaauaugauuaucauggacgaagcccacuuuacggaccccagcuccauugccgcccggggguacauuagcacccgcgugggcaugggggaagcggccgcgauuuucaugaccgccacuccccccggcuccgucgaggccuucccccaaagcaacgcggugauucaggaugaggagagggacaucccugagcgcucauggaacuccgguuacgaguggauaacggacuuccccgggaagacaguaugguucguccccucuaucaagagcggcaacgauaucgcgaauugucuacggaaaaacggaaagcgcgugauccaacucucacggaagaccuucgauaccgaguaccagaagaccaagaacaacgacugggacuacguggucaccacugacaucagcgagaugggcgcuaacuucagagccgaccgagugaucgacccccgccggugucucaagcccgugauccuuaaagauggcccugaacgcgugaucuuagcggggccuaugcccgugaccguggccuccgccgcccagagacgcgggagaaucggccgaaaccacaacaaagaaggcgaccaguacaucuacauggggcagccucucaacaacgacgaggaccacgcccauuggaccgaggcgaagauguugcuggacaacauuaacacccccgaaggaaucauccccgccuuguucgagccggagcgagagaaguccgccgcgaucgacggagaguaccgccugcgcggcgaagcccggaagaccuucguggaguuaaugcgccgaggggaccucccuguguggcuguccuacaaagucgcuagcgagggcuuccaguauuccgacaggcgguggugcuucgacggcgagcgcaauaaccaggugcuggaggagaacauggauguggagaucuggacuaaagaaggggagaggaaaaagcucaggccucguugguuagacgcccgcaccuacuccgauccgcuggcucuccgugaguucaaggaauucgcggccggccgcagauccgucucgggcgaucuaauccuggaaauugggaagcucccgcagcaccuaacccagagggcgcagaaugcuuuggacaaucucgugauguugcacaacuccgagcagggcgggcgggcuuaucgccacgcaauggaagagcugcccgauaccaucgagacccuuaugcugcuugcacuaaucgcgguucugacgggcggugucacacuguuuuuccucuccggcagagggcuggggaagaccagcaucgggcuguuaugcgugauggccuccagcguguugcucuggauggccucugucgaaccccauuggaucgccgcgucaaucaucuuagaguuuuuccugauggugcuucucauuccggaacccgacaggcagcggacgccccaggauaaccagcuugccuaugugguuaucggccuucucuuuaugauccugaccguggccgccaacgagaugggccuacucgagacgaccaagaaagaccugggcaucggccacguggcggucgagaaucaccaccacgcgaccaugcucgacguggaccuccacccagccagcgcguggacccuguaugccguggccacgacaaucaucacuccgaugaugcgccauacgaucgaaaacacgacggcuaacauuucccugaccgccaucgcaaaccaggcugcgaucuuaauggggcuggauaaggguuggccaaucuccaagauggacaucggugucccccugcucgcgcuggggugcuauagccaggugaauccguugacgcucacggccgccgugcucauguugguagcccacuacgcgaucaucggacccggguuacaggcaaaggcuacgcgggaggcccagaagaggaccgcagcuggcaucaugaagaauccaaccguggacgggauuguggccaucgaccuggaucccgucguguaugacgcuaaguucgagaaacaacucggacagaucaugcuccugauccuuugcacuucccagauccugcuaaugcgcaccacuugggcccugugcgagaguauaacccucgcaacagggcccuugaccacccugugggagggguccccgggcaaguucuggaacaccacaaucgcggugagcauggcgaacaucuuucgggguuccuaucucgccggcgccggccuggccuucucgcugaugaagucacugggcggcgggcgcagaggcaccggggcgcagggcgagacccugggcgaaaaauggaaaaggcagcugaaccagcugucuaagagugaguuuaacauauacaaacgcuccggcaucauggaggucgaccgcagcgaggccaaggagggccugaagaggggagagacuaccaggcacgccgugucccggggcaccgcaaaauuaaggugguucgucgaacggaaccuggucaagcccgagggaaaagugaucgaccucggcugcggccgugguggcuggagcuacuauugugcggggcugaaaaagguaaccgaggucaagggcuauacgaaagggggucccggccacgaagaacccauaccaauggccacguacggguggaaccucgugaagcuccacucaggcaaggacguguuuuuuacgccgcccgagaaaugugacacacugcugugugacaucggugaauccagccccaacccaaccaucgaggaaggccggacccuucgcguacuaaagaugguggagcccuggcugcgggggaaccaguucuguaucaagauacucaacccguacaugccgagugucgucgagacucuggaacagaugcaacgcaaacacggcggcaugcuagugcgaaacccgcucucccgcaauucaacccacgaaauguacuggguguccugcggcaccggcaacaucgucucggcugugaacaugaccucccgcauguuacugaacagguuuacgauggcacaccgcaagcccaccuacgagcgggacguggaccugggugccggcacccgccauguugcagucgagccugaggucgccaaccucgacaucauagggcaaaggaucgagaacauuaaacaugaacacaagagcaccuggcacuacgaugaggacaaccccuacaagacgugggccuaccacgggucuuacgaagucaagccuucaggaucugccagcucaauggugaacgggguggugaagcuguugaccaaaccuugggacguaauccccaugguaacacaaaucgccaugaccgacacgaccccuuucggacagcagcgcguguucaaagagaaggucgauacccggaccccuaaagcgaagcgcggcacugcucaaauuauggagguaacggcccgcuggcuguggggcuuucuaucccgaaacaagaaaccucggaucugcacccgggaagaguucacccggaagguucgcagcaacgccgccaucggcgcgguguucgucgacgagaaccaguggaacuccgcgaaggaggcaguggaggaugagcgguuuugggaucuugugcaaaaggagcgcgagcuucacaaacaggggaagugugccacgugcguguacaauaugaugggcaaaagagagaagaagcuaggggaguuugguaaggcgaaggggagccgcgcgaucugguacaugugguugggcgcccgguuccuggaguucgaagcccugggauucaugaacgaggaucacugguucucccgcgagaacagucucucugggguggaaggggagggcuuacacaagcuuggcuacauccuccgggacaucucuaagauccccggcggcaacauguacgccgacgacaccgcggggugggacacccgcaucacugaggacgaccuucagaacgaagccaagauuacggacaucauggagccggagcacgcccugcuugcaacauccauauucaagcugaccuaccaaaacaagguuguucgggugcagcgccccgcaaaaaacggaaccgucauggacguaauaucaagacgcgaccagcgcgguucaggccaggugggcacuuacggccucaauacauucacgaacauggaggcgcaacucauccggcaaauggagucagaggggauuuuccugccgagcgagcuggaaacaccgaacuuagcagagagggugcuagauuggcuggagaagcauggaguagagcggcucaagcgaauggcgaucagcggggaugacugcguagugaagccgaucgaugaccgauucgcaacggcuuugaccgcguuaaacgacauggggaagguacgcaaggacauuccccagugggagccaucaaagggauggaaugacuggcaacaggucccuuuuugcagccaccacuuccaucagcucaucaugaaggacggucgugagaucguggucccgugucgcaaccaagaugagcuggugggccgggcgcgcgucucucagggagcuggcuggagccugcgggaaacagccugcuugggcaaaagcuacgcccagauguggcaguugauguacuuccaccgucgugaccuaaggcuagcugccaacgccaacugcuccgcggucccuguugacuggguaccaaccagccggaccaccugguccauccaugcgcaccaccaguggaugaccacggaggacaugcugagcguguggaaccgcguguggauagaggaaaaccccuggauggaggacaagacgcacguguccagcuggggcgacguccccuaccuggggaagcgggaagaccaguggugcggaucccugaucggguugaccgcgcgcgccaccugggccagcaauauacagguagcuaucaaccaggugcgacggcuaauugggaacgagaacuaucuagacuacaugacauccaugaagcgcuucaagaacgagggggaccccgaaggggcuuuaugguaa

SEQ ID NO: 24322 - RNA, 9879 nt, Artificial Sequence
  derived and/or modified CDS sequence (opt11) from DENV-1__GQ199810__SS-prME
agcgugaccaugcuucugaugcugaugcccaccgccuuagcauuccaccucaccacacggggaggugagccacauaugaucgucagcaaacaggagcggggaaagucgcugcuguucaagaccucagccggcgucaacaugugcacccucauugcaauggaccugggcgagcugugugaggacacgaugaccuauaagugcccccggauaaccgagaccgagccagaugacguugauugcuggugcaacgccacggacaccugggucaccuauggcaccugcagccagacgggcgagcaccgacgggacaagcgguccguagcccuagcaccccacguuggcuuagggcuggagacacgcacagagaccuggaugagcagugagggcgcguggaaacagauucaacgggucgaaaccugggcccugcgucaucccggguuuaccgugaucgcccuguuccuggcccaugcgaucgguacaaguaucacucagaaggggaucaucuucauccucuugauguuagugacgcccagcauggccaugcggugcgucgggaucggcagccgcgacuuuguagagggccuguccggcgccaccuggguggacgucguacuggagcacgggagcugcgucaccaccauggccaaggauaagcccacgcuggacaucgagcuccugaagaccgaggucaccaaccccgccguacugcgaaagcucugcaucgaggcaaagaucuccaacaccacaaccgacagccgcugcccgacccagggggaggcgacucugguugaggagcaggacgccaacuuugucugucggcggacauucgucgaucgaggcugggggaaugggugcggguuauucgggaaggguucacucaucacuugcgccaaguucaagugcgugaccaagcuggaggggaagaucguacaauacgagaaccucaaguacucagugaucgugacaguccacacgggcgaccagcaccagguggggaaugaauccaccgaacacggcaccaccgccacaaucacgccgcaggcacccacuaccgagauccagcucacugacuacggcgcccugacccuugacugcagcccccgcaccggccucgacuucaacgagaugguccugcuuacaaugaaagagaaguccuggcuggugcacaagcagugguuccuggacuuaccccuacccuggaccagcggggccaguacgucacaggagacauggaaccggcaggaccugcuugucaccuucaagaccgcccacgcaaaaaagcaggaagucgucguucucggcucgcaagagggcgcgaugcauacugcccugacaggggccaccgagauucagacaucgggcacgacuaccaucuucgccgggcacuugaagugucgccucaagauggacaagcugacccugaagggaaugagcuaugucaugugcacgggguccuucaagcucgaaaaggagguggccgagacccagcacggaaccgugcugguccagaucaaauacgagggcaccgacgcgccgugcaaaauccccuuccuuacgcaggaugagaagggggugacccagaacggacggcugaucacagccaaccccaucgugaccgacaaggagaagcccguaaacaucgaggccgagccacccuuuggggagagcuauaucaucaucggcgccggcgagaaagcgcucaagcucucuugguucaagaaggguucauccauaggcaagauguucgaggcuacagcccgcggggcccggcgaauggccauccugggugacaccgcgugggacuucgggagcauugggggcguguucacauccguggguaagcucguccaccagauauuugggacagcauacggugugcuguuuagcggagugaguuggacgaugaagauagguaucggaguccugcucaccuggcugggccuuaauagccgcucgaccagucucuccaugaccugcauugccguggggcuggugacucuguaccucggcgugauggugcaggccgacagcgggugcguaaucaacuggaagggacgagagcugaagugcggguccggcaucuuugucaccaacgaggugcacacguggaccgagcaauacaaguuccaggcagacagcccgaagcgccuaucugcggccaucggaaaggccugggaggagggugugugcggcauccgguccgcaaccaggcuagaaaauaucauguggaagcagaucagcaacgagcuaaaccacauacugcuugaaaacgacaugaaguucacggucguagucggggacgucgccggaauccucgcccaggguaagaagaugauccggccccagcccauggaguacaaguacuccuggaaguccuggggcaaggcuaagauuaucggugccgacgugcagaacaccaccuucaucaucgacgggcccaauaccccggagugccccgaugaccagagggccuggaacauuugggaggucgaggacuacggguucgguaucuucacgaccaacauauggcugaagcuccgggauucgcacacacagguaugcgaccacagacugaugagcgcggccaucaaagauuccaaggcugugcacgccgacaugggcuacuggaucgagagcgagaaaaacgagaccuggaaacuggcccgggcgucuuucaucgaaguaaagacgugcauauggcccaagagccacacccugugguccaacggaguacuggagagcgagaugaucauccccaagaucuacggcggcccaauaucccagcacaacuaccggcccggcuacuucacccagaccgccggcccguggcacuuagggaaguuagagcuggauuuugaccuuugcgagggcacuacggugguggucgacgaacacugcggaaaucggggaccgagcuuaaggaccacaacggugacgggcaagauuauccaugaauggugcugccguuccugcacccugccgccgcugcgguuccgcggcgaggacggcugcugguacggaauggaaauccgccccgugaaggagaaggaggagaaccucgugaagagcaugguguccgccggcucuggcgagguggacagcuucucccuggggcugcucugcaucuccauuaugaucgaggagguaaugcggucccgcuggagccggaaaaugcugaugaccggcacgcuggccgucuuuuuccuccugaucaugggucagcugaccuggaaugaccucaucaggcugugcaucauggugggugccaacgcguccgaccgcauggggauggggacaaccuaccuggccuuaauggccacguucaagaugcggccgauguucgccgucggacugcuguuccgccgccuuaccagccgcgaggugcugcugcucaccaucgggcugucucugguagccucaguugagcucccgaauucgcuggaagagcugggugauggcuuagcgauggggaucaugauccugaagcugcucacagacuuucaaagccaccagcugugggccacgcugcucucucugacuuucaucaagaccacauucagccugcauuacgccuggaagacaauggccauggugcucuccaucguaagccuguucccccugugccugucaaccaccagccagaagaccacguggcugcccgugcugcucggcucccuggggugcaagccgcugacgauguucuuaauugcggagaacaagaucuggggacggcgcagcuggccucugaaugagggaaucauggccgugggcauagucuccauccugcuuagcagccugcuaaagaacgacguaccucucgcagggccucugaucgccggcggcaugcugaucgccuguuaugugaucuccgggagcuccgcggaccucagccuggagaaggcggccgaaguauccugggaagaggagguugagcacucgggagccucccacaacauccugguggagguccaggacgacgggaccaugaagaucaaggacgaggagcgggacgauacguuaacaauacugcugaaggccacguuguuggcagugucaggcguuuacccgcugagcauccccgccacccuuuucgucugguacuuuuggcagaagaagaagcagcggagcgggguguuaugggacacccccagcccgcccgagguagaacgagcgguccucgacgaugggauuuaccgcaucaugcagcgcggcuugcucggucgcagucaggugggcgugggggucuuccaggagaacguuuuccacaccauguggcacgugacgcggggcgccguccugauguaccagggcaagcgccucgagccuuccugggccucugugaagaaggaccucaucucauauggggguggguggcgguugcaggguagcuggaacaccggcgaggagguucaggucaucgcgguggagcccggcaagaacccuaagaacgugcagaccgcccccgggaccuucaagacacccgagggcgaggucggggcaaucgcccuggacuuuaagcccgggaccucagggagccccaucgugaaccgggagggaaaaaucgucggccucuacggaaauggggucgucacaaccaguggcacguacgugucugccaucgcacaggccaaagccagccaggaggggccgcuacccgagaucgaggacgaggucuucagaaagcgcaaccugaccaucauggaccuacaccccggguccgggaagacccggcgcuaccugccugccaucguucgggaggcuauuaagcgcaagcugcggacucugauccuagcccccacgcguguugucgccucggagauggcagaggcgcucaagggcaugccuauucgcuaccaaacaaccgcggugaaauccgagcacacuggcaaggagauuguggaucuaaugugucacgccacguucacaaugcggcugcuguccccugugcgcgugccuaacuacaacaugaucaucauggacgaggcccacuucaccgaccccuccagcaucgccgcccggggguauaucuccacccgcguuggcaugggggaggcggccgccaucuuuaugacugccacuccgccgggcucugucgaggccuucccgcaguccaaugcggucauccaggacgaggaacgggacaucccggagcgcuccuggaacucuggguacgaguggaucaccgacuuucccggcaagaccgugugguucgucccuagcaucaaguccgggaacgacaucgcuaacugccuacggaaaaacgggaaacgcgugauccagcugagucggaagacguuugacaccgaguaccagaagaccaagaacaacgacugggacuacgugguuaccacggacaucagugagaugggggccaacuuccgcgcggaccgggugaucgacccgcgccgaugccugaagcccgugauucucaaggacgggccugagcgcgucauccuggcgggucccaugccggugacggucgcgagcgcugcccagcggcgggggcgcaucggaaggaaccacaacaaagagggagaccaguacaucuacauggggcagccccuaaacaacgacgaggaccacgcccacuggaccgaagcuaagaugcuccuagauaacaucaacacccccgagggcaucauccccgcccuguucgaaccggagcgagagaaguccgccgcgaucgacggggaguaccggcugcgcggagaggcccguaagacguucguggaacuuaugagacgcggggaucugccugucuggcuuagcuacaaagucgcaucagagggcuuccaauacucggaccgacgguggugcuucgauggcgagcgaaacaaccaggugcuggaggagaacauggacguggagaucuggaccaaggaaggggagcggaagaagcugcguccccgcuggcucgacgcccguacuuacucagacccccuggcccugagggaguucaaggaauucgccgccggccgcagguccguaagcggggaccucauccuugaaaucggcaaguugccgcagcaccuaacccaaagagcucagaacgcucuggacaaccuggugauguugcauaauuccgagcagggcgggcgggccuaccgccacgcuauggaggagcugccugacacuaucgagacccugaugcuccuagcgcugaucgccgugcucaccggcggggucacccuguucuucuuaagcggccgggggcucggcaagaccucgauuggccugcugugugugauggccagcuccgugcuucuguggauggccagcgucgagccccacuggaucgccgccuccaucauccuggaguucuuccucaugguacugcugauccccgagccggaccgccagcggacgccacaggacaaccagcuggccuacguggugaucggccugcuuuuuaugauccucaccguggccgccaacgagaugggccugcuggaaacgacgaagaaggaucucgggaucggccacguggccgucgagaaucaccaccaugcggcgaugcuugacguggaccugcaucccgccagcgccuggacgcucuacgccguagcuaccacaaucauaaccccgaugaugcgccacacgaucgaaaacaccacagccaacaucucccugacugcuaucgccaaccaggccgcuauccugauggggcuggacaagggguggcccaucagcaagauggauaucggcguccccuugcuggcucucgguuguuauucccaagugaacccauuaacgcugacugccgccgugcuaaugcugguugcacacuacgcaauaaucggcccggggcugcaggccaaagccacccgggaggcgcagaaacggaccgcggccgggaucaugaagaaccccacaguggacgggaucguggccaucgaccucgacccagugguguaugacgccaaguucgagaagcaguugggucagauuaugcugcucauccuaugcaccagucagauccugcucaugcggaccacaugggcccugugugaguccauaacgcuggcgacgggcccccucacuacccugugggaggguagcccgggcaaguucuggaacaccaccaucgccguguccauggccaacaucuuucgggggagcuaccuggccggggccggcuuagcauucucccugaugaagucccucgggggcgggcgccgggggaccggggcccagggcgagacccucggugagaaguggaagcgacaacugaaccagcugagcaagucggaguucaacacuuacaagcggagugggaucauggaggucgaccgcuccgaggccaaggaaggccucaagcgcggggagaccaccaagcacgccgucagccgugggaccgcgaaacugcggugguucgucgagcgcaaucuggucaagcccgaggggaaagugauugaccugggcuguggccguggcgggugguccuacuacugcgccggauuaaagaaggugacggaggugaagggguauaccaagggcggccccggccacgaggagcccauaccgauggccaccuacggauggaaccuggugaagcuacauucgggcaaagaugucuucuucauuccgccagagaagugugacacccuccugugugacauaggcgaguccagccccaacccgacuauugaggagggccgcacccugcgugucuugaagaugguggaacccuggcugcgcgggaaccaguucuguaucaagauccugaaucccuacaugcccuccguggucgagacccucgaacagaugcagaggaagcaugguggcaugcugguacgcaacccgcuaagccggaacaguacccacgaaauguauugggucagcugugggaccggcaauauagucucugccgugaacaugacgagccgcaugcuccuaaaucgcuucaccauggcccaccggaagccgaccuacgaacgcgacguugaccugggugcggguacucggcacgucgccguggagcccgaaaucgccaaccucgacauuauaggccagcgcaucgagaacaucaaacacgagcacaagaguacguggcacuacgaugaagacaaccccuacaaaaccugggccuaucauggaagcuacgaggugaagcccagcggcagcgccuccagcauggucaaugggguggucaagcucuuaaccaaacccugggacgugauccccaugguuacacagaucgcgaugacggauaccaccccguucggucagcagcgcgucuuuaaggagaagguggauacuagaacgccgaaggccaagcgggggacugcgcagaucauggagguuacggccaaguggcucuggggcuuccugagucgcaacaagaaaccccguaucugcacccgcgaggaguucacuagaaagguccgcuccaacgccgcgaucggcgcgguuuuuguggacgagaaccaguggaacagcgccaaggaggccgucgaggacgaacgguucugggaccucgugcaucgcgagcgggagcuccacaagcaagggaagugcgcgaccugcguuuacaacaugaugggcaagcgcgaaaagaaguuaggggaauuuggcaaagccaaggggucccgggccaucugguacauguggcuaggcgcccgcuuucucgaguuugaggcccugggauuuaugaacgaggaccacugguucucccgggaaaacucccucagcgggguugagggcgagggacugcacaaacugggcuacauccugcgcgacaucuccaagauccccgggggcaacauguaugccgacgacaccgccggcugggacaccagaauaacggaggacgaccuucagaaugaggcccgcaucacugacaucauggagccggagcaugcccugcuggccaagucuaucuucaagcuuaccuaccagaauaagguggugcggguccagcggcccgcgaagaacgggacggugauggacgugaucagucgccgggaucagcgcggcagcgggcaggucggcacguacggacugaacaccuucaccaacauggaggcucagcugaucaggcagauggaguccgaggggaucuucagccccuccgaguuggagacccccaaccuggcggagagaguucuggauuggcuugagaaauacggcguagaacggcugaagagaauggcgaucagcggggacgacugcgucgugaagccaaucgacgaccgguucgccacggcguuaaccgcccuuaacgacaugggcaaggugcggaaggacaucccccagugggaacccucgaagggguggaacgauuggcagcaaguccccuucugcucacaccacuuccaccagcugaucaugaaggauggccgggagaucgucgugccguguagaaaucaggaugagcuggucggccgggcccgcgugucccagggggcuggauggagccuccgggaaaccgccugucucggcaagagcuaugcgcagauguggcagcugauguacuuucaccgccgggaccuacgccuagcagccaacgcgauaugcuccgcggugccgguugacuggauacccaccagccggacgaccuggaguauccacgcgcaucaccaguggaugaccaccgaggacaugcuuagcguguggaaccgcguuuggaucgaggagaaccccuggauggaggacaagacgcacaucuccaguuggggcgacguaccguaccucgggaagagagaggaucaguggugcggcucccugaucggccuaaccgcccgggccaccugggccaccaacauccagguagcuaucaaccagguucgccggcucauagggaacgagaacuaccuugacuacaugaccagcaugaagcguuuuaaaaacgaaggcgaccccgagggggcccugugguga

SEQ ID NO: 24323 - RNA, 9879 nt, Artificial Sequence
  derived and/or modified CDS sequence (opt11) from DENV-1__GQ199811__SS-prME
agcgugaccaugcuccugaugcugaugcccaccgcccuggccuuccaccucacgacccgaggcggggagccccacaugaucgucagcaagcaagagcgaggcaagucacugcuuuucaagaccucugccggugugaauaugugcacccucaucgccauggacuuaggcgaauucugcgaggacaccaugaccuauaaguguccccggauuaccgaggccgagcccgacgacguggauugcuggugcaacgccaccgacacuugggugaccuacgggaccugcagccagaccggcgagcaucggcgcgacaagcgguccguggcgcuggcaccgcacguaggccucgggcuggagacuagaacugagaccuggaugagcuccgaaggggcauggaagcagauacagcgagucgagaccugggcccugagacaccccggcuucacggugaucgcgcucuuccuggcacacgcaaucgggaccagcauaacccagaagggaauaauauucauacuucucauguuagugaccccguccauggccaugaggugcgucggcauaggcagccgcgauuuuguggagggguuauccggcgccacuuggguggaugucgugcucgagcaugggagcugcguaaccaccauggccaaggacaagcccacccuggacaucgagcuccuuaagacugaagucacuaacccugcgguccugcggaagcuguguaucgaggccaaaaucuccaacaccaccacggacucgcgcugcccgacccaaggugaggccaccuuaguugaggagcaggacgccaacuucgucugccggcgcacguucgucgaccggggaugggggaacggcugcgggcuguucgguaaggguucccugauuacgugcgccaaauucaagugcguuaccaagcucgagggcaagaucguccaguacgagaaccugaaguacagcgucaucgugacuguccauaccggggaccaacaccagguggggaacgaguccacagagcauggcaccacggcgaccaucacgccccaggcccccucaacggagauccaacugaccgacuacggggcccucacgcuugacugcagcccccggaccggccuggacuucaaugagaugguccucuugacgaugaaggagaagucuuggcuggugcauaagcagugguucuuggaccuuccgcugcccuggacgagcggggcauccacuagccaggagaccuggaaucgccaggaccugcuagugacguucaagaccgcccacgcuaagaaacaggaagucguugugcugggcucgcaggaaggugccaugcauacggcacucacaggagccacggagauacagaccagcggcaccacgacaaucuucgccgggcaccugaagugccgcuuaaagauggacaagcucacccugaaaggaauguccuaugucaugugcaccgggagcuucaagcuggagaaggagguagcggagacccagcacgggaccgugcucguccagauuaaauacgaggguaccgacgccccgugcaagauccccuucucgacacaggacgagaagggcguaacccagaacggccgucuaauaacggccaacccuaucgugaccgacaaggagaagccagugaacauagaagcagagccgcccuucggagagaguuauaucgucauaggcgccggagaaaaggcacugaagcuguccugguucaagaagggaagcucuaucggaaagauguucgaagccacugcacgcggggccaggcgcauggcaauacucggcgacacugccugggacuuuggaucaaucggaggcgucuucacguccgucgggaagcugguacaccaaaucuucgggaccgccuauggggugcuguucagcggggucuccuggaccaugaaaauagggaucggcguucuccugaccuggcugggccucaauagccgguccacgagcuuauccaugaccugcaucgcagucggguuagucacccuuuaccuggggguaauggugcaggccgauucggggugugucauuaacuggaagggucgggagcugaagugcgggagcggcaucuucgucacgaacgaagugcacacauggaccgagcaguauaaguuucaagcggacucccccaagcgccucucggcagccaucggaaaggccugggaagagggggucugcggcauccgcagcgccacccgccuggagaacauaauguggaagcagaucucuaaugagcucaauuauauccuccuagagaacgacaugaagcugacagugguggucggggauguggcaggcauccucgcccagggaaagaagaugauucgaccacagccuauggaauacaaguacuccuggaaaagcuggggcaaggccaagaucauuggcgccgacguacagaauaccacguucaucauugacggucccaacaccccagaaugcccugacgaccagagagcuuggaacaucugggaggucgaggacuacggcuucgggaucuucaccaccaacauauggcugaaacugcgggacuccuacacucagguaugcgaccaccgccucaugagcgcagccauuaaggacuccaaggcggugcacgccgacaugggcuacuggaucgaaucagagaagaacgagacuuggaagcuggcgcgggccuccuuuaucgaggucaagaccugcaucuggcccaagagccacacccugugguccaacggggugcucgagucggaaaugauaauacccaagaucuacggcggcccgaucucccagcacaacuaccgccccggguacuucacccagacagccggcccuuggcacuugggcaagcucgagcucgacuucgaccugugcgagggcaccacagugguuguagacgagcacugcggcaaccgggggcccagccugcgcacaaccacgguaacgggcaagaucauccacgagugguguugccgguccugcacccugccgccucuccgcuucaagggagaggacggcugcugguacgggauggagauccggccaguaaaggaaaaagaggagaaucuggucaagucuaugguuagcgccggcuccggcgaaguggauucguucucccucgggcugcuguguaucagcauaaugaucgaggaggugaugcgcucccgguggucacgcaaaaugcuaaugacuggcacccuggcaguguuuuuccuguuaaucauggggcagcucacauggaaugaccugauccggcucugcauaauggucggugcuaaugccuccgaccgcauggggaugggaacuacauaucuggcccugauggccaccuucaaaaugcgcccaauguucgccguggggcuccuguuuaggagguuaaccucccgggagguuuugcugcugacaaucggacucuccuuaguagcgucuguggaacugcccaauucgcucgaagagcugggcgacgggcuggccaugggcauaaugauacuuaagcuguuaaccgacuuccagagccaccagcucugggccacccugcucagccuaaccuuuguucgaacgaccuuuagccugcacuacgccuggaagaccauggcgauggugcuguccaucgugucgcucuuccccuuaugccuauccaccacgagccagaaaacaacguggcuucccguacugcuugggucccucgggugcaagccgcuaaccauguuccugaucgccgagaacaagauuuggggccgcaagagcuggccacucaacgagggcaucauggccguggggauugugagcauccuucugagcagccuccugaagaacgacguucccuuagccgguccacucaucgcuggcggcaugcugaucgcgugcuacguaauuucagggagcagugccgaccugucccucgaaaaggccgccguggucuccugggaagaggaggcagagcacagcggagcgagucacaacauccugguggaggugcaggacgacgggacgaugaagaucaaggacgaggagcgcgacgacaccuuaacaauccuucugaaggcaacacuguuagcugucagcgguguauauccgcugaguauaccugcgacucuuuucgugugguacuucuggcagaaaaagaagcagcgaagcgggguccugugggauacgcccagcccgccugagguagagcgggccgugcuggaugacggcauuuaccgaaucaugcagcggggccugcugggacggagccaggucggcguagggguguuucaagagaacgucuuccacaccauguggcaugugacccguggcgcugugcuuauguaucaaggaaaacggcuagagcccagcugggcuagcgucaagaaggaccuuaucucguacggcgggggguggcgucuccaaggcagcuggaacaccggggaagaagugcaaguaauugccgucgaacccggcaagaacccuaagaacgugcagacggcucccgggaccuucaaaaccucugagggcgaagugggcgcaaucgcgcuagacuuuaaacccgggaccagcggcagccccauaguaaaccgugaggggaagaucgugggccuuuacggcaacggggugguuacgaccucuggcacuuacgugagcgccaucgcccaagccaaggccucccaagaggggccucucccugagauugaggacgaaguuuucagaaagcggaaucugacuauuauggaccugcaccccgguagcgggaaaacgcgccgauaucuccccgccaucguucgcgaggcaaucaagcggaagcuccgcacucugauccuggcgccgacgcgggugguggccagcgaaauggcggaggcacucaagggcaugcccauacgauaccagacuacggccgucaagagcgagcacacaggcaaggagaucguagaccugaugugucaugccaccuucaccaugcgccuccugucccccguccggguucccaacuauaacaugauuaucauggacgaggcccauuucacggacccaagcuccauugcggcccggggguauauuuccacuagaguggguaugggggaggccgccgccaucuucaugaccgcgaccccgcccggcuccguggaggccuucccacagagcaacgcagucauucaggaugaggagcgcgauaucccggagcgcagcuggaauagcggguacgaauggaucacggacuuucccggcaaaaccguuugguuugugcccucuaucaagagcggcaaugauaucgcuaacugucugcgcaagaacgggaagcgcgucauucaguuguccagaaagaccuuugauaccgaauaccagaagacgaagaacaacgauugggacuacguggucaccaccgacaucuccgaaaugggcgcaaacuuccgcgcagaucgcgucauagacccccggcgcugccugaagccggugauccugaaggacgggcccgagcgggucauccucgccggccccaugcccgugaccguggccucggccgcgcagcgccgugggcgcaucggucggaaccacaacaaagagggcgaccaguacaucuacauggggcagccacugaacaacgacgaggaccacgcccacuggacagaggcgaaaaugcugcucgacaacaucaacaccccagaaggcaucaucccagcucuguucgaaccugagcgcgagaagagcgccgcgauugacggggaguaccgccuccgaggcgaggcccgcaaaaccuucgucgagcuuaugcgccguggggaucugcccguguggcucaguuacaaggucgcguccgagggauuucaguacagcgacagacgcuggugcuucgacggcgagcgaaacaaccagguccuagaggagaacauggacgucgagaucuggaccaaggagggggaaaggaagaagcugcgaccucgcuggcuggacgcgaggacguacucugacccccucgcccugcgcgaauucaaggaauuugcugcgggccggcgcuccguguccggggaccugauauuggagaucgguaagcuuccccagcacuugacccagcgggcccagaacgcccucgacaaccugguaaugcugcacaacagcgagcagggcgggcgcgcuuaccggcaugcuauggaggagcucccggacacaauugagacccugaugcugcucgcccuuaucgccgugcugacgggcggcguuacccucuucuuccuguccggaagagggcuggggaagaccagcaucggucuacugugugucauggcuuccagcguccugcucuggauggcuaguguagagccucacuggaucgccgccagcauaaucuuagaguucuuccugaugguucuccugaucccagaacccgaccggcaacgcacaccgcaggacaaccagcuggcuuacguugugauaggucuccuguucaugauccugaccgucgcagcgaacgagaugggccuccuugaaacgaccaagaaggaucuggggauuggccacguggccguagagaaccaccaccacgccgcgaugcucgaugucgaccugcaccccgcuuccgcguggacccuguacgccgucgccacaacgaucaucacccccaugaugcgacacaccaucgaaaacacgacggccaacaucucucucaccgccaucgcgaaccaagccgccauccugauggggcuggacaagggauggccgauaagcaagauggauaucggcguaccucuccuggcccuggguugcuacucacaggucaaucccuugaccuuaaccgcggcaguacugaugcucguugcccacuacgccauaauaggcccuggccugcaggccaaggcaacacgcgaagcccagaagaggacugcggccggcaucaugaaaaacccgacggucgacgggaucguggccaucgaccuggacccuguagucuacgacgcgaaguuugagaagcagcuaggccaaaucauguuacugauucucugcacuagccagauccuccugaugcguacuaccugggcccucugugagagcaucacccuggccacugguccccugacgacacuuugggagggcucccccgggaaguuuuggaauaccaccaucgccgugagcauggccaacauauucagagggaguuaccuggcgggcgcggguuuggcguucucacucaugaagucccucgggggcggccggcgcgggacgggggcccagggcgagacgcugggcgagaaauggaagcggcagcucaaucaguuauccaaaucggaguuuaacacuuauaagcgcuccgggaucauggagguggaccggagcgaagcgaaagaaggccugaagcgcggcgagacaacuaagcacgcugucagccggggcacugcaaagcuucgcugguuuguugagcgcaaccuggugaagccggaggggaaagugaucgaucuugguugcggccgcgggggcuggagcuauuacugcgccgggcugaaaaaggugaccgaggugaaggguuauaccaagggcgggcccggccacgaagagcccauccccauggcgacguacggauggaaccucgucaagcugcauaguggcaaggacguguucuucaucccgcccgagaagugcgacacccugcucugcgauaucggggagagcuccccuaaccccacaaucgaagaggggcggacccugagagugcugaaaauggucgagccguggcuccgggguaaccaauucugcaucaaaaucuuaaacccuuacaugccauccgugguggagacgcuggagcagaugcaacgcaagcacggcggcaugcucguacguaaccccuuguccagaaacagcacgcaugagauguauuggguuuccuguggaaccggcaauaucgugagcgcggucaauaugaccucucggaugcuacuuaaccgcuucacgauggcccacaggaagccgacauacgagagggacguggaccugggggccggaacccgccacguggccgucgagccagagguggcgaacuuggacaucaucggccaacggauagagaacaucaagcacgaacacaaaucuaccuggcacuacgacgaggacaaccccuauaaaacgugggcguaccacgguuccuacgagguuaagcccucuggcucggccuccagcauggugaauggaguggucaagcuccucacgaagccaugggacgugauccccauggugacccagaucgcgaugaccgauaccacgcccuucggacagcaacgcgucuucaaggagaagguggauacccggacccccaaagccaaaaggggaaccgcacagauuauggaggugacggcuaaguggcuguggggcuuccucagccguaacaagaagccgcguaucugcacgcgagaggaauucacucguaaggugcggagcaacgcggcaaucggcgccguguucguugacgaaaaccaguggaauuccgcgaaagaggccgucgaggacgagagguucugggaccuggugcaccgggagcgcgaguugcacaaacagggaaagugcgcgaccugcguguacaacaugaugggcaagagagagaagaagcucggggaguucggcaaagccaaagggucacgcgccaucugguacauguggcugggcgcgcgguuccucgaguucgaagccuugggauucaugaacgaggaccacugguucagccgcgaaaacagccuguccggaguggagggcgaggggcugcacaagcucggcuacauccugcgggacaucagcaagauccccgggggcaacauguaugccgaugacacugcagguugggacacccgcaucacugaggacgaccugcaaaacgaggccaagaucaccgacaucauggagcccgagcacgcucuacuggccaaguccauauuuaagcugacguaccagaacaaggugguacggguacaacgcccagccaagaacgggaccgugauggaugugaucagccgccgggaccagcgcggcuccgggcaggucggcaccuacggccucaacaccuucacuaauauggaggcucagcugauacggcagauggaaagcgaggggauuuuuucccccagcgagcuggaaacccccaaccucgccggccgaguguuagacuggcuggagaaacacgggguugagagacucaaaagaauggcgaucuccggugacgacugcgucgugaagcccauugacgaccgauucgcaacggcgcucaccgcccugaaugauauggggaaggugcgcaaggacaucccgcaaugggagcccucgaaagguuggaacgacuggcagcaggucccuuucugcagccaccauuuccaccaguugaucaugaaggauggcagagagauaguugugcccugccgcaaucaagacgagcuggucgggcgggcacgcgugucccagggugcgggguggagccuucgggagacggccugccucggcaaauccuacgcccagauguggcagcuuauguacuuccaccgccgggaccuucgccucgccgcgaacgcaaucugcagugcuguuccggucgauugggugccuacuucccggaccaccuggagcauccacgcccaccaccaauggaugaccaccgaggacaugcuguccguguggaaccgcgucuggauugaggagaacccguggauggaggacaagacccacaucucgucauggggagacgugcccuaccugggcaagagagaggaccaauggugcggcagccucaucgggcugacugccagagcgacgugggccacaaauauccagguggccaucaaucaggugcgccgacuauuggggaacgagaacuacuuggauuacaugacuucgaugaagcgcuucaagaacgagucggacccagagggcgcucucugguga

SEQ ID NO: 24324 - RNA, 9879 nt, Artificial Sequence
  derived and/or modified CDS sequence (opt11) from DENV-1__FJ882549__SS-prME
ucugugaccaugcugcucaugcuuaugcccacugcccuggccuuucaccucaccacccggggcggcgagccccacaugaucgugagcaagcaggagcgaggcaagucgcugcuguucaagacaagcgcaggagugaauauguguacccucaucgccauggaccugggcgagcugugcgaggacaccaugaccuauaagugcccccgcaucacugaaguagaacccgacgacguggauuguugguguaauacgaccgacaccuggguuaccuacgggaccugcucgcagacuggagaacaccggagagacaagcgcagcguggcgcucgcaccccacgucggcuuggggcuggagacccgggcugagacauggaugucuuccgagggcgcuuggaagcagauccagaaaguggagaccugggcguugcggcaccccggguuuacggugaucgcucuuuuccuagcccacgcgauaggaaccagcaucacccagaaggggaucauauucauccugcugaugcugguaacaccuuccauggccaugcgcugcguagggauuggcagccgggauuuugucgagggucuuuccggagcaacgugggucgacguaguguuagaacacgggucuugcguuaccaccauggccaaggacaaaccuacacuggacaucgagcuccugaagacggaggugaccaaccccgccgugcugcgcaaauugugcaucgaggcgaagaucucuaacacaaccacggacucacgguguccgacgcagggggaggccacccuagucgaggaacaggaugcuaacuucgugugccgccggacauucgucgaccgcgguugggguaauggcugcgggcuguuuggcaaagggucccucaucacuugcgcgaaguucaagugcgucaccaagcuggaagggaagaucgugcaauaugagaaccugaaguacucagugauagucaccgugcacacaggagaucagcaucaggucgggaacgagagcacugaacacggcacuaccgcgacuauuacgccccaggcgcccaccagugagauccaguugacggacuacggagcccuaacccuagacugcagcccccggacgggccuagacuucaacgagauggugcugcugaccaugaaggaaaaauccugguuagugcacaagcagugguucuuggaccugccccuccccuggaccagcggagcguccacaucucaagaaacauggaaccgccaggaucuguugguuacguucaagaccgcccacgccaagaaacaggagguggugguccucggcagucaggagggggcgaugcacacggcccugaccggggccacagagauccagacuucuggcacgaccacgauuuucgccgggcaccugaagugccggcucaagauggacaaguuaacccuuaaaggaauguccuacgugauguguacagggucauucaagcucgagaaagaaguggccgagacgcagcacggcacgguccuaguacagaucaaauacgagggcaccgaugcgccuugcaagauccccuucuccacccaagacgaaaagggggucacccagaacggccgccugaucacagcgaacccgaucgucaccgauaaggagaagcccgugaauauugaggccgagccgcccuucggagaaagcuacaucgucauaggcgccggcgagaaggcccucaagcucuccugguucaaaaaggggaguuccauaggcaagauguucgaggccaccgcccgcggagccagacggauggcaauccugggcgacacagccugggacuucggcuccaucggcggcgucuuuacguccguggggaagcugguacaucagaucuucgggacagcguacggggugcucuucagcggggugagcuggacuaugaaaaucgggaucggggugcugcugaccugguuaggccugaauagcaggucaacaagccugucgaugaccugcauagccgucggucucgugacgcucuaccucggagucaugguccaagccgacagcgggugcgugaucaacuggaagggccgcgaauuaaaaugugggucuggcaucuucgugacgaacgagguucacacguggaccgagcaguacaaguuccaagccgacucgccgaagcggcugucggcggccauaggcaaggccugggaggaaggggugugcggcauccgcuccgccacccggcuggaaaacaucauguggcgccagaucagcaaugagcucaaucacauacugcuggagaaugacaugaaauucaccguggucgugggggacgucgugggcauauuggcucaagggaagaagaugauccggccacagccuauggagcacaaguacucuuggaaguccuggggcaaagcgaagauaaucggagcggacgugcagaauacuacguuuauuaucgacgggcccaacaccccugaaugccccgacgaucagcgcgccuggaacaucugggagguggaggacuaugguuucgggaucuucaccaccaacaucuggcugaaacugcgagauucauacacgcaagucugcgaccacagacuuaugagcgccgccaucaaagacuccaaggccgugcaugccgacaugggcuauuggaucgagagcgagaagaacgagaccuggaaacuggcccgagcgaguuucaucgaggucaagaccugcaucuggcccaaaagccacacgcugugguccaauggcguccucgaaagcgagaugaucaucccgaagauauaugguggcccuaucucccagcacaacuaucgcccggguuacuucacacagacggcgggccccuggcaccugggcaaacuggagcucgacuuugaccugugcgagggcaccaccguagugguugacgagcacugcggcaaucgagggccgucccuucgcacgaccacugugaccggcaaaaucauccacgaguggugcugucguuccugcacacuuccgccccuccgauucaagggggaggacggcugcugguacggaauggagauccggccuguaaaagaaaaggaagagaaucuugucaagagcaugguaucugccggcuccggcgaggucgacagcuuuucccucggucuguuguguaucagcaucaugaucgaagaggucaugcgcucccgguggagccgcaagaugcugaugaccggcacccuggccgucuucuuucuccucaucauggggcagcugacuuggaaugaccugauccgcuccugcaucaugguaggcgccaacgcuagugacagaauggggaugggcacgaccuaccucgcgcugauggcaaccuucaagaugcgcccaauguucgccgugggguuacuguuccggcgccugaccucccgagaagugcuucuccucacgaucgggcugagccuugucgccucgguggagcuaccgaacagucuggaggaguuaggcgacgggcuggccaugggcauaaugauucugaaguuacugaccgacuuccaguccuaccagcugugggcgacccuacugagccugacuuucaucaaaacgacauucucgcuccacuacgccuggaaaacuauggccauggugcugagcaucgucucccuacucccccugugccucagcaccaccucccaaaaaaccacauggcugccggugcugcuggggagccuagggugcaagccgcuuaccauguuucugaucgccgaaaauaagauauggggccgcaagagcuggccccuaaaugaggggaucauggccguggguauagucuccauccugcuuucaucacuccugaagaacgacgugcccuuggccgggccccucaucgccgguggcaugcugauagccugcuacgugauuucggggucuagcgcggaccugucccuagagaaggcagccgagguauccugggaggaggaggcagagcacuccggcgcaucgcacaacauccucgucgaggugcaagacgacgggacaaugaaaaucaaggaugaggagcgggacgacacucugacaauccuccuuaaggccacccugcucgccguuuccgguguguacccgcugucgauaccagccacccuuuucgugugguacuucuggcagaagaagaagcagcgcuccgggguacucugggacacacccucgccgcccgagguggagcgggccgugcuggaugacggcauuuaccgcauuaugcagcggggccuacugggacgcucgcaggucggcguugggguguuucaggagaauguguuccauaccauguggcacgugacccggggcgccguacuaauguaucaagggaaacgccuggagcccagcugggcauccgugaaaaaggacuuaauaucguacggcgggggguggagacuccagggcuccuggaauaccggggaagagguacaggugauagcagucgaaccgggcaagaacccuaagaacgugcagacggccccagggacauuuaagacuccugaaggcgaagugggggccaucgcccuggauuuuaagccugggaccucuggaagccccauugucaauagagaagggaagaucgugggucuauacggcaauggagucgucacgaccuccggcaccuaugugagcgccaucgcgcaggcaaaggcuucacaggaggggccgcuccccgagaucgaggaugagguauuccgcaagcguaaucuuaccaucauggaccugcacccuggcagcgggaagacaagacgcuaccuaccagccaucguccgggaagcuaucaaaaggaagcugcggacauugaucuuagcccccaccagagucgucgccucggagauggcggaggcacugaagggcaugccaauacgcuaucagaccacagcggucaaguccgagcacaccggccgggagauuguagaucugaugugucacgcgacauucaccaugaggcuccugucccccgugcgggucccgaauuauaacaugaucaucauggacgaggcccacuucacggaccccucguccaucgccgcucguggguacauuaguacccgggugggcaugggcgaggcggcagccaucuucaugaccgccacgccgccgggcuccguugaggccuuuccgcagagcaaugcggucauccaggacgaggagcgcgacauccccgagcgguccuggaacucaggauacgaguggaucacagacuuccccggcaagaccguuugguuugugccauccauuaagaguggcaacgacaucgccaauugccugagaaagaacggcaagcgagucauacagcuaucccgaaagaccuucgacaccgaauaccagaagacgaaaaacaacgacugggacuaugugguaacuaccgacaucagcgagaugggcgccaacuuucgggccgaccgcgucauugauccgcggcggugccugaagcccgugauacugaaggacgggcccgagcgugugaucuuagcggggcccaugccgguuaccguggcauccgcagcccagcgacgggggcgcauaggacggaaccacaacaaggagggcgaccaguacauauacaugggccaaccccugaauaacgacgaggaccacgcccauuggacagaggcgaagaugcugcucgacaauaucaauacgcccgagggcauaauccccgcccuguucgagccggagcgcgagaagucugcggcaaucgacggggaguaccgacugcggggcgaggcgcgcaagaccuucgucgagcuuaugaggcgcggggaucugcccguaugguugucguacaagguugcguccgaaggauuccaguacucugacagacgcuggugcuuugacggcgagcggaauaaccagguccucgaggagaauauggacguggaaaucuggaccaaagagggugagcguaaaaagcugcggccacgcuggcuugaugccagaacguauuccgauccccucgcccugcgcgaguucaaggaguuugccgccggccggcgcucuguguccggggaccucaucuuggagauaggcaaguuaccucagcauuugacgcagcgggcgcagaaugcucuugauaaucuggucaugcuccacaacucggagcagggcgggcgagcguacagacacgcuauggaagagcuacccgauacgaucgaaacacugauguuacucgcacuaaucgccguucuaacgggcgguguuacccucuucuuccuguccggcaaggggcugggcaagacaagcaucggccuccugugcgucauggcguccagcgcccugcuuuggauggcguccguggagccucacuggaucgcggccucuaucauccuggaguucuuccugauggugcuccucauccccgaaccggaccgccagcggacgccacaggacaaccagcuggcguacguagucaucgggcuccuguucaugauccugaccguggcggccaacgagaugggccuccuggagaccaccaagaaagaucuggguaucggucacgucgccguggagaaccaccaccaugccacgauguuggacguggaccuacaccccgcauccgccuggacauuguacgcugucgcgacgaccaucaucacaccgaugaugcgccacaccaucgagaacacgaccgccaauaucucucucaccgcaauagccaaccaagccgcgauucuaauggggcuggacaagggcuggcccaucagcaagauggauauaggcgugccccuccuggcacugggguguuacucgcaggucaacccccucacccugaccgccgccguccugauguugguggcgcacuaugcaaucaucggcccggggcuucaggccaaggccacacgcgaggcacagaagcgcaccgccgccggcaucaugaagaaccccaccguggacgggaucgucgccauagaccuggaccccgucguuuaugaugccaaauucgaaaagcagcuuggccagaucaugcugcugauccucuguacgucacagauccugcugaugcgcacaacaugggcccucugcgagucaaucacacuggcaacgggcccacuaaccacacucugggaagggagcccgggcaaguucuggaacaccacgaucgccguaagcauggccaacaucuuccgggggagcuaucuggccggcgcuggguuggccuucuccuugaugaaaagccucgguggagggcggcgggggaccggggcccagggugagacacugggcgagaaguggaagaggcagcucaaccaacuguccaaaucagaguucaauaccuauaagcguuccgggaucauggaagucgaccgcagcgaggcuaaggagggccugcggcgaggggagacgaccaagcacgcggucuccagagggacagcgaagcuccgcugguuuguugagcggaaccugguaaaacccgaggggaaggugaucgaccugggcugcggacgcgggggcuggagcuacuacugcgccggccugaagaagguuaccgagguaaaaggcuacacgaaggguggacccggccacgaagagccgauccccauggcuacguacggguggaacuugguaaagcuacacuccggcaaggacguuuucuucaucccccccgagaagugcgacacccuacucugcgauaucggugagagcuccccuaauccuacaaucgaggagggccggacacugcgcguacugaagaugguggagccgugguugcgggggaaccaguuuugcaucaagauucucaaccccuacaugcccuccgugguugagacgcuugagcagaugcagcgcaagcacggcggcaugcucgugcggaacccguuaagccgcaauucgacucaugagauguauugggucuccugcgguacaggcaacaucgugagcgccgugaacaugaccagccggaugcuccucaaccgguucacgauggcccaccgcaagcccaccuacgaacgggacgucgaucugggggcggggacccgccacguugcgguggagccagaggucgcaaaccuggacaucaucggccagcggauagagaacauuaagcacgagcacaagagcaccuggcacuacgaugaggacaaccccuacaagacaugggccuaccacggguccuacgaggugaaaccguccggcagcgcgagcucuauggugaacgggguugugaagcuccugaccaagcccugggacguaaucccgaugguaacgcagaucgcgaugaccgacacgaccccauucggacaacagcgcgugcugaaggagaaaguggacacccggaccccgaaggccaagcgagggacggcacaaauaauggaggugaccgcaaaauggcucuggggcuuccugucccggaacaagaaaccccgcaucugcacgcgcgaggaguuuacgagaaaggugcgguccaaugcggcgaucggcgccgucuuuguggaugagaaccaguggaacuccgccaaggaagcugucgaggacgaacgcuucugggauuugguacaccgggagcgcgagcuccauaagcaggggaagugcgcgaccugcguguacaacaugaugggcaagcgggagaagaaacugggggaguucggcaaagccaaggguagccgcgcuauaugguauauguggcugggugcccgguuucucgaguucgaggcccugggcuucaugaacgaggaccauugguuuucccgcgaaaauucacuguccgggguggagggcgagggacuccacaagcugggcuauauccugcgggacaucagcaagauucccgggggcaauauguaugccgacgacaccgcagggugggacacucgcaucaccgaggacgacuuacaaaacgaggccaagauuacggacaucauggaaccggagcacgcccugcuggcaaccuccauauucaagcuaaccuaccagaauaagguagugcgggugcagcgccccgcucgcaacggcaccgucauggaugugaucagcaggcgagaccagcggggauccggucagguuggaacguauggccugaacaccuucacaaacauggaagcccagcuuauccgccagauggagucagagggaauauucuccccuuccgagcucgagacccccaaccuggcagaacgcgugcuggauuggcucgaaaagcacggcguagaaagacugaaaaggauggccaucaguggcgaugacugcguugucaagccgaucgacgaccgcuucgccacggcgcuguccgcccucaacgacaugggcaagguucguaaggacauaccccaaugggagcccagcaagggguggaacgacuggcaacaagucccauucugcucccaucacuuucaccagcugauaaugaaagacggccgugagauagucgugcccugccguaaccaggacgaauuggugggucgugccagggucagccagggcgccggcuggagucuccgagaaaccgccugccuuggcaagagcuacgcgcaaauguggcagcugauguacuuccaccggagggacuuacgucuggcggcaaacgcaaucugcagugcgguacccguggacuggguucccacuagccgcaccaccugguccauucacgcccaucaccaguggaugaccacggaggacaugcuaucaguguggaaccggguguggaucgaggagaaccccuggauggaggacaagacucacauuuccagcuggggggacguaccguaccuugggaagcgcgaggaccaauggugugguucccucaucggacucacggcacgcgccaccugggcgacuaacauccaaguugcaaucaaccagguuagaagacuuaucggcaaugagaacuaccuggacuacaugaccuccaugaagcgauucaagaaugagucugaccccgaaggggcccugugguaa

SEQ ID NO: 24325 - RNA, 9879 nt, Artificial Sequence
  derived and/or modified CDS sequence (opt11) from DENV-1__GQ199814__SS-prME
agcgugaccaugcugcucaugcugaugccgaccgcccuugcauuccaccucacuaccagaggcggggaaccccacaugaucguguccaaacaggagcggggcaagagccugcuauuuaagaccagcgcgggcguaaacaugugcacgcuaauugccauggaccugggagaguucugcgaggauacgaugaccuacaaguguccccgcaucaccgaggcagagcccgacgacguugacugcuggugcaacgcuaccgacacgugggucaccuacgggaccugcagccagacaggggaacaucggagggacaagcgguccguggcccuggcgccucaugugggccuaggucuugaaacgagaaccgagaccuggaugucguccgaaggcgccuggaagcagauccagagagucgagaccugggcgcugcgccacccaggguucacugugauugcccucuuccuggcgcacgccaucggcacaagcaucacucaaaaggggaucauauucauccugcucaugcuggucacuccuuccauggcaaugcggugugucgguaucgggucaagggacuucguggagggguuaucuggcgccaccuggguugacgucgugcucgagcaugggagcugcguuaccaccauggccaaagacaagccuacgcuagauaucgagcuguuaaagacggaagucacgaaccccgcagugcuucggaagcuaugcaucgaagcgaagauauccaauaccaccacugacagccgcugcccgacucagggagaggccacccugguugaagagcaggacgccaauuucgucugucggcgcaccuucguggaucgcggcugggguaauggcugcgggcuguucggcaagggaucccugauuacgugcgcuaaauucaagugcgugacaaaacuggaaggcaagaucguacaauacgagaaccugaaguacuccguuauuguaaccguccacacuggcgaccagcaccagguuggcaacgagucgacggagcacgguaccaccgcgaccaucacgccccaagccccuagcacggagauccagcugacggacuacggggcacucacucuggauugcagcccucggaccggccuggacuucaacgagaugguuuuguugacgaugaaggagaaguccuggcugguucacaagcagugguuucucgaccugccgcugcccuggaccucuggugccuccacuagccaggaaaccuggaaccggcaggaucuacuggugacauucaagaccgcccaugcgaagaagcaggaggucgugguucuuggcagccaggagggugcgaugcacacugcccucaccggagccacggagauccagaccagcgguaccaccacgauauucgccgggcacuuaaagugcaggcugaagauggacaaacucacccugaaaggcauguccuacgucaugugcaccgggagcuucaaguuagagaaggaaguggcggagacacagcauggcacugugcucguucaaauaaaauacgagggcaccgacgcccccuguaagaucccauucuccacacaggaugagaagggugugacucaaaauggccggcugaucaccgcaaacccaaucguaaccgacaaggacaagcccgucaacauugaggccgagccgccuuuuggggagagcuacaucgugaucggggcgggcgaaaaagcccugaagcuguccugguucaagaaagggagcuccaucgggaaaauguucgaggccaccgcacgcggggcccggcgcauggcuauccucggggacacugccugggacuuugggagcaucggggguguguucacgucggucgggaagcuggugcaccagaucuucggcacugccuacggggugcucuuuagcggcgucaguuggaccaugaaaauaggcauaggcgugcuccuaaccuggcuggggcucaauagccgcucuacgucucuguccaugaccugcauagccguagggcuggucacccucuaccugggcgugauggugcaggccgauagcggcuguguuauuaacuggaagggcagagagcugaaguguggcucuggcauuuucgugaccaacgaagugcacacguggaccgagcaguacaaguuccaggcggacaguccgaagcgcuugagcgcagccauuggcaaggcgugggaggagggcgugugcggcauccgguccgccacccgccuggagaacauuauguggaaacagaucagcaacgaacugaaucauauccuccuggagaaugacaugaaauucaccgugguugucggggauguggcgggaauccuggcacaggggaaaaagaugauccggccccagccaauggaguauaaguacucguggaaguccuggggcaaagccaaaaucauaggcgcggacgugcagaacaccaccuucaucaucgacggacccaacacaccggaaugccccgacgaccagagagcguggaacauaugggaggucgaggauuacggcuucgggaucuucaccaccaauaucuggcucaagcugcgggacuccuacacccaggugugcgaccaucgccugaugagcgccgccauaaaggacuccaaggccguucaugccgauaugggcuauuggaucgagagcgaaaagaacgaaaccuggaagcucgcgcgagccucauuuaucgaagucaagaccugcauuuggccuaagagccacacacugugguccaacggcguccucgagagcgagaugaucauccccaaaaucuacgggggaccgaucucccagcacaacuaccgccccggguauuuuacccagaccgccggcccuuggcaccucgguaagcuugagcuggacuucgaucucugcgaaggcaccacugucgucguggacgagcacugcggaaacagagggccuucccugcgcacuaccacgguaaccggaaaaaucauccacgaauggugcugucgcuccugcacgcugccaccccugcgcuuuaagggggaagauggcugcugguacgggauggagaucaggccugucaaggaaaaggaggagaacuuggugaaauccauggugagugccggcucaggcgaaguagacaguuuuucccuagggcuacugugcaucagcaucaugaccgaggaggugaugagauccagauggagccggaagaugcugaugaccgggacacucgcgguguucuuccuucugauaauggggcaacucaccuggaacgaucucaucaggcuauguaucauggucggggcgaaugcauccgaccgcauggggauggggacaaccuaccucgcccuuauggcgaccuuuaagaugcgaccgauguucgccgugggguugcuguuucggcgcuuaacgucucgggaggugcuucuccuaaccauaggguugucgcucgucgcgagcguugagcugccgaacagucuggaggagcucggagacggccuagccauggguauaaugauacugaagcuccugacugacuuccagucgcaccaauugugggcgaccuuguugagcuuaacguuuaucaagacuacuuucagcuuacacuaugccuggaagaccauggcgaugguccuguccaucgugagccuauucccccucugccugaguaccacuagccagaagaccacguggcugccaguacuguuaggcucccugggguguaagccgcuaacgauguuccucauugccgagaauaagaucugggggcgcaaaaguuggccgcugaacgaggggaucauggccgucggcaucguguccauccuccucaguagccugcucaaaaaugauguuccccuggccgggccccuaaucgccggcggcauguugauagcgugcuacgucaucuccgggagcuccgccgaucugucccuagagaaggcagccgaaguguccugggaggaggaggcggagcacaguggggcuucccacaacauucucguggagguccaggacgauggaaccaugaagaucaaggacgaggagcgcgacgacacccuaaccauucuccucaaggccacccuccuugccgugagcggcgucuacccucucucaaucccggccacccuguucgucugguacuucuggcaaaagaagaagcagcgcucgggggugcugugggacacccccagcccuccggagguugagcgagccguccucgacgacggaauauaccggauuaugcagcgcggacuauuggggcgcagccaggugggcgugggggucuuucaggagaacguauuccauaccauguggcacgugacccggggcgcggucuugauguaucaggggaagcgccucgagcccagcugggccagcgugaagaaagaccugaucuccuauggcggggguuggcggcuucagggcucauggaacacgggggaggagguucaggucaucgccguggagcccggcaaaaaccccaagaacguacagacggcucccgguacauucaagaccuccgagggcgaagucggcgccauagcucucgauuucaagccagggacgagcggcucccccaucgugaaucgcgaggggaagauugugggcuuauacgggaacggggucguuaccaccuccggcaccuacgugagcgccauugcccaggccaaggcaucccaggaagggccacugcccgagaucgaagaugaggucuuccggaagcgcaaccuuacgaucauggacuugcaccccgggucgggaaagacacggcgcuaucugccugccaucgugagagaggccaucaagcgcaaguuacggacccuuauccuggccccgacgagaguaguagccuccgaaauggcggaagcccucaagggcaugcccauccgcuaccagacuacagcggucaagagcgagcacaccggcaaggagauuguagaccuaaugugccacgccaccuucacgaugcgucuucucuccccgguccgcgugcccaacuacaacaugaucaucauggacgaggcccauuucacagacccgagcucaauugcggcccggggguacauaagcacacgugugggcaugggggaagccgccgccaucuucaugaccgcgaccccacccggcagcgucgaagcuuucccccagucgaacgccgugauccaggacgaggagagggacauaccggaaagauccuggaacagcggguacgaauggaucacggauuuccccggcaagaccgugugguucguccccuccauuaaaagcggcaaugauaucgcaaacugccugcggaaaaaugguaagcgcgugauccagcugucccggaagacuuuugacacagaguaccagaagaccaagaacaaugacugggauuacgucgucaccaccgacaucagcgagaugggcgccaauuuucgcgcggaucggguuaucgacccccgucggugccucaaaccgguuauccugaaggacggacccgaaagagucauccuugccggccccaugcccgugacgguagccuccgccgcucagcgccgcgggcggauaggacgcaaccacaauaaggagggcgaccaguacguuuacaugggucagccguugaacaacgacgaggaccacgcccauuggacggaggccaagaugcugcuggauaacauuaauaccccagaggggaucaucccagcccucuucgagcccgagcgugaaaaauccgcagccaucgauggggaguaccgcuuacgcggcgaggcaagaaagaccuucguggaacucaugcgccgcggggaucucccggucuggcuguccuacaaggucgcuuccgaggguuuccaguacagcgacaggcgguggugcuucgauggagagcgcaacaaccaagugcuggaggagaacauggacguagagaucuggacaaaggagggagagaggaagaagcucagaccccgguggcuagacgcccgcaccuacuccgacccccuggcccuccgggaauuuaaggaauucgcggcuggccguaggagcguguccggggaccuuauccuggagaucgggaagcuaccacagcacuugacccaacgcgcccagaacgcccuggauaaccucgugaugcugcauaauagcgagcaaggcgggcgggcguaccgccacgccauggaggaacuccccgacacgaucgaaaccuugaugcuucuggccuugauagccguccugaccggcggcgugacccuguucuuccucucaggccggggucugggcaagaccagcaucggccuacuaugcgugauggccuccagcgucuugcuguggauggcguccguggagccccauuggaucgccgccaguaucaucuuagaguucuuucugauggugcugcuaauccccgaacccgaccgccagaggaccccacaagacaaucagcucgcuuauguggugauaggguuauuauucaugauccugacgguggcggcaaacgagaugggccuguuggaaacuaccaaaaaggaccuggggaucgggcacguagccguggagaaccaucaccacgcugccaugcuggauguggaccuucaccccgccucagcauggacccuguacgccgucgccacgacaaucaucacccccaugaugcgacacacgaucgaaaacacaaccgcgaacaucucucucaccgccauagcgaaccaggcagcaauucuuaugggccuggacaagggcuggccgaucucuaagauggacaucggcgugccccugcucgcccuggggugcuacagccaggucaauccucugacccucacugcggccguccugaugcugguagcucacuacgccaucauuggccccgggcugcaggccaaggcaacgagggaggcccagaagaggaccgccgccggcauuaugaaaaacccaaccguagacgguauagucgccaucgaucuggacccugugguguacgacgcgaaauucgagaagcaguugggucagauuaugcuccugauccugugcacgucccagauccuccugaugcgcaccaccugggcccugugcgagucgaucacccuugccaccggcccccugaccacccugugggaagggucucccggcaaguucuggaauaccacuauagcugugagcauggccaacauuuuuagggggaguuaccucgccggcgcuggcuuggccuucagucugaugaagucccuagggggcgggcgccgcggcacgggggcccaaggcgagacccugggcgagaaguggaagcgccagcuaaaccagcucuccaagagcgaguuuaacaccuacaagagaagcggaaucauggaggucgaccgcagcgaggccaaagagggacuuaagcggggggagacuaccaagcacgccgugucccgcgguaccgccaagcugcgaugguucgucgaacgcaaccucgugaagcccgaaggcaaggugauugaucucggcugcggucgcggcggguggagcuacuacugcgccggacugaaaaaaguaaccgagguuaagggguauacgaagggagggcccggccacgaggagccuauacccauggcaaccuauggguggaaccuggugaagcuccacucgggcaaggacgucuucuuuaucccgcccgagaagugcgacacccugcugugcgauauaggggaguccucccccaacccaacgauugaggagggccgcacgcuccgggugcugaagaugguggagccauggcugcgcgggaaccaguucuguaucaagauccucaaccccuacaugcccagcgucguugagacccuagagcagaugcagcggaagcacggcggcaugcugguacgcaacccccucucccgaaacagcacacacgaaauguacugggucucuugcggaacugggaauaucgugucggccguaaacaugaccucccgcaugcugcugaacagauucacaauggcccaucgcaagccgacuuacgagcgcgacgucgaucucggugccggcacccggcacguggcagucgagcccgaggucgcuaaucuggauauuaucggccaacgcaucgagaauaucaagcacgagcacaaaagcaccuggcauuacgacgaggacaacccuuacaagacgugggcguaccacgggucguacgaggugaagcccaguggcagcgccucaagcauggucaacgggguggugaagcuguugaccaaaccgugggacgucauccccauggugacccagauagccaugaccgacacgacccccuucggccaacagcguguguucaaggagaaggucgauacccgcaccccuaaggcaaaacgugggacggcccagaucauggaggugaccgccaaguggcuuuggggcuuccugagucgcaacaagaagccccggauuuguacgagagaggaauucacaaggaaaguccgcagcaacgcagccauaggcgccgucuucguggacgagaaccaauggaacagugcgaaggaggccguggaagacgagcgguuuugggaccucguccauagagagcgggaacugcacaagcaagggaagugcgcgacguguguguacaauaugaugggcaagcgcgagaagaagcugggagaguuugggaaggccaaggggagccgggccauaugguacauguggcucggcgcgcgcuuucuggaguucgaggccuuaggguucaugaacgaggaccacugguucucccgggagaacagccuauccgggguggagggugagggguugcacaagcugggcuacauccuaagggacaucuccaagauccccgggggaaacauguacgcagacgauaccgcuggcugggacacuaggaucacugaggacgaccuacagaacgaggccaagauuacggacaucauggagcccgaacaugcccuucuggccaaauccaucuucaagcucaccuaccagaauaaagucgugaggguucagcggccggccaaaaacgggaccgucauggacgugauaagccgccgagaccagagggguuccggacagguuggaaccuacggccucaacacauucaccaauauggaggcccaauugauucgccagauggagagcgaggggaucuucucucccucugaguuggagacuccuaaccuggcgggaaggguccucgacuggcuugagaagcacgggguggaaagacugaaacggauggccaucuccggagacgauugcguugucaaaccgauagacgaucgcuuugccacagcccucacggcccugaacgacauggggaaggugcggaaagacaucccgcagugggagcccagcaaggguuggaacgauuggcagcaagugcccuuuugcagccaucacuuucaccagcuuaucaugaaggacgggcgugagaucguugugcccugucggaaccaggaugagcucgucggacgcgcccggguaucccagggcgcggguuggucguuacgcgagaccgcaugccuggggaaauccuacgcccagauguggcagcucauguacuuccaccgccgugaccugcggcuggcagccaacgcaaucugcagcgcuguucccgucgacuggguccccaccucccggaccacguggagcauccaugcgcaucaccaauggaugaccaccgaggacauguuaucuguguggaacaggguuuggauugaggagaauccauggauggaagacaaaacccauaucucaagcuggggcgacgugcccuaccugggcaagcgugaggaccaauggugcggcagccugaucgggcucacggcucgugcaaccugggcuaccaacauccaggucgccaucaaccaggugcgccgccugauaggcaacgaaaacuaucuugacuacaugacauccaugaagcgguuuaagaacgagucggacccggagggggcccugugguaa

SEQ ID NO: 24326 - RNA, 9879 nt, Artificial Sequence
  derived and/or modified CDS sequence (opt11) from DENV-1__GQ199816__SS-prME
agcgugaccaugcugcuuaugcugaugccgaccgcccuggccuuccaccuaacuacuagggggggggagccccacaugaucguauccaagcaggaacgggguaaaagcuugcuguuuaagaccuccgcgggcgugaacaugugcacccucauagccauggaccugggggaguucugcgaggacacgaugacauacaagugcccucgaaucacggaggccgaacccgacgacguggacugcugguguaacgcgacagauacguggguuaccuaugggacguguagccagaccggggaacaccgacgggacaagcgguccgucgcccuggcgccccaugucggccucgggcuagagacgcgcacagaaacuuggaugagcuccgaaggcgccuggaagcaaauccaaaaaguugagaccugggcccuacggcaccccgguuucacggugaucgcccucuuccuggcgcacgccaucgggaccucaaucacucaaaaagggaucaucuuuauccugcucaugcuuguuacgcccuccauggccaugcgcugcgucggcaucggcagccgcgacuuuguggaggggcuguccggagcuacguggguggacgucguguuagaacacgggaguugcgugaccaccauggccaaggacaagccuacucuggacaucgagcugcuaaagacggaggugacuaacccggcugugcugcgaaagcugugcaucgaggcaaagauuuccaacaccacuacggacagccgaugcccgacucagggagaggccacccucguggaagaacaggacgccaacuucgucugccgcaggaccuucgucgaucgcgguugggggaacggcugcgggcuguuugguaaggggucccuuauuacaugcgcgaaguucaagugcgugaccaagcucgagggcaagacaguacaguaugagaaucugaaguacagcgugaucguuaccguacacacgggcgaccaacaccaggugggaaaugaauccacagaacacgguaccaccgcaacgauaacgccgcaggcccccaguaccgaaauccagcugacagacuacggggccuuaacccuggauugcuccccccggacgggccuggacuucaacgagauggucuugcugaccaugaaggaaaaggccugguuggugcacaagcaaugguuccuugaucugcccuugccuuggaccagcggggccagcacuucgcaggaaacguggaauagaaaagaccuccuggugaccuucaagaccgcccaugccaaaaagcaggaggucguggugcucggcucgcaggagggugcgaugcacacagcacucaccggagcaaccgaaauucagaccuccggcaccaccaccaucuucgcugggcaccucaagugccggcucaagauggauaagcugacccugaaagggaugagcuacgugaugugcaccggcaguuucaagcuggagaaggagguggccgagacacagcacggcaccgugcucguccagaucaaguacgaaggcacggacgcaccauguaagauacccuuuagcacccaagacgagaaaggggugacacagaauggacgacuuaucaccgccaacccgaucguaaccgacaaggagaaacccgucaacaucgaggcggagccgcccuucggggaguccuacauuguaaucggggccggagagaaggcccugaaacugagcugguucaagaagggguccucuauuggcaagauguucgaagcaaccgcccgcggagcgaggcgcauggccauccucggcgacacggccugggauuucggguccaucggcggggucuuuaccagcguagggaaacuggugcaucagaucuucggcaccgccuacggaguguuguuuuccggugucucguggaccaugaagaucgggaucggcgugcuccugaccuggcugggccugaacucccgcagcaccucccuuagcaugaccuguaucgccgucggucuggucaccuuauaccugggcgucaugguccaagcggacucugggugcgucaucaauuggaagggccgugagcugaagugcgggucuggcauuuucgugacgaacgaggugcacaccuggaccgaacaguacaaguuccaggccgacucgccgaagcggcucagugcugcgaucggaaaggcgugggaggaggggguuugcggcauccggagcgcuacccggcucgagaauaucauguggaaacagaucagcaaugagcugaaccacaucuugcuggagaaugacaugaaguuuaccgugguaguuggggacguggccgguauccuggcccagggcaagaagaugauccgcccccaacccauggaguacaaguacagcuggaaauccugggggaaggccaagaucaucggcgcggacgugcagaacgccacauuuauaauugauggacccaacaccccggagugccccgaugaccaaagagccuggaacaucugggagguagaggacuacggauucggcauauuuaccaccaacaucuggcucaagcugagagacagcuacacccaggucugcgaccacagacugauguccgccgccaucaaggacucgaaggcgguucacgccgacaugggcuacuggaucgagagcgaaaaaaacgagacguggaaacuggcccgagccucuuucauagaaguaaagaccugcaucuggcccaaaucccauacucugugguccaacggcguacucgaguccgagaugaucauccccaagauauacgggggccccaucagccaacacaauuaccgacccggguacuucacgcagaccgcuggucccuggcaccucgggaagcuggaguuggauuuugaccucugcgaaggcaccaccgugguuguggaugagcacugcggcaaccgaggcccaucccugcggacgaccacugugacuggcaagauaauacaugaguggugcugccggagcugcacccugcccccccugcgcuucaagggggaggacggaugcugguacggaauggagauccgccccgucaaggagaaggaggagaaccuggucaaguccauggucagcgcgggcucgggcgaggucgacuccuucagccuuggucuccugugcaucuccauaaugaucgaagaggucaugcggagccgcuggucccgaaagaugcuaaugaccgguauccucgccguguucuuucugcugauuauggggcaacuaaccuggaacgaccugauucgucuguguaucaugguaggcgccaaugccucagaucggauggggaugggcaccacguaccucgcccugauggcgacuuuuaagaugcguccgauguuugccgugggccuguuauuuaggcggcugaccucccgcgaagugcugcuccucacgauagggcugagccugguugccaguguggagcugccaaauucccuugaggagcucggcgacggccuggccaugggcauuaugaucuuaaaacuccuuacggacuuccagagucaccaguuaugggcgacacucuugagccuuaccuuuauaaagaccaccuucucucuccacuaugccuggaagaccauggcuauggucuuaagcaucgugucccuuuucccccucugccuuucuaccaccucgcagaaaacgaccuggcugcccgugcucuuggggagccugggauguaagccucucaccauguucuuaaucgccgagaacaagaucuggggccggaagagcuggccccugaacgaagggaucauggccguggggauugucagcauacuccugagcucccugcucaaaaacgacgugccucuggccgggccccugaucgccgguggcaugcugauugccuguuacguuauuagcgggucgucggccgaccugucccuggagaaggccgcggaggugagcugggaggaggaagcagagcacaguggcgccagccacaacauccuugucgagguccaggacgacgggacgaugaaaaucaaggacgaggagcgcgacgacacucuuaccaucuugcucaaggccacccugcuagccgugucgggcguguacccgcucucaaucccagcgacgcuguucgucugguacuucuggcagaagaaaaagcagcggucgggcgugcugugggacacacccucuccgcccgagguggaacgcgcaguacucgacgacgggauauaccggaucaugcaacgcggcuuacuagggcggagucaggugggcguuggggucuuccaggaaaacguuuuccacaccauguggcacgugaccaggggcgccguucugauguaccaggguaagagacuggaacccagcugggccuccgugaagaaggaucugauuucauacgggggcggauggcgccugcagggcagcuggaacaccggggaggaggugcaggucaucgccguggagcccggcaagaacccuaagaacguccaaaccgcacccgguacguuuaagaccagcgagggagaggucggcgcgaucgcccuugauuuuaagcccgggaccagcgguucucccauugugaaccgggaggggaagaucguaggccuguacgguaauggagucgugaccacuagcggcaccuacguuuccgcuaucgcccaagccaaggcgagucaggaggguccucugccggagaucgaagacgaggucuuuagaaagcggaaccucaccaucauggaccuccacccaggcuccgggaaaacccgccguuaucugccggccaucgugcgcgaggccauuaagagaaagcuccgcacgcugauacuggcaccgacucgggucgucgccagcgagauggcagaggcccucaagggcaugcccauaagguaccaaaccaccgccgugaaguccgagcauacgggcaaggaaauagucgaccugaugugccacgcgacauucaccaugcgcuuacucuccccagugcgggugcccaacuacaacaugauuaucauggacgaggcccacuucaccgacccuuccagcauugccgcucgcggguacaucagcacccggguggggaugggggaggcggcagccaucuuuaugaccgcaacgccgccaggauccguggaggccuucccccagucuaacgcgguuauccaagacgaggaacgcgacauuccggagcggagcuggaacuccggguaugaguggauaaccgacuuucccggcaaaacggugugguucguuccgucaaucaaguccggcaaugacauugcuaauugccugcgcaagaacgguaagagggugauccaguugagccgcaagacauuugacacagaauaccagaagaccaagaauaacgacugggacuacguaguuacgaccgacaucuccgagaugggcgccaacuuccgcgccgaccgcguuaucgacccccgucgcugccucaagccagugauacucaaggacggucccgagagagucauacuagccggcccuaugccggugaccguggcgagugccgcgcagcgccgggggcgcauuggccggaaccacaacaaagagggcgaucaguacauauacauggggcaaccguuaaacaaugaugaagaccacgcccacuggacagaggccaagaugcugcuggacaacaucaacacgccugaggguaucauuccugcacuauucgagcccgagcgcgaaaaauccgcagccauagacggggaguaccggcugcgcggcgaagcccgcaagacauucguggagcugaugcggcggggggaccucccggucuggcuaagcuacaagguagcuagcgagggcuuccaguauucggaccggcgcugguguuucgauggcgagcgaaauaaucagguccuggaagaaaacauggacguggagauuuggacgaaggagggagagcgcaagaagcuccggccacgcuggcuugacgcgcgcacuuacucggacccccucgcccuucgcgaauucaaggaauuugccgcgggccggcgauccgucagcggggaccuuauucuugagaucggcaagcuaccccagcaccugacgcagcgggcgcagaacgcccuagacaaccucgugaugcugcauaacagcgagcagggagggcgcgccuacaggcacgccauggaggaguuaccggacaccaucgagacgcucaugcugcuggcccugauugcggugcucaccggcggagucacgcuguucuucuugagcggcagagggcugggcaagacuuccaucggacugcucuguguuauggcgagcuccgugcuguuguggauggccagcgucgagccacacuggauugccgccuccaucauacucgaguucuuccugauggugcuccuaauucccgaacccgaccggcagcgcaccccgcaggauaaucagcuggcguacguagucaucgggcuccuauucaugauacugaccgucgcugccaacgagaugggccugcucgagaccacgaagaaagaccuggggauuggucacguggccgucgagaaccaccaccacgccgcaaugcuagacguugaccuccaccccgcaagcgccuggacccuuuacgcugucgccaccacuauuauuacgcccaugaugcggcauaccaucgagaacaccaccgcaaauaucucccugacggccaucgccaaccaggccgcaauccuuaugggccuugacaagggcuggccgauaaguaagauggacaucggggucccccugcuugcauuagggugcuacagucaggugaacccucugacucuaacugccgcagugcugaugcuggucgcccacuacgcuaucauuggcccugggcuccaggccaaggccacccgcgaggcgcagaagcgaacggcugcggggauaaugaagaauccgaccguugacgggaucguggccaucgaccuugaccccgucguguacgauaccaaguuugagaaacaacuggggcagauuauguuacugaucuuaugcaccucucaaauccugcuaaugcgcaccaccugggcccugugcgaguccauaaccuuagccacaggcccccugacgaccuuaugggaggggucacccggcaaauucuggaacaccaccaucgccguuucuauggccaauaucuuccgaggaagcuaccucgcuggcgcuggccuggcguucucacucaugaaaucccucgggggggggcgacgcgguacaggggcacagggggagacucucggcgagaaauggaagcggcagcugaaccagcucagcaaguccgaauuuaacaccuauaagcgcagcgggaucauggaggucgaccggucagaggccaaggagggccugaagagaggggagaccacaaagcacgccgugagccgcgggacugccaagcugcgcugguuuguggagaggaaccucgucaagccggaggguaaggucaucgaccuaggcugcggccgcgggggcugguccuacuacugcgccggucugaagaaggugacggaggucaagggcuacaccaagggcgggcccggucacgaggagcccauacccauggcgacguacggguggaaccuggugaagcuccacagcggcaaggacguguuuuucauucccccggagaagugcgacacccugcugugcgacaucggggaaucgagccccaauccuaccaucgaggagggacggacccuccgcguccugaagaugguggaaccguggcugcgugggaaccaauucuguaucaagauucucaauccguacaugcccuccguggucgagacucuggagcagaugcagcgcaagcacggaggaauguuaguaaggaauccccucagccgcaacucaacccacgagauguauuggguuagcugcgggaccggcaacaucgucuccgcuguuaacaugaccagccgaaugcugcugaaucgcuuuaccauggcccaucguaagccaacguacgagagggacguugaccucggcgccggcacucgccauguggccguggagcccgagguugcgaaccuggacaucauuggccagcggauagagaacaucaagcacgaacacaaguccaccuggcacuacgaugaagacaaccccuacaaaaccugggccuaccacgggaguuacgagguuaagcccaguggcucagcgagcuccauggugaacggggucguaaaguugcuaacgaaacccugggauguaauacccauggucacacagaucgccaugaccgacaccacgcccuucgggcagcaaaggguguuuaaggagaaaguagacacccggacccccaaggccaagcgcgggaccgcucagaucauggagguuacagccaaguggcuguggggauuccugagccggaacaagaagccccgcaucugcacccgggaggaauucacccgcaagguccggaguaacgccgccauaggcgcgguguucgucgacgagaaccaguggaacucagcaaaagaggccgucgaggacgagagguucugggaccucgugcaccgugagcgcgaacuccacaaacaggguaagugcgcgaccugcgucuacaauaugaugggcaagcgggagaagaagcucggggaguuuggcaaggcaaaagguucccgugcaauaugguacaugugguuaggugcacgauucuuagaguucgaagcccugggcuucaugaaugaggaccacugguucagccgcgagaacagccucucugggguggaaggcgaagggcuccacaagcugggcuacauccugcgggacaucagcaagauccccggaggaaacauguacgccgacgacacggcaggaugggacacgcggaucaccgaggacgaccuacagaacgaggcgaagaucacugacaucauggagcccgaacacgcgcuuuuggcaaagagcaucuucaaauugacguaucagaacaaggugguucggguacagcgcccggccaaaaacgggacugugauggauguuauuucccgaagggaccagagagguagcgggcagguuggcacauacggccuaaauacguucacgaauauggaggcgcagcucauccggcagauggaguccgaggggaucuucucgcccucagagcuggaaacccccaaucuggcgggucgcgugcucgacuggcuggaaaagcacggggucgagcggcugaagcgaauggccaucucaggugacgacugcguagugaaacccaucgacgaucgguucgccacagcccucacggcccugaacgacauggguaaaguccgcaaggauauaccgcagugggagccuuccaagggcuggaacgacuggcagcagguccccuucuguagccaucacuuccaucaauuaaucaugaaggacggccgagagaucgugguucccugcagaaaucaggacgagcucguugggcgggcgcgcgugagccagggcgccggguggagucugcgggagacggcauguuuagguaagucguacgcccaaauguggcaacuaauguacuuccaucgccgggacuugcgccuggcagcuaacgcaaucugcagcgccgucccgguggacugggugcccaccucccggaccaccugguccauccacgcccaucaccaauggaugacuaccgaagauaugcucuccgucuggaaccgcguuuggaucgaagagaaccccuggauggaggauaaaacgcacaucuccagcuggggagauguccccuaccugggcaaacgggaggaccaauggugcggcucccugaucggguugaccgcgcgcgccacgugggccaccaauauccaagucgcaaucaaccaaguucgccggcugauuggcaacgagaacuaucuggacuacaugaccagcaugaaaagguucaaaaacgagaucgacccggaaggggcccucugguaa

SEQ ID NO: 24327 - RNA, 9879 nt, Artificial Sequence
  derived and/or modified CDS sequence (opt11) from DENV-1__GQ199817__SS-prME
ucuguaaccaugcugcugaugcugaugcccaccgcguuagccuuucaccuaacgacccgggguggcgagccccacaugaucgugagcaagcaggagcggggcaaaagccugcuguuuaagacgucugcaggcgugaacauguguacacucauugccauggaccugggcgaguucugcgaagacaccaugacauacaagugcccccggaucaccgaggccgagccagacgauguggacugcuggugcaaugccaccgacacgugggugaccuacgggacaugcagccagaccggggagcaccggcgggauaagcgguccguggcccuugcgccccacguagguuugggacuggagacgcgcaccgaaacguggaugagcuccgaaggugccuggaagcaaauucagcggguggagacuugggcccugcgccaucccggguucacgguuaucgcccucuuccuggcgcacgccaucggcaccagcauuacccagaaggguauaauauucauccugcucaugcuggugaccccgucgauggccaugcggugcgucggcaucggcagccgcgacuucguggagggguuauccggcgcgacguggguagacgucgugcucgagcacgggagcugcguaaccaccauggccaaggauaaacccacccuggauauugaacugcuaaagacagaggucaccaacccagcgguguuacgaaagcugugcaucgaggccaagauauccaacaccaccacggacagccgcugcccgacucaaggcgaggcuacccuagucgaggagcaggacgccaacuucgucugccggcgcaccuucgucgaccgaggcugggggaacggcugcgggcuguucggcaaggggucccugaucacgugcgccaaauucaagugcguaaccaagcucgaggggaagauaguccaguacgagaaccugaaguacagugugauagugacgguucacacgggcgaucagcaccagguggggaacgaguccacagagcacggcacaaccgcgaccaucacuccucaggcccccagcacggagauacaauugaccgauuacggggcccucacccuugauuguagccccagaaccggucuggacuucaacgagaugguccuccucacaaugaaggagaaguccugguuagugcacaaacagugguuucucgaccugccgcuuccguggacaagcggggcauccaccagccaggagacguggaacagacaggaccuccuggugacguucaagacagcccaugcaaagaagcaagaggucguagugcucggcucccaggagggagccaugcacaccgcccucaccggggccacagagauccagaccucugguaccaccacaauauuugccgggcaccugaagugcaggcugaagauggacaaacucacccugaagggcauguccuacguaaugugcaccgggagcuuuaaauuggagaaggaggucgccgagacacagcacggcacggucuuaguccagaucaaguacgaaggcaccgacgcuccgugcaagaucccguucucgacccaggaugaaaagggggugacgcaaaacggccggcuaaucacggccaauccgaucgugaccgacaaagagaagccuguuaacauugaggcggagccgcccuucggggagagcuacauugugauuggagcgggugagaaggcguugaaacuguccugguuuaaaaaggggagcuccaucggaaagauguucgaagccacggcccgcggggcccggcguauggccaucuugggggacaccgcaugggacuucggcagcaucggcggcguuuuuacgucugucggcaagcuggugcaccaaaucuucggcaccgccuacgggguccuguucagcggcgucaguuggaccaugaagaucgggaucggcgugcuccugaccuggcugggccucaacucccgauccacgagccucuccaugaccugcaucgccgugggguuagugacccucuaccugggcgugauggugcaggccgacagcgggugcgucaucaauuggaaaggccgggaacugaagugcgggucaggcaucuucguaaccaacgaagugcauacguggaccgagcaguacaaauuccaggcggauuccccuaagcgccucagcgcugccauuggcaaggccugggaggaaggggucugcggaauacgguccgcaacccgccuggagaacaucauguggaagcaaaucagcaaugagcugaaccacauccuccuggagaaugacaugaaauuaacagugguggucggcgauguggcgggcauccucgcccaggguaaaaagaugauucggccacaaccgauggaguacaaguacuccuggaagagcuggggcaaagccaagauaaucggagcggacguucagaacaccacuuucaucaucgacggacccaacaccccggaaugccccgacgaccagcgcgcguggaacaucugggaggucgaagacuaugguuucgggauuuucacaaccaauaucuggcuuaagcugcgggacucuuacacacaggugugugaccaccgccucaugagcgccgccaucaaagacuccaaggcggugcacgccgacaugggauacuggauagagucggagaaaaaugagacuuggaagcuagcgcgggccuccuucaucgaagucaagaccugcaucuggcccaagagccauacccugugguccaacggcguguuagaaagcgagaugaucauccccaagauuuacgggggcccgaucucccaacacaacuaccgcccuggguacuucacgcagacagcaggccccuggcaucuggggaaacuggagcucgacuucgaccugugcgagggaaccaccguggugguggacgagcacugcggaaaccgggggccgucccugcguacgaccacugugaccggcaaaaucauacacgaguggugcugccgguccugcacgcugccuccauugcgcuuuaagggggaagacggcugcugguacgggauggagauccggcccgucaaggagaaggaagaaaaccuggugaagagcauggugagcgccggcuccggcgaggucgacagcuucucccucgggcugcugugcaucagcaucaugaucgaggaggucaugcgcucccgguggucgcggaagaugcucaugacuggcaccuuagcuguguucuuccuguugauuauggggcagcugaccuggaacgaccuaauucggcucugcaucauggucggcgcgaaugccuccgaccgcauggggauggggacuaccuaccuggcccugauggccacuuucaaaaugcgcccaauguucgccguaggccuccuguuccgccgccuuacuagccgggagguccuccuccugacgaucgggcucucacuggucgcgucuguggagcugccgaacucccucgaggaacuaggagacgggcuggccaugggcaucaugaucuuaaagcuucugaccgacuuccagagucaccagcucugggccacccugcugucccucaccuucauccgcacgacauucucgcugcacuacgcuuggaaaacuauggccaugguccuguccauugugagccucauccccuugugccugucuacuaccagccagaaaaccacuuggcugcccgugcuccucggcucccucgggugcaagccgcuuaccauguuucucaucgccgagaacaagauauggggccgaaagagcuggccgcucaacgaagguauaauggcagucggcaucgugagcauccuacugagcagccugcugaagaacgacgucccgcucgccgggccccucaucgccgguggaaugcugaucgcgugcuacgucaucuccgggucguccgccgaccugagccucgaaaaggcugcugagguguccugggaagaggaagccgaacacagcggagcgucucacaacauucugguggaggugcaggacgacggcacgaugaagaucaaggacgaggagcgcgacgacacccugaccauacuccugaaggccaccuuauuagccguguccggagucuacccgcuguccaucccugccacccuguucgucugguguuucuggcagaaaaagaagcagcgcagcggugugcuaugggacacacccuccccgcccgagguggagcgcgcgguacuggacgacggcauuuaccgcaucaugcaacgcggcuuacuggggcgaucacaggugggcgucggggucuuccaggaaaacguguuccauaccauguggcacgugacgcgcggggcgguccugauguaccaagggaagcggcuggagcccuccugggccagcgugaagaaggaucugaucaguuauggcggcggguggcgucuccaaggaaguuggaauaccggggaggaggugcaggucaucgccgucgagcccgggaagaacccuaaaaacguacagacugcaccuggcacauuuaagaccuccgaaggcgaggucggagcaaucgcucucgacuucaagccuggcaccagcggcucgccgaucgugaaccgggaggggaagauuguuggcuuauacggcaacggggugguuacgaccuccggcaccuacgugagugccauagcucaggcuaaggcaagucaggaagggccccuuccggagaucgaggacgaggucuuccgcaaacgcaaccugaccauaauggaccuucaucccggcagcggcaaaacgcgccgguaucuucccgcuaucgugcgcgaggccauuaaacggcgacugcgaacccuaauccuugccccgacacggguggucgccuccgagauggcggaggcccugaaggguaugccaauccgcuaccaaaccacggccguuaagucugagcauacugguaaagagauuguugaucugaugugccacgccaccuucaccaugcggcuccugagucccgucaggguucccaacuacaacaugaucaucauggacgaggcccacuucacggacccgagcuccaucgcagcccggggguacauuagcaccagaguuggcaugggggaggccgccgcuaucuucaugaccgcgaccccgccggguuccgucgaagccuucccccagagcaaugccgugauccaggacgaggagcgggacauuccggagcgcuccuggaacagcggguacgaguggauuacggacuuuccugggaagaccguaugguucgucccuuccauaaagagcggcaacgacaucgccaacugccugaggaagaacgggaagcgcgugauucaacucucccggaagaccuucgacaccgaguaccaaaagacgaagaacaacgacugggacuacguggucaccacugacaucagcgagaugggcgccaacuuccgcgccgaucgggugaucgacccccgccggugucugaagccggugauccugaaggaugggccggagcgcgucauccucgccggccccaugcccgugacggucgccuccgcagcacagcggcgcgggcguaucggccgcaaccacaacaaggagggagaccaguacaucuauaugggucagccgcugaacaacgacgaggaccacgcccacuggacggaggccaagaugcuccucgacaacaucaacacacccgagggcaucauccccgcgcuguucgagcccgagagagagaaguccgcugcgaucgacggggaguaccgccugaggggcgaggcccguaagaccuucguggaauuaaugcgccgcggggaccugccgguguggcugucuuauaaggucgccuccgaagguuuccaauacagcgaccgccgguggugcuucgacggugaacguaacaaccaggugcucgaggagaacauggacguugagauuuggaccaaggagggggagcggaagaagcugcgcccccgguggcuggacgccaggacuuauuccgauccccucgcucugagggaguucaaggaguucgcggcgggccgccggagcgucuccggggaccugauucuagagaucggcaagcugccccagcaccugacucagcgcgcccaaaacgcccuagacaaccuggugaugcugcacaacucagagcagggagggcgcgcguaucgccacgccauggaagaguuaccggacacuaucgagacccugaugcuccucgcccucaucgcgguacugacuggcggggucacacucuuccugcugucgggccgggggcucgguaagaccagcaucggccugcugugugugauggccuccagcguccuccuguggauggcgagugucgagccccacuggauugccgccuccaucauccuggaguucuuccucauggugcugcugauccccgagcccgaccgucagcggaccccgcaggacaaucagcucgccuacguaguaauuggguugcuguucaugauccucaccguggcggcaaacgagauggggcugcuggagacaaccaagaaggaucucgggauaggacacguugcugucgagaaccaccaccacgccgccauguuggaugucgaccugcauccugcuuccgcguggacucuuuacgcaguggcgaccacgaucaucaccccgaugaugaggcacacgauagagaacaccaccgcuaacaucagccucaccgccauugcgaaucaagccgccauccugaugggacucgacaaaggauggccgaucuccaagauggacaucggcgucccccugcuggcccucgggugcuacucccaggugaacccccuuaccuugaccgcggcgguucucaugcuggucgcucauuacgcgaucaucgggccgggacugcaggcuaaggcgacgcgcgaggcccagaagcggaccgccgccggcaucaugaaaaacccuaccguggacgggauuguggcuaucgacuuggaccccgucguguacgacgcgaaguuugagaaacaacuaggucaaaucaugcuucucauccugugcaccucgcagauccugcugaugcgcaccaccugggcguugugugaaucuaucacccuagccaccggcccccucacuacccugugggaagguucccccggaaaauucuggaacaccaccaucgcggugagcauggcuaacaucuuccgggggagcuaccuggcgggcgccggccucgccuucucucugaugaagucccucgggggcgggagacgggggacgggggcccagggcgagacccugggcgaaaaguggaaacgccagcugaaccaguuauccaaaagcgaguucaacaccuacaagcgguccggcaucauggagguugaccgcagcgaggcgaaggaggggcucaagcgcggggaaaccacgaagcacgcggugucgagaggcaccgccaagcugcggugguucguggagcgcaaccuggugaagccggaagggaaggugaucgacuuagguugcggccgcggcggguggagcuacuauugugccggccucaagaaggugaccgagguaaagggguauaccaagggcggcccaggccacgaggagccaauacccauggccacguacggguggaaccuggucaaacuccacuccggcaaggacguguuuuucaucccgcccgagaagugcgacaccuuacugugcgauaucggggagagcucccccaaccccaccauagaggagggccggacacugcggguccucaaaaugguagagccguggcugcgcgggaaucaauucugcauaaagauauuaaaccccuacaugcccucaguagucgagacguuagagcagaugcagcguaagcacggcggcaugcuggugcgcaacccccugucccggaacagcacccacgaaauguacuggguguccugugggaccggcaauaucgucagcgcggugaacaugaccuccagaaugcuccuuaacagauucaccauggcccaccggaagccgacguacgagcgugacguggaccugggggccggcacacgccaugucgccguggagccagagguggccaaccucgacaucauuggacaacgcauagagaacaucaagcacgagcacaaaagcaccuggcacuaugaugaggacaacccguacaagaccugggcguaccacggguccuacgaggucaagccuagugggucugcguccagcauggugaauggcgucguaaagcugcugacgaagccgugggacguuaucccuauggucacccagaucgccaugacggacaccacgcccuuuggccagcagaggguuuucaaggagaagguggacacccgcacccccaaggccaaacgagggaccgcccagauuauggagguaacggcgaaguggcugugggguuuccugucccgcaacaagaagccgcguaucugcacccgcgaggaauucacacggaaggugcgcagcaaugccgccaucggcgccguguuuguugacgagaaccaguggaacucggcgaaagaagccguggaggacgagagauuuugggacuuggugcaccgcgagcgugaauuacacaagcagggaaagugcgcgacuuguguauacaacaugaugggcaagcgugagaagaagcugggggaauucgguaaagccaaggguucacgcgccauaugguacauguggcugggcgcgcgguuccucgaguuugaggcguuaggcuucaugaacgaggaccacugguuuucgcgggagaauagccuguccgggguggagggcgaaggccuccacaaacucggguacauccuacgcgauaucaguaagaucccagggggcaauauguaugccgaugauaccgccggaugggacacccgcauaacggaagacgaccuccagaacgaggccaagauuaccgacauaauggaacccgagcacgcgcugcuugccaaguccaucuucaaacucacauaccagaauaaggugguccgcgugcagcgcccggccaagaacgguacagugauggacgucaucagccggcgcgaucagagaggcuccggccaggugggcacuuacggccugaacaccuuuacgaacauggaggcccagcugauccgccagauggaaucugaggggaucuucagccccagcgagcuggagacccccaaccuggccggccgaguucuggacuggcuugagaagcacgggguagagcgccugaagagaauggcgaucagcggagacgacuguguggugaaacccaucgacgaccgcuucgccaccgcccugacagcccuuaacgauauggggaagguccggaaagacauuccgcaaugggagcccucuaagggcuggaaugauuggcagcagguccccuuuugcagccaucauuuucaccagcugaucaugaaggauggccgcgagaucgugguccccugccggaaucaggacgagcugguggggcgcgcccgggugucccagggugcaggguggucgcuacgcgagacggccugccuugggaaguccuaugcccagauguggcagcuaauguacuuccaccggcgcgaucuccggcuggcugcuaacgccaucugcagcgccgucccuguggacugggugcccacaucccgcaccacauggagcauucacgcucaccaccaauggaugacgaccgaggauaugcugucagucuggaaccggguguggauagaggagaaccccuggauggaggacaaaacccaugugucuaguuggggcgacguccccuaccuuggcaagcgcgaggaccagugguguggcagcuugaucgggcucaccgcccgcgcgacgugggccacgaacauccaggucgccauuaaccaggugcggcgccuccuggggaacgaaaacuaucuggacuacaugacuuccaugaaacguuucaagaacgaaagugacccggaaggagcucucugguga

SEQ ID NO: 24328 - RNA, 9879 nt, Artificial Sequence
  derived and/or modified CDS sequence (opt11) from DENV-1__FJ882550__SS-prME
agcguaaccaugcuguuaauguuaaugcccaccgcccuggcguuucaccucaccacacggggcggugaaccccacaugauugugacgaagcaggagcggggcaaaagccugcuguucaagaccagcgccggcgugaacauguguacccucaucgccauggaccuuggcgaacugugcgaggacaccaugacguacaagugccccagaaucaccgaggccgagcccgacgacguggacugcuggugcaacgccacggacaccugggugacuuaugggacgugcagccagacgggugagcaccggagagacaaaaggagcguggcccucgcuccccacguaggucucgggcuggaaacccgcaccgaaacguggaugaguagcgagggcgccuggaagcagauacaacgggucgagacgugggcucuccgacaccccggcuucaccguaaucgcgcuguuccuggcgcacgccaucggcacuuccaucacccagaaggggaucaucuuuauccucuuaaugcucgugacgcccagcauggcuaugcgaugcgucgggaucgggucccgcgacuucguugaggggcucagcggcgcuaccuggguugaugucguucuugagcacggguccugcgugacuacuauggccaaagauaaacccacgcuggauaucgaguuacuuaagacugaggucaccaaucccgcugugcuacggaagcuauguaucgaggccaagaucucaaacaccacgaccgacucccgcuguccaacccagggcgaggccacccuuauggaggaacaggacgcgaacuucgugugccggcggacguuuguagaccggggcugggguaacggcugcgggcuguucggcaaggggucgcucaucacgugcgccaaguucaagugcgugaccaagcuagagggcaagaucguccaauacgaaaaucugaaguacuccgugaucguaaccgugcacacgggcgaccagcaccaagucgggaacgaaagcacggaacacggcaccaccgcgaccaucacgccccaggcucccacgucugagauccaacuuacggauuacggggcccugacccuggacuguaguccccgcacgggccucgacuucaacgagauggugcugcugaccaugaaagagaagucauggcucguccauaagcagugguuccuggaccugccguuacccuggacuagcggcgccucaacuucccaggagacguggaaccggcaggaccugcuggucaccuucaagacugcccaugccaagaagcaagagguggucguuuuaggcagccaggagggcgccaugcauaccgcccugacgggggccacagagauacagaccuccggcaugaccacgauuuucgcggggcauuugaagugucgacucaagauggauaagcugacccugaagggcaugagcuacgugaugugcaccgggucauuuaagcucgagaaagaagucgcggagacccagcauggcacggugcuggugcagaucaaguacgaaggcaccgacgcccccugcaagauccccuucucgacccaggacgagaaagggguuacccagaacggccggcuuaucacggccaacccgauugugaccgauaaggagaagcccgugaacaucgaagcggagccgcccuucggggagucuuacaucgucaucggcgcaggcgagaaagcccucaaacucagcugguucaaaaagggguccagcaucggcaagauguucgaggcuaccgcccgcggggcccggcgaauggcuauccucggugacaccgcgugggacuucgggucagugggcggaguguucacuagcgucgggaagcuggugcaccagauuuucggcaccgccuacgggguccuguucuccggcgucagcuggaccaugaagaucggaaucggcgugcuucugaccuggcucggccugaacucccgcagcacaucccugagcaugaccuguauugcaguggggcucguaacccuguaucugggcgucaugguacaggccgauucagggugugucauuaacuggaagggccgcgagcucaagugcgggagcgguaucuuugugaccaacgaagugcacacguggaccgagcaguacaaguuccaggcggacucccccaagcgccuguccgccgcaaucggcaaggccugggaggaggguguauguggcauccggucggccacccgccuggagaacaucauguggaagcagaucuccaacgaacuaaaccacauccugcuggagaaugacaugaaauucaccguggucgugggggacguaguagguauucucgcgcaggggaagaagaugauccguccccaacccauggagcauaaguacagcuggaaaaguuggggcaaagcuaagaucaucggcgcagacguccagaacacgacguucaucaucgacggucccaacaccccggagugccccgaugaccagcgcgccuggaauauuugggagguggaggacuacggcuucgggaucuucacuaccaacaucuggcugaagcugcgggacagcuauacccaggucugcgaccacagacucauguccgcagccauuaaggacuccaaagcuguccacgccgacaugggauacuggaucgaguccgagaagaacgagaccuggaagcuggccagagcgucguucauagaggucaagaccugcaucuggcccaaaucccacacccuauggaguaacggugugcuugaguccgagaugaucauccccaagaucuacggagguccgaucagccagcauaacuacagacccggauacuucacacagacggccggcccuuggcacuuaggcaagcucgagcucgacuuugaucugugcgagggcacgaccgucgugguggacgagcacuguggcaaccgggguccgagucugagaacuacaaccgugaccggcaagaucauucacgaauggugcugccgcucgugcacgcugccaccccugcgcuucaagggggaggacggcugcugguaugggauggaaaucagacccgugaaagagaaagaggagaaccuggugaaauccauggucagcgccggcagcggugagguggacuccuucagucugggccugcucugcaucaguaucaugaucgaggaggugaugcgcucucgguggucccggaagauguugaugaccgggacacuggccgucuuucugcugcugaucaugggacaauugaccuggaacgaucucauccggcugugcauaauggugggcgccaacgcgucggaccgcauggguaugggcacgacguaccuugcccucauggcuaccuucaagaugagaccgauguucgccguggggcugcuguuccggaggcucaccucucgggagguccugcugcucacgaucgggcugagccucguggccuccgucgagcuccccaacagccuagaagaacugggcgacgggcucgcgaugggcaucaugauccugaagcugcucaccgacuuccagagucaccagcugugggccacccuacucagccucacuuucaucaaaacgacgcugucccuccacuacgccuggaagaccauggccauggucuugucaaucgugucacuauucccccucugccuaucaacaacgagucagaaaacaacauggcugccgguucuucugggcucucuggggugcaagccgcucacaauguuccugauaacggagaacaaaaucuggggccgcaaguccuggccccugaaugaggggaucauggcggugggcguggucagcauccucuuguccucccugcucaaaaacgacgugccacuggccgggccccugaucgccggcggcaugcugaucgccugcuacgucaucagcgggucuagcgccgaccuguccuuagaaaaggcggccgagguuagcugggaggaggaggcggagcacuccggcgccucacacaacauucuggucgagguacaggaugacgggaccaugaagaucaaggaugaggaacgggaugacacccugaccauccugcucaaagcuacucuacuggcaguaagcggcguuuacccgcucaguauccccgcgacacuguucgugugguacuuuuggcagaagaagaagcagcgcuccggggugcuuugggacacccccaguccacccgagguggagcgggccguuuuagaugacggcauuuaccguaucaugcaacggggccuccuggggcgcucacaaguaggcgugggaguguuccaggagaacgucuuccacaccauguggcacgugacaaggggcgcagugcugauguaccaggggaagcgccuagagcccagcugggcaagcgucaaaaaggaucugaucucuuacgggggcggguggcggcugcagggcucguggaacacgggcgaggagguccaagugaucgccgucgaaccaggcaaaaacccgaagaaugugcagacagcccccgggaccuuuaagacccccgagggcgaggugggcgccauugcccucgacuucaagcccgggacgagcggcucccccaucgucaaccgcgaggguaaaaucgugggccuguacgggaacggaguggugacaacaagcggcacauaugugucggccauugcacaggccaaggcaucccaagagggcccgcugcccgagauugaggacgagguauuccggaagcgcaacuugacgaucauggaccugcaccccgguuccgggaagacccggcgcuaccuaccggccaucguccgugaggcgaucaagcgcaagcuccggacccuaauccuggccccaacccgcgugguggccuccgagauggcugaggcccucaagggcaugccuauccgauaccagacgacggcaguuaaguccgagcauaccgggaaggagauuguggaccucaugugccacgccaccuucacgaugagacugcucucccccgugcgcgucccgaacuacaacaugaucaucauggacgaggcgcacuucacugacccaucuaguaucgccgccagagguuacaucagcacccgcgugggcaugggugaggcggcggccaucuucaugaccgccacuccgcccggcuccguggaggccuucccgcagagcaaugcggucauccaagacgaggagcgggacauccccgaacgcuccuggaacuccggguacgaguggaucacggacuuccccggcaaaaccgugugguucgugcccagcaucaagagcgguaaugacaucgccaacugccugagaaagaaugggaaacgggucauucagcuuucccggaaaacguucgacacggaauaccagaagacgaagaauaacgacugggacuacguggucaccacggacaucagcgagaugggugccaacuuccgagccgaucgggucaucgauccgagacgcugccucaagcccgugauccucaaggacgggcccgagcgcguuauccuugcaggaccgaugccggucacgguggccuccgccgcccaacggcgcggacguaucggacgcaaccauaacaaggagggcgaccaauacaucuacauggggcagccccugaacaacgaugaggaccacgcgcacuggaccgaggcgaagauguuauuggacaacaucaauacccccgagggaauaauacccgcccuuuucgagccggagcgagagaaguccgccgccaucgacggggaauaccgccugcgcggcgaggcucggaagacuuucguggagcugaugcgccgcggggacuuacccguguggcuguccuacaagguggcgagcgagggcuuccaauauagcgaccgccgguggugcuucgacggcgagcgcaauaaccagguucuagaagagaacauggauguggagaucuggacuaaagagggugaacgcaagaagcuccgcccccguuggcucgaugcccgaacuuacucggaccccuuggcccuccgugaguucaaggaguucgccgccggccgccggucuguguccggggaccucauccuugagaucggcaaacuuccgcagcaccugacccagagggcgcagaacgccuuggacaaucucgucaugcuucauaauagcgagcagggcggacgugccuaccgccacgccauggaggaacuucccgacaccaucgagacgcucaugcugcuggcgcuuaucgccgugcugaccggcggggugacccuguucuuccucuccggccggggccugggcaagaccagcaucggccugcucugugucauggccuccuccgugcugcuauggauggcguccguggaaccccacuggaucgcagcuagcauaauccucgaguucuucuuaaugguccugcucauccccgagccagaccgccagcggacgccccaagacaaccaguuggcuuacguggugaucgggcuccucuucaugauacuaacggucgccgccaacgagaugggccugcucgagaccaccaagaaagaccuagggaucgggcacguggcgguggagaaccaccaccaugcgaccaugcuggacguagaccugcauccggcguccgccuggacguuauaugcuguggccacuaccaucaucacuccgaugaugcgccacacgaucgagaacacuaccgcgaacaucagccuuacggccaucgcaaaccaggccgcuaucuugauggggcuggacaagggcuggcccaucucaaagauggacaucggcgucccccugcucgcgcuggggugcuacagccaagucaacccccugacccuaacggccgccguccucaugcugguggcccacuacgcgauuauaggcccgggucuccaagcuaaggccacccgugaggcccagaagcguaccgccgcgggcaucaugaagaaccccaccgucgacgguaucguggcuaucgaccucgaccccguagucuacgacgcaaaguucgagaagcaacugggacagauaaugcuccugauccucuguaccucccagauccuccucaugcgcaccaccugggcccugugugaguccaucacgcucgccacaggcccccucacuacccugugggaggggaguccugguaaguucuggaacacuaccaucgcugugagcauggccaacaucuuucgggguuccuaccucgccggggccgggcuugccuucagcuuaaugaagucccucggcggcggcagacgcggcacaggggcccaaggggagacucugggcgagaaguggaagcgccagcugaaccaacuaucuaaguccgaguucaacauauacaagcgguccgggaucauggagguggaccguucagaggccaaggaaggccugaaacgcggagagacgaccaggcacgcggucucgagaggcaccgccaaauugcgcugguucguggaacggaaccuugugaagcccgaggguaaagucaucgaccucggcugcggacgugggggcuggagcuauuacugcgcgggccucaagaaggugacugaggucaagggauacacgaagggcggacccggccacgaggagcccaucccgauggcaaccuacggguggaaccugguuaaguugcacagcggcaaggacguguucuuuacgccucccgagaagugcgacacccugcugugcgacauuggcgagagcagcccgaacccgacuaucgaggaaggccgcacgcuccgcgugcugaagauggucgagcccuggcugcgggggaaccaguucugcaucaagauccuaaaccccuacaugcccagcguugucgagacccuggaacagaugcagcgcaagcacggcggcaugcucguccggaacccgcuuucccgcaacagcacccacgaaauguauuggguuagcugcgggaccggcaacaucgucagcgccguuaacaugacgucccggaugcuguugaaccgguucacgauggcacaccgcaaacccaccuacgagcgcgauguggaucucggugcaggcacccgccacgucgcggucgagccggagguggccaaucuggacaucaucggccaacggaucgaaaauaucaagcaugagcacaagagcacguggcacuacgacgaggacaacccauacaagacaugggccuaccacgggucauacgagguuaagccgucagguagcgcuucaagcauggugaacgggguugucaagcuccucacgaagcccugggacgugauccccauggugacccagauagccaugacugacaccacccccuucggccagcagagggucuucaaggagaagguggauacccggacgccaaaggcgaagagggggaccgcacagauuauggaggugaccgcccgguggcuguggggcuuccugucccgcaacaagaagccgcggaucuguacccgcgaagaguucacgcguaaaguccgcucaaacgcugcuaucggcgcaguguucguggaugagaaccaguggaacuccgcuaaggaggccgucgaagacgagcguuucugggaccuagugcagaaggagcgggagcugcacaagcagggaaagugcgcgaccugcguguacaacaugauggggaagcgggagaaaaagcugggggaguucggcaaggcuaaggggagucgugccauuugguacaugugguugggagcccgguuccuggaguuugaagcccugggguucaugaaugaggaccacugguucucccgcgagaacagccucuccgguguggaaggcgagggccugcacaagcugggcuacauccuccgggacauaagcaagauccccggagggaacauguacgccgacgacaccgcgggcugggacacccgcauaaccgaggacgaccuucagaacgaggccaagaucacggacaucauggaaccggaacacgcucugcuugcgaccuccaucuucaagcugaccuaccaaaauaagguggugcggguccagcgccccgccaagaacgggacagugauggacgugaucucacggagagaucagcgcggcagcgggcagguagguaccuacggccugaacaccuuuaccaacauggaggcgcaguuaauccgucagauggagucugaagggaucuuccuucccuccgagcucgagacgcccaaccucgccgagcgcguguuggauuggcuggagaaguacggcguagagcgguugaagcgcauggccaucagcggggacgacugcgucgugaaaccaaucgaugaucgguucgcgaccgcccugacggcgcugaacgauaugggcaagguucgcaaggacaucccccaaugggagcccuccaagggguggaacgacuggcaacaggugccauucugcagccaccauuuccaccagcucaucaugaaagacggccgggagaucguggugccgugccgcaaucaggaugagcuggugggacgggcccgcguuucccagggcgcgggcuggucgcugcgggagacggccugcuuaggcaagucguacgcccagauguggcaguugauguacuuccaccgccgggaccugcgccucgcggcuaacgccaucuguuccgccgugcccguggacuggguccccacgagucggaccaccuggaguauccacgcgcaccaccaguggaugaccacggaggacaugcugagcguguggaaucgcguguggaucgaagaaaacccguggauggaagacaagacccacguguccagcuggggcgacgugccguaccuggggaagcgggaagaccaguggugcggcuccuuaauuggccuaaccgcgagggccaccugggccucgaacauacaggucgccaucaaccaggugcgccgucugaucgggaacgagaacuacuuagauuacaugaccagcaugaagcgauucaagaacgagggagaccccgagggggcgcugugguga

SEQ ID NO: 24329 - RNA, 9879 nt, Artificial Sequence
  derived and/or modified CDS sequence (opt11) from DENV-1__FJ882551__SS-prME
agcgugaccauguugcuaauguuaaugccuaccgcccuggccuuccaccucacaacgcgcggcggugaaccccacaugaucgugagcaagcaggagcgaggcaagucacugcuguucaagaccagcgcgggggugaacauguguacccucaucgccauggaccugggcgaguuuugcgaggauaccaugaccuacaagugcccucgcaucaccgaggcggagcccgacgacguggacugcugguguaaugccaccgacacguggguaacguacggaaccuguagccagaccggggagcaccggcgcgacaagagguccguggcacuggcgccacaugugggccucgggcuggagacgcguaccgagaccuggaugagcuccgagggcgccuggaagcagauccagcgggucgagacaugggcccuucgccauccgggguucacgguuauugcccucuuccuggcacacgccaucggcaccuccauuacccagaaagggauuaucuucauucugcucauguuggugacccccucuauggcuaugcggugcguuggaaucgggagccgcgacuuuguggaaggguugaguggggccacauggguggacgucguguuagagcacggcagcugcgugaccaccauggccaaggacaagcccacccuggacauagagcuguuaaagacggagguaaccaaccccgcagugcuucggaagcugugcaucgaggccaagaucagcaauaccaccacggacagccgcugcccgacacaaggcgaggccacccuaguggaagaacaagacgccaauuuugugugccggcgcaccuucguagaccggggcuggggaaacggcugcgggcuguucggaaaggggucgcugaucacgugcgccaaguucaagugcgugaccaaguuggagggcaagaucguccaauacgagaaccugaaguacagcgugaucgugaccguccauaccggcgaccagcaccaggugggcaacgaguccacggagcacgguaccaccgcgaccaucacaccgcaggcccccucaacagagauccagcugacugauuacggggcccucaccuuggacugcucgccucggaccggccuggacuuuaacgaaauggugcuccugacgaugaaagagaaguccuggcugguacacaaacagugguuccucgaccugccgcugccguggaccagcggggccagcacaagucaggagaccuggaacagacaggaccuccugguuacguucaagacggcgcacgcaaagaagcaggaggucguggugcugggcucucaggagggcgccaugcacaccgcguuaaccggggcaacagagauacagaccagcggcaccacgacgaucuucgccggacaccucaagugccggcucaagauggacaagcuuacccugaagggcauguccuacgucaugugcaccgggagcuuuaagcucgaaaaggagguggcggagacucagcacggcacggugcuaguccagaucaaguacgagggaaccgacgccccguguaagaucccguucuccacacaggaugagaagggcgugacgcagaacggacggcugauaacagccaacccgaucgugacggacaaggagaagcccgucaacaucgaggccgagccuccguucggcgagagcuacaucgucaucggcgcuggcgaaaaggcccugaagcuguccugguucaagaaggggucguccaucgggaaaauguuugaggccaccgcucgcggggcccgacgcauggcgauccucggcgacaccgccugggacuucgggaguauaggcggagucuucacuuccgucggaaagcucgugcaccagaucuucggaaccgccuacggagugcuguucagcggaguuuccuggacuaugaagaucgguaucggcguacuccugacguggcuuggccucaauagccgcuccacgagccuguccaugaccugcaucgccguggggcugguuacucucuaucugggcgugaugguucaagccgacaguggcugugucaucaauuggaagggccgggaacugaagugcgguagcggcaucuucguuaccaacgagguccauacguggaccgagcaguacaaguuccaggcggacuccccgaaacgcuuaagcgccgccauaggcaaagccugggaggagggugucugcggcaucagauccgccacacgucuggagaauauuauguggaagcagaucagcaacgagcugaaccacaucuugcuagaaaacgauaugaagcugacagugguuguuggugacguugcgggcauccucgcccaggggaagaaaaugauucggccucagcccauggaguacaaguacuccuggaaguccuggggcaaggcaaagaucauuggcgcggacgugcagaacaccacauucaucaucgacggaccaaauacgccggagugccccgacgaccagcgcgcauggaauaucugggagguggaggacuacggauucgggauauucacaaccaacaucuggcugaagcugcgggauuccuacacccaggugugugaccacagauugaugagcgccgccaucaaggacuccaaggccguucacgccgacaugggcuacuggauugagagcgagaagaacgagacuuggaaacuggcgcgggccagcuucauagaggucaagaccugcaucuggcccaagagccacacacucugguccaauggagugcucgagagcgagaugaucaucccuaagaucuacggggguccgacaucccagcacaacuaccgccccggguacuucacgcagaccgccggcccuuggcaccuagggaagcuggagcuggauuuugacuuaugcgagggaaccacggugguuguggaugaacauugcggcaaccguggcccgagccugcgcaccaccaccguaacugggaagauaauccaugaguggugcugccggucgugcacucugccuccccuccgauucaagggugaggacggcugcugguacgggauggagauacggccuguaaaggagaaggaggagaaccuggucaagagcaugguuagcgccggcuccggagagguugacagcuucucccucggccugcugugcaucucaaucaugaucgaggaggugaugcgcucccgguggagucgcaaaaugcucaugaccgggacccuggccguguucuuccuucucaucaucgggcagcugacguggaacgaccugauucggcucugcauuauggucggcgcaaacgccuccgaccgcauggggaugggcaccacuuaucuugcccucauggccacuuuuaagaugcgcccaauguucgcaguggggcuccucuuccggcgccugaccagccgggaggugcuccuacugaccaucgggcuaucccucgucgcaagcguggagcugccuaacucccuugaggagcugggcgauggccuggcaaugggcaucaugauccucaagcugcugaccgacuuccaaagccaccaacucugggccaccuugcugucccucaccuuuauccgcaccacauucagcuuacacuaugccuggaagaccauggccaugguuuuaaguauuguaagccucuuuccccugugccuguccacgaccagccagaagaccaccuggcuccccgugcugcugggcucccucggcugcaagccgcugacgauguuucugaucgcggagaacaagaucuggggccgcaagagcuggccucucaacgaggguaucauggccgucggaaucgugaguauccugcuguccagccugcuaaagaacgacguaccccuggccgggccccucauugcgggcggcaugcugaucgcgugcuacgucaucuccgguagcuccgcugaccugagccucgagaaggccgccgugguuuccugggaggaggaggccgagcauuccggcgcgucccacaacauucuggucgaggugcaggacgacgggaccaugaagaucaaggaugaggagcgcgacgacaccuuaaccauccuccugaaggccacgcugcucgccgugagcgguguuuacccgcuguccaucccugccacguuauucgugugguacuucuggcagaagaagaaacagcgguccggggugcucugggauaccccgagcccgccugaggucgagcgcgccguguuggacgacggcaucuaccggaucaugcaacgcgggcugcuggggcggagccagguuggcgucgggguguuccaggagaacguuuuccacaccauguggcaugucacacguggcgccgugcucauguaccaggguaagcggcuggagcccucaugggccagugucaagaaggaccugaucuccuacggaggaggguggcgccuccagggcagcuggaauacuggggaagagguccaggugaucgccguggagcccggcaaaaaccccaagaacguccagaccgcgcccggcaccuucaagaccuccgagggggaggugggagccauugcgcuagacuucaagcccgguacaagcggaagccccaucguaaaccgggaggggaagaucgucggccuguacggcaacggaguggugacgacauccggcacauaugucagcgcaaucgcucaagcuaaggcgagccaggaggggccgcuccccgagaucgaagacgagguauuccgcaaacgaaaccuuacgaucauggaccugcaccccgggagcgggaagacccgccgguaccuccccgccauugugcgcgaggcuaucaagcggaaacugcgcacccuuauccuugccccgacccgugucguggccucagaaauggcagaagcccuaaaggguaugcccauccgguaccagaccacugcugucaagagcgagcacaccgggaaggagaucguagaccugaugugucaugccacauucacgaugcgccuccugucccccguucgggugccaaacuacaacaugauuaucauggacgaggcccacuucaccgacccgucaucuaucgcggcucgcggguauauaagcaccagggucggaaugggugaagccgccgccaucuuuaugacggcgacuccacccggcaguguugaagccuuuccgcaaagcaacgccguaauccaggacgaagagagagacaucccggagcggucauggaacagcgguuaugaguggauuacugacuuccccgggaagaccgucugguucgugccgucgaucaagagcgggaacgacaucgcuaacugccugcgcaaaaacgggaagcgggugauucagcuauccaggaagacauucgauacggaguaccagaaaacaaagaacaacgacugggauuacguggugaccacugacaucucugagaugggcgcgaacuuccgugccgacaggguaaucgacccgcgccgcugucugaagccggucauccugaaagacggacccgagcggguuauccucgcgggcccaaugccagucacgguggccuccgccgcacagcgccgggggcgaauuggucggaaccacaacaaagagggugaucaguacaucuauaugggucagccguuaaacaacgacgaggaccacgcccacuggaccgaggcuaagaugcugcucgacaacaucaacacccccgagggcaucaucccggcccuguucgaaccggaacgcgagaaguccgccgcgaucgacggggaauacaggcuaagaggcgaggcccgcaagacauucguggagcucaugcggcgcggagacuugccggucuggcugagccacaagguagccuccgagggcuuccaguauagcgaccggcgcugguguuucgacggggagcggaacaaccaggugcucgaggagaacauggacguugaaauuuggacgaaggagggugagcgcaagaagcugcgaccccgcuggcuggacgcccggacauauuccgacccccucgcccugcgcgaguuuaaggaguuugcggccggccggcgaagcgucuccggggaccugauucucgaaaucggcaagcugccccagcaccuaacucagagagcccagaacgcccucgacaaucuggugaugcugcacaauagcgagcagggcgggcgcgcguaccggcacgccauggaggaacugccggacaccauagagacguugaugcuucucgcccugaucgccguacuuaccgggggggugacccucuucuucuuguccggccgcggacugggcaagacuagcaucggccuccugugcgugauggccucuucugugcugcuguggauggcgucgguggagccccauuggaucgccgcuuccaucauucuggaguuuuuucugaugguccucuugauacccgagcccgaucggcagcgcaccccgcaagacaaucaguuggccuacgucguaaucggacuccuguucaugauccugacgguggcggcgaacgagaugggucuccuggagaccacuaagaaggaccuggggaucggccacguugccgucgaaaaucaccaucacgcugccaugcucgacguggaccuacaucccgccuccgcguggaccuuguacgccgucgccacgaccaucaucacccccaugaugcggcacaccaucgagaacacgaccgcgaacaucagccucacugccaucgcuaaccaggccgccauccugauggggcuggacaaaggauggccgauauccaagauggacaucggagugccccuccuggcucuggggugcuauucccaagugaacccccucacccucaccgcggccguccugaugcucguggcccacuaugcgaucauaggccccgggcugcaggccaaggcgacccgcgaagcccagaagagaaccgccgcuggcaucaugaagaacccaacaguggacgggaucguagccaucgaccuggacccagugguguacgacgcgaaguuugagaagcagcucggacagaucaugcugcugauccugugcacgucccagauacugcugaugcggaccacgugggcccucugcgagagcaucacccuggccacaggcccucugaccacccuuugggaggggucccccggcaaguucuggaacacaacgaucgccgucagcauggccaauaucuuccgcggguccuaccuggcaggcgccggccuggccuucagucucaugaaaucccucgggggcgggagacgcgggacaggggcccagggcgagacccugggagagaaguggaagcgucagcucaaccaacucaguaaaucagaguucaacaccuacaagcguaguggaauaauggaggucgaucgaagugaggcaaaggagggccugaaaaggggggagacaacuaagcacgccgugucccgggguaccgccaagcuccgcugguucguggagcgcaaucuggucaagccggaaggaaaggucauagaccugggcugcggccguggggggugguccuacuacugcgccgggcugaagaaggucaccgagguuaaaggcuacacgaagggcgggcccggccacgaagaacccaucccaauggcuacuuacggguggaaucucgucaagcugcacuccggcaaggacgucuuuuucauaccgccggagaagugcgauacccugcucugcgauauuggggagagcucacccaacccaacgaucgaagagggccggacccuaagggugcuaaagaugguggagccuuggcuucgggggaaccaguucugcaucaagauacugaacccauacaugcccagcgucgucgagacccuugagcagaugcaacgcaagcacggcggcaugcucgugcggaacccccugucccgcaacagcacccaugaaauguauugggugucaugcggaacuggcaacauagugagcgcggugaacaugaccucccggaugcuacucaaccgauucacgauggcccaccgcaagccuaccuacgagcgugacgucgacuuaggggccggcacccgccacguggccguggagcccgaggucgccaaccucgacaucauaggucagcggaucgagaacaucaagcaggagcacaaaagcaccuggcacuacgacgaggacaaccccuauaagacgugggcguaccacggguccuacgaagugaaacccagcggcagcgcaaguagcauggucaacgggguagugaaacuccugaccaagccgugggacgucaucccgaugguuacccagauagccaugaccgacacgacccccuucggccagcagcggguuuucaaggagaaggucgacacccggacccccaaggccaagcgcgggacggcccagaucauggaggugaccgcgaaguggcuuuggggauuucucuccagaaacaagaaaccgcgcaucugcacucgggaggaauucacucgcaaggugcguagcaacgccgcaaucggagccgucuucguggacgaaaaccaguggaacucugcgaaggaggccguggaggacgagcgcuucugggaccugguccaccgggagcgugagcugcacaagcaggggaagugcgccacgugcguguacaacaugaugggcaagcgggagaagaaguugggggaguucggcaaggccaaagguagccgcgccaucugguacauguggcuuggugcgcgguucuuagaguuugaggccuuaggcuuuaugaacgaggaccacugguuuuccagggagaacagccuguccgggguugaaggugagggccugcacaagcuuggcuauauccugcgggacauuagcaagaucccugggggcaacauguacgccgaugacaccgcaggcugggacacccgcaucaccgaggacgaccugcagaacgaggcgaaaaucacagacauaauggagcccgagcaugcgcuacuggccaaguccauuuucaagcucaccuaccagaacaaggucgugcgggugcagagaccggccaagaacgggaccgucauggaugugaucagccgccgggaccagcguggaagcggacaaguuggcaccuacggccugaacacguucaccaacauggaggcccagcugauucggcagauggagucggaggggaucuucucccccagcgagcuggaaacccccaaucucgccggcagaguccucgacugguuaaagaaacacgggguggagcggcucaagcgcauggccaucucaggcgaugacugcguggucaagccaaucgacgaucgguucgcuaccgccuugacagcucugaaugacauggggaaagugcgcaaggacaucccgcagugggagcccucaaagggauggaacgacuggcagcaggugcccuucuguucucaccacuuccaccagcucauuaugaaggacggacgggagcuggucgucccgugccgcaaccaggacgagcugguggggcgggcgcgugucucccagggcgcgggguggagccuccgggaaacagccugccugggcaaguccuacgcucaaauguggcaguugauguacuuccaccgcagagaccuccgccuggcugcgaacgccaucuguuccgccgugccgguggacuggguccccaccucccggaccaccuggucaauucacgcccaccaucaguggaugaccacggaggacaugcugucuguguggaaucgcguguggaucgaggagaaccccuggauggaggauaagacccauaucagcucuuggggcgacguccccuaccucggaaagcgggaggaccaguggugcggcucgcugauagggcugacggcgcgcgcgaccugggccaccaacauccagguggccaucaaccaggugaggcggcuccugggcaacgagaacuaucuggacuacaugaccuccaugaaacgcuucaagaacgaaagcgacccggaaggggcgcugugguga

SEQ ID NO: 24330 - RNA, 9879 nt, Artificial Sequence
  derived and/or modified CDS sequence (opt11) from DENV-1__FJ882552__SS-prME
ucugugacuaugcuguuaaugcugaugcccaccgcgcuggcauuucaccucacgacccggggcggcgaaccccacaugaucgugagcaagcaggaacggggcaaaucacugcuguuuaagaccagcgccggugugaauauguguacucucaucgccauggacuugggcgaguucugugaagauacgaugacguauaagugcccccgcaucaccgaagccgaacccgacgauguggacuguuggugcaaugccaccgacaccugggucacauacgggaccugcagccagaccggugagcaccggcgggacaagcgguccguggcgcuggcuccacauguggggcucggucucgagacuaggaccgagaccuggauguccuccgaaggggcauggaagcaaauccagcgggucgaaacgugggcccugcgccauccaggguucacagugauugcacucuuccuggcgcaugccaucggcaccagcaucacacagaaggggaucaucuucauacugcugaugcuggugacacccucuauggccaugcggugcgucggcaucggcagccgcgacuucguugagggccugucaggugcgacguggguggacgucgugcucgagcacgggagcugcgugacuacaauggcuaaggauaagcccaccuuagacauagagcugcuaaaaacggaggucacuaaccccgcggugcugcguaagcugugcauagaggcuaagaucuccaauacgacuacagacagccgcugcccgacccaaggcgaggccaccuuaguggaggagcaagacgccaauuucgucugccggcguaccuucgucgaccguggcugggggaauggcugcgggcuguucggcaaggggucccugaucacuugcgccaaguucaaguguguaaccaaacucgagggcaagaccguacaauaugaaaaucugaaguacagugugauagugaccguccacacgggcgaccagcaccagguggggaacgagagcacagaacacggcacaaccgcaacaaucacgccccaggcgcccagcacagagauccagcugaccgacuauggggcccucacucuggauuguagcccucggacggggcuagacuuuaacgagaugguacuauuaacaaugaaggaaaaguccuggcugguucacaagcagugguuccucgaccugccccugcccuggaccucaggggccuccaccucccaggagaccuggaacagaaaagaccuccugguaacauuuaagacggcccacgcgaagaagcaggaagugguugugcugggcucccaagaaggcgcgaugcacaccgcccugacgggcgccaccgagauacagaccagcggaaccacgacaaucuucgccggucaucugaaguguagacucaaaauggacaagcucacgcuuaagggcaugucauaugucaugugcaccgggagcuucaagcuggagaaagagguggcggagacgcaacacggcacaguguuaguacagaucaaauacgagggcacggacgcaccaugcaagauccccuuuagcacucaggacgagaaaggggugacgcagaauggccgccugaucacagcaaauccaauugugaccgacaaggagaagccugucaacauugaggccgagccgcccuucggggaguccuacaucgugaucggcgcaggggaaaaagcacugaagcugucaugguucaagaaggggagcuccaucggcaagauguucgaggcaaccgcgcgcggcgcacggaggauggcuauccuuggcgacaccgccugggacuuuggaagcaucgguggcguguucacgucgguugggaaacuggugcaucagauauuuggcaccgccuacggggugcuguucagcggcgucuccuggaccaugaagauagggauuggagugcuuuuaacguggcucgguuugaacagccgcagcacgagccuguccaugaccugcauugccguuggauuggucacccucuaccugggugugauggugcaggcugacagugggugcguaaucaauuggaagggccgagagcugaagugcggcucaggcaucuucguuacaaacgaagugcacaccuggaccgagcaguacaaguuccaggcugacagcccgaagcgccucucugcagcgaucggcaaagccugggaagagggugucugcggaauccgguccgcaaccagacuggaaaacauaauguggaagcagaucagcaacgaacugaaccauauccugcuggagaacgacaugaaguuuaccgugguggucggagacguagcgggcauccuggcccaggggaagaaaaugauccggccucagccaauggaguacaaguauuccuggaaguccuggggcaaagccaagaucaucggcgcagacgugcagaacacgacuuucaucaucgacgggccgaacaccccggaaugucccgacgaccagcgagcauggaacaucugggaagucgaggacuauggcuucgggaucuuuaccacgaacauauggcucaagcuacgggacuccuauacccagguaugcgaucaccgcuugaugagcgccgccauaaaagauucaaaggccguacacgcagacaugggcuacuggaucgagagcgagaagaacgagacuuggaaguuagcgcgggccuccuucauugaggucaagacgugcaucuggcccaaaagccauacgcugugguccaacggcguacuggagucagaaaugaucauccccaagaucuacggagggccuauuucucagcacaacuaccgccccggguacuucacacaaaccgcaggccccuggcacuuagggaagcuggagcuggacuucgaccucugugagggcaccaccguagucguggacgagcacugcggcaaccgggguccgagucugcgcaccacgaccgucacggguaagaucauacaugagugguguugccggaguugcaccuuaccaccacugcgcuucaaaggggaggacggcugcugguacgggauggagauccggccugucaaggagaaagaggagaaucuagucaagaguauggugagcgccggaagcggcgagguggacaguuuuucccuggggcuccugugcaucucuaucaugauagaagaggugaugaggucccgguggagccgcaagaugcuuaugacggguacucuggccguauucuucuuacugaucaugggucaacuuacguggaaugauuugauccggcucugcauuauggucggcgcgaacgccucggaccgcauggggauggguaccacauaccucgcgcugauggccaccuuuaaaaugcgcccgauguucgccguggggcucuuguuccggagacugacgagccgcgagguccugcuccugacaaucgggcugucauuggucgcaagcguugagcugcccaacucccuggaggagcuaggcgauggguuagccaugggcaucaugaucuugaagcuccuuaccgacuuccagagccaucagcugugggccacacucuugaguuuaacguuuaucaagaccacuucuucccuccacuaugcuuggaagaccauggcuaugguacugagcaucgugucccucuuuccccugugccugagcacuaccucccagaagaccacuuggcuacccgugcuacugggaucguugggcugcaaaccucugacgauguuuuugaucgccgagaacaagauuugggggcgcaagagcuggccauugaacgaaggaaucauggccgucggaaucguuuccauucuccuuuccucccucuuaaagaaugacgugccucuggccgggccccugauugccggcgggaugcucauagcgugcuauguaaucuccggguccucugccgaccugucccuggagaaggcagccgaaguguccugggaggaggaggccgagcacuccggcgcgagucacaauauacucguggagguccaagacgacgguaccaugaagauuaaagaugaggagcgggacgacacccugacaauccuucugaaggccacacuucuggcgguguccggcguguacccgcucagcauccccgccacacuguucgugugguacuucuggcagaagaagaaacagcgcucaggggugcuaugggacacccccagcccgccugagguggagcgggccguguuggaugacggcaucuaccguaucaugcagcggggccuguuggggcgaucccagguggggguggggguauuccaggagaacgucuuccauacaauguggcacgugacccggggcgcggugcugauguaccagggcaagcgacucgaacccaguugggccuccgugaagaaggaucugauaagcuacggcggaggguggcggcugcagggguccuggaacacuggggaagagguccaaguuaucgcagucgagccugguaagaaccccaagaacguacagacagcccccgggaccuucaaaacaucugagggggaggucggcgcgaucgcucuggauuucaagccaggcacgagcggcucccccaucgugaaccgcgaggggaaaaucgugggccuguaugggaacggggucgugaccacuagcgguaccuauguguccgccaucgcccaagccaaagcuagccaggaaggcccccugccggaaauagaggacgaggucuuccggaaaaggaaccuuacaaucauggaccugcaucccggcucgggcaagacccggcgcuaccuuccagccaucgugcgggaggccaucaagcggaagcuaagaacccuaauccuggccccgacccgcgugguggcaagcgagauggcggaagcauugaaagguaugcccauccgcuaucaaacaaccgccgugaagucggaacacacggguaaggaaaucguggauuuaaugugccacgcaacuuucacuaugcggcuacuaagccccguccgggugccgaacuacaacaugaucaucauggaugaagcccauuucaccgacccguccuccaucgcggcccggggguacaucuccacccgcgugggcaugggagaggcugcagcaauuuucaugacagcgacuccaccugguagcgucgaggcuuucccccaauccaacgccgucauccaggacgaggagcgggacaucccggagagaucuuggaacuccggguacgaauggauuacagacuuucccgggaagacagugugguucguaccgagcaucaaaaguggaaacgauaucgccaacugccugcggaagaaugggaagcgugucauccagcucucgcggaagaccuuugacacggaguaccagaaaacaaagaauaaugacugggacuacgugguuaccaccgacaucuccgagaugggcgcgaauuuccgcgccgaccgggugaucgacccaagaagaugccucaaaccggugauacugaaagacggacccgagcggguuauccuugcuggcccgaugcccgugacagucgccagcgccgcgcagcgacgcgggcggaucggacgaaaccacaacaaggagggcgaucaguacaucuacaugggacagccucugaacaacgacgaggaccacgcccacuggacggaagccaagaugcugcuggauaacaucaacacccccgagggcaucauaccggcccucuucgagcccgaacgugagaagucggccgcgaucgacggggaauauagacuacguggcgaggcaaggaagacauucgucgagcugaugaggcgcggugaccucccgguguggcuauccuacaaggucgcuagcgaggguuuccaguacuccgaucgccguuggugcuucgacggugagaggaacaaccaagugcuggaggagaacauggacgucgaaaucuggacaaaggagggggagcgcaagaaacuccguccucgcuggcuggacgcccgcaccuacucggaccccuuggccuugcgggaguucaaggaguucgcggccggccgccgguccguuucaggggacuuaaucuuagagauaggcaaacuaccccagcaucugacccaacgcgcucaaaaugcccuggacaaccucgugaugcugcacaacucagaacaaggagggcgagcguaccgccacgccauggaagaacugccagauacuaucgaaacgcuuaugcugcucgcacuaaucgccgucuuaaccggcggugucacgcuguucuuccuauccggccgcggcuugggaaagaccagcauaggcuuacucugcgugauggccucaagcgugcugcuuuggauggcgucgguagagccgcacuggaucgccgccucgaucauccucgaguuuuuccugauggugcugcucauucccgaacccgaccgucagaggacuccgcaggacaaccagcuggccuacgugguuauugggcucuuauuuaugaucuuaacuguugcagcgaacgaaaugggcuuacucgagacaaccaagaaggaccuggggaucgggcacgucgccgucgagaaccaccaccacgcagccaugcucgacguggaccugcacccagcgagcgcguggacgcuguacgcuguggcgacgaccaucaucacacccaugaugcgucacacgauugagaacacgaccgcaaauaucucacugacagccaucgcgaaccaagcggcaauccuaauggggcuagacaaaggcuggccgaucucuaagauggacaucggugucccucugcucgcauugggcugcuacucccaggugaacccuuuaacacugacggcggccgugcuaaugcuggucgcccacuacgccaucaucggccccgggcuccaagccaaggcuacccgggaagcgcaaaagcgcaccgccgccggaaucaugaagaacccgacugucgacggaaucgucgcuauagaucucgaccccgugguauacgacgcgaaguucgaaaaacaacugggucagauaaugcuccugaucuugugcacgucucagauccuccugaugcgcaccaccugggcccugugcgaguccauuacccucgcgacgggcccgcugaccacccugugggaggggucgcccgguaaguucuggaacaccacgaucgccguguccauggccaacauuuuccgggggaguuaucucgcuggcgccggcuuagcguuuagccugaugaagucacuagggggcgggaggcguggcaccggggcccagggcgagaccuugggcgagaaguggaaacgccaguugaaucagcucagcaagucggaguucaacacuuacaaacggagugggaucauggaagucgaccgcuccgaggcgaaggagggccugaagcgcggggagaccaccaaccacgcuguuucgcgcggcaccgcaaaacuccggugguucguggagcgcaaccuaguaaagccggaggggaaggugauugaccugggcugcggcaggggcggguggucuuacuacugcgccggucugaagaaggugaccgaaguaaaaggguauacgaaaggagggccuggccacgaggagccgauuccaauggccacauacggguggaaccuggugaagcuccauucuggcaaggacguuuucuuuaucccucccgagaaaugcgacacacugcucugcgacauaggggaauccagccccaaccccaccauagaggagggccgcacucuccgggucuuaaagaugguggaaccguggcugcgcgggaaucaauuuuguaucaagauccucaauccguacaugccaucaguugucgagacccuggaacagaugcagcgcaagcauggcggaaugcugguccgcaacccccucucgcggaacucuacgcacgagauguacugggugagcugcgggacgggcaacauugucucugcggugaauaugaccucgcgcaugcuacugaaccgguucaccauggcccaucgcaagccgacauacgaacgcgacguggaccucggggccggcacccgacaugucgccguggagccugaaguugccaaucuagauaucauaggucagcgcaucgagaacaucaaacacgagcacaagagcacauggcacuaugacgaggacaauccuuacaagacgugggcuuaucaugggagcuaugaggucaagccgaguggcuccgccagcucgaugguuaauggugucgugaaacuccucaccaaaccgugggacgugaucccuauggucacgcagaucgccaugaccgacacgacucccuucggccagcagcgcguauucaaggaaaagguggacacucgcacccccaaagccaaacgggguacggcccagaucauggaggucaccgcaaagugguuaugggguuucuuaagcagaaauaagaagccgcggaucugcaccagagaggaguucacgaggaaagugcgcuccaacgccgccauuggugcgguuuucguugacgagaaccaguggaacucggcgaaggaggcaguggaggacgagcgcuucugggaucucguucacagggagcgugagcugcauaaacaggguaagugcgccacuuguguguauaacaugauggggaagcgcgagaagaagcugggggaguucgggaaagccaagggaucccgugccaucugguacauguggcuaggggcgcgcuuucuggaauuugaggcccugggcuucaugaaugaagaccacugguucagccgggagaacaguuuguccgguguggagggcgagggcuugcacaaguugggcuacauccugagagacaucuccaagauccccgggggcaauauguacgccgacgacaccgccggcugggauacucggaucaccgaggaugaccugcaaaaugaggccaaaaucacggacauaauggaacccgagcacgcuuuauuggccaagagcaucuucaaguugaccuaccagaacaaaguaguucgcguccagaggcccgccaaaaaugggaccgugauggacguaauaucccgccgagaccagagaggcagcggccagguaggcacguacggccugaauacguucacgaacauggaggcccagcuaauccgccaaauggaguccgagggaaucuuuagccccuccgaacuggagacccccaacuuggcucggcgcgugcucgacuggcuggagaaacacggggucgagcggcucaagcgcauggcgaucaguggcgaugacugcguggucaagccuaucgacgaucgguucgcgaccgcccucaccgcucucaacgacauggguaagguucgcaaagacauaccgcagugggaacccucuaagggguggaaugacuggcagcaagucccauuuugcagucaccacuuccaccaacugaucaugaaagacgggagggaaaucgugguacccugcaggaaucaggacgagcuugugggccgagcccgugugucucagggagcgggcuggucccugagagagaccgccugccugggaaagaguuacgcccagauguggcagcucauguacuuucaccgccgggacuuacgcuuagccgcgaacgccaucugcuccgcgguuccuguggacuggguucccaccagccggacgacgugguccauccacgcccaccaccaguggaugacgacggaggauaugcucagcgucuggaaccgcguguggaucgaggagaauccauggauggaggacaaaacccauaucuccagcuggggcgacgugcccuaucucgggaaacgggaagaccaguggugcgggucccucauuggcuuaaccgcgagggcgacaugggccacaaacauucaggucgccauaaaucagguccgccggcugaucgggaacgagaacuacuuagacuacaugaccucgaugaaaagauucaaaaacgaguccgacccggagggggccuugugguaa

SEQ ID NO: 24331 - RNA, 9879 nt, Artificial Sequence
  derived and/or modified CDS sequence (opt11) from DENV-1__FJ882553__SS-prME
ucaguuacgaugcuuuugaugcugaugcccaccgcacuggccuuucaccucacgacccgggguggggaaccucacaugaucgugagcaagcaagaaaggggcaagagccuacucuucaagaccagcgccgggguaaauauguguacccugauugccauggaccugggcgaacugugugaggacaccaugaccuacaagugcccccgcaucaccgaaaccgagccggacgacguggacugcugguguaaugccacugacaccugggugaccuacggaaccugcagccagacgggcgagcaccggcgcgacaagcgguccguggcccucgcgccccacgucggucuggggcuggagacccggaccgagaccuggaugagcuccgagggcgccuggaagcagauccagcgggucgagaccugggcguugagacaccccggguucacugugauagcccuguuucuggcccacgcgaucggcaccagcaucacccaaaaggggaucaucuucauccucuugaugcuggucacgcccucaauggccaugagaugcgucggcaucggcucgcgcgacuucguggaggggcucuccggcgcaaccuggguggacguuguguuagagcaugggagcugcgugaccaccauggccaaagacaagcccacccuggacauagagcucuuaaagaccgagguuaccaauccggccgugcugcgaaagcucugcaucgaggcgaagaucuccaacaccacgaccgacagccgcugcccgacccagggugaggcuacccugguugaggagcaagacgccaacuuugucugccggcgcacguucguggaccgcggauggggcaacggcugcgggcuguuuggcaaggggucacucauaacgugcgccaaguucaagugugugaccaagcucgaggguaaaaucgugcaguacgagaaccugaaguacagcguuaucgucacaguccacaccggcgaccagcaccagguugggaaugaguccacggagcacggcaccacagcgacaauaacgccucaagcgcccaccacagaaauccagcucacggacuacggggcccugacucuggacugcagcccccgcacaggccucgacuucaacgagaugguccuucugaccaugaaggagaaguccuggcucgugcauaagcagugguuccuggacuugccccuccccuggaccagcggggccagcacgucccaagagaccuggaaccgucaggaccuguuagugacguucaagaccgcccaugccaagaagcaggagguggucgugcucgggagccaggagggcgcuaugcacacagcacugaccggggccaccgagauacagaccucaggcacgaccaccaucuuugcggggcaucugaagugccgccucaagauggacaagcugacucugaaggggaugucauacgugaugugcacgggguccuucaagcucgagaaggagguggccgagacccagcauggcaccguacugguccagaucaaguacgaaggcaccgaugcccccugcaagauccccuucagcacgcaggacgagaagggaguuacacagaacggcagauuaaucacugccaacccgaucguuacagauaaggaaaagcccguaaauaucgaagccgagccacccuucggugaguccuacaucgugaucggcgccggcgaaaaggcccugaaacucagcugguuccgcaaaggguccuccaucggcaaaauguucgaggccacggcgcgcggcgcccgccgcauggccauccugggggacaccgcgugggacuuuggcuccauagguggcguguucacuagcgucgggaagcuggugcaccagaucuucggcaccgccuacgggguguuguucuccggggugagcuggaccaugaagaucgggauuggagugcugcucaccuggcucgguuuaaacucacggagcaccucccuuagcaugaccugcaucgccguggggcucgucacgcuguaccugggcgugaugguacaggccgacuccgggugugucaucaacuggaagggccgagagcucaagugcgggagcgguaucuucgugacuaacgaggugcacaccuggacagaacaguacaaguuccaggcugacuccccgaaacggcugucagcggccaucggcaaggccugggaggaggggguaugcggaauuagaagcgccacccggcuggagaacaucauguggaaacagaucuccaacgagcucaaccacauacugcuugagaacgacaugaaguucacgguggugguaggggacguggcagguauccucgcgcaggguaagaagaugauacgcccccagcccauggaguauaaauacagcuggaagucguggggcaaggccaaaauaaucggcgcggacgugcagaacaccacuuucaucaucgacggacccaacaccccugagugucccgaugaccagcgggccuggaacaucugggaggucgaggacuacggcuucgggaucuuuacgaccaauaucuggcugaaacuacgugacucuuacacccaagugugcgaucaccggcucauguccgcggccaucaaggacagcaaggcagugcacgccgacaugggcuacuggaucgagagugagaagaaugagaccuggaagcuggcccgcgccagcuucauugaggugaagacuugcaucuggccgaagucacacacuuugugguccaacggcguucuagaguccgagaugaucaucccgaagaucuacggcggcccgaucucucagcauaauuaccggcccggguacuucacccagaccgccggccccuggcaccuggggaagcuggaacuugacuucgaccugugcgagggcacgaccguggucguugacgagcauugcggcaacagaggcccgagccugcguacaacgacgguaaccggaaagauuauucacgaauggugcugucgcucaugcacccuaccgccccuccgguuccguggugaagacggcugcugguacgggauggagaucaggcccguuaaggagaaggaggaaaaccucgugaagucaauggugagcgccggcagcggcgaggucgauuccuucagccucggacugcugugcauauccaucaugaucgaagaggugaugagaucucgcuggucccgcaagaugcucaugacaggcacgcuggccguauucuuucugcucaucauggggcagcugaccuggaacgaccucauucggcucugcaucauggucggcgccaacgcuagcgaccggaugggcaugggcaccaccuaccuggccuuaauggccacguucaagaugcgcccgauguuugccgucggccuccuguuccgccgguugacuucccgggagguguugcugcugaccaucggauuaagccuagucgcuucaguagagcugccuaacagccucgaggaacugggcgacgggcuggcgauggggaucaugauacucaagcuacugacggacuuccagucccaccagcugugggcuacgcuucugagccucacauucaucaagacgacuuucucccuccauuaugccuggaagacaauggccaugguccucagcaucgugucccuauucccccugugccugaguaccacaucucagaaaaccacguggcuacccgugcugcugggcagcuuggggugcaagccgcugaccauguuccugauugcagagaacaagaucuggggccgccgguccuggccccucaacgaggggaucauggccgucggcauagugagcauccuguuguccagccuccuaaagaacgacgugccccuggccgggccgcucaucgccggcggcaugcugaucgcuuguuacgucauaaguggauccucagcggaccugucccucgagaaagcagcagaggugagcugggaggaagaggcagagcacaguggcgccagccacaacauacugguggagguccaggacgacgggaccaugaaaaucaaggaugaggagcgcgacgacacccugaccauccuucucaaggccacgcugcucgccguguccggcguguacccgcugagcauucccgcgacccuguucgucugguacuucuggcagaagaagaaacagcgguccggggugcucugggacaccccgucgccgcccgagguagagcgcgccguauuggacgacggcaucuaccggaucaugcagaggggacugcuggggcgcucccaggugggcgugggcgucuuccaggagaauguauuccacaccauguggcacguaacgcgcggggccguccucauguaccaaggcaaacggcuggaacccucuugggcguccgugaagaaggaccugaucaguuacggcggcggguggcgccuccagggcuccuggaacaccggcgaggaggugcaggucaucgccguggagcccggaaagaacccaaagaauguucaaacugcgcccgggaccuucaagacacccgagggagaggucggggcgaucgcuuuggacuucaagcccggaacuagcggcucccccaucgugaacagggagggaaagaucgugggucuguacggaaacgggguaguuaccaccagcggcacauacgucagugcgaucgcccaggccaaggccucacaggaggggccgcuccccgagaucgaggacgaggucuuccggaagcggaaucugacuauaauggaccuccaccccggaagugggaagacccgacgguaccuccccgcgauagugcgcgaggccaucaagcgcaagcugcggacacuuauccucgccccuacgagaguggucgcuuccgagauggccgaggcgcugaaggguaugcccauccgguaccagacgaccgccgucaagagcgagcacaccggcaaggagauaguggaucugaugugccaugccacguucacuaugcgccuccugucccccguccgggugccgaacuacaacaugaucaucauggacgaggcccacuucaccgacccaagcucaauagccgcgcgcgguuacaucagcacccgggugggcaugggagaggccgccgccaucuuuaugaccgccacgccgccuggcuccguggaggcguucccgcagagcaacgcugugauccaggacgaagaacgcgacaucccugaacggaguuggaacucuggguaugaguggaucaccgacuucccgggcaagaccguaugguucguccccuccauaaagaguggcaacgacauugccaauugccugcgcaagaaugggaagcgggugauccagcucucccgcaagacguucgauaccgaguaccagaagacaaagaacaacgauugggacuacguggucaccacggacauuucugagaugggcgcuaacuucagggcggaccgcgugaucgauccgaggcggugccugaaaccuguaauccuuaaggacgggcccgagcgggucauccucgcuggccccaugccagugaccgucgccuccgcagcccagcgccgggggcggauaggccgcaaccauaauaaagagggcgaccaguacaucuacaugggucagccccucaacaacgacgaagaccacgcgcacuggaccgaagcuaagaugcugcucgacaacaucaacacucccgagggcaucaucccagccuuauucgagccggagcgggagaagucagcugccaucgacggggaauaccgcuugcggggagaggcgcgcaaaacguucguggagcucaugcgucgcggggaccugcccguguggcugaguuacaaagucgccuccgagggcuuccaguacagugaucggcguuggugcuuugacggggaacggaacaaccaagugcucgaggagaacauggacguggaaaucuggaccaaagagggagagcgcaagaaacugcguccgcguuggcuagacgcucggaccuacuccgacccccucgcccuccgggaguucaaggaguuugcggcgggaagacgcuccgucuccggagaccugauauuagagauuggaaagcugccgcagcacuuaacccagcgggcccaaaaugcccucgacaauuuagugaugcugcacaacuccgagcagggcgggcgcgcuuaccggcacgcgauggaggagcuccccgacacgaucgagacacugauguuacucgcccugauagccguguugacaggcgggguuacccucuucuuccuguccggccgcgggcugggcaaaaccucuauuggccuacugugcgugauggcuuccucggugcuacucuggauggccuccguugagccgcauuggaucgcggccucgaucauucucgaguucuuucugauggugcucuugaucccagagccggaccggcagcggacaccccaggacaaccaauuggccuauguugugaucggguuacuguucaugauccucaccguagcggccaacgagaugggacuccuggagaccaccaagaaggaccuggggauuggccacguggcgguagagaaccaccaccacgcugccaugcuggacguggaccugcacccugccuccgccuggacccuuuacgcgguggccacgaccauuauuaccccgaugaugcgccacaccauugagaacaccaccgcaaacaucucccucacggcaaucgccaaccaggcggccauccugauggggcuggacaaggguuggcccauauccaagauggacaucggcgucccccuucuggcccuggggugcuacagccagguaaaccccuugacccugacggcggcgguguugaugcucguggcccauuaugcaaucaucggcccgggccugcaggccaaagccacccgggaggcgcaaaaacgcaccgccgccggcaucaugaagaaccccacuguggacgggaucguggccaucgaccuggacccaguaguguacgacgccaaguucgagaagcaguuaggacagaucaugcugcugauucucugcacaucccagauuuuguugaugagaaccaccugggcgcucugcgaaagcaucacgcuggccacaggcccacugacuacgcucugggagggguccccgggcaaguucuggaacacgaccaucgcagugagcauggccaacauuuuccggggcuccuaccucgcgggcgcgggcuuggccuucucacucaugaagucccuagggggagggcggcgcgggaccggggcgcaaggugagacccugggggagaaauggaaaagacaacuuaaucagcuguccaagagcgaguucaauacguauaagcgcucagggaucauggaggucgaccggucagaggcaaaggaggggcugaagcgcggggagacaaccaagcacgcgguaucccgaggcaccgcaaaauuacgcugguuuguggagaggaaucugguaaagcccgaggggaaagugaucgaccugggcugcggccgcgggggcuggagcuauuacugcgccgggcugaagaaggugaccgaggucaaaggguacacuaaaggagggccuggacacgaggagccaauuccgauggccaccuacggguggaaucucgucaagcugcacuccggcaaagacguguucuuuauuccgcccgagaaaugcgacacacugcucugcgacaucggagagagcucccccaacccaacaaucgaggagggccggacgcugcgcguccugaagauggucgagcccuggcuccgggggaaccaguucugcauuaaaauccugaaccccuacaugcccagcguggucgaaacccuggagcagaugcagcgcaagcauggcggcaugcucgugcggaauccgcugucgcgcaacaguacccacgaaauguacugggugucuugcgggaccggaaauaucguuucugccguuaacaugaccucgcgcaugcuccucaaccgguucaccauggcgcaccgcaagcccacauacgagcgggacguggaccugggggccggcacccgccaugucgccguagagccagaaguggccaaccuggacaucaucggccagcggaucgaaaauauuaaacaugagcacaagaguacguggcacuacgacgaggacaaccccuacaagacgugggccuaccacggcuccuacgaaguaaagccgagcggauccgcgagcagcauggugaacgggguugugaaacuccugaccaaacccugggacguuaucccgaugguuacccagaucgcgaugacggacaccaccccguucggacaacagcgcguguucaaggagaaaguggacacccggacgccgaaggccaagcgcgggacggcacagaucauggagguuaccgccaaguggcuguggggcuuccucucccggaacaagaagccgcggauauguacucgugaggaguucacgcgaaagguucggagcaacgcggccaucggcgcgguguucguggacgagaaucaguggaacuccgccaaagaggcaguggaggacgagcgcuuuugggaccugguucaccgggagagggagcuucacaagcaggggaaaugcgcgacuugcgucuacaacaugaugggcaagcgggagaaaaagcucggcgaguucggcaaggcgaaagggagccgcgccaucugguacaugugguuaggcgcccguuuccuggaguucgaggcgcucggcuuuaugaacgaagaucacugguucucccgagaaaauucgcuguccgggguggaaggcgaggggcugcauaagcucggcuacauccugcgggacauuucaaaaauacccgggggcaacauguacgccgacgacacagcaggcugggacacccguaucacggaggacgaccugcagaacgaggcccgcaucaccgacauaauggagccugagcacgcacucuuggcuaaguccaucuucaagcugacuuaucagaauaaggugguccgugugcagcgccccgccaagaacgggaccgugauggacgucaucagccggcgcgaccaacggggcuccggacagguggguacguacggccucaacaccuucaccaacauggaggcccagcugauucgccagauggaguccgaggggaucuuuucuccuucagagcuggagacccccaaccucgcugagcgggugcuugacuggcuggagaaguauggcgucgagcgccucaagcggauggcaaucuccggggacgacugcguggugaagccaauugacgaccgcuucgcgacggcgcugaccgcccugaacgacaugggaaagguuagaaaggacaucccccagugggagcccucaaaaggguggaaugacuggcagcaggucccguucugcucccaccauuuccaccaguugauuaugaaggacggccgcgagaucguggugccguguagaaaccaggaugaacuggucggccgcgcccgggugagccagggggccggcuggucguugagagaaaccgcaugccucgggaaguccuacgcccagauguggcagcugauguauuuccaucggcgcgaucugcggcucgcagccaacgcgauuuguagcgccguccccguggauuggaucccaaccucccgcacgacguggaguauccacgcccaccaucaauggaugacuaccgaagacauguuauccguguggaaccgagucuggaucgaagagaaccccuggauggaggacaagacccacaucagcuccuggggagacgugccguaccuggggaagcgggaggaccaguggugcgguagccucaucggcuuaacggcucgcgccacaugggcuaccaacauccaaguggccauuaaccaggucaggcgcuugaucgggaacgaaaacuaccucgauuacaugacgaguaugaagagguucaagaacgagagcgagcccgagggcgcccugugguga

SEQ ID NO: 24332 - RNA, 9879 nt, Artificial Sequence
  derived and/or modified CDS sequence (opt11) from DENV-1__FJ882554__SS-prME
ucagugaccaugcuauugauguuaaugcccaccgcccucgccuuccaccucaccacccggggcggggagccccacaugaucguuuccaaacaggagcggggcaagagcuugcuauucaaaaccagugccggggugaauaugugcaccuuaaucgccauggaucugggggagcugugcgaggacacgaugaccuacaaauguccacgaaucaccgaaaccgagcccgacgacguggacugcuggugcaacgcaaccgacaccugggugacuuacgggaccugcagccaaacgggggagcaccgacgcgacaagcggaguguugcccuagccccgcacgucggccuggggcuagagacucgcaccgagaccuggaugucuagcgagggagcguggaagcagauacagcgagucgaaacuugggcccuccgccacccuggguucaccguaauagcacuguuccuggcucacgcgaucgggacgagcaucacccagaaggggauaaucuucaucuuauuaaugcuggucacgcccucaauggcaaugcggugcgugggcaucgguucccgggacuucguggaagggcucuccggcgcgaccuggguggacguugugcuggagcaugggucuugugugaccaccauggcuaaggacaagcccacgcuagacaucgaacugcuuaagaccgaggucaccaacccggcugugcugcggaagcucuguauugaggccaagaucucgaacacuacgacggacucgcgcugcccgacccagggcgaggccacccugguggaggagcaggacgcuaacuucgugugucggcgcacguucguggaucggggcuggggaaacgguugcggccuguucggaaaaggguccuugauaacgugugccaaauucaagugcgugaccaaacuugaagggaagauaguacaguaugaaaaucuaaaguacagcgugaucgugaccguacacacuggagaccagcaucagguggggaacgagagcacagagcacggcaccacagccaccauaacgccacaggcaccgaccacugagauccagcugaccgauuauggggcucucacauuggacugcagcccccgcaccggccuagacuuuaacgaaaugguccuuuuaaccaugaaggaaaagucuuggcuagugcacaagcagugguuccucgaccugccccuccccuggacgagcggggccucaacuucccaggagaccuggaaccgucaggaccugcuggugacuuucaagaccgcccacgcaaagaagcaggaagucguugugcucgguucgcaagagggcgcgaugcacacggcacugaccggggcuacggagauacagaccuccggcacuacgaccaucuucgcggggcaccugaagugccgccucaagauggacaagcugacccugaagggcaugaguuacguuauguguacgggaucuuucaagcucgaaaaggagguagccgagacccagcacggaacaguacugguccagaucaaguaugagggcaccgacgcucccugcaagauccccuuucucacgcaggacgagaaaggagugacccagaacggccgguugaucaccgccaacccgaucgugaccgacaaggaaaagccagucaacauugaggcagaaccuccauucggagagagcuauaucgugaucggggccggagagaaggcucugaagcuguccugguucaaaaaggggagcucaauuggcaagauguucgaagccacggcccgcggggcccgucguauggccauccugggcgauaccgccugggacuucgggagcauuggcggcguguuuaccuccgucgggaaauuggugcaccagaucuuuggaacagcuuacggaguacuguucucuggagucuccuggacuaugaaaaucgggaucggcguccuuuuaaccuggcugggccugaacagccgcuccaccagccucuccaugaccugcaucgcuguaggccuggucacguuauaccuaggcgugauggugcaggccgacagcgggugugucaucaacuggaagggccgggagcuaaaaugcggguccggcauuuuuguuaccaacgagguacacaccuggaccgagcaguacaaguuccaggccgauaguccgaagcgucugagugcugcgauaggcaaggccugggaggagggagucuguggcauucggucagccacgcgcuuagaaaacauuauguggaagcagaucucuaaugagcugaaucacauccugcucgagaacgauaugaaguucacuguaguagucggggacguagccggcaucuuagcgcaagggaaaaagaugauccggccacaaccaauggaguauaaguacuccuggaaaaguugggguaaagcuaaaaucauaggcgccgaugugcagaacacaaccuuuaucauugacggucccaacaccccggaaugccccgacgaccagcgagccuggaacauuugggaagucgaagacuacggcuucggcauuuuuacaaccaacauuuggcugaagcuacgggacucauacacgcagguaugcgaccaccgccugaugagcgcagccaucaaggacuccaaggccgugcaugccgacaugggcuauuggauugagagcgagaagaacgagacguggaagcuggcacgggcuucauucaucgaagucaagacaugcaucuggcccaagagccacacccucuggaguaacggggugcuugagagugagaugaucaucccuaaaauauacgggggcccaaucucucaacacaacuacaggccuggauauuucacccaagcagccggucccuggcaccuagggaaacuugagcuagacuucgaccuuugcgaaggaacuaccgugguagucgacgaacacugcggcaaccggggacccagccuacgcacaacaaccguuacuggaaagauuauacacgaguggugcugccguuccuguacccugccuccccugcgcuuccgaggugaggauggcugcugguacgguauggaaauacgacccgucaaagaaaaggaggagaaccucgucaaaagcauggugucugccggcaguggcgaagucgauaguuucucccucggccugcuaugcaucagcauaaugauugaggaagugaugcggucacgguggagccggcgcaugcugaugacuggcaccuuagcuguguucuuucuccugaucauggggcagcugacuuggaacgaucucauacggcuguguauaauggucggggcuaacgccuccgacaggauggggauggggacaacguauuuagcccucauggccaccuucaagaugcgcccuauguuugccgugggguugcuauuccggcgcuugacgagccgggaaguucuguuacucaccaucgggcugucccuaguagcgagcguggaacuucccaacucccuagaggaguugggcgacggguuagccaugggaaucaugauccugaagcugcucaccgacuuucagagccaccagcugugggccacucugcucucccugacauucaucaaaaccacuuuuagccugcacuaugcauggaagacaauggccauggugcucucuaucguuagccuguucccacugugucucuccacgacuagccagaaaaccacuuggcugccagugcugcucggcucccuggguugcaagccauuaacgauguuccucaucgcagaaaauaagaucuggggccgccggucauggccccugaaugaggguaucauggccgucggcaucguguccauucugcucucgagcuuauugaagaacgacgugccucucgcggguccccucaucgccggcggcaugcucaucgcgugcuacgucaucagcgggaguucggccgaucucucccuggagaaggccgcugagguguccugggaggaggaggccgagcacagcggagccagccacaacauucugguggagguccaggacgacgggaccaugaagaucaaagacgaggagcgcgacgacacccucaccauccuguuaaaagcuacccugcucgcugugagcgguguguacccacuguccaucccugccacucuguucguuugguacuucuggcaaaagaagaagcagaggaguggggugcuuugggauacgccaagcccgcccgaaguggagcgcgccguucuggacgacggcaucuacaggaucaugcagcgcggccugcucggccgaucgcaaguuggagugggagucuuccaagagaacguuuuucacacaauguggcauguaacgcgcggcgcgguccugauguaucaggggaagcgguuagagcccuccugggccagcgugaagaaagaccucaucucauacggcggcggguggaggcugcaaggcagcuggaacacaggggaagagguacaagucaucgccguggagcccggaaagaaccccaagaauguacaaaccgcaccggggaccuucaagaccccggaaggcgaggucggugccaucgcgcuggacuucaaacccgggacgucgggcagccccaucgugaaucgggaggggaaaaucgucggccucuacggaaacgguguggugacgaccuccgggaccuacguguccgccaucgcccaagccaaagccagccaagaagggccgcugcccgagaucgaggacgaggucuuucgcaagcggaaccugacgaucauggaccuccaccccggcuccgggaagaccaggcgguacuuaccggccauuguccgcgaagcuaucaagcguaagcugcggacucucauccucgccccuacgcggguggucgccagcgagauggcggaggcucugaagggcaugccuauccgguaccagacgaccgcaguaaaaucggagcauacggggaaggagaucgucgaccucaugugccaugcgacauucaccaugcgccuccucagccccguccgagucccgaacuauaacaugaucaucauggacgaggcgcacuuuacugauccguauagcaucgcagcuagaggguacaucagcacgcggguagggaugggggaggccgccgccauauucaugacagcgacgccacccggcagugucgaggcuuucccgcagagcaacgccguaauaaaggacgaagagagggauauccccgagcgcucuuggaacagcggguacgaguggaucaccgauuucccgggcaagaccgucugguuuguccccuccaucaaaagcggcaaugacaucgccaauugccuccgcaaaaacgggaagcguguaauccagcucuccagaaagaccuucgacacggaguaccagaagaccaagaacaacgacugggauuauguggucaccaccgacaucagcgagaugggcgcuaacuuccgggcggauaggguaaucgauccccggagaugucugaaacccgugauucucaaggacgggcccgagcgggucauccuggccgggcccaugccggugacagucgcguccgccgcgcagcgacggggucgaaucggccgcaaccacaacaaggaaggcgaccaguacaucuacauggggcaaccccugaauaacgaugaggaccaugcgcacuggaccgaagcaaagaugcuucuggauaacauaaauacccccgaggguauaaucccggccuuauucgaaccggagcgggagaaauccgccgcgauagacggcgaauaccggcuacggggcgaggcucgcaagaccuucguugagcugaugcgaagaggggaccugccaguguggcucuccuacaagguugcaagugagggguuucaguacucugaccggcgcugguguuucgacggcgagcggaacaaccaggugcuagaggaaaauauggacguggagaucuggacgaaggagggagaacgcaagaaacuucggccucgcuggcuagacgcacggaccuacagugacccccuggccuuacgcgaguucaaggaguucgcugccgggcggcgcagcgucuccggggauuugauccuggagaucggcaagcugccgcagcaucucacccagcgggcacagaaugccuuagacaauuuggugaugcuccacaacuccgagcagggcgggcgggccuaccggcaugccauggaggagcugccagacacuauugagacacugaugcuacuggcacuuaucgccguccuaaccggcggaguuacccuguucuuuuuguccgggcgggggcucggcaagaccagcaucggccuacugugcguuauggccucgucaguccuguuguggauggcguccguugagccccacuggaucgccgccaguauaauccuggaguucuuucucaugguacugcugaucccagagccugaccgccagcguacgccccaggauaaccaguuggccuacgugguuaucggguugcuuuucaugauccucacuguagccgcgaacgagaugggccuuuuagagaccaccaagaaggaccucgggauaggccacguggccguugagaaccaucaccacgccgcuaugcuggacguagaccugcaccccgccucggcauggaccuuauaugccguugccacgaccaucaucaccccgaugaugcgccacacaaucgagaacacgaccgccaauauuagucugaccgccaucgcgaaccaggccgccauccugaugggucucgauaaaggcuggcccaucuccaagauggauaucggcgugccccugcuagcccucggcuguuacucacaggugaauccccugacccugacagccgccguguugaugcuagucgcccacuacgccauaaucggcccggggcugcaggccaaggccacucgggaggcacagaagcgaacugccgcugggaucaugaaaaaccccacgguggaugguaucguggcgauugaccucgaccccgucguuuacgacgcaaaguucgagaagcagcuaggccagaucaugcugcucauucugugcacgucccagauccugcucaugcggaccacuugggcucuaugcgagagcaucacacuggccacgggccccuugaccacucugugggagggguccccuggcaaguucuggaacacuaccaucgcaguuagcauggccaacaucuuccgcgguagcuaccuggccggugcaggucucgccuucuccuuaaugaaaucacucgggggcggucgacgcggaaccggggcccagggggaaacacucggggagaaguggaagcgccaacucaaccaguugagcaaaagcgaguucaauaccuacaagcgcagcggaaucauggagguagaucggagcgaagcaaaggagggauuaaagagaggggaaacgacgaagcaugccgucaguagaggcaccgcgaagcugcgcugguucguugagcggaacuuggucaagcccgaggggaagguaaucgauuuaggcuguggcagagguggcuggucguacuacugcgccgggcucaagaaagugaccgaggucaagggguacacgaaagggggaccaggccacgaggaacccaucccgauggcuaccuauggguggaaccuugugaagcuccauuccggcaaggacguguucuucauuccgcccgagaagugcgauacauugcugugcgacauaggggaguccucccccaacccaacaaucgaggagggaagaacacugcgcguccucaagaugguggagccauggcugcgggggaaccaguuuugcaucaaaauccugaaucccuacaugccaucggugguugagacacucgagcagaugcagaggaagcaugguggaauguuggugcggaacccccuguccaggaacucaacucacgagauguauugggugagcugcgggaccggcaacauugucagcgcggugaacaugacaagucgcaugcuccucaaccgauucaccauggcccaccggaagcccaccuacgagcgggauguggaccugggagcgggcacccgccacgucgccguggagcccgagguggccaaucucgauauuaucggacagcggaucgagaacaucaagcacgagcacaagagcaccuggcacuacgaugaagacaacccauacaagacaugggcauaccacggguccuacgagguaaaaccgagcggcuccgcaagcaguaugguuaacggggucgugaaacuguuaacuaaacccugggauguuaucccuauggucacccagaucgcaaugaccgacacgacgccuuucggacagcagcgcguguucaaagagaagguggacacccggaccccaaaggccaagagggggacugcccagauaauggaggucaccgcgaaguggcucuggggguuuuuaucacguaacaagaagccgcguaucugcacccgggaagaauuuacuagaaaagugcggucaaaugccgccaucggagccgucuucgucgacgagaaccaguggaacuccgcgaaagaggccguggaggacgaaagguucugggaccucguacaccgggagcgcgaguugcacaagcaggggaagugcgcuacgugcgucuacaauaugaugggaaagcgggagaagaaacugggagaguucggcaaagcuaaggggagccgcgcuaucugguacauguggcuuggcgcgagguucuuagaguucgaggccuugggauucaugaaugaagaccauugguucucucgcgagaauagccuauccggggucgaaggcgaggggcuccacaagcugggauacauacugcgggacauaaguaagauccccggggguaacauguacgccgacgacaccgccggaugggacacacgcaucaccgaagacgaccuccagaacgaggcgcgcauaacugacaucauggagccagaacaugcgcugcuggccaaguccaucuucaaacucacuuaccagaacaaggucguccggguacaacguccugcaaagaacggcacagugauggauguuaucagccgaagggaccagcguggcuccggccagguggggaccuauggccugaacacguucaccaacauggaggcccaacugauccgucagauggagucugagggcaucuucuccccaagcgaacucgagaccccgaaccuggccgaacgcgugcucgauuggcucgagaaauacggggucgagcgccugaagcgaauggcgaucucuggggacgacuguguuguaaagccaaucgaugauagguucgccaccgccuugacggcacugaacgauaugggcaaggucagaaaggacaucccgcaaugggaaccauccaagggauggaaugacuggcaacagguuccauucuguucacaccacuuccaccaguugaucaugaaggacggccgugagaucguggucccgugccggaaccaagaugagcucgugggcagagcucggguaagucaaggugcggguuggucgcucagggagaccgcgugccuggguaagagcuaugcucagauguggcagcucauguacuuccaccggcgcgaccuccgacuggcugcgaacgcaaucugcuccgccguccccgucgacuggauccccacgagccgaaccacuuggagcauccacgcccaucaucaguggaugaccaccgaagauaugcuguccguguggaaccgcguuuggaucgaggagaaccccuggauggaagacaagacccacauuagcuccuggggcgacgugcccuaccucggcaagagagaggaccaguggugcgggagccugaucggccugacugcucgcgcaaccugggccaccaacauccagguggccauuaaucaggucaggcgccucauuggaaacgaaaacuauuuggacuacaugaccaguaugaagcgguucaagaaugaaagcgaccccgagggcgcccugugguga

SEQ ID NO: 24333 - RNA, 9879 nt, Artificial Sequence
  derived and/or modified CDS sequence (opt11) from DENV-1__GQ868610__SS-prME
ucggucaccaugcugcucauguuaaugccuacagcccuggccuuccaccucacaacccgggguggggagccccacaugauuguuaccaagcaggagcggggcaagagcuuacuguucaagacaagcgcgggugugaacauguguacucucaucgccauggaucugggcgaguugugcgaggauacgaugaccuacaaguguccccggaucacugaagccgagcccgacgauguggacugcugguguaacgccacggacacaugggugacuuacggcaccugcagccagacgggcgaacaccggagggacaagcggagcguggccuuggcgccccacgugggcuuggggcuggagacccgcacagagacauggaugucgagcgagggugccuggaagcagauucagcgggucgagacgugggcccuacgccacccaggcuucaccgugaucgcgcucuuccuagcgcaugcgaucgguaccuccaucacccagaaggggaucauuuucauacuucugaugcuggucacgcccucuauggccaugcggugcguuggcaucggcucccgcgacuucguggaaggacucagcggcgcgaccuggguggacgucguccuagagcacggauccugcgugaccaccauggccaaggacaagcccacgcuggacaucgaguugcugaagaccgagguuaccaaucccgcgguacugcgcaaacucuguaucgaggccaagaucucuaacaccacgaccgacucccgcugccccacccaaggcgaggccacccugauggaggagcaggacgccaacuucgugugccggcgcaccuucguggaccguggcugggggaacggcugcgggcuguucggcaaggggagccuuaucacgugcgccaaguucaagugcguaacgaagcuggagggcaagaucgugcaguacgaaaaccugaaauacuccgucaucguuaccguacacacgggugaccagcaccaggucgggaacgagagcaccgagcacggcaccaccgcgaccaucacgccccaggcccccaccagcgagauccagcucaccgacuacggggcccugacccuggacugcagcccccgcacgggccucgacuuuaacgagauggugcugcugaccaugaaggagaaguccugguuaguccacaagcaaugguuccuggaccugccgcucccguggaccagcggagcaagcaccagccaggagacuuggaaccggcaggaccugcuugugacuuuuaaaaccgcacacgcgaagaagcaggaggugguggugcucgggucacaggaaggcgccaugcacaccgccuuaacgggggccaccgagauucagaccuccgggacgacgaccauuuuugccggucaccugaagugccgccucaagauggacaaacugacccugaagggcaugagcuacguaauguguaccggguccuucaaguuggagaaggagguugcggagacgcagcacggcaccgugcuagugcagaucaaguacgaaggcaccgacgccccuugcaagauccccuucagcacccaggacgagaaaggggugacgcagaacggccggcugauuaccgcuaacccgaucgugaccgacaaggagaagcccgugaacaucgaggcggagccgcccuucggugaguccuacaucgugaucggcgcgggcgagaaggcccugaagcucaguugguucaaaaagggcagcagcaucggcaaaauguucgaggccaccgcccgcggggcccggcgcauggcgauucugggcgacacggccugggacuucggauccaucggaggcguguucaccagcguggggaagcucguccaccaaaucuucggcaccgccuacggggugcuguucuccggcguuucuuggaccaugaagaucgggaucggcguccugcugacguggcucggccugaauuccagaagcacaucccugagcaugaccugcaucgccgugggccucaucaccuuauaccugggcgugaugguccaggccgacuccgguugcgugaucaacuggaagggccgggagcucaagugcgggagcggcaucuucguaacgaacgaaguccacaccuggaccgaacaguacaaguuccaggcggacucgccgaaacgccugucagccgcaauuggcaaggccugggaggaagggguaugcggcauccggagcgccacacgccuggagaacaucauguggaagcagaucuccaacgagcucaaccacauccuacuggagaacgacaugaaguuuaccguggucgugggggacgucgucggcauccucgcccagggcaagaagaugauccggccccagcccauggagcacaaguacucguggaaguccuggggaaaggccaaaaucaucggcgccgacgugcaaaacacgaccuucaucaucgacggccccaacaccccggagugccccgacgaccagagggccuggaacauaugggaaguggaagacuacggcuucggaauuuucaccacgaacaucuggcugaagcugcgggacucuuacacccaggucugcgaucaucgccucauguccgcggccaucaaggacagcaaggcugugcacgccgacaugggcuacuggaucgaguccgaaaagaacgagaccuggaaauuagcccgcgcgagcuucaucgaggugaagaccuguauuuggccaaaaucucauacgcuguggagcaacggcgugcucgaauccgagaugaucaucccuaagaucuacgggggcccgaucagccagcauaacuaccgccccggguacuucacccaaaccgccggccccuggcaccuggggaaguuggagcucgauuucgaccuuugcgagggcacaacggugguggucgacgagcacugcggcaaccggggcccaucccugcgcaccaccaccgugacaggcaaaaucauacaugaguggugcugucggagcugcacucugccaccccuccgcuucaagggagaggacggcugcugguaugggauggagauccggcccgugaaggagaaggaggagaaucuggucaaguccauggugagcgccggcagcggcgaagucgauuccuucagccuugggcuguuaugcauuuccauuaugaucgaggaggucaugcgcagccgguggucacgcaagaugcucaugaccgggacacuggcugucuuccugcuccugaucauggggcagcugacguggaacgaccucauccggcucugcaucaugguuggcgccaacgccagcgaccgcauggguaugggcaccaccuaucuggcacucaucgccaccuucaagaugcgcccgauguucgccgucggguugcuguuucggcgacucacgucccgggaaguguugcuccucaccaucggcuuaagucugguggcauccguagagcucccgaacagccuggaggagcugggcgacgggcucgcgaugggcaucaugaucuugaagcugcucaccgacuuccagucccaccagcugugggccacccuccugagcuucacauucauaaagaccacucugucccuucacuacgccuggaagacgauggcgaugguguuaagcaucgugucacuguucccccugugccucagcacaacuucccagaaaacuaccuggcugccgguacugcucggcagcuuagggugcaagccgcucacgauguuccucauagcggagaacaagauauggggccgcaaguccuggccccucaacgaagggauaauggccgugggcguugugagcauacugcucagcucccugcugaagaacgaugugccccucgccgggcccuugaucgcugggggcauguugaucgccuguuacgucaucagcgggucgagcgcggaucucucccuggagaaagccgcggaggugagcugggaggaggaggccgagcacuccggcgccagucacaauauccugguggaagugcaggacgacggcacgaugaaaaucaaagacgaggagcgugacgacacccucaccaucuuacugaaggcgacccuacuagcuguuuccgguguguauccgcucucgauccccgccacccucuucgucugguacuuuuggcagaagaaaaagcagcgcagcggggugcugugggacacgcccagcccgcccgagguggagcgugccguccuggaugauggcaucuaccgcaucaugcagcggggccugcuugggcgcucccaggucggcgugggugucuuccaggagaacguguuccacaccauguggcacgugacccggggggccguccugauguaccaggggaagcgccuggagccuagcugggcguccgugaagaaagaccugaucagcuacggcggcggguggcgucugcaggggucguggaacacgggggaagaggugcaggucaucgccguggagcccggcaagaaccccaagaacgugcagacggcccccgggaccuucaagacccccgagggggaggucggcgccaucgcccuggacuucaagcccgggacgucgggcucccccaucgugaaccgcgaagggaagaucgugggccucuacgggaacgggguugugaccaccagcgguacauacgugagcgcgauagcccaggccaaggccucccaggaggggccucugccugagauugaggacgaggucuuccgcaagcgcaaucugaccauuauggaccuccaccccggcagcgggaagacgcggcgcuacuugccagcgaucgugcgggaggcgaucaagcgaaagcugcggacacucauccuagcccccacccgcguagucgcauccgagauggcagaggcgcugaagggcaugcccauccgcuaccagacgaccgccgucaagagcgagcauaccggcaaggagaucguggaccucaugugccaugccaccuucacgaugcggcugcucagucccguccgggugccgaacuacaauaugauuauuauggacgaggcccauuucacugaccccagcuccaucgccgcgcgcggauauauuagcacccgcgugggcaugggggaggccgccgccaucuucaugaccgccaccccgcccgguagugucgaggcuuucccccagucgaacgccgugauccaagacgaggagcgggacauccccgagcgcaguuggaacagcgguuacgaguggaucaccgacuuccccggcaaaaccgugugguucguccccucuaucaagagcggcaaugacaucgccaacugccugagaaagaacgggaagcgcgugauccagcuguccagaaagacuuucgacacggaguaccagaagaccaaaaacaacgacugggauuacgugguaaccaccgauauaagcgagaugggcgccaauuuccgcgcggaucgggugaucgacccgcgccggugccuaaagcccgugauccuuaaagacgggccagagcgcgucauccuggccggccccaugcccgugacagucgccuccgccgcccagcggcguggccggaucgggcgcaaccacaacaaggagggcgaccaguacaucuacaugggccagccacugaacaacgacgaagaccacgcgcacuggaccgaggccaagaugcuacuagacaacaucaauacucccgaggggauaauccccgcccuguucgagccggagcgggagaaguccgcugccaucgacggggaauaccgcuuacgcggcgaagcgcggaagaccuucguggagcugaugcggcgcggggacuuaccagugugguugucuuacaagguugccagcgagggcuuucaauacagcgaucgccgguggugcuucgacggcgagagaaacaaccagguccucgaagagaacauggacguggaaaucuggacgaaggaaggggaacgaaagaagcugcgcccccgguggcucgacgcccgaaccuauuccgacccccuugcccugcgggaguucaaggaguucgcugcgggccgccggucugucaguggggaucucauacuagaaaucggcaagcugccgcagcaucucacccagcgcgcucagaaugcccuggacaaucuugugaugcugcacaacagcgagcaaggcgggcgggccuaccgucacgcgauggaagaauugcccgacacaaucgaaacgcugaugcuccuggcccugaucgccgugcucaccggcggggucaccuuguucuuccugucggggcggggccuggguaagaccucuaucggccugcuuugcgugauggccuccagcguccuccuguggauggccuccguggagccccacuggaucgcggcaagcaucauccuggaguuuuuccucauggugcugcuuauccccgagccggaccgccaacguacaccucaggacaaccagcucgccuacguaguaauugggcugcuguucaugauccuaacgguggcggccaacgaaaugggccugcuggagaccaccaaaaaggaccucgguaucggccauguggcggucgagaaccaccaucacgcuaccaugcuggacguggaccugcaccccgcuuccgccuggacgcuauacgcgguggcgacaaccaucaucaccccaaugaugcgccacacgaucgagaacaccacggccaacauaagccugaccgccaucgccaaucaggccgcgauccugaugggacucgacaagggcuggccaauuuccaagauggauaucggcgucccccugcuggcccucggguguuacagccaggugaacccccucacgcugaccgccgccguguugaugcuggucgcgcacuacgccaucaucggcccggggcugcaggccaaagccacccgugaggcccagaagagaaccgcggccggcaucaugaagaacccaacgguggacgggaucguggccauagaccucgaccccgucguguacgacgccaaguuugagaagcagcuggggcagaucauguugcucauccugugcaccucacagauccuacucaugcgcaccaccugggcacugugcgagagcaucacacuugcgaccggcccccucaccacccugugggagggguccccgggcaaauucuggaacacgaccaucgccguaucaauggccaacaucuuccguggcucuuaccuugccggggccggacuagcguucagcuugaugaagucccucggaggcgggcgccgggggacgggggcccagggcgagacccucggcgagaaguggaagcgccaguugaaccaacugucgaagagcgaguucaauacauacaagagauccgggaucauggaggucgaccgaucggaagccaaggaaggccucaagcgcggugagaccacccgccacgcggugucacggggcaccgcgaagcugcggugguucguggagcggaaccugguuaagcccgagggaaaggugaucgaccuggguugcggccgcgggggcuggagcuacuauugcgccgggcucaagaaggucacggagguaaagggauauacgaagggcgggcccggccacgaggagcccaucccaauggccaccuauggauggaacuuggugaagcugcacucgggcaaggacguguucuucacgccgcccgagaagugcgacacgcuccucugcgauaucggggagagcucccccaacccgaccaucgaggagggccgcacccuucgaguccucaagaugguagagcccugguuacggggaaaucaauucugcaucaagaucuuaaaucccuacaugccgagcguuguagagacacucgagcagaugcaacgcaagcacggcggcaugcuggugagaaacccgcuaucccgcaauagcacccacgagauguacuggguuuccugcggcacgggcaacaucguaagcgccgugaacaugaccucccggaugcuccugaaccgcuucacaauggcacaccgcaagccgacuuaugagcgggacguggaccugggggcuggaacccggcacgucgcagucgagcccgagguggccaaccucgauauaaucggccagcggaucgaaaauaucaagcacgagcacaagagcaccuggcacuacgacgaggacaacccguacaaaaccugggccuaccacggguccuacgaggucaagccgagcggcuccgccaguagcauggugaacggggucgugaagcuguuaacuaagcccugggacgucaucccgauggucacgcaaaucgcgaugaccgacaccacccccuucggccagcagcguguguucaaggagaagguggauacgcggaccccgaaggcuaagcgcggcaccgcccagaucauggaagucacggccaaguggcucuggggcuuccugucucggaacaagaagccucgaaucugcacgcgggaggaguuuacccgcaagguucggagcaacgccgcgauaggcgccguguucgucgacgagaaucaguggaacuccgccaaggaggcgguggaggacgagcgguucugggaccuggugcagaaggagcgggagcuccacaaacagggcaaaugcgcgaccugcgucuacaacaugaugggcaagcgcgaaaagaagcuaggggaguuuggcaaggccaagggcucccgggcaaucugguacauguggcugggcgccagguucuuagaguucgaggcccugggcuuuaugaacgaagaccacugguucucccgggagaacucccuguccggcguggagggcgaggggcuccacaaacugggcuacauccugcgcgacaucagcaaaaucccuggaggcaauauguaugccgaugauacagccggcugggacacgcggaucacggaggacgacuugcaaaaugaggccaagauuaccgacaucauggagccggagcacgcccuccucgccacauccaucuucaagcucacguaccaaaacaaggugguccgcguccagcggcccgcaaagaacggcacuguaauggacgucaucagccgccgcgaccagcggggcucugggcaggugggcaccuauggcuugaacaccuucacgaauauggaggcucagcugauccgccagauggagagcgaggggaucuuccuccccucagaacuggaaaccccaaacuuggccgagcggguucucgacuggcuggagaaguacggcgucgagcgccugaagcgaauggccauuagcggggacgacugcguggucaagccgauagacgaccgcuucgcgaccgcacucaccgcccugaacgacaugggcaagguccggaaggauaucccccagugggaacccuccaagggguggaacgacuggcagcagguccccuucugcagccaccacuuucaccagcugauaaugaaggacggccgcgagaucgucgucccgugucggaaccaggacgagcucguuggccgcgcccggguaucccagggggccggauggagccugcgcgagacugccugccuggggaagagcuacgcccagauguggcagcugauguacuuccaucggagggauuugcgacuggccgccaacgcuaucugcuccgcggucccaguugacugggugcccacaagccgcaccaccugguccauccaugcccaccaccaguggaugacgaccgaggacaugcucucagucuggaaccggguguggaucgaggagaaucccuggauggaagacaagacccacguguccagcuggggugacgucccguacuuagggaagcgcgaggaucagugguguggcagccugaucggccucacggcccgggccaccugggccagcaacauccagguggcaauuaaccagguucgccgcuuaaucgggaacgagaacuaccuggacuauaugacguccaugaagcgguucaagaacgagggagacccggaaggggcccucugguaa

SEQ ID NO: 24334 - RNA, 9879 nt, Artificial Sequence
  derived and/or modified CDS sequence (opt11) from DENV-1__GQ868611__SS-prME
ucgguaaccauguuccugaugcucaugcccaccgcccucgccuuccaccuaacuacccggggcggggagccccacaugaucgugagcaagcaggaacgaggcaagagccuccuguuuaaaaccucugccggggugaauaugugcacucugaucgccauggaccuuggcgagcugugcgaggacaccaugacguacaagugcccccgcaucacugaaaccgagccggacgacguggauugcugguguaacgccacggacaccugggucacauacgggaccugcagccaaacgggcgagcaccggcgcgacaagcggagcguagcccuggcgccgcacgucggcuuggggcuggagacccgcaccgagaccuggaugagcuccgagggugcguggaagcaaauccaacggguugagacgugggcccugcgccaccccggguucaccgugauugcccucuuccuagcccacgcgaucggcaccagcaucacacagaaggggauuaucuucauccugcucaugcucgugacgcccuccauggccaugcggugcguaggcaucgggagccgcgacuucguggaggggcuguccggcgccaccuggguggacgucguccuagagcaugggagcugcgugaccacgauggccaaggacaagcccacacuggacaucgagcugcuaaaaacggagguuacuaacccagccguccugcggaagcugugcaucgaggcgaagaucagcaacaccacgacagacagccgcugcccgacccagggcgaggccacccucguggaagagcaggacgccaacuucguaugccggcgcacuuucguugaccggggcugggggaacggcugcgggcucuucggaaagggguccuuaaucacgugcgccaaauucaagugugucaccaagcucgagggcaagaucguccaguacgagaaccugaaguacagcgugaucgugacaguccacacgggagaccagcaccagguggggaacgaauccaccgaacacggcaccaccgccaccaucaccccccaagcgcccaccaccgagauacaacugaccgacuacggggcccucacgcuggacuguagcccccgcacgggccuggacuucaacgagaugguccuccugacaaugaaggagaaguccuggcugguucacaagcaaugguuccuagaccugccacugccauggaccagcggggccucaacgucacaggagaccuggaaccggcaggaucugcuggugaccuucaagaccgcccaugccaagaagcaggagguagucgugcugggcagccaagagggcgcgaugcauaccgcccucacaggggccaccgagauccagaccuccggcacgaccaccaucuucgccgggcaccugaagugccgccucaagauggauaagcuuacccuaaagggcaugagcuacgucaugugcacgggguccuuuaagcuggagaaggagcucgccgagacgcaacacggcaccgugcuggugcagaucaaguacgagggcaccgacgcgcccugcaagauccccuuuagcacacaggacgagaagggggucacccagaacggccggcugaucaccgccaacccgauagugaccgauaaggagaagcccgugaacaucgaggccgaaccgcccuucggggaguccuacaucgucaucggcgccggcgagaaggcucugaagcucagcugguucaagaaggggucuagcaucggcaagauguucgaggccacggcccgcggggcccggaggauggcuauccugggcgacacggcgugggacuuuggcuccaucggcggcguguuuaccagcgugggcaagcugguccaccaaaucuucggcacugccuacggggugcuguucucuggcgugucguggacgaugaagaucgggaucggcgugcugcuuacaugguuaggccugaacucccgcagcaccucccugucuaugaccugcaucgccguggggcucgugacgcuguaccugggcgucauggugcaggccgacuccgggugcgugaucaacuggaagggccgcgagcucaagugcgggaguggcaucuuugucaccaaugaggugcacaccuggaccgagcaguacaaauuccaggccgacagcccgaagcgcuugagugcggccaucggaaaggccugggaagagggggugugcggcauacggagcgccacucgcuuggagaacaucauguggaagcaaaucuccaacgagcuuaaccacauccugcuggagaaugacaugaaguucacggucgugguaggggacguugccggcaucuuggcgcaggggaagaagaugauuagaccccagcccauggaguacaaauacucauggaaauccuggggcaaggccaagaucaucggcgccgacguccagaacaccaccuucaucauagacggucccaacaccccggagugccccgacgaccaacgcgccuggaacauaugggaaguggaggacuaugguuucggcaucuucacaaccaacaucuggcugaagcugcgggacucguacacacaggucugugaccacagguuaauguccgcggccauaaaggacagcaaggccguacacgccgauaugggcuacuggaucgaguccgagaagaacgagacauggaaguuggcucgggcgucuuucaucgaggugaagacgugcaucuggccgaaaucccacacccuguggagcaacggcguccuugagucagagaugaucauccccaagaucuaugggggaccuaucagccagcacaacuaccgcccaggguacuuuacacagaccgccggccccuggcaccuggggaaguuagagcucgacuucgaccugugcgagggcacgaccguaguggucgacgagcacugcgguaaccgggggccgagccugcgcaccaccacggugacaggcaaaaucauacacgaguggugcugucggagcuguacccuacccccccuccgcuuccguggggaggauggcugcugguacgguauggaaauacgucccgugaaggagaaggaggagaaccuggucaaguccauggucagcgcgggcagcggcgagguggacuccuuuagccuggggcugcugugcaucuccaucaugaucgaggaggucaugcggagccgcuggucccggaagauguugaugaccggcacgcuggccguguucuuccuguuaauuauggggcagcucaccuggaacgacuugaucagacucugcaucauggugggugcaaacgcaagcgaccgcauggggaugggcaccaccuaccuugcccugauggccacguucaagaugcgcccgauguucgcagugggccuccuguuccgccggcugaccucccgcgaggugcuccugcugaccaucgggcucucacugguggccucggucgagcugcccaauagccucgaggagcugggagacgggcuggccaugggcauuaugaucuugaagcugcuaaccgacuuccagucccaccagcuuugggccacgcugcugagccucaccuuuaucaagaccaccuucucccuccacuacgccuggaagacgauggccauggugcugagcaucgucucccucuucccccuguguuuaagcaccaccucccaaaaaaccacgugguugcccguucugcugggcagccucgggugcaagccgcugaccauguuccugaucgcggagaacaagaucuggggccgccgcuccuggccccucaacgaagggaucauggccguaggcauagucagcauacugcugagcucccuccugaagaacgacgugccccuggccgggccccucaucgccggcggcaugcugaucgccugcuacgugaucagcggguccagcgcggaccuguccuuagagaaagccgccgaggucagcugggaggaggaggccgagcacaguggcgcgagccacaauauccugguggaggugcaggacgacggaaccaugaagaucaaggacgaggagcgggaugacacccugaccauacuccugaaggcgacgcugcucgccgucuccggcguauauccgcugagcaucccggccacccuguuugugugguacuucuggcagaagaagaaacagcgcuccgggguccucugggacacccccaguccgcccgagguggagcgggccgugcuggacgacggcaucuaucgcaucaugcagcggggccugcuagggcgcucccaggucggcguggggguguuccaagagaacgucuuccacaccauguggcacgugacgcggggcgccgugcucauguaccaggggaagcgccuggagcccagcugggcguccgucaaaaaggaccugaucagcuacggcggcggguggcggcuccaggguuccuggaacaccggggaggaggugcaggugaucgccgucgagcccggcaagaaccccaagaacgugcagaccgcccccgggaccuuuaagacgcccgagggcgaagugggcgccaucgcccuggacuucaaacccgggacuagcggcucccccaucgucaaccgcgaagggaagauagugggucuguacggcaaugggguggucaccaccagcgggacguacgugagcgcgaucgcccaggcccgggccucccaagaggggccgcuccccgaaauagaggacgagguguuccgcaagcggaaccugaccaucauggaccuccaccccggcagcgggaaaacccgccgguaccucccagcgaucguccgggaggccaucaagcgcaagcugcggacccugauccucgccccaacgcgcgucguggccucagagauggccgaggcgcugaagggcaugcccauccgguaucagaccaccgccguuaaaucugagcacaccggcaaggagauaguggaccugaugugccacgccacguucaccaugcgccuccugucccccgugcgggucccgaacuauaauaugaucaucauggacgaggcccacuucaccgaccccagcuccauagccgcgcgcggguacauuagcacccgggugggaaugggcgaggccgccgccaucuuuaugacggccacgccgcccggauccguggaggccuucccgcagagcaacgccgucauccaggacgaggagagagacauccccgagcgguccuggaacagcggguacgaguggaucaccgacuuucccggcaagaccgugugguucgugcccuccaucaagagcggcaacgacaucgccaacugccugcgcaagaacgggaagcgggucauccagcucucgcgcaagacguucgacaccgaguaccagaagaccaaaaacaacgacugggacuauguggugaccacggacauaagcgagaugggugcuaacuuccgggcggaccgcgucaucgacccgcggcgcugucugaagcccgugauccuaaaggacggacccgagcggguuauccucgcgggccccaugccggucaccguggccuccgccgcccagcgucggggacgcaucgggcguaaccacaauaaggagggcgaccaauacaucuacauggggcaaccucucaauaaugacgaggaccacgcgcacuggaccgaagcaaagaugcugcucgacaacauuaacacccccgagggcaucauccccgcccuguucgagccggagcgggagaaguccgccgccauugacggcgaguaccgccugaggggcgaggcgcgaaagacguucguggagcucaugcggcgcggggaccugcccguuuggcuguccuacaaggucgcguccgagggcuuccaguacucggaccgacgcuggugcuucgauggcgagcggaauaaccagguccucgaggagaacauggacguggagaucuggaccaaggagggggaacgcaagaagcugcggccccgcuggcuggacgcccggacauacuccgacccacucgcccugcgcgaguucaaggaguucgccgcgggccggcgcucuguguccggggaccugauccucgagaucggcaaacugccgcagcaccugacgcagcgugcccagaacgccuuagacaaccuggucauguuacacaauagcgaacaaggcgggcgcgccuaccggcacgcgauggaagagcugccggacacgaucgagacgcugaugcugcucgcccugaucgccgugcugaccggcggggugacccucuucuuccuguccggccgcggucugggcaaaacgagcaucgggcuccugugugucauggcauccuccgugcugcucuggauggccucuguggagccccauuggaucgcggcgagcaucauccuggaguucuuucugaugguccugcugauccccgagccggaccggcagcgcacgccccaggacaaccagcuggccuacguggucaucgggcuucuguuuaugauccugaccgucgccgcgaacgagaugggcuugcuggagaccacgaagaaggaccuggggaucggccacguggcgguggagaaccaccaccacgcugccaugcucgacgucgaucuucaccccgccuccgccuggacgcuguacgcgguggcaacaacuaucaucacuccgaugaugcgccacacgaucgagaacaccaccgccaauaucagccugaccgcaaucgccaaucaggcggccauccugaugggguuggauaagggcuggcccaucuccaagauggacaucggcguaccccuccuggcccuggggugcuacagccaggucaacccccuuacgcugaccgccgcggugcugaugcucguggcccacuacgccaucaucggcccggggcugcaggccaaggcaacccgggaggcgcagaaacggaccgccgccggcaucaugaagaaccccacggucgacgggauuguugcgaucgaccuggaccccguggucuacgacgccaaguucgagaagcagcucggccagaucaugcugcugauccucugcaccucccagauacuacugaugcggaccaccugggcgcucugcgagagcaucacgcuggccaccggccccuuaacuacccuuugggagggguccccgggcaaauuuuggaauacgacuauugccgugagcauggccaacaucuuccgcgggaguuacuuggccggagcgggccuggccuucagcuugaugaagucgcucgggggcggucgacgcgggaccggggcccagggcgaaacccugggcgagaaguggaagcgucagcucaaccagcuguccaagagcgaauucaacacguacaagcgcuccgggaucauggagguggaccggagcgaagccaaggagggccuaaagcggggggagacaaccaagcacgcgguaucacggggcacugccaagcuucgcugguucguggagcgcaacuuagugaagcccgaggggaaggucaucgaccugggcugcggccgcgggggcuggagcuacuacugcgccgggcugaagaagguuacggaggugaagggcuauaccaagggcggcccgggccacgaggaacccauaccgauggccaccuauggauggaacuuagucaagcuccacuccggcaaggacguguuuuuuaucccacccgagaagugcgauacccugcucugcgacaucggggagaguucccccaauccgacuaucgaggagggccgaacccuaagggugcugaagauggucgagcccuggcuccgagggaaccaguuuugcaucaagaucuugaacccguacaugcccagcgugguggagacccuggagcagaugcagcgcaagcacggcggcaugcucguccggaacccccugucccgcaacucgacucacgagauguacuggguguccugcgggaccggcaacaucguguccgcagucaauaugacgucccgcauguuguuaaaccgguucaccauggcccaccggaagcccaccuaugagcgggacguagaccugggggccggaacccgccacguggcaguggaacccgagguggccaaccuggacauaaucggccagcggaucgagaacaucaagcacgagcacaagagcacguggcacuacgacgaggacaacccguacaagaccugggccuaccacgggaguuacgaagugaagccgagcggauccgcgaguagcauggucaaugggguggucaagcuccugaccaaacccugggacgugauacccauggugacccagauagccaugacggacaccacccccuucggccagcagcgcgucuucaaggagaagguggauacucggacgccgaaggccaagcgcgggaccgcccagaucauggaggugaccgccaaguggcugugggguuuccucucccggaacaagaagccccgcaucugcaccagagaggaguucacucgaaaggugcgguccaacgccgccauuggcgccguuuucguggacgagaaccaguggaacuccgccaaggaggcggucgaagacgagcgguuuugggaccuggugcacagggagcgcgagcugcacaagcaagggaagugcgcgaccugcguguacaacaugaugggcaagcgagagaaaaaguugggagaguucggcaaggccaaggggagccgcgccaucugguacauguggcugggcgcacgguuccuggaguucgaggcgcucggcuucaugaacgaggaccacugguucucccgagaaaacucacuguccggugucgagggcgaggggcugcacaagcuaggcuacauccugcgugacaucagcaaaauccccgggggcaacauguacgccgaugacaccgcgggaugggacacccgcaucacggaggacgaccugcagaaugaggccaggaucaccgacaucauggagccggagcacgcccuccuggcuaaaucaaucuuuaagcugaccuaccagaacaagguggugaggguacagcgccccgccaagaacgggaccgugauggacgugauaagccgacgcgaccagcgcggcuccgggcaagucggcaccuacggccucaacaccuucaccaacauggaggcccagcugauccgccagauggaaagcgaagggaucuucucuccgagcgagcuggagacccccaaccucgcugagagggugcuggauuggcuggagaaguacggcguugagcgccucaagcggauggccaucuccggggacgacugcguugugaagccgaucgacgaucgcuucgcgacggcccugaccgcacugaaugacauggguaaggugcggaaggacaucccccagugggagcccagcaagggguggaacgacuggcagcagguccccuucugcucccaccacuuccaccaacuaaucaugaaggacggcagagagaucguggugccgugcagaaaccaggacgagcuggucggccgcgcgcgggugagccagggggccgguuggagccugcgcgagaccgcgugccucgggaaguccuacgcccagauguggcaguuaauguacuuccaccggagggaccugagacucgccgccaacgcgaucugcagcgccgugccggucgacuggauccccaccagucgcacgacguggagcauccacgcccaccaccaguggaugaccaccgaagacaugcuuuccguguggaaccgcguguggaucgaggaaaaucccuggauggaggacaagacacauaucagcucuuggggugacgucccguacuuggguaagcgggaggaccaguggugcggcagccucaucggccugaccgcccgcgccaccugggcaaccaacauccagguggccaucaaccaggugcggcgccugaucgguaacgaaaacuaccucgacuacaugacguccaugaagcgguucaagaacgagagcgacccagagggugcccugugguga

SEQ ID NO: 24335 - RNA, 9879 nt, Artificial Sequence
  derived and/or modified CDS sequence (opt11) from DENV-1__FJ882555__SS-prME
ucuguaaccaugcugcucaugcugaugcccaccgccuuggccuuccaccucaccacccgcgguggggaaccgcacaugaucgugucgaagcaagaacgggguaaaagccuccuguucaagaccucugccgggguuaacaugugcacccucauugcgauggacuugggcgaguucugcgaggauaccaugaccuauaagugcccccgcaucaccgaggcugaacccgacgacguugacugcuggugcaacgcgaccgacacgugggucaccuacggaaccugcucccagaccggggagcaucgacgcgauaaaagaucagucgccuuggcgccccacgugggccucgggcuagagacucgcaccgagaccuggaugucauccgagggcgccuggaagcaaauccaacgggucgagaccugggcacuccgacauccuggguucacggugaucgccuuauuucuggcgcacgccaucggcacaucaaucacccagaaggggaucaucuucaucuuacuuaugcuggugacccccagcauggccaugcggugcgucgguaucgguucacgcgauuuuguggaggggcugucaggugcgacguggguggacgucgugcucgagcacgggucgugcgugaccacgauggccaaggacaaacccacguuagauaucgagcugcucaagacagaggucaccaaccccgccgugcugcguaagcuguguaucgaggcgaagauauccaauaccaccacagacagccgcugccccacccagggcgaagccacccucguggaagaacaagacgcuaacuucgucugccggcguacauucguggaucggggcugggggaauggcugcggccuguuugguaagggcuccuuaaucacgugcgcaaaguucaagugcgucacaaaguuagaggguaagauaguccaauacgagaaccuuaaguacagugugauuguuaccguccacacuggcgaucaacaucaggucgggaacgaauccacagagcacggcacgacagcgacaauuacgccccaagcccccucuacagagauccagcugaccgacuacggagcccucacccuggacugcucuccgcggaccggccuggacuucaacgagaugguguugcugacgaugaaggagaaguccugguuggugcauaagcagugguuccuugaccucccgcuuccuuggaccucuggggccagugccucacaggagaccuggaaucggcaggauuuacuggugacauucaaaacugcucacgccaagaaacaggaagucgugguccuagguucccaagaaggcgccaugcacacagcccucaccggugcgaccgagauccagacaagcggcaccaccacaaucuuugcagggcaccuuaaaugccgauugaagauggacaaguugacuuuaaaaggcauguccuacgucaugugcacagggagcuuuaaauuggagaaagaaguggccgagacccaacaugguacaguucucguccagaucaaguacgagggcacggaugcgcccuguaagaucccuuuuucaacccaggacgagaagggggugacccagaacggcagacugaucaccgccaacccgaucgugacggacaaggagaagcccgucaacaucgaggccgagccacccuucggggagucguauauagugauaggcgcaggcgagaaggcauuaaaacugucaugguucaagaaagguucaagcaucgggaaaauguucgaggccacggcccgcggggcgcggcguauggcaauccucggcgauacugcaugggacuucggaucuauuggcggcguguucaccuccguggguaaacugguucaccagauauucggaaccgccuacggcguucuguucucaggcgucuccuggacgaugaagaucgguaucggcguguugcugaccuggcuugggcugaauagucgcaguaccucucucucaaugaccugcauagccgugggacuggucacauuauaucugggcguuauggugcaagcagauagcggaugugucauaaauuggaaggggcgggagcugaagugugggagcggcaucuucguaaccaacgaggugcacaccuggacggaacaguacaaauuucaggcagauuccccgaaacgccucagcgccgcuaucggaaaagccugggaagagggagucugcggcauacgguccgcgacacgcuuagaaaacauaauguggaaacagauuagcaacgagcugaaccacauccuccuggagaaugacaugaaguuaaccgugguggucggggauguggccggcauacucgcccaagggaagaaaaugauccggccacagcccauggaauacaaguauuccuggaaauccuggggcaaagccaagaucaucggugcggacguacagaacacgaccuuuauaauagaugggcaaaacaccccugagugucccgacgaccagcgcgcauggaacaucugggaggucgaggacuacggcuucgguaucuucaccaccaacauaugguuaaaacugagagacaguuauacccagguuugcgaccaccgacugaugucggccgccaucaaggacaguaaggcagugcaugcggacaugggcuacuggaucgagagcgagaagaacgaaaccuggaagcuggcccgggccaguuucauugagguuaagacuuguauauggccuaaaagccacacucuguggagcaacggugugcucgagagcgagaugauaauccccaagauauaugggggccccaucucccagcacaacuaccgcccggguuacuucacucagacagcaggcccauggcaccuggggaaguuggaguuggacuuugaucugugcgaggggaccaccgucguaguggaugagcauugcgggaaccggggacccagccugcgcaccacuaccguuaccggcaagauuauccacgagugguguuguagguccugcacccucccgccgcugcgcuucaaaggagaggacgguugcugguacgggauggagauccggccugugaaggagaaggaagagaaccuggugaaauccaugguuagcgccggcuccggcgaggucgacagcuucuccuuagggcugcugugcauaagcaucaugauugaagaagugaugcgcagucgguggucaagaaagaugcuaaugacggguacguuagcgguguucuuucugcuaauaauggggcagcuuaccuggaacgaccugauccggcucuguauuauggucggggcgaacgccuccgauaggauggggaugggcaccacauaccuggccuuaauggccacauucaagaugcgacccauguucgcggugggacuccuuuuccggcgccugacaucacgcgagguguuauugcugacaaucggucuuucccuuguggccagcguggagcugccgaacagucucgaggagcugggcgacggacuggcaaugggcaucaugauccucaagcugcugacggacuuucagagucaucagcucugggccacgcugcuguccaugaccuucauccguacuacguucagccuccacuacgcguggaagaccauggccaugguccuguccaucgugagccuguucccccucugccuguccaccacaucacaaaagacgaccugguuacccguacucuuagguuccuugggaugcaagccgcucaccauguuccuuaucgccgaaaacaagauuugggguagaaagagcuggccguuaaaugaggggauuauggcagucggcauagucagcauccuccuguccagccugcucaagaaugaugucccacuggccgguccccugauugcgggcgguaugcucaucgccugcuacgucaucucggggagcagcgccgaucugagcuuggagaaggccgcuguuguuucuugggaggaggaggcggagcacucuggggcaucucauaauauccucgucgaagugcaggacgacgggaccaugaagaucaaggacgaggaacgcgacgauacgcuaaccauccuuuugaaggcuacccugcuggccguuucaggcgucuacccccucuccauuccagcuaccuuguucgugugguauuucuggcagaaaaagaagcaacggagcggaguccugugggacacaccaagcccucccgaagucgagcgagcggugcuagacgacggcauuuacaggaucaugcagagaggccugcuggggcggucucagguaggcguagguguuuuccaagagaauguauuccauacgauguggcaugucacucggggcgccgugcuaauguaccaggggaagcgguuagagccguccugggcaagcgugaagaaagaucugaucucuuacggaggcggguggcgccugcagggcucguggaacaccggagaggagguucaggugauugccguggagcccggcaagaaccccaagaacguccagaccgcgcccggaacauucaaaaccagcgagggcgaggugggagcuaucgccuuagacuucaagccggggacgagcggaagccccauagugaaccgggaaggaaaggucgucggcuuauacggaaacgggguggugaccacaucuggaaccuacgucucagccauagcccaggcgaaggcgucccaggaggggccgcugcccgagauugaggacgaaguguucagaaaacggaaccucacgaucauggaccugcacccggggagcgggaagacccgucgguaucuacccgcgauagucagggaagccauaaagcggaagcucaggacgcuaauccuggcccccacgcgcguggucgcgagcgagauggccgaggcgcuuaaaggaaugccuauccgguaccagaccacugccgugaagucggagcacacgggcaaggagauuguggaucugaugugccacgccaccuucaccaugcgccugcuuaguccugugcgcguccccaacuacaacaugauaauuauggacgaggcgcacuucaccgacccgucauccaucgccgcacgcggguacaucagcacccgcgugggcaugggggaggcggccgcuaucuucaugaccgcaaccccgcccggcagcguggaggccuucccucaguccaacgccgugauccaagaugaggagcgcgacauacccgagcgaucguggaauagcggcuaugaguggaucaccgacuucccgggcaagacgguaugguucgugccgaguaucaaaagcggaaacgacaucgcgaacugcuuacgcaaaaauggcaagcgagugauccaacugucccgaaagacuuucgauacugaguaccaaaagaccaagaacaacgauugggacuacguuguuacgaccgacauuagugagaugggcgcaaacuuccgcgccgaccgagucauugacccccggaggugccucaagccugugauccugaaagaugggccagagagagucauacuugccggccccaugcccguuaccgucgcguccgcggcucaaaggagggggcgcaucggccgcaaucauaacaaggagggcgaccaguacaucuacauggggcaaccacuaaacaacgacgaggaccaugcccacuggaccgaagccaagaugcuacuagauaacaucaauacgccugagggcauaaucccagcccucuuugagccagagagggagaagucagcggccaucgacggagaguaccgccugcggggcgaggcccgcaagacauucgucgaguuaaugcggcgcggggaccuccccguguggcugagcuacaagguggccucggaaggguuccaguauagcgaccgucgcuggugcuuugacggggagaggaauaaccagguacucgaggagaacauggacguggagaucuggaccaaagagggggagcgcaagaaacuucggccgcgguggcuggaugcacggaccuacucugacccccuggcgcucagggaauuuaaagaguucgccgccggacggcgcucugucucaggagaucugauucuggagaucggcaaacucccacaacaccugacgcagcgggcucagaacgcgcuugauaaccucgucaugcugcacaacagcgagcaaggcgggcgcgccuaucgccacgccauggaagaacugcccgacacaauagaaacguugauguugcuggcccuuauagccguauugaccggcggagucacacuauucuuccuguccggccgcgggcuggguaagaccucaauuggacuacucugcgugauggcaaguagcgugcugcuguggauggccuccguggaaccgcacuggaucgcagcaucaaucauccuggaguucuuccugaugguauuacucauacccgagcccgacaggcagaggacgccccaggauaaccagcuggcguacguggugaucgggcuccucuucaugauuuugaccguugcggcaaacgagauggggcuguuagagaccaccaagaaagaccuaggcauaggucacguggcagucgagaaccaccaccaugccgcgaugcuggaugucgaccuccacccggcaucggccuggacccucuaugccguagccacgaccaucaucacgcccaugaugcggcacacuaucgaaaacaccaccgcuaacaucucucugacggcaauagccaaccaggcagcuauccucauggggcuggauaaggguuggccgauauccaagauggacaucggcguuccucugcucgcccugggguguuauagccagguuaaccccuuaacccugaccgcugccgugcuuaugcugguugcccacuacgccauaauaggucccggucuacaagcgaaggccacccgcgaggcccaaaagaggacugccgcuggcauaaugaagaaccccacagucgacgggaucguggcgauugacuuagaccccgugguguacgacgcgaaguuugagaaacagcuaggccagauaaugcuacucauccuguguaccucccaaaucuuacugaugcggacgacgugggcgcugugcgagagcaucacauuggccaccggcccucuaaccacucugugggagggcucccccggcaaguucuggaacacuaccauugccguaagcauggcgaacaucuuccgcgggagcuaccucgccggcgccggacuagccuucucccuaaugaaaucccucgggggagggcguaggggcaccggagcucaaggagagacgcugggggagaaguggaagaggcaacugaaccagcucuccaagucagaguucaacaccuacaagcgcuccgggauaauggagguagacagaagcgaagccaaggaagggcugaaacgcggggagaccacgaaacaugccgucucccgagggacagccaagcugcgcugguucguugagcgcaacuuaguuaagcccgagggcaaggucaucgaucugggcugcggucgcggcggcuggucuuauuacugcgccggacugaagaaggugaccgaggugaagggauauacuaagggagggccaggccacgaggaacccauacccauggcgaccuacggguggaaccuugucaagcuccacuccggcaaggauguauuuuucauaccacccgagaagugcgauacgcugcugugcgacaucggggagagcucccccaaccccaccaucgaggaaggacggacgcugcgaguuuugaagauggucgagcccuggcugcgcgggaaccaguucuguaucaagauucuaaaucccuacaugcccagugugguggagacccuagagcaaaugcagcgcaagcauggaggcaugcuuguccggaacccccuaucccggaacagcacccacgaaauguacugggugucaugugggaccggcaacauaguuagcgcggucaacaugacaucucggaugcuccuuaaucgcuucaccauggcccaccguaaacccacauacgagcgggauguggaccucggggcaggcacgcgucacguggcgguugaaccggagguagcgaaccuggauaucaucggccagcggaucgaaaauaucaagcacgagcacaagucaaccuggcacuacgacgaggauaaccccuacaagaccugggcguaccacgguucguacgagguuaagcccagcgguagcgcauccagcauggugaacgggguggucaagcuacucacgaagcccugggaugucaucccuaugguaacucagaucgcgaugacagacaccacaccuuuugggcaacagcgcguauucaaggagaagguagauacuaggaccccaaaggcuaagcgugggaccgcgcagaucauggaaguaacggcgaaauggcugugggguuuccuuuccaggaacaagaagccuagaauuugcacgcgggaggaguuuacacgaaaggugcggagcaacgccgcuauuggcgccguguucguggacgaaaaccaauggaacuccgccaaagaggccgucgaagacgagcgcuucugggaucucguacaccgggagcgcgagcuccacaaacaagggaaaugugcaacuugcgucuauaacaugauggguaagcgggagaagaaguugggggaguucggaaaagccaagggaucuagagcgaucugguacauguggcugggcgcccguuucuuggaguucgaagcccuggguuucaugaacgaggaccacugguucucccgcgagaacucgcucuccggugucgaaggugaggggcugcacaagcuaggcuacauccuacgggacaucagcaaaauccccggagggaacauguacgccgacgacacggccgggugggacacgcgcaucaccgaggaugaccugcagaacgaggcgaagaucaccgacaucauggagcccgagcaugcucuguuagccaaguccauuuuuaagcugaccuaccaaaacaagguggugcggguacagagacccgccaagaacggcacggugauggacgugaucucccgccgggaccagcguggcuccgggcaggucggaacguauggccugaauaccuucacuaauauggaggcccaguuaauccggcagauggagagcgaggggaucuucucaccguccgagcuggagacgcccaaccuggcggguagggcccucgacuggcuggaaaagcacgguguggagcgucucaagcgcauggcuaucuccggcgacgauugcguugucaagccgaucgacgacagguucgccaccgcccuaaccgcguuaaacgacaugggcaaggugcgcaaggauaucccccagugggagccaagcaagggcuggaacgauuggcagcagguccccuucuguucccaccacuuccaccagcugauaaugaaggacggccgggagaucgucguccccugccgcaaccaagacgagcuugucggucgggcucgcgugucccagggcgcgggguggagccugcgcgaaaccgcaugucuuggcaaguccuacgcccagauguggcagcucauguacuuucaucgccgagaccugcgucuggccgccaacgcuauaugcagugcggugccggucgacugggucccgacgucacggaccaccuggagcauccacgcgcaucaccaauggaugaccacggaggacaugcuuuccguguggaaccgcgucuggaucgaggagaaccccuggauggaggacaagacccacaucucauccuggggagacgugcccuaccuggggaagcgggaggaccaguggugcggaagccugaucgggcucacagcacgcgcaaccugggcuaccaauauacaagucgcgauaaaucaggugcgccgucugcucggcaacgagaacuaccucgauuacaugacuuccaugaagcgcuuuaagaacgagagcgauccggagggggcucugugguga

SEQ ID NO: 24336 - RNA, 9879 nt, Artificial Sequence
  derived and/or modified CDS sequence (opt11) from DENV-1__GQ199821__SS-prME
ucgguuaccaugcuauugaugcuaaugccgacggcccuagccuuccacuuaacgacccgcggcggggaaccccacaugaucgugucaaagcaggaacgggguaagagcuuacuguucaagaccagcgcuggggugaacaugugcacccucaucgcaauggaucugggcgaguucugcgaagacacgaugaccuacaagugcccccgcaucaccgaggcagaacccgacgacguggacugcuggugcaaugcuaccgacaccugggugaccuauggaaccugcucucagaccggugagcaccgccgcgacaaacgguccguugcccucgcgccgcauguggggcucggacucgagacgcgcaccgagacuuggaugagcagcgagggagcguggaagcagauccagcggguggagaccugggcucugcggcauccaggguucacggugauagcccuauucuuggcgcacgcgaucggcaccagcaucacucagaaaggaaucauuuucaucuugcucauguuggugacccccuccauggcaaugcgaugcgugggcaucggcucucgagacuucguggaggggcuguccggcgccacuuggguggacgucgugcucgagcacgggagcugcgucaccaccauggccaaggacaagcccacgcuggacauugagcuccucaagacggaggucaccaacccggcggugcuccguaagcuguguaucgaggccaagaucuccaacaccacgacggacagucgcuguccgacccagggagaggcuacccucguggaggagcaagacgcuaacuucgucugccgucggaccuucguggaccggggcugggggaauggcuguggacuauuuggcaaggggucccugaucacgugugcuaaguucaaaugcgugaccaagcuagaagggaagacaguccaguacgagaaucugaaguacucuguaaucgugaccguucacacgggcgaccagcaccagguagggaacgagucgacugagcacggcaccaccgcuacgauuacaccccaggccccgagcacugagauacaacugacagacuacggggcccucacccuggacuguucaccccggacgggucuggauuucaacgagaugguucuccugaccaugaaagagaaguccuggcuggugcacaagcagugguuccucgaccucccacugcccuggacaagcggggccucuacuucacaggagacguggaaccggaaggaucucuuggugacguucaagacugcccacgcgaagaaacaggaagucgucguguuaggcucgcaggagggcgccaugcauaccgcccucacgggggcaaccgagauccagaccagugggaccacuaccaucuucgcagggcaccuaaagugcaggcugaaaauggacaagcucacccugaagggcauguccuacgucauguguacagggagcuucaaacuggagaaggagguugccgagacucagcacggcaccgugcuugugcaaauaaaauacgaaggcaccgacgcccccuguaagaucccuuuuuccacccaggacgaaaagggggugacgcaaaacggccgguuaaucacggccaacccgaucgugaccgacaaggagaagcccgucaacauugaggcggagccucccuucggagaaucuuacaucgugauaggcgcgggcgagaaagcccugaagcugucaugguuuaagaagggcagcagcaucggcaagauguucgaggccaccgcccgcggggcacggcgcauggcgauucucggcgacacagcgugggacuucggaagcauaggcggcguguucacaagcgucgggaagcugguacaccagaucuuuggcaccgccuacggggugcuguuuagcggcgucagcuggaccaugaagauugguaucggcgugcuacugacguggcucggguuaaacagcaggagcaccagccuguccaugacaugcaucguggucgggcuggucacccuguaccugggcguaaugguucaggccgacagcgggugcguuaucaauuggaagggccgagaguugaaaugcgggagcggcaucuucgugacgaacgagguccacaccuggaccgaacaauacaaguuccaagccgacaguccgaagcgccugagugccgccaucggcaaggcaugggaagagggggucugcggcauucgcucggccacccgccucgagaacaucauguggaagcaaaucucgaacgagcugaaccacauacuccuggagaaugacaugaaguucaccguggucgucggggacguggccggcauccuggcccaaggaaagaagaugauccgcccccagcccauggaguacaaauacuccuggaaguccuggggcaaggcuaagauaauaggcgcugacguccaaaacacgaccuucauaaucgaugggcccaacacgccggaauguccagacgaccagcgcgccuggaacaucugggagguggaggacuacgguuucgguaucuucaccacuaacauauggcucaagcugcgggacuccuacacccaagugugcgaccaucgccuaaugagcgcggccaucaaggacuccaaggccguucacgcggacaugggauacuggauagagagcgaaaagaacgaaacguggaaguuagcccgggccuccuucaucgagguaaagaccugcaucuggcccaagucucacacccuguggucaaacggcgugcuggagagcgagaugauaauccccaaaaucuacggggguccuauuucccagcauaacuaccgccccggguacuuuacccagacagccggcccuuggcaccuggggaagcuggagcuggacuucgaucucugcgaggggaccacggucgugguggacgagcacugcggcaaccgggggccaucacugcgcacgaccacugucaccgguaagaucauccacgaauggugcugcagaucgugcacacugccaccccugcgauucaagggggaggauggcugcugguacggaauggaaauuaggcccguuaaggagaaagaggagaaucuggugaaaagcauggucagcgccggcagcggcgagguugacagcuucagucuggggcuccuguguaucucuaucaugauugaggagguaaugcgcucgcgguggagccgcaagaugcugaugaccggcacccuagccgucuucuuccuccugaucauggggcagcucacauggaacgacuugaucagguuaugcaucaugguaggcgccaaugcguccgaccgcaugggaaugggcacgacguaucucgcgcugauggccacuuucaagaugcggcccauguucgcgguugggcuccuguuccgucgccugacgagccgggagguucugcuccuuaccauagggcugucccucguggccagcgucgagcugccuaauucccuggaagaguugggggacggucucgcgaugggcaucaugauccugaaacuucugaccgacuuucagagccaccagcugugggcuacgcugcugucccugacguuuaucaagacgaccuuuucacuccacuacgccuggaagacgauggccauggugcugagcaucguaagccuauucccccucugccugucgacgacgagccagaaaaccaccuggcuucccguccuucuaggcucccugggcugcaagccccucacgauguuucugauagcggaaaauaaaaucuggggcaggaagucuuggccccugaacgaggggaucauggccgugggcaucgugagcaucuuacugucaucacugcucaagaacgauguaccccuggccgggccccugauugccgguggaauguuaauagcaugcuacgugaucuccggaagcucagcggaccuaucacuagaaaaggcggccgaggugaguugggaggaggaggcggagcacagcggcgcaagccauaacauacuuguggaggugcaagacgaugggacaaugaagauuaaagacgaggagcgcgacgauacccugaccauccugcucaaagcuacccuucuggcagugagcggaguguauccccucuccaucccagccacgcuguucgugugguacuucuggcagaaaaagaagcagagaagcggggugcugugggacacccccagcccgcccgagguagagcgggcagugcucgacgacggaaucuaucgcaucaugcagcggggccugcuggggcggagccaggugggcgucgggguguuccaggagaacguguuucacaccauguggcacgucacccggggagcagugcugauguaccaagggaagcgccucgagccaaguugggcaucuguaaagaaggaccugauuuccuacggcggcggguggcgguugcagggaucauggaacacgggggaggagguacagguaauagccguggagcccggcaagaacccgaagaacguucaaaccgcgcccggcaccuucaagaccuccgagggcgaaguuggugccaucgcccucgacuucaagcccgggacuagcggcucucccauagugaaccgcgaggggaagaucgucggguuguacgguaacgggguagugaccaccucuggcacguacguuucugcgauagcccaagcgaaagccucccaggaggggccccugcccgagaucgaggaugagguguuucggaagcguaaccucaccauuauggacuugcaucccggcagcgggaagacgcggagguacuugcccgcgaucgugcgagaggccaucaaacgcaagcuccggacgcuuauccuggccccgacccgcguagucgccuccgagauggccgaggcguugaaaggcaugcccauccgcuaccagacuaccgcagucaaaagcgaacacaccggaaaggagaucgucgaucugaugugccacgccaccuucacgaugcggcugcucuccccugugcguguaccgaacuauaacaugaucaucauggacgaggcccacuucaccgacccgagcuccaucgccgcgcgaggguacauauccacacgcguggggaugggggaggccgccgccauauucaugaccgccacgccgcccgggucgguagaggcguucccccagucgaacgccguaauccaagacgaggagcgagacaucccugaacgcuccuggaacagcggguacgaauggauuaccgacuucccgggcaagaccgucugguuugugcccuccauuaagagcggcaacgacaucgccaacugccugcgcaagaaugggaaacgugugauacagcugagccggaaaacuuucgacacggaguaucagaagaccaaaaacaacgacugggacuacguagugaccaccgauauuucggaaaugggcgccaacuucagagcggacaggguaaucgaccccaggcgguguuuaaagccggugauccugaaggacggucccgagagaguaauccuggccggccccaugcccgucacgguggccuccgccgcccaacggcgcgggcgaauuggccgcaaccacaacaaggagggcgaccaguacauauauauggggcaaccgcucaacaacgacgaggaccacgcucauuggacagaggccaagaugcuccuggacaacaucaacacacccgagggcaucaucccggcucucuucgagccggagagggagaaguccgcggccaucgacggggaguaccgccuccgcggcgaggccagaaaaaccuucgucgagcucaugagacgcggggaccucccggucuggcuaagcuauaaaguggcgucagaaggcuuccaauacagcgacagaagguggugcuucgacggcgagcgcaacaaccaggugcuugaggagaacauggacgucgagaucuggacgaaggagggggagcggaaaaagcuccgacccagauggcuggaugcccgcaccuauuccgauccccuugccuugcgggaguucaaagaguucgcagcgggccgccguagcgugagcggagaccugauucuggagaucgggaagcucccccagcaccugacccagcgcgcacagaacgcucuggacaaccuggugaugcugcauaacucugagcagggcgggcgggcauacagacacgcgauggaggagcugccugacacgauagagacgcucaugcuguuagcccucauugcgguccuaaccggcgggguaacccuguucuuccucagcggccggggucuggggaagaccagcaucggcuuacuaugcgugauggcguccucggcccuccuguggaucgcuagugucgagccgcacuggauagccgccagcaucauucucgaguucuuccugauggugcuacucaucccagaaccagacagacagaggaccccgcaggacaaccagcuggccuauguggucauugggcuccucuuuaugauccucacgguggcggcgaaugaaaugggcuugcucgagacgaccaagaaagaccugggaaucgggcacguggccgucgagaaucaccaccacgcagcgaugcuggacguggaccuacacccagccuccgcauggaccuuguacgcgguggcuacgacaaucaucaccccuaugaugcgccacacaaucgagaacaccaccgcgaacaucagucugacugccaucgcgaaccaggccgcaauccucauggggcuggacaaaggguggccgauauccaaaauggacaucggcgucccguuacuggcccuggggugcuacucccaagugaacccccugacccucacggcggcgguucugaugcuuguagcccacuacgcuaucauaggacccgggcuccaggccaaggcuacgcgggaagcccagaagcgcaccgccgcggguaucaugaaaaacccgaccguggacgggaucguagccauagaucuggacccggucguguacgaugcgaaguucgaaaagcaacugggccagaucaugcuccugauccugugcacgucgcagauccucuugaugaggacuacgugggcccugugcgagagcaucacgcucgccacgggcccccugaccacccugugggaaggguccccaggcaaauuuuggaauaccacgaucgcagugagcauggcgaacauuuuccgggggagcuaucucgcaggcgccggccuggccuucucucugaugaagagucucgggggaggccgucggggcacaggggcccaaggagaaacuuuaggcgagaaguggaaacgccagcugaaccaacucuccaagagcgaguucaauacguauaagcgcuccgggaucauggaggucgaucgcagcgaggcaaaagaggggcugaagcgcggcgaaacgacuaagcacgccgugucgagaggcaccgccaaacuucggugguucguggagcguaaccuugucaaacccgaggggaaggugaucgacuuagguuguggcagaggcggguggagcuacuacugcgccgggcugaaaaaggugacggaaguaaagggguacacgaaaggcgggcccggccacgaggagcccaucccuauggccaccuacggguggaaccucgugaagcuccauagcggcaaggacguguucuuuaucccgcccgaaaaaugcgacacccugcucugcgacauaggggagucgucccccaaccccacaauugaggagggccgcacguugcggguccugaaaauggucgagcccuggcugcgcgggaaccaguucugcaucaagauacucaauccauacaugccaagcguagucgagacccuggagcagaugcagagaaagcacggggguaugcucguucgcaauccccucuccagaaacagcacccaugaaauguauugggugaguugcgguaccggcaacauagucucugccguuaauaugacaucgcgcaugcugcugaaccgguuuacgauggcccaccgcaagccgaccuacgagcgcgacguggaucucggggccggcacgcggcauguugcgguggaaccggaaguggcgaaccuggacaucaucggccagcgcaucgaaaacaucaaacacgagcauaaaagcaccuggcacuacgacgaggacaaccccuauaagacuugggcuuaccacgguuccuaugaagucaagccuaguggcagcgccuccagcauggugaacggaguagugaaguuacuaaccaagccgugggacgugauccccauggucacccagaucgccaugaccgacacgacacccuuuggccagcagaggguauucaaggagaagguggacacccgaacacccaaagccaaaaggggcaccgcucagaucauggaggucaccgcuaaguggcuguggggcuuccugucccguaacaagaaaccgcgcaucuguacacgcgaggaguuuacgcguaagguucggagcaacgcggcgaucggcgcuguauucguugacgaaaaccaguggaacuccgcgaaagaggccguggaggacgagcgcuucugggacuuagugcaucgcgagagagagcugcacaagcaggggaagugcgccacgugcgucuacaacaugauggggaagcgcgagaaaaagcucggggaguucggcaaggcuaagggaucccgggccauuugguacauguggcucggcgcgcgcuuucuggaguucgaggcacuuggauucaugaacgaagaccacugguucagucgggagaacagucucucuggaguggagggagaggggcuccacaaacugggguacauccuucgcgacauuagcaaaauccccggugguaacauguacgccgacgacacugccggcugggauacccgcaucaccgaggacgacuugcagaacgaggcuaagaucacggacaucauggaaccggagcacgcgcugcucgccaaguccauauucaaguuaaccuaccaaaauaaaguuguccgcgugcagcggccagcuaagaacgggaccgucauggacgucauaucacgccgugaccagcggggcuccggccaagugggcacauacggccuuaauacuuucacaaacauggaggcucaacugaucaggcagauggagucagaagggaucuucucgcccagugaacuggagacucccaacuuggccgggcgggugcucgacuggcuggaaaaacacggggucgagcgccuaaaacggauggccauauccggcgacgacugcguggugaagccgaucgaugaccgauucgccaccgcccucaccgcuuuaaacgauauggggaagguccgcaaagauauaccacagugggagcccagcaagggcuggaacgacuggcagcaagucccguucugcucacaccacuuccaccaacugaucaugaaagauggaagggagaucgugguccccugccggaaucaggacgagcucguggggcgcgcgcgggugucccagggcgcgggguggucucugcgagagaccgccugccugggaaaguccuacgcgcagauguggcagcucauguacuuccaccgacgagaccugcgacuggccgcgaacgccaucugcagcgcggucccaguggacugggugccgacuucccgaaccaccugguccauccaugcccaccaccaguggaugaccaccgaggauaugcuguccguuuggaaccggguguggaucgaggaaaacccuuggauggaggacaagacccauaucuccucuuggggagaugugcccuaccugggcaagcgcgaagaccaauggugugguucgcugaucggacugacggcccgggcgaccugggccaccaacauccaaguggccaucaaccagguacgucgccugauuggaaaugaaaacuaucuggacuauaugacgucgaugaagcgguucaagaaugagagcgacccggagggugcccucugguga

SEQ ID NO: 24337 - RNA, 9879 nt, Artificial Sequence
  derived and/or modified CDS sequence (opt11) from DENV-1__FJ882556__SS-prME
ucggugacuauguugcucauguugaugcccacagcccuggcauuccacuuaaccacccgggguggcgagccacacaugauagugaguaaacaggagcggggcaaaagcuugcuguuuaagacguccgccggggucaacaugugcaccuuaaucgccauggaccugggcgagcugugcgaggauaccaugaccuacaagugcccacgaaucacggaaaccgaaccugaugacguagacugcuggugcaacgccaccgauaccugggugacuuacgguaccugcagccagacaggcgagcauagacgcgacaaacgguccgucgcccucgcgccccaugucggccuuggguuagagacacggaccgagacguggaugaguuccgagggcgccuggaaacagauacagcgugucgagacgugggcccuccgccacccaggguucaccgugaucgcccuguuccuggcacaugcaaucgguaccagcaucacgcagaaagggauuaucuucauccucuugauguuagugacccccucgauggccaugcggugcgucggcaucgguagccgagauuucguggagggguuaucaggagcaaccuggguagacgucgugcuggaacaugggaguuguguuacgacaauggccaaggacaagcccacgcuugacaucgagcuccugaaaaccgaggucaccaauccggccgugcugcggaagcucugcaucgaggcgaaaauuuccaacaccacgacggacagccgcugcccgacacagggugaggcuacccugguggaggaacaggacgccaacuucguuugucggcgcacauucguggaccggggcugggggaacggcugcggguuguucggcaaggggagccucaucacuugcgcgaaguucaaaugcguaaccaaacuagaaggaaaaaucguccaguaugagaaccugaaguacagcgugaucgugaccguccacacgggugaccaacaccagguggggaacgagucgacggagcacggaaccaccgccacuauaacgccccaggcgccgaccaccgaaauacagcugaccgacuacggggccuuaacucuggacugcucaccacgaaccggccuugacuucaaugaaaugguccugcugaccaugaaggagaaguccuggcucguucacaagcagugguuucucgaucugcccuugcccuggacaucgggagccaguacgucccaggagaccuggaaccggcaggaccuguuaguaacguucaaaaccgcccacgccaagaagcaggaggucguggugcucggcucgcaggagggcgcgaugcacaccgcccugaccggggccaccgaaauccagaccucgggaacgaccacuaucuucgccgggcaccugaaaugccgccucaagauggauaagcugacccugaaggguaugagcuaugucaugugcacugggucuuucaaacucgagaaggagguggccgagacucaacauggcaccgugcuaguccaaauaaaauacgaggggacugacgcccccugcaagauccccuucagcacgcaagacgagaaggggguaacccagaacggucgucugaucacagcuaacccgaucguuucggacaaggagaagcccgucaacaucgaggcagagccgcccuucggggaaagcuacaucgugaucggcgccggcgagaaggcacucaagcucuccugguucaagaaggggagcucuaucggaaagauguuugaggccacugccaggggggcccgaaggauggccauccugggcgauacugcgugggacuucgggagcaucggagguguuuuuaccucugucgggaaguuagugcaccagaucuucggaaccgcguaugguguccuguucagcggagucuccuggacgaugaagaucgggaucggcguucuuuugacguggcucggccugaauagccgcagcaccucgcugaguaugacuuguauugccguggggcuggucacccuuuaccugggugugaugguccaggccgacagcgggugcgucaucaacuggaaaggcagagaguuaaaaugcgggagcgguaucuucguuacgaaugaggugcacaccuggacagagcaguacaaguuccaggccgacucccccaagcguuugagcgcggccaucggcaaggccugggaggaaggggucugcggcauccgguccgccacccgccuggagaacaucauguggaagcagaucagcaaugagcucaaccacauacuacuggagaacgacaugaaguucaccgugguggucggggauguggcaggaauccucgcgcaagggaagaagaugauccggccccagcccauggaguacaaguacuccuggaaguccuggggcaaggccaagaucaucggcgccgacguucagaacacgaccuucaucaucgacgguccuaauacaccggagugccccgacgaccagcgcgccuggaacaucugggagguggaggauuacggguucgggaucuucaccaccaacaucuggcuuaaacugcgcgacaguuacacccaggugugcgaccaccgccucaugucagcggccaucaaggacuccaaggccgugcaugccgacaugggcuacuggauugagagcgaaaagaaugaaacuuggaagcuagcccgggcguccuuuaucgaagucaagaccugcauauggcccaagucacacacccuaugguccaacggcgugcucgagagcgaaaugauuauccccaagauuuauggcgguccgauuucccagcacaacuaccgaccugguuacuuuacccaggcggccggacccuggcaccugggaaagcuggaauuggacuuugacuugugcgagggcaccacgguggucgucgacgagcacugcgguaaccgggggccuagccugcgcacgacaacaguuaccggcaagauaauacaugaguggugcugcagauccugcacuuugccaccccuccgcuuccgcggggaggacgggugcugguacggaauggagauuagacccgucaaggaaaaggaggagaaccugguaaagagcauggugagcgccggcucgggcgaggucgacagcuuuucccucgggcuccuuugcauaaguaucaugauagaggaggugaugcggucccgcuggucgcggcgcaugcucaugaccggcacccuagccgucuucuuccugcucaucaugggacagcugaccuggaacgaccuuauccgccucugcaucauggugggcgcgaacgcuucagaccggauggggauggguacgaccuaccucgcccugauggccaccuuuaaaaugcgcccgauguucgcagugggcuuacuuuuucggcgccugaccagccgggaggugcucuuacuuacgaucggguuguccuuggucgcuucagucgagcugcccaauucgcucgaggagcuaggggacgggcuggccauggggauuaugauccucaagcugcugaccgacuuccagucgcaccagcucugggccacccugcugucccucacuuucauaaagacgaccuucucgcugcacuacgcguggaagacgauggcgaugguucuguccauagugucauuguucccccuuugccuguccacaacgagccagaagacaacuuggcuccccguucugcuuggguccuuaggcuguaagccucugacuauguuccugaucgcugagaacaagauauggggccgccggucuuggccgcucaacgaagggaucauggccguaggaaucgugucuauccugcuguccagcuuacugaaaaaugaugugccccuggcgggaccccucaucgccggcgguaugcugauagcaugcuacguuauauccgggagcucagccgaccugagcuuggagaaggccgccgagguguccugggaagaagaggcggagcacagcggugccucccacaacauccugguggagguccaggaugacgggacgaugaaaaucaaggacgaggagcgggacgacacccugacgauccuccugaaggccacgcugcucgcugugagcggaguuuacccgcugucaauucccgccacgcuguucgucugguacuucuggcagaagaaaaagcaacggagcggggugcucugggacacgcccagcccgcccgagguggagagagcagucuuggacgaugggaucuaccggaucaugcagcgcggccuguuaggacguagccaggugggggugggaguguuccaagagaauguguuccacaccauguggcacgugacccgcggagcgguuuuaauguaccaagggaagcgguuagagccguccugggcuucugugaagaaggacuuaauauccuauggcggaggguggcgccuccaggggagcuggaacacaggagaagagguccagguuauagccguggagcccggcaagaaccccaagaacgugcagacggcccccgguacauucaaaaccccagagggcgaggucggcgccauagcccuggacuucaagcccgggacgucuggcagccccaucgugaaccgggaggguaagaucgugggccuguaugggaacggggucguuacgaccuccggcaccuacgugucggccaucgcccaggccaaggcgucacaggaggggccccugccggagauugaggacgaagucuuccgcaagcggaaccugaccauaauggaucugcaccccggguccgguaaaacgcguagauaccuuccggccaucgugcgagaggccauuaagcgcaagcugcggacgcugauccucgcccccacccgcguagucgcaagcgagauggcggaggcucugaagggcaugccgauccgguaccaaacuacggccguaaaguccgagcauacaggcaaggagaucguggaccugaugugccacgccacguucacgaugagacuccugucucccguccgggugccaaauuacaacaugauaaucauggacgaggcccacuuuacggauccaucaagcauugcggcccguggauacauauccaccagggugggcaugggggaggcagccgccaucuucaugacggcgacgccgccgggcagcgucgaggccuucccgcaguccaacgcggugauccaggacgaggagcgcgacauccccgagcggucuuggaacuccggguacgaguggaucacggacuuccccggcaagacagugugguucguccccagcaucaaguccggcaacgacauugccaacugucugagaaagaacgggaagcgggugauucaacucagccgcaagaccuucgacacggaguaccagaaaaccaagaacaaugacugggauuacguggucacaaccgacauauccgagaugggcgcgaacuuccgggcugacagagugauugauccucgccgaugcuugaagcccgugaucuugaaggaugggcccgagagagucauccuagccggccccaugccggugaccgucgcgagcgccgcgcagagaaggggacgcaucggccgcaaccacaacaaggagggagaccaguauaucuacaugggccagccccugaacaacgaugaggaucacgcccauuggacggaggccaagaugcuacucgauaacaucaacaccccagagggcaucauuccugccuuguuugagccugagcgggagaagucugccgccaucgacggggaguaccgccugcggggagaagcccgcaagaccuuuguggagcucaugaggcgaggggaucugcccguguggcuguccuacaaagucgccagcgaaggcuuucaauauucugaucgacgcuggugcuucgacggagagcggaauaaucaggugcuggaggagaacauggauguggagaucuggaccaaggagggugagagaaagaaguuacggccccgcuggcuggacgcuagaacguacagcgacccacucgcacugcgcgaguuuaaagaauucgcggcuggccggagaucugucagcggagaccugauccucgagaucggcaagcugccgcagcaucuaacccagcgagcccagaacgcccucgacaaccuggugaugcugcacaacucugagcaaggcgggcgcgcguacaggcaugcgauggaggaacuccccgacacgaucgaaacuuuaaugcuucucgcccugauugccgugcugacggguggggucacccucuucuuccuguccggccgcgggcucggcaaaaccuccauuggcuugcugugcgugauggccagcuccguguugcuguggauggcgucugucgagccccacuggauugcggcaucaaucauccuggaguucuuccugaugguguuacugauucccgagccggaccggcagcgcacuccccaggacaaucagcuggccuauguggucaucgggcuccuguucaugauccugacuguggcggcuaacgagauggggcuccuggaaacgaccaagaaggacuuagggauuggccacguggccguugaaaaccaccaucacgccgccaugcuagauguggaccugcaccccgccagcgcguggacacuguacgcgguagccaccacgaucaucacaccaaugaugcgccauaccaucgaaaacaccaccgccaacaucucccucaccgccaucgcgaaucaggcggccauccugauggggcuggacaagggcuggccgaucagcaagauggauaucggugugccccuccucgcccuagguugcuacucccaagugaauccgcuuacgcuaacggcggcaguccugauguugguagcccacuacgccaucauuggaccgggccugcaggcaaaagcgacgcgggaggcucagaagcgcaccgccgcaggcauuaugaagaaucccacgguggacgggaucgucgcuauagaccuggaucccgucguguacgaugcgaaguucgagaagcagcuaggccaaaucaugcugcugauucucugcacaagccagaucuuacugaugcggacgaccugggcccuuugcgaauccaucacccuggcgacagguccccugacgacccucugggaaggguccccagggaaguucuggaacacgaccauagccguguccauggcaaacauauuccgcgggagcuauuuagccggcgccggccucgccuucagucucaugaagucccucgggggcggucgacgcgggacgggugcacaaggcgagacccugggcgagaaauggaagcggcagcuuaaucagcuuagcaaauccgaguucaacaccuacaagcgcagcgguaucauggaggucgaccgguccgaagcgaaggagggccugaaacgcggggagaccacgaagcacgccgugagccgggggaccgccaagcuacgcugguucguggaacgaaaccuggucaaacccgaggggaaagugaucgaccugggcugcggucgcgggggcugguccuacuacugcgccggguugaagaaggugaccgaggucaagggcuauaccaagggggggcccggccacgaggagcccaucccgauggcaacguacggguggaaccuggugaagcugcacaguggcaaagacguguucuucaucccgcccgagaagugcgauacccuccugugcgacauaggagaguccagcccuaacccgaccauagaggagggccggacccugcguguucugaagauggucgagcccuggcuaagggggaaucaguucuguaucaagauacugaaccccuacaugccauccguuguggagacguuagagcaaaugcagcgcaagcacggagguaugcucguucgcaacccacucuccagaaauuccacccacgagauguacugggugucaugcggcaccggcaacauagucuccgcgguuaacaugaccucucgcauguuacucaaccgguucaccauggcucaccgcaagccuacguacgagcgggacguggaccugggggccggcacccgccacgucgcuguggagcccgagguggccaaccuggacaucaucgggcagcggaucgagaauauuaagcaugaacauaaguccaccuggcacuaugacgaagacaaccccuauaagacuugggcguaccacgggagcuaugaagucaagccguccggcagcgcgagcuccaugguaaacggggucguuaagcuguugacgaagccuugggacgugaucccgauggucacacagaucgcuaugaccgacaccacaccauucgggcagcaacgcguauucaaggagaagguugacacccggaccccgaaggccaagcgcggaacugcacagaucauggaggucaccgcgaaguggcuguggggcuuucucagcagaaacaagaagccacggaucugcacgcgggaggaguuuacccgcaagguccgauccaacgcggccaucggcgccguguucgucgacgagaaccaguggaacucagcgaaagaggccguggaggaugagcgcuucugggaccuggugcauagagagcgugagcugcacaagcagggaaaaugcgcgaccugcguuuacaacaugaugggcaagagggagaagaagcucggggaguucggcaaggccaaggggucccgcgccauuugguauauguggcugggcgcgcgguuucuagaguuugaggcccucggauucaugaaugaggaucacugguucagccgcgagaauuccuuaagcggcguagaaggggagggacugcacaaauuaggcuacauccugcgggacauaucuaagauucccgggggcaacauguacgcggacgauaccgccggcugggacacucgcaucaccgaggacgaccugcagaacgaagcgcgcaucacagacauaauggagcccgagcacgcgcuucuggccaagagcaucuucaagcugacguaucagaauaaggugguccggguacagcgccccgcuaagaacgggaccgugauggacgugauaucccggcgggaccagcgaggcucaggccagguugggaccuacggucucaauacuuucacaaauauggaggcgcagcucaucaggcagauggagagugaggggaucuuuagcccuuccgagcuggagacccccaaccucgcagaacggguacuggacuggcuggaaaaguacggcgucgagcgccucaagcggauggcgaucagcggggacgauugcguugugaagccaaucgacgaucgcuucgcgacagcucugaccgccuuaaacgacaugggcaaggugagaaaggauaucccccaaugggagccuaguaaaggguggaacgauuggcagcagguucccuucugcucgcaccacuuccaccagcucaucaugaaggauggcagagagaucgucguuccgugccggaaccaggaugagcuggugggucgagcccggguaagucagggggcgggauggucccuucgggagacggcuugccucggcaaaucauaugcucagauguggcagcuuauguacuuccaccggcgcgaucugagauuagcagcgaacgccauauguuccgccguucccguggacuggauccccacuagccgcaccaccuggucaauacacgcccaccaccaauggaugacgaccgaggacaugcugagcguauggaaucgugucuggaucgaagagaaccccuggauggaggacaagacgcacaucaguucuuggggcgacgugccauaucugggaaagcgggaagaucaauggugcgguagccucauuggucuuaccgcccgcgcuacuugggccaccaacauccagguggcaaucaaccaggucagacgccugauagggaacgaaaacuaccucgacuauaugaccagcaugaagcgguucaagaacgagucggacccugagggcgcccucugguag

SEQ ID NO: 24338 - RNA, 9879 nt, Artificial Sequence
  derived and/or modified CDS sequence (opt11) from DENV-1__GQ199822__SS-prME
agcgugaccaugcuucucaugcugaugcccaccgcccuggccuuccaccuuaccacccgcgggggggagccccauaugaucguuaccaagcaggagcggggcaagagccugcuguuuaaaaccagcgccggggugaacaugugcacccucaucgcuauggacuuaggcgaacugugugaagauacuaugaccuacaagugcccccggauaaccgaagccgaacccgacgacguggauugcuggugcaacgccacggacaccugggucacuuacgggacgugcucacagacgggcgagcacaggcgagacaagcgcagcguggcccucgcgccgcauguagggcuggggcucgagacaaggacggagacauggauguccagcgaaggcgccuggaagcagauacagcggguugagacuugggcccuccgccaucccggguucaccgucaucgcccuguuccuggcgcacgccauaggcaccaguaucacucagaaggggaucaucuucauccucuuaaugcuggugacgcccucgauggccaugcguugcgucggaaucggcucgagagacuucgucgaggggcucagcggugccaccuggguggacguagugcuggagcacgggaguugcgugaccaccauggccaaagacaaaccuacgcuggacaucgagcuucuaaagaccgaagucacgaacccagcuguuuuacggaagcucugcaucgaggccaagaucagcaacaccacaaccgauucccgcugccccacacaaggagaggccacccuuauggaagagcaggacgccaauuuugugugccggcgcacguuuguggaccgcggcugggggaacggcugcgggcuguucggcaaggggagccucaucacgugcgcgaaguucaagugcgucaccaagcucgaaggcaagaucgugcaauacgagaaccuuaaguacagcgucaucgugacggugcacaccggagaccagcaccagguggggaaugagucgacugagcacggaacgaccgcgaccaucacuccucaggcaccgaccucugagauccaacucacggacuacggugcacuaacccuggacugcucgccccgcacaggacucgacuucaacgagaugguacugcuaacaaugaaggagaaguccugguugguacacaagcagugguuccuggacuugccccuccccuggacuagcggggccagcaccucccaggaaacguggaacagacaggaccuguuggugaccuuuaaaacagcccacgcuaagaagcaggagguugugguauugggcagccaagagggcgccaugcacaccgcccugacgggagccaccgagauccagacuuccgggacaacgaccauuuucgcugggcaucugaagugccgccucaaaauggacaagcugaccuuaaagggcaugucuuacgugaugugcacuggauccuucaagcuagagaaggagguagcggaaacgcagcauggcaccgugcugguccagaucaaguacgagggcaccgacgccccgugcaagauccccuuuucaacucaggaugagaagggcgugacgcagaacggccggcugaucacggccaacccgaucguaaccgacaaggagaaaccugucaacaucgaggcggagccgcccuuuggugaauccuacaucgucaucggagcaggagaaaaggcccugaagcucucgugguucaaaaagggauccucuaucggcaagauguucgaggcuacagcccgcggggcucggcgcauggcaauucuuggggacaccgccugggacuucggguccgugggcgggguguucaccucugucgggaaguugguacaccagaucuucggcaccgccuacggugugcucuucucgggcguuucguggaccaugaaaaucgguaucgguguauugcugacuuggcucggccugaacuccaggucaaccucccuuagcaugaccuguaucgccguggggcuagucacgcuguaccugggcgucauggugcaggccgacuccgggugcguaaucaacuggaagggcagagagcucaaguguggaagcggcauuuuuguaaccaaugagguucauacuuggaccgagcaguacaaguuccaggcagacucacccaagcgacuguccgcagcuauaggcaaggccugggaggaggggguauguggaauccggagcgcgacucgccuggagaacaucauguggaagcagauuucuaacgagcucaaccacauccugcuggagaaugauaugaaauucaccguagugguuggcgauguggugggcauauuggcgcagggaaagaagaugaucagaccccagcccauggaacacaaguauaguuggaaauccuggggccgcgccaagaucaucggcgccgacgugcagaacacgaccuuuaucauugauggccccaacaccccggagugccccgacgaccaacgggccuggaacauuugggagguagaggacuacgguuuugggaucuucacaacgaauaucuggcugaaacugcgcgacagcuacacccaggugugcgaccauagacucauguccgcugcgauaaaggacagcaaggccguccacgccgacaugggcuacuggaucgaguccgaaaagaaugagacuuggaaguuggcccgcgcgaguuucaucgaggugaaaaccugcaucuggcccaagucgcauacgcuuuggaguaacgggguucucgaauccgaaaugaucaucccaaagauauacgggggcccgaucucccagcacaauuaucggcccggcuacuucacccagacagcgggccccuggcacuuagggaagcuggaguuagacuucgaccuaugugagggcaccacugucgugguggacgagcacugcggaaaucgcggccccucgcuacggaccaccacugucacgggcaaaaucauacacgaguggugcugccgcagcugcacccugccgccccucagguuuaagggggaggacggaugcugguaugggauggagauccgccccguuaaggagaaggaggagaaccucguaaagaguauggucagcgccgggagcggugagguggacagcuuuagccucggacugcuaugcaucucuaucaugaucgaggaggugaugcggagccgcuggucgcggaaaaugcucaugaccggcacccuggcaguuuucuuacuccucaucaugggacagcuaacuuggaacgaucugauacgucugugcauaauggugggagccaacgcgucugaucgcauggggaugggcacgaccuaccucgcgcugauggcgaccuucaagaugagaccgauguucgccgugggccucuuauuccgccggcucacgucccgagagguccuguugcucaccaucgggcuguccuuaguggcgucggucgagcuucccaacuccuuggaagagcuaggcgaugggcucgcgauggguaucaugauccugaagcuauuaaccgacuuccagucccaccaacugugggccacgcugcucucacugacguucaucaagaccacucugucccuucacuacgccuggaagaccauggcuauggugcuaaguaucguaucccucuucccccucugucuaagcacgacgucccagaagaccaccugguuacccgugcugcuggggagcuugggcugcaagccacucacgauguuccugaucaccgagaacaaaaucugggggcguaaguccuggcccuuaaacgaggggaucauggcugugggcgugguuuccauucucuuauccucgcugcucaagaacgacguucccuuagccgggccccugauugcaggcggcaugcucauagcguguuaugucaucagcggguccagcgcggaccugagccuagaaaaagcggcugaggucagcugggaggaagaggccgagcacagcggcgccagccacaacauacucguagaggugcaagacgacggcaccaugaaaaucaaagacgaggagagagacgacacccugacaauccugcucaaggcgacacugcuggcggucuccggcguguacccgcucucaauuccagccacccuuuucgucugguacuucuggcaaaagaagaagcaacgaagcgggguccugugggauacccccagcccgccugagguggagcgcgccgugcuggacgacgggaucuaucgaaucaugcagcgcggccugcuggggaggucucaggucgguguugggguuuuccaggagaacgucuuccacaccauguggcacgugacccgcggcgccguucugauguaccaggggaaaaggcucgagcccagcugggccucugucaagaaggaccugaucucuuacggcggcggcuggcgccugcagggcucauggaacaccggggaagaaguccaggugaucgcggucgagccgggcaagaauccuaagaacguccaaacugccccagggaccuucaagacgcccgaaggugaggucggagccaucgcucucgacuucaagccggggaccagcggcucgcccaucgucaaccgcgaagguaagauugugggucuguauggcaacgggguggucacaaccucgggcacguacguuagcgcgauugcgcaggccaaggccucucaggagggcccgcugccagaaauagaagacgagguguuccgcaagcggaaucucacaauaauggaccuacacccgggcucggggaagaccagacgguaucugccggcccucguucgagaagcgauaaagcgcaagcugcgcacccucauccuggccccuacgcgugugguugcauccgagauggccgaggccuuaaagggcaugccuauccgguaccagacaaccgcgguuaagagcgagcauacuggcaaggagaucguggaccugaugugccacgcgacauucaccaugcgcuuacugaguccaguaagggucccgaacuacaacaugaucaucauggacgaggcucacuucaccgaucccagcucuaucgccgccagaggcuauaucagcacccggguaggaaugggcgaggcggcagcaaucuucaugacggccaccccgcccggguccguggaggcguucccgcaguccaacgcggucauucaagacgaggaacgcgacauccccgagcguuccuggaauagcggguaugaguggaucaccgacuucccuggcaagaccgugugguucguucccaguaucaagagcggaaacgauauugccaauugccugcguaagaacggaaagcggguaauccagcucucccgcaagacguucgacaccgaguaccagaagaccaagaacaaugacugggacuacguagucaccacggacaucagcgagaugggcgccaacuuccgagcugaccgcgucaucgacccuagacggugcuugaagccagugauccucaaggauggucccgagcgggucauccucgcgggccccaugccggugacugucgcguccgccgcccagaggcgggggcgcaucggccgaaaccacaacaaggagggcgaucaguacaucuauaugggucagccccugaacaacgacgaggaccacgcccacuggaccgaggcaaagaugcugcucgacaacaucaacaccccugagggcaucauaccagcccuguucgagccagaaagagagaagucagccgccaucgacggagaguauaggcugcggggcgaggcucgaaagacguucgucgagcuuaugcggcgcggggacuugcccgugugguuguccuacaagguggcaucugagggcuuccaguacagcgaccggcgcuggugcuucgacggcgagcggaacaaccaggugcucgaggagaacauggacguggaaaucuggaccaaagagggggagcgcaagaagcugcgacccagauggcuggacgcgagaaccuacuccgacccccucgcccuacgugaguuuaaggaguucgccgcgggccggcgcagcgucuccggugaccuuauccucgagaucgguaaauugccgcagcacuugacccaacgggcacagaacgcccucgacaacuuagucaugcugcacaacagcgaacaaggcgggagagcuuaccggcaugccauggaagagcuccccgacacgaucgagacucugaugcugcuugcacugaucgccgugcugaccggcggggucacgcucuucuuccugucuggccgagggcuuggcaagaccagcaucggccuucugugcgucauggcguccagcgugcugcuuuggauggccuccguggagccucacuggaucgccgcgucgaucauacucgaguuuuuucugaugguacuccugauccccgagccggaccgccagaggacuccccaagacaaccagcuggccuacgugguuaucgggcuccuguuuaugaucuuaacaguagccgcgaacgagaugggauuacuagagaccaccaagaaggaccucggcauuggccacguggccguugagaaccaucaccacgcgacgaugcucgacguugaccugcaucccgccuccgccuggacucuguacgccguggcuaccacuauuaucacgccgaugaugcggcauaccaucgagaacaccacggccaacaucagccucacggcgauugccaaccaggccgcaauccugauggggcuugacaagggcuggcccaucuccaagauggacaucggcgugccacuuuuagcacugggguguuacagccaggucaacccucucacccugaccgcugccgugcucaugcucguggcccacuacgcaauuauuggcccggggcugcaagcaaaagccacacgcgaggcacaaaagcgcaccgccgcuggcaucaugaagaaccccaccgucgacgggauuguggccauugaccuggaccccguggucuaugacgccaaguucgagaagcagcucggccagaucaugcugcugauccucugcaccucccaaauccuccugaugcggacgacgugggcccuaugugaaagcaucacccuggcuacgggcccccugaccacgcucugggaagguuccccaggaaaguucuggaacaccacuauagccguaagcauggccaacaucuuccgcggauccuaccuggcaggggcuggucuggccuuuagccucaugaaaucccucgguggcggucggcgagggacaggagcgcagggcgagacgcugggcgagaaguggaaacggcagcuaaaucaguugucaaaaagcgaguucaacauauacaaaagaagcgggaucauggagguggaccgaagugaagccaaggagggcuuaaagcgcggagagacgacccgacacgcggucucccgcggcaccgccaagcugcggugguuuguagagcgcaaucucgugaagcccgaagggaaggucaucgaccugggcugcggcaggggcggguggagcuacuacugugccggauuaaagaaggugacggagguaaaaggauacaccaaaggcggaccgggacacgaggaacccaucccgauggccaccuauggguggaauuuggucaaacuucacucgggcaaggacguguucuucacuccccccgagaaaugcgacacucugcucugcgacauuggggagagcucgccuaacccaaccaucgaagagggccgcacccugagggugcugaagaugguugagcccugguuaagagggaaccaguucugcaucaagauacucaacccguacaugcccagcgugguggagacccuagagcagaugcagcgaaagcacggcggaaugcucguccgcaacccgcugucccggaacaguacacacgaaauguauuggguguccugcgggacaggcaacaucgugagcgccgucaacaugaccucgcgcaugcugcugaaccgcuuuaccauggcacaccggaagcccacguacgagcgcgacguagaccuaggggccggaacgcgccacguugcgguggaacccgagguggccaaccuggacaucauuggccagcgcaucgagaacaucaagcacgagcauaagagcacguggcauuacgacgaagacaaccccuacaaaaccugggcuuaccaugguuccuaugagguuaagccgaguggcagcgcuaguucaauggugaaugggguugucaagcuccugaccaagccgugggacgugauacccauggugacgcagaucgccaugaccgauaccacccccuuuggucagcagcgggucuucaaagagaaaguagacacgagaacuccaaaggcgaagcgggggaccgcacagaucauggaagugaccgcccgcuggcugugggguuuccucagcaggaauaagaagccccggaucugcacucgggaggaauucacucgcaagguucgaagcaacgccgccauaggggcgguguucgucgacgagaaccaguggaacucagccaaggaggccgucgaagacgagcgcuuuugggaccugguucagaaagagcgggaacuacauaaacaaggcaaaugcgcgaccugcguguacaacaugaugggcaagcgcgagaaaaagcucggggaguucggaaaagcgaaggggagccgagccaucugguacauguggcugggagcccgauuccuggaguucgaggcccucggcuucaugaacgaagaccauugguucucccgggagaacagccuguccggggucgaaggcgagggauugcacaaguuggguuacauccugcgcgacaucagcaaaauccccggcggcaacauguaugccgaugacaccgcgggaugggacacgcggauaaccgaggacgaccugcagaacgaggcaaagauuaccgauaucauggagccggaacacgcacugcuggccaccucuauuuuuaagcugaccuaccagaacaaaguggugcgcguccagcgaccugcaaaaaacggaaccgugauggaugugauuagccggagagaccaacggggcuccgggcaggucggaacauauggccucaacacguucacgaacauggaggcgcaacugauccgccagauggagagcgaggggaucuuccugcccuccgagcuggagacccccaaucuggcggagcgggugcuggauuggcucgagaaguacggcguggagcgccugaagcguauggcgaucagcggggacgacugcgucgugaagccgauugacgacagauuugccaccgcccugaccgcccucaacgacaugggcaaggugcggaaggauaucccccagugggagcccaguaagggauggaacgauuggcaacagguccccuucugcucccaccauuuccaccagcuaauaaugaaagacggccgcgagauuguagucccgugccggaaccaggacgaguuagugggcagggccagagugucccagggggcuggcuggucucuccgcgagacggccugucugggcaagaguuacgcccagauguggcagcugauguacuuccaucggagagaucuccggcuggcagcgaaugccaucugcuccgccgugcccgucgacugggugccgacgucgcgcaccacuugguccauccacgcgcaccaccaauggaugacgaccgaagauaugcugagcguguggaacagggucuggaucgaggaaaacccuuggauggaggacaagacccauguguccucguggggcgacgugccuuaccucgggaagcgagaggaucaguggugcggauccuuaaucggccugaccgcccgcgcaaccugggccagcaacauccagguugccaucaaccaagugcgacgccucauagggaacgagaacuacuuagauuacaugacguccaugaagcgguucaagaacgagggcgaccccgaaggggcgcugugguag

SEQ ID NO: 24339 - RNA, 9879 nt, Artificial Sequence
  derived and/or modified CDS sequence (opt11) from DENV-1__FJ882557__SS-prME
ucuguaacuaugcuacuaaugcuaaugcccaccgcgcuagcuuuccaccuaacgacaagagggggcgaaccccauaugauagucaguaaacaagagcguggaaaaagccuucuauucaaaacuucagccgguguaaacaugugcacccuuaucgcaauggaccuaggggaguuaugcgaggauacaaugacguacaaauguccgcguauuacggaggcagagcccgacgaugucgacugcuggugcaacgcuaccgacacuuggguaacguacgggacuugcucacaaaccggagaacaccggagggacaaaagaaguguggcauuagcuccacacgucggacucggccucgaaacccguaccgagacguggaugagcagugagggggcuuggaagcagauacagcgaguagagaccugggcgcuccggcaccccggguucacagugaucgcacuauuucucgcccacgcaaucggaacgucaaucacccagaaggguauaauauucaucuugcugaugcuaguuacaccaagcauggcgaugagaugcguuggcauaggaagucgagacuucguugaagggcugucaggugcaacuugggucgacguaguccuagaacacggcaguugcguaacaacaauggcgaaggacaaacccacccuagacaucgagcuguuaaaaaccgaagugacgaacccugcggucuuacgcaagcuaugcauugaggcaaagaucaguaacacuaccaccgauagcagaugcccaacccaaggcgaagccaccuuaguagaggaacaggacgcgaacuuuguuugcagacgaaccuucguagacagaggauggggaaacggcugcgggcucuuuggaaaaggcagccugauaaccugcgccaaauuuaaaugcgucaccaaacuugaaggcaagauaguccaauacgaaaaccucaaauacagcguuaucgucaccguccacacuggagaccagcaccaaguagguaacgagucgacagaacacggaacgaccgcgacaauaacaccccaggcaccaacuaccgaaauccagcuaacggauuauggggccuuaaccuuagauugcucgccaaggacaggauuggauuucaacgaaauggucuuacucaccaugaaagaaaaaucauggcugguccauaaacaaugguuccuggaccugccccuacccuggacguccggagcgaguaccucgcaagagacguggaaucgacaggaucuacugguuaccuucaagacagcgcaugccaagaaacaagaaguagugguucuugguucgcaggagggcgccaugcacacggcccuuacaggcgcaaccgaaauacaaacgucugguaccacaaccauauucgcaggacaucugaaaugccgcuuaaagauggacaagcuaacucugaaaggcaugucguacgugauguguacugggagcuuuaaacucgaaaaagagguggcagagacacaacacgggacaguacucguccaaaucaaauacgagggcaccgacgcgccguguaagauaccauucucaacgcaagacgaaaaaggcgucacccaaaacggcagacucaucacggccaacccuaucgugaccgauaaagaaaagccaguaaauaucgaggcggaacccccauucggcgaguccuauauugucauaggcgcaggagaaaaagccuugaagcuaagcugguuuaagaaagggucuuccauaggcaaaauguucgaagccacagcccgcggggcacgacgcauggcgauacuuggggauacggccugggacuucggaagcaucggaggaguguucacaucgguugggaagcugauucaccagauauuugggacggcauacggggugcuguuuagcgguguaagcuggacgaugaaaauaggaaucggugugcuccugaccuggcuaggccucaauucgaggaguacaaguuuauccaugaccugcauagccgugggacuuguaacguuauauuugggaguaaugguacaagcggauagcggaugcguuauaaauuggaaaggaagggaacucaaaugcgguagcggaaucuucgugacaaacgaaguacacaccuggaccgagcaauauaaauuccaagcagacucaccgaagcgccuauccgcggcaauuggaaaagcgugggaggaaggaguaugcggaauacgauccgccacacgucucgaaaacauaauguggaagcaaauaaguaacgaauuaaaccacauccuucucgaaaaugacaugaagcuaacaguaguagucggagacgucgcaggcauucucgggcaagggaaaaagaugauacguccucagcccauggaguauaaauacucguggaagucauggggaaaggcaaaaaucaucggggcugaugcgcagaacaccaccuucauaaucgacggccccaacacgccagaaugccccgacgaccagcgggcuuggaacauaugggaagucgaggacuauggguucgggaucuuuacuacaaauaucugguuaaaacuacgugacagcuauacacaagucugugaccaccgccucaugucagcagcuauaaaagacuccaaagcgguucacgccgacaugggcuacuggaucgaaucagaaaagaaugagacauggaagcuggcucgagccagcuucauagaaguaaaaacaugcaucuggccgaaaagucauacacuauggucaaacggaguucuggaaagcgagaugaucauccccaaaauauacggcggacccaucucacaacacaacuauagaccagguuacuucacccaaaccgccggccccuggcaccucggcaaauuggaacuugauuucgaccucugugagggaacaaccgucgugguagacgaacauugcggaaaccggggcccaagccucagaaccacgacggucacgggaaagauuauacacgaguggugcugccguagcugcacccuuccaccccuacgguuccgaggagaggacggcuguugguacggcauggaaauccggccgguuaaagagaaagaagagaaccucguaaaaagcaugguuucagcuggcuccggugagguagauagcuucaguuuaggguuauuaugcauaucgauaaugaucgaagaggucaugcgcagcagauggucgaggaaaaugcucaugacaggcacccucgcugucuuuuucuuacuaauaaugggacagcugaccuggaacgaucucauucgccuuugcaucaugguuggggcaaacgccuuugaccgcaugggcaugggaaccaccuaccuugcccucauggcgaccuucaaaaugcgcccgauguucgccgugggacuacuauucagacggcuaacuagccgcgaaguacuuuuacuuacaauagggcugagccuggucgcgucgguggaacuuccuaacagccuggaggagcucggagauggccuagccauggggauuaugauccugaagcuacucacugacuuccaaagccaucaacuaugggcgacccuacucuccuuaaccuuuauaaagacgacguuuaguuuacacuacgcauggaagacaauggcaaugguacugagcauagugucacuuuucccgcuaugccuuagcacaacaucccagaaaaccacguggcuccccgugcuucucggaagccuaggcugcaagccacuaaccauguuccuuauagcagagaacaaaaucuggggaaggaagucuuggccauugaacgaaggcaucauggcggucggcaucguguccauucugcuaucuucucugcugaagaacgacgucccccuagcagggccacuaaucgccggcggcaugcuuaucgcaugcuaugucaucucagggagcucugcggaccuaucacuagagaaagccgccgaggucucaugggaggaggaggcagagcauagcggagcaagucacaacauccuaguagaaguccaggaugauggaaccaugaaaauaaaagacgaagagagggacgacacucugaccauacuccuaaaagcaacccuguuggcugucucuggcguuuacccccugucuauaccggccacacuauucgugugguacuuuuggcagaagaagaaacaaagaucuggcguccuuugggacacuccuucaccgccagaaguggaaagagccguacucgacgacggaaucuacaggauaaugcaaagagggcuccuuggacggagucaaguaggagucggagucuuucaggaaaacgucuuccauacaauguggcacguaacacggggcgccguacuaauguaucaaggaaaacgacuagagccaucaugggccagcgugaagaaagaccuaauuucguauggcgggggcuggcgacucagagguagcuggaacacuggugaggaggugcaagugaucgccguggagccgggcaaaaaucccaagaacguacaaacagcucccggcacuuucaaaacccccgagggcgaaguuggagcuauagcacucgacuucaaaccagggacauccggaagcccaaucgugaaccgugaaggcaaaauaguagggcuauacgguaacggugucgucaccacuuccgggacguauguuucagcaaucgcacaagccaaagccagucaagaagguccccuaccagaaaucgaggaugaaguuuucagaaaaaggaaccuaaccauaauggaccuacacccuggcagcggcaaaacaaggagauaucugccagccauagugagggaggcuaucaagcgaaaacuccggacacucauucuugccccaacucggguaguagcaagugaaauggcggaagcgcuaaaggguaugcccauaagguaccaaacuaccgccgucaaguccgaacacaccggaaaagaaauaguggaucuuaugugucacgcaacauucacgaugcgccuccugaguccaguccggguaccgaacuauaacaugauaaucauggacgaagcucauuucacagaccccucgaguaucgcagcaagaggauacauauccacuagagugggcaugggugaagccgcggcaaucuucaugacggccacgccgcccggcucagucgaagcauucccacagagcaacgcggugauccaggaugaggaacgcgacauaccugaacguucguggaacuccggacacgaauggauaacagacuuuccgggaaaaacuguaugguucgucccgucgaucaagagcgggaacgauauagcuaacugccuccgcaaaaacgguaagcgaguaauccagcucagcagaaaaacguucgacacugaguaccagaaaacaaagaauaacgacugggacuacguaguaaccaccgacaucucugaaaugggggcgaacuucagagcagaucgggucaucgacccccgacgauguuuaaagccaguaauuuuaaaggaugggccagaaaggguaauucuagccggucccaugccgguaacgguagccucggcggcccagcgucgggggagaauaggccgaaaccacaacaaagaaggagaccaguacauauacaugggccaacccuuaaacaacgaugaagaccacgcucacuggaccgaggcaaagaugcucuuggacaacaucaacaccccagaggguauaaucccagcauuauucgaaccggaaagggaaaagucggccgcagucgacggcgaguaucgguuaagaggcgaggcacguaagacguucguggaacugaugaggagaggcgaccuaccugucuggcucucauacaaaguagccucagaagguuuucaauauagcgacaggcguuggugcuucgacggggaaagaaacaaccaaguacuggaagagaacauggauguugagaucuggaccaaagaaggggaaagaaagaaacugcgaccacgguggcuagacgcaaggaccuacuccgacccccucgcacuacgagaguucaaagaguucgccgcaggccggcgcucugucucgggggaccuaauccuagaaaucgggaaacugccgcaacaccugacgcagcgagcccaaaacgcccuggauaacuuagugaugcuccacaacagugagcagggagggagggcauaccgccaugcuauggaagaacuaccagacacaaucgagacacuaaugcuacuggcccugauagcaguucucacagguggcguuacacuauucuucuugucggggagaggcuuagguaaaacaagcaucggacuucugugcgucauggcuaguucaguacuccuauggauggcgucgguagagccccacuggauagcagcaucgaucauccucgaauuuuucuuaaugguacuacucaucccagaaccggaccggcaacgcacuccacaagauaaucaacuugcuuauguuguaaucggucuacuuuucaugauauuaacgguggcagccaaugaaauggggcuucuggagacgacaaagaaggaccuagguauugggcacguagcagucgaaaaucaccaccacgcggcgaugcuugacgucgaccuacacccggcgagugccuggacccuuuacgccguagcaaccaccauaauuacgcccaugaugcgacacacgauagaaaacaccacugcaaauaucucccugacagcaaucgcgaaccaagcagccauacucaugggccuagacaaaggguggcccauaaguaaaauggauauaggcgucccacuguuagcacuaggguguuacucgcaaguaaacccccuaacuaugacggcagcaguauuaaugcucgucgcacacuacgccaucaucggacccggauuacaagcuaaagccacaagagaagcucagaaaagaacagcagcggguauaaugaagaacccaaccguugacggaauagucgcgauugaccucgacccagucgucuacgacgccaaauucgagaagcaacuaggccaaaucaugcuacucauccuaugcacuucacagauccuacucaugcgaaccacaugggcucugugugagagcaucacacuagcaaccgggccucucacaacacugugggaagggucacccggaaaauucuggaauacgacaauugccguaucuauggcaaacauuuuccgagggucauacuuagcuggcgccgggcuugcguucagccucaugaaaucccuaggagggggcagacgcggcacgggcgcccagggcgaaacauugggagaaaaauggaagcgacagcuuaaccaacuaucuaaaagugaguuuaauacuuacaaaagaucagggauaauggaaguagaucgcagugaggcaaaagaaggccugaaaagaggggagacgacaaaacaugccguaucccgcggaacggcgaaacuacgcugguucgucgaacggaaccucgucaagccagaggguaaggucauagaccucggcugugggcgaggaggguggucauacuacugcgcgggacucaagaaagucacagaaguaaaaggcuacacuaagggcggccccggucacgaagaaccgauaccaauggcgacauacgguuggaaccuagucaaacuccauucaggcaaagaugucuucuucauaccacccgaaaagugugacacucuuuuaugugacaucggggagucaaguccaaacccaacgaucgaggagggccgaacccugagaguccucaagaugguggaacccugguuaagaggaaaccaauucuguaucaagauauugaacccauacaugccgagcgucguagaaaccuuggaacaaaugcagcgcaaacacggagggaugcucguacgcaacccgcuaucccgaaacucaacgcaugaaauguauugggucagcugcgggacuggcaacaucgugucagccgucaacaugacaucgcggaugcuacugaacagauucacaauggcccaccggaagcccacauaugagcgggacguugaccucggaacggguacccggcacguagcagucgaaccagaggucgcaaaccucgacauuauaggacagcggauagaaaacaucaagcacgaacacaaaucuacauggcacuacgacgaagacaacccauacaagaccugggcauaccauggcagcuaugaaguuaaacccaguggaucagcgagcucaaugguaaauggcgugguaaaacuccugacuaagccgugggacgucauacccaugguaacacaaaucgcgaugaccgacacgaccccuuucgggcagcaacgggucuucaaagaaaaagucgauacgcgcaccccuaaggccaaaaggggcaccgcacaaaucauggaagucacggcgcgcuggcuauggggauuuuuaagcagaaacaagaaaccgcggaucugcaccagggaggaguucacucggaaaguacgcucgaacgccgcgauaggagccguguucguagacgaaaaucaguggaacagcgcgaaagaagcgguagaggacgaaagguucugggaccucgugcaucgcgaacgcgaacuccauaaacagggcaaaugcgcgaccugcguauacaacaugauggguaagcgggagaagaagcucggugaauuuggcaaagcuaaggggucacgcgccaucugguacauguggcucggagcgcguuuccuagaguucgaagcacucggcuucaugaacgaagaucacugguucagccgcgaaaacucccucagcggaguugaaggcgaggggcuccauaaacuaggguauauccuaagagacauauccaaaauaccaggcgggaacauguaugcggacgacaccgcaggaugggauaccagaaucacagaagaugaccuucaaaacgaagccaaaaucacagacauaauggaaccugaacacgcacugcuggccaaagcgauauucaagcucacguaucaaaacaaggucguuagagugcagcggccugcgaaaaacggaacagucauggacgucaucucgagacgggaccaaagaggcucaggucaagucgggacguacggacucaacacuuucacgaacauggaagcacaacucauucgucaaauggaaucggagggaaucuuuucuccaucugagcuagagacgccaaaucuugcagaaagagcguuagauuggcuugagaaauacggcguagaaagacucaaaagaauggcgaucuccggagacgauugcgucgucaaaccgauugacgaccgauucgcaacggcacuaacagcgcuuaacgacauggguaaaguccgcaaagacaucccacaaugggagcccagcaagggauggaaugacuggcaacaggucccuuucuguagccaucacuuccaccagcuaauaaugaaagacggccgagagauagugguaccguguagaaaucaagacgagcucguugggcgagcaagggucagucaaggggcugguuggagccugagggaaacagcaugucuggggaagucauaugcacagauguggcagcucauguauuuccacaggcgcgaucuccgccuagcagcaaacgcaaucugcuccgccguaccugucgauugggucccaacaucacguacgaccuggucaauccaugcacaccaucaauggaugaccacagaagacaugcucuccgucuggaacagagucuggauugaggaaaaccccuggauggaggacaaaacgcauauaucaucaugggaagacgucccauaccuagggaaacgugaggaucaguggugcggcagcuuaauagggcuaacggcacgcgccaccugggccacgaauauccagguagcuauaaaccaaguccgccgacucauaggcaacgagaacuaucuagacuacaugaccuccaugaagagguuuaaaaaugaaucggaccccgagggagcgcugugguga

SEQ ID NO: 24340 - RNA, 9879 nt, Artificial Sequence
  derived and/or modified CDS sequence (opt11) from DENV-1__FJ882558__SS-prME
agcgugaccaugcugcucaugcugaugcccaccgcucuggcuuuccaccucacgacccggggcggggagccccacaugaucgugagcaagcaggagcggggcaagagccugcuguucaagaccagugccggggugaacaugugcacacucaucgccauggaccugggcgaguucugcgaggacaccaugaccuauaaauguccccgcauaaccgaagccgaaccagaugacguggacugcuggugcaacgccacggacaccugggucaccuacgguaccugcucucagaccggcgagcaccggcgggacaagcgguccguggcguuggcgccccacguugggcucgggcuugagacucgcaccgagacauggaugagcuccgagggagccuggaagcagauccagcggguggagacuugggcccugcgccaccccggcuuuacagugaucgcccucuuccuggcacaugccaucggcacgucuaucacgcagaaagggaucaucuucauccugcucauguuagugaccccguccauggccaugcguugcgucggcaucggcagccgcgacuucguggaggggcuguccggcgccacguggguggacguugugcuggagcacgggucgugcgucaccacgauggccaaggacaagcccacccuggacaucgaguuacuaaagacagaggucaccaacccugcggugcugcggaaguugugcauagaggcaaagaucucuaacaccacgacagacucacgcugcccgacccagggggaggccacccugguggaggagcaggacgccaacuucgucugccggcguaccuucguggaccguggcuggggaaacggcugcgggcuguucgggaaggggucccugaucacgugcgcuaaguucaagugcguaaccaaacucgagggcaagacuguccaauacgagaaccugaaguacagcgugaucgugaccguucauacaggugaccagcaccaaguggggaacgaguccaccgagcauggcaccaccgcgaccaucacgccccaggccccaagcaccgagauccaauuaaccgacuacggggcccucacccuggacugcucaccccgcaccggacuggacuucaacgagauggugcugcugaccaugaaggagaaguccuggcuggugcacaagcaaugguuccucgacuugccacugccauggacaagcggggccuccacaucacaagagacguggaacagaaaagaccugcuagugaccuucaagaccgcccaugcgaagaaacaggagguuguggugcugggcucccaggagggcgccaugcacacggcccucacgggggcaaccgaaauccagaccagcgguaccaccacuauuuucgccgggcaccuaaagugccgccugaaaauggacaaauugacauugaagggcaugagcuacgucaugugcaccgggagcuucaagcuugagaaggaaguggcggagacgcagcacgggacaguguuaguccaaaucaaguacgagggaaccgacgcccccugcaagaucccuuucuccacccaggaugaaaagggggugacgcagaauggccgguugaucaccgccaacccgaucguuaccgacaaagagaagcccguuaacauugaggccgagccacccuuuggagagagcuacauagucauaggcgcuggcgagaaggcgcuaaaacuguccugguucaaaaaggggagcucaaucggcaagauguucgaggccaccgcccgcggggcccggcgcauggcgauccucggcgacacggccugggacuucgggucuaucgggggcguguucaccuccgucgguaagcugguacaccagauuuuuggcaccgccuacggggugcuuuuuagcggcgucucguggacgaugaagaucgggaucggcgugcuccugacguggcugggccucaauagccgcuccaccagccugucaaugacaugcaucgccgucgggcuggucaccuuguaccugggcgucauggugcaggccgauagcggaugcgugauaaacuggaagggccgggagcugaagugugguagcggcauauucgugacaaacgaggugcacaccuggacggagcaauacaaguuccaggccgacucccccaagcgccucagcgccgcaauuggcaaggccugggaggagggggucugcggcauccgauccgccacccgccucgagaacauaauguggaagcaaaucagcaacgagcucaaccacauacugcuggagaacgacaugaaauucaccguggucgucggggacguagcgggcauccuggcccaggggaagaagaugauccggccccaacccauggaauacaaguauuccuggaagaguuggggcaaggcgaagauuauuggcgccgacgugcagaauacgaccuucaucaucgacgggcccaacaccccugagugccccgacgaccagcgugcguggaauaucugggaagucgaagacuacggcuucgggaucuucacaacgaacauuuggcuuaagcuacgggacucauacacccaggugugcgaccaccgccugaugagcgcggccaucaaggauuccaaggccguucacgccgacaugggcuauuggaucgagagcgagaagaacgaaaccuggaagcucgcgagggccuccuuuaucgaggucaaaaccugcauuuggcccaaaucccacacgcugugguccaacggcgugcuagagagcgagaugaucauccccaaaaucuacggaggcccuaucucccagcacaacuaccgccccggauauuucacccagaccgccggccccuggcaucucgggaagcuagagcuggacuuugaccucugugagggcaccacuguggucguggacgaacacugcggcaaccgcgggccgagucugcguaccaccaccgugacgggcaagaucauccacgaauggugcugcagguccugcacccugccaccauuacgcuucaagggugaggacggcuguugguacgggauggagauucggccagucaaagagaaagaggagaaccuggugaagucaauggugagugccggcuccggcgaggucgacagcuucaguuuagggcuccugugcauuuccaucaugaucgaagaagucaugcggucacgcuggagcagaaagaugcuaaugaccggcacccucgcaguguucuuccugcugaucaugggacaacucacguggaacgaccugaucagacuauguauuauggucggcgcaaaugccuccgaucgaauggguaugggcaccaccuaccucgcccugauggccaccuuuaagaugcgcccaauguucgccgucggucuccuguuucggcgucuuacgagccgggaggugcugcuccugaccaucgggcuguccuuagucgcgagcgucgagcugcccaauucgcuggaggagcucggcgacggucucgccauggguauuaugauacugaagcuccugacggacuuccagagccaccagcugugggccacuuugcugucccuuacguucaucaagaccaccuucucccuccacuacgcuuggaagaccauggcgauggugcuguccaucgugagccuguucccucugugucuguccacgaccagccagaagaccacauggcugcccguucuccugggcucccuggggugcaagccgcucacgauguuccucaucgccgagaacaagauauggggccguaagagcuggccccugaacgaggggauaauggccgucggcaucgugagcauacuccuauccagccugcucaaaaacgacgugccccuggcggguccccugauugcaggaggcaugcuaaucgcgugcuacgucaucucggggucuagugccgacuuaagccuggagaaggccgcggaggucuccugggaggaggaagccgagcacagcggcgcgucccacaauauccucguggagguucaggacgacgggacuaugaagauuaaggacgaggagcgggacgauacccugaccauccugcucaaggccacccugcucacagugagcgggguguacccgcucaguaucccugccacgcuguucgucugguacuuuuggcagaagaaaaagcagcggagcggggugcugugggacaccccaagcccgcccaagguagagcgcgccguccucgacgauggcaucuaccgcaucaugcagcgggggcugcugggccgcagccaggugggggugggggucuuucaagagaacguguuccacaccauguggcacgugacgcguggcgccguccuuauguaccaggguaagcgucuagagcccuccugggcgagcgugaaaaaggaccugaucuccuauggcgguggauggcgguugcaaggcagcuggaacaccggggaggagguccaggugauagccguggaacccgguaaaaaccccaagaaugugcagaccgccccugggaccuucaagacuuccgagggugaggucggcgccaucgccuuggacuucaaacccggaacgagcggcucucccauagugaaucgcgaagggaagauuguuggccuguacggcaacggggucgugaccacguccggcacguaugucagcgcaaucgcccaggccaaggccucccaggaggggccccugccagagauagaggacgaggucuuccggaagcgcaauuuaaccaucauggaucugcacccgggcagcgguaagaccagacgguaccugcccgcgaucgugcgagaggccaucaagagaaagcuucggacccugauccuggcgccgacgcgcguggucgccucagagauggccgaagcgcucaagggcaugcccauccgcuaccagacaacagccguuaagucagagcacaccggcaaggagaucgucgaucugaugugccacgccacguucaccaugaggcuucucuccccgguccgcguccccaacuauaacaugaucaucauggacgaggcccacuucacugaccccagcuccaucgccgcgcgggguuauaucagcacccgcgugggcaugggggaggccgccgccaucuucaugacggccacgccgcccggguccguagaggcguucccucagucuaacgcggugauccaggacgaggaacgggauauaccggagcgcucauggaacucaggguacgaguggaucaccgacuuccccggcaagacagugugguucguacccucuaucaagucgggcaacgacauagccaacugcuugcggaagaacgggaagcgcgugauccagcugucccggaagacuuucgacaccgaguaccagaagaccaagaacaacgacugggacuacgugguuacgacggacauuagcgaaaugggggcuaacuucagggcagaccgggugaucgacccccgccggugccucaagccggugauccugaaggacgggcccgaacgcgucauccuggccggcccgaugccggugaccgucgccuccgccgcccagagaagggggcgcaucggacgcaaccacaacaaagagggcgaccaguacaucuacauggggcagccgcucaacaacgacgaggaccaugcgcacuggaccgaggccaagaugcuacuggacaacaucaacacccccgaggguaucauccccgcgcucuucgagcccgaacgggagaaaagugccgccaucgacggggaguaccgccuucgaggcgaggcgcguaagacguucguggagcugaugcggcgcggggaccucccgguguggcugagcuacaagguagccuccgagggauuccaauacucugaccgccgguggugcuucgauggcgagcgcaauaaccagguccuggaggagaacauggauguggagauauggaccaaagagggggagcgcaagaagcuccgcccuaggugguuagacgcuaggacguacuccgauccucuggcccugcgugaguucaaggaguucgccgcuggccgcagaagcgucagcggcgaccugauccuugaaauaggcaagcugccccagcaucuaacccaacgcgcccaaaaugcguuggacaaccuggugaugcugcacaacucggagcagggcgggcgggccuaccgccacgcgauggaagagcugccggacacgaucgaaacgaugaugcuccuagcacuaauugcagugcucaccggcggcgucacccuguucuuccugucuggccggggguuaggcaagaccagcaucggccuccugugcguuauggccuccagcguguuguuauggauggcauccgucgagccccauuggaucgcagccagcaucauucucgaguucuucuuaaugguacugcugauccccgagcccgacagacagcggacgccgcaggauaaccaguuggccuacguggucaucggacugcuuuuuaugauccucaccguagccgccaacgagaugggucugcuggagaccacuaagaaggaccucggcaucggccauguggcggucgagaaccaccaccacgcggccaugcuggacguugaccugcaccccgccuccgcguggacacucuaugcgguggcuaccaccaucaucacccccaugaugcgucacacgaucgagaacaccacagccaacaucagccugaccgccauugcaaaucaggcggcaauccugauggggcucgacaaaggcuggccgaucuccaagauggacaucggggugccccuacuggcccucggguguuacagccagguaaauccgcugacucuaaccgccgcgguguugauguuagucgcccacuacgcaauuaucggcccugggcuccaggcuaaggccacucgggaggcgcagaaacgcacggcggccggcaucaugaagaacccgacaguggacgggaucguggccaucgaucucgacccggugguguaugacgccaaguucgagaaacagcugggccagaucaugcugcucauccuguguacaagccagauccugcucaugcgaaccaccugggcucugugcgagucuauuacgcuggccaccggcccucucacaacccuuugggaggggucgcccgggaaguucuggaacaccaccaucgccguaagcauggccaacaucuuccgggggucguaccuggccggcgcuggucucgccuucucacugaugaagagccucgggggcggccgccgggggacuggugcccagggggagacccuaggggagaaguggaagcgccagcuuaaccaacugagcaaguccgaauuuaauacguacaaacgguccggaaucauggaggucgaccgcagcgaggcuaaggagggccucaagcgcggggagacgaccaagcacgcgguuucccgcggcaccgcuaagcucagaugguucguggagcgaaaccugguaaagccggaagggaaagugauagaucucgggugcggucgcggcggguggucauacuacugcgcuggguugaaaaaagugacggagguaaagggauacaccaaaggcggccccggucacgaagagcccauccccauggcuacuuacggguggaaucuggugaagcugcacuccgggaaggacguguucuucaucccgcccgagaagugcgacacacuccugugcgacaucggggaguccagucccaacccgacgaucgaggaaggucggacucugcgggugcugaagaugguggagccguggcugcgcgggaaccaguucugcaucaagauucugaacccuuacaugcccagcguuguagagacccucgagcaaaugcagcguaagcaugguggcaugcuggugcgcaacccccuuucccguaacagcacccacgagauguacuggguauccugcgggacuggcaauaucgucagcgccgugaauaugacguccagaaugcuccugaaccgguucaccauggcgcaccgcaagcccaccuaugagcgcgacguggaccugggggccggcacccggcacgucgcgguggagccugagguggcaaaccuggacaucaucggccagcgcaucgaaaacauaaagcacgaacacaagucuacuuggcacuacgacgaggacaaccccuacaagaccugggcauaccacggguccuacgaggucaagcccagcggcagcgccuccagcaugguuaauggcgucgugaagcuguugacaaagccgugggaugugauccccauggucacccagaucgccaugacggacaccacccccuuuggccaacaacggguguucaaagaaaagguggacacgcgcacacccaaggccaaacggggcacugcccagaucauggaggucaccgccaaauggcucuggggcuuccugucaaggaacaagaagccgcgcaucugcaccagagaggaguuuacgcggaaggugaggucaaacgcagccauuggagcaguauuugucgacgagaaucaguggaauucugcaaaggaggcgguugaagacgagcgguucugggacuuagugcaccgggagcgggaguuacauaagcaggguaagugcgcgacaugugucuauaauaugaugggcaagcgcgagaaaaagcugggggaguucggcaaggccaaggggagccgggccaucugguacauguggcugggcgcgcgguuccucgaauucgaggcgcugggauucaugaacgaggaucacugguucucacgggagaacagccugucugggguggagggcgaggggcuccauaagcugggcuauauacuucgcgacauaagcaagauccccgggggcaauauguaugccgaugacaccgccggcugggacacccggaucacggaggacgaccuccagaaugaggcuaagauuacugacaucauggagcccgagcacgcccugcucgcgaaguccauauucaagcuuacguaucagaacaagguaguccgcgugcaacguccggccaagaacggaaccgugauggacgucaucagccgcagggaccaacgagguaguggccagguggguacguacggccugaacaccuucaccaacauggaggcgcagcugauccgccagauggaaagcgaggguaucuucuccccgagcgagcucgagacaccaaaccuggcucggaggguccuagauuggcuagagaagcacggagucgaacgacugaagcggauggcaaucucaggggacgauugcguggugaagcccaucgacgacagauucgcuacggcccuuaccgcccuaaacgauaugggcaaaguccgcaaggacauuccacaaugggagcccagcaagggguggaacgacuggcagcagguccccuucuguagccaccacuuucaccagcugaucaugaaggacggcagggagaucguggugcccugccgcaaccaggacgagcugguaggccgggcccgcgugucccagggugccggcuggucacuucgggagaccgcgugccuggggaaauccuacgcacagauguggcagcugauguauuuccaccgccgggaccuccgguuagccgccaacgcgaucugcagcgccguuccgguggacuggguacccacguccagaacgacauggagcauccacgcucaccaccaguggaugaccacagaggauaugcugucaguauggaaccgugucuggaucgaagagaaccccuggauggaggacaaaacgcacaucagcuccuggggggauguucccuaccuggggaagcgggaagaccaguggugcggcagccugaucggccugaccgcccgcgccacaugggcgacgaauauccaggucgcuaucaaccagguacggcgauuaauagggaaugagaacuaccuggacuacaugacauccaugaagcgcuucaagaacgagagcgacccggagggcgcucugugguga

SEQ ID NO: 24341 - RNA, 9879 nt, Artificial Sequence
  derived and/or modified CDS sequence (opt11) from DENV-1__GQ199824__SS-prME
agcgugaccaugcuccugaugcugaugcccaccgcccuggcuuuucaccucacgacucgaggcggggaaccccacaugauuguguccaagcaagagcgggggaagucgcuccuuuucaagaccuccgcgggggugaacaugugcacccucauugccauggacuugggcgaguucugcgaggauaccaugacauacaagugcccccgaaucacugaagcggagcccgacgauguggacugcuggugcaacgccaccgacaccugggucaccuacggcacgugcagccagaccggcgagcaccggcgagacaagcgguccguggcccucgcgccccacgugggccucgggcuggagacgcgcaccgagaccuggaugagcucagagggcgcguggaagcagauucagcgugucgagaccugggcccugcgccauccaggguucacggucaucgcucucuuccuggcgcacgccaucggcaccaguaucacccaaaaggguaucauuuucauucuauugaugcuggugacccccuccauggccaugcgcugcgucgggaucggcagccgcgacuucguggaagggcuguccggcgcgacauggguggacguagugcucgagcauggguccugcgugaccaccauggccaaggauaagcccacccuagacauugagcugcucaagaccgaggucaccaauccagcagugcugcggaagcugugcaucgaagccaagauuuccaacacgaccacggacucccgcugcccuacgcagggugaggccacccucguagaggaacaggacgccaacuuugucugccggcgcaccuucguggaccguggcugggggaacggcugcgggcuguucggcaaggggucccugaucacgugugccaaauuuaaaugcguaaccaagcucgagggcaagaccgugcaguaugagaaccugaaguacagcguaaucgugaccguccacacaggcgaccaacaccagguggggaacgaguccaccgagcacgggaccacagcgacuaucacgccccaggcccccagcacggagauccagcugaccgacuacggggcacucacacuggacugcaguccccggacgggcuuagacuucaacgagauggucuuacuuacaaugaaggagaaauccuggcucguccacaagcagugguuccucgaccucccgcugcccuggaccagcggcgccuccacaucucaagagacuuggaaccggaaggaccuccuggugaccuucaagaccgcccacgcuaaaaagcaggaggugguggugcugggaucccaagaaggcgcaaugcauacugcgcucacgggagccacagagauccagaccucgggcacgacgacgaucuucgccgggcaccugaaaugccgucugaagauggacaaacucacccugaaaggcauguccuacgucaugugcaccgggagcuucaaacuugagaaggagguggccgagacucagcacggcaccgugcucgugcagaucaaguacgagggcacggacgcacccugcaagauacccuucuccacccaggacgagaagggggugacgcagaacgggcggcucaucaccgccaacccuaucgugaccgauaaggagaagcccgucaacaucgaagccgaaccucccuucggugagucuuacauugugaucggcgcgggcgagaaggcccugaaacugagcugguucaagaagggguccuccauaggaaaaauguucgaggcuaccgcccgcggagcccgccgcauggcgauuuuaggcgacacugccugggacuucggaagcaucggcggcguauucaccuccgucgggaagcucguacaccaaauuuucggcacggcuuaugguguauuguucuccggcguuucauggaccaugaagaucggcauuggggugcugcuuacguggcuaggccucaacucucgcuccacuucccuguccaugaccuguaucgccguaggccuggucacccucuaccugggcguuauggugcaggcagacagcgggugcgucaucaacuggaagggcagggaauugaagugcggaagcgggauuuucgugacgaacgagguacacaccuggaccgagcaauacaaauuccaagcggacuccccuaagcggcucagcgcggcaaucggaaaggccugggaagaggggguaugcggcauacgguccgcgacccgccuggagaacauaauguggaagcagauccuuaacgagcucaaccacauccugcuggagaaugauaugaaguucaccgugguggucggggauguggcgggcauccucgcccaggggaagaagaugauccggccccagcccauggaauacaaguacucuuggaaguccuggggcaaggccaagaucaucggcgccgacgugcaaaacacgaccuucaucaucgacgggccuaacacgccggagugucccgacgaucagcgggcauggaacaucugggaggucgaggauuacggguucggaaucuucaccacgaacaucuggcugaaacugcgcgacagcuacacccagguaugcgaccaccgccucauguccgcggccaucaaggacagcaaggccguccacgccgacaugggcuacuggaucgagucagagaagaaugagaccuggaaacuggcgagagccagcuucaucgaggugaagaccuguaucuggcccaagucccacacgcuguggagcaauggcguccucgagagcgagaugauaauccccaagaucuacgggggaccgauaucccagcauaacuaccggcccggguacuucacccagaccgccggccccuggcaccuggggaagcuggaauuggauuucgaccugugcgagggcaccacgguggucguggaugagcacugcgggaaccgggggccgagccugcggacgaccaccgucacgggcaagaucauccacgaguggugcugccggagcugcacccugccgccccuucguuucaagggggaagacggcugcugguacgggauggagauuaggcccgucaaggagaaagaggagaaccuugugaaguccauggugagcgccggcucaggugaggucgauuccuucagccucgggcugcugugcauuuccaucaugaucgaagagguaaugcgaagccgguggagucgcaaaaugcucaugaccgguacccuggccguuuucuuccuguugaucauggggcagcugacguggaaugaccugaucaggcucuguauaauggucggagcgaacgccagcgaccggauggggaugggcaccaccuaccucgcccugauggcuaccuucaaaaugcgcccuauguucgccgugggccuccuguuccggcgccugacgagucgcgaggugcuccuccugaccaucggccucagccuggucgcgagcgucgagcuccccaacucucucgaggaacugggcgacgggcuggccauggguaucaugauccucaagcugcugacggacuuucagagucaccagcucugggcaacccuguuaagccucacguuuaucaaaaccacuuuuucccugcacuacgccuggaagaccauggcgaugguucuguccaucgugagccucuucccucucugccugagcacgaccucccagaagaccaccuggcucccggugcugcugggcagccucgguugcaagccgcuaacgauguuccugaucgccgagaauaagaucuggggcaggaaaucguggccacucaacgaagggaucauggcgguaggcaucgugagcauccugcugagcucccuccugaagaacgacguaccccuggccgggccccucaucgcgggcggaaugcugaucgcgugcuacgucaucucuggguccagcgccgaucugagccuugagaaggccgccgaagugagcugggaggaggaggccgagcauuccggcgcuagccacaauauccugguggaggugcaggacgacgggaccaugaagaucaaagacgaggagcgcgacgacacccugaccaucuuacucaaggccacccuacucgccguguccggcguguauccgcugagcauccccgcuacgcuguucgucugguacuucuggcaaaagaagaaacagcgcucugggguguugugggacacucccuccccgcccgaaguugaacgggccguccuggacgacggcauuuaccgcaucaugcagcguggccugcuggggaggucccagguaggcgugggggucuuccaggagaauguguuucauacgauguggcacgugacccggggcgcgguacugauguaccaggggaagagauuagagccguccugggccuccgugaagaaggaccugauaagcuacggcggcggcuggcgguugcaaggcuccuggaacacuggagaggaaguacaggugaucgcgguagagccgggcaagaacccuaagaacgugcagaccgcccccgggaccuucaagacgagugagggcgaggucggggccaucgcacuggacuucaagcccggcaccuccggcucccccaucgugaacagagaagggaagauugugggccuguacggaaauggugucguaaccaccagcggcacauacguuuccgccaucgcucaggccaaggcgucacaggaaggcccccucccggagauagaagacgaagucuuccggaagcguaaccugacuaucauggaccuacaccccggcucugggaagacccggcgcuaccuccccgccaucgugcgggaggccaucaaacgcaaacugcggacucugauucuagcccccacccgagugguugccagugagauggcggaggcccuaaaagggaugcccauaagguaucagacgaccgccgugaaauccgagcacaccggcaaggagaucguggaccugaugugccacgcuaccuucacaaugcggcuacugagcccaguccgcgugccgaauuacaacaugaucaucauggacgaggcacacuucaccgaucccuccagcaucgcggcucggggguauaucuccaccagggugggcaugggggaagccgccgccaucuucaugaccgccacgccgcccggcucugucgaagccuucccccaguccaaugcugugauccaggacgaggaacgggauauaccggagcgcagcuggaacagcggguacgaguggauuaccgacuuccccggaaagaccgugugguucgugcccagcaucaaguccggcaaugacauugccaauugucugagaaagaaugggaagcgcgugauccagcucagccggaagacuuuugauacggaguaccagaagaccaaaaacaacgacugggacuacguggucaccacagacaucucagagaugggcgcgaauuuccgcgccgaccggguaauagacccgaggcgaugccugaagccaguaaucuuaaaggacggacccgagcgcgucauucucgccggccccaugccugugacgguggccucagcugcccagcggagagggcggaucgggcgcaaccacaacaaggagggcgaccaguacauauacauggggcagccccugaacaacgacgaggaccacgcccacuggaccgaagccaagaugcugcuggacaauaucaacaccccugaagguaucaucccagcccuguucgagcccgaaagagaaaaaucugccgcgaucgacggcgaauaccgccugcgaggcgaggcccggaagaccuucguggagcucaugagacguggugacuuaccgguauggcugucuuacaaagucgccagcgagggcuuccaguacucggacaggcgcuggugcuucgacggcgagcgcaacaaccaggugcucgaagagaacauggacguggagaucuggacgaaggagggggagcggaagaagcugcgaccccgauggcuggacgcccggaccuauagcgacccccuugcacuaagagaguucaaggaguucgcggccggcagacgguccgucagcggggacuugauacucgaaaucggaaaacugccucagcaccugacgcagcgagcucagaacgcccuugacaaccuggugaugcuacacaacuccgagcaaggcgggcgggcguaccgccaugccauggaggagcugccggacacgaucgagacucucaugcugcucgcccugaucgcaguccugaccggcggggugacccucuucuuccuaagcggccggggguuaggcaagacaucaaucggccucuugugcgugauggccagcuccguucuccucuggauggcgagcgucgagccccacuggauagcggccuccaucauccuggaguucuuccuaauggugcuccugauccccgagcccgaccgccagcggaccccacaagacaaccaacuggccuauguggugaucgggcuccuguucaugauacugacaguggccgcgaacgaaaugggacuccucgaaaccaccaagaaggaccugggaaucggccauguggccgucgagaaccaccaccacgcugcuaugcuugacguagaccugcacccugccuccgcguggacccuguaugccguagcaacgaccaucaucacccccaugaugcgccacaccaucgagaacaccaccgccaacaucucccuaacagccauugcaaaccaggcugcuauccugauggggcuggacaagggcuggccgaucagcaagauggacaucggcgucccccuccuggcucuggggugcuacucccaggugaacccacucacccugacggcggccgugcucaugcuaguggcccacuacgccaucauaggcccagggcugcaggcaaaggcgacucgggaggcccagaagcgcaccgccgccggcaucaugaagaacccgaccguugacgggaucguggccaucgaccuugaccccguuguguacgacgcuaaguucgagaagcagcucggccagaucaugcugcugaucuuaugcacuucgcagauccugcuaaugcgcaccaccugggccuugugcgaguccaucacccuggccacgggcccccugacuacccuuugggaagggagccccggcaaauucuggaauaccacgaucgccguguccauggccaacauuuuccgggggagcuaucuggcgggcgccggauuagcauucagccucaugaagucccuuggcggcgggcgccgggggacaggggcccagggcgagacccugggagagaaauggaagcgccagcuuaaccagcugagcaaguccgaguuuaacacuuacaaacggucugggaucauggaagucgaccguuccgaggcgaaggagggcuugaaacguggggagacgaccaagcacgcgguaagccgcggaaccgccaaguuacggugguuuguggagcgcaaccucguaaaaccugaagguaaggugaucgaccugggcuguggcagaggugggugguccuauuacugcgcagggcuuaaaaaggugacagaggucaaggguuacacuaagggcgggcccggccacgaggaacccauccccauggccacauacggguggaaccuugucaaacugcauagcgggaaagacguguucuucaucccgccggagaagugugauacccugcucugcgauaucggggaguccagccccaaucccaccauagaagagggccgcacgcugcggguccugaagaugguggaaccuuggcucagaggaaaccaguucugcaucaagauucugaaccccuacaugcccuccguagucgagacccuggagcagaugcagcggaaacacggcggaaugcucguacgcaacccucugagccguaauaguacgcacgagauguacugggucagcugcgggaccggcaacaucguguccgcgguaaacaugaccagucgcauguuacucaaccgguucacuauggcccaccgcaagccgaccuacgaacgcgacguggaccuuggggcaggcacccggcacgucgcggucgagcccgaaguugccaaccuggacaucaucggccagcgcaucgagaacaucaagcaugagcacaagagcaccuggcauuacgacgaggacaaccccuauaagaccugggcuuaccacggguccuacgagguaaagcccagcggguccgccagcucuauggugaacggugucgugaagcucuugacuaagccgugggacgugaucccaaugguuacgcagauagccaugaccgacacgacccccuucggccaacagcggguuuuuaaagagaaaguggacaccagaaccccuaaggcgaaacgugggacggcgcagaucauggagguuaccgcgaaguggcuguggggguuucucagccgcaauaagaagccgcggaucugcacccgcgaggaguucacccggaaggugcggucaaacgccgccaucggggcugucuucguagacgagaaccaguggaacagcgcgaaagaggccguggaggaugagcgguucugggaccuggugcaccgcgagcgggagcugcacaagcaggggaagugugccacgugcgucuacaauaugaugggcaagcgcgagaagaagcucggugaguuuggcaaggcgaagggguccagggccaucugguacauguggcugggcgcacgguuuuuagaguuugaggcccucggcuucaugaaugaggaccacugguucucgcgggagaacucccugagcgggguagaaggugaggggcugcacaaacuuggcuacauccugcgcgauaucuccaagauacccgggggcaacauguacgccgacgacaccgccggcugggacacgcggaucacggaggacgaccugcagaacgaggccaagaucacggacaucauggagcccgagcacgcgcuucucgccaaaagcaucuucaaauugaccuaccagaacaaggugguacgcgugcagcggccugcuaagaacgguaccgugauggacgucaucucccgcagggaccagagagguucaggacaggugggcaccuacggcuugaacacuuucacaaauauggaggcccagcuuauccgccagauggagagugaggguauauucagcccuuccgagcuggagacgcccaaccucgccggcagaguacuggacuggcucgagaagcaugggguugaacgccucaagagaauggcgaucucaggcgacgacugcguggucaagccuauagaugaucguuucgccacugcucugacggccuugaaugacauggggaagguccggaaggacaucccgcagugggagcccuccaagggguggaacgacuggcagcagguccccuuuugcagccaccacuuccaccagcucaucaugaaggacggacgugagauaguggucccuugccggaaucaagaugagcugguggguagggcccgagugagccagggcgcggggugguccuugcgcgaaaccgccugccucggcaagagcuaugcccagauguggcaacucauguacuuccaccggagggaccugcggcucgccgcgaacgccaucugcuccgccgucccggucgacuggguucccacaagcagaaccaccugguccauccacgcccaucaccaguggaugaccaccgaggacaugcugagcgucuggaaccggguguggauugaagaaaaccccuggauggaggacaagacgcacaucuccucuuggggcgacgugcccuaccugggcaagcgggaggaccaguggugcggcuccuuaaucgggcucacggcacgggcgaccugggccaccaacauccaggucgccauaaaucaagugcgccgccuuauugguaaugagaauuaccucgacuacaugaccagcaugaagagauucaaaaacgaguccgauccggagggggcccugugguaa

SEQ ID NO: 24342 - RNA, 9879 nt, Artificial Sequence
  derived and/or modified CDS sequence (opt11) from DENV-1__FJ882559__SS-prME
aguguaacuauguuacucaugcugaugcccaccgcccuggccuuccaccuuacgacacggggcggggaaccccacaugaucguuagcaagcaggaacgggguaagagccugcuguuuaaaaccagcgcuggggugaacauguguacccucauagccauggaucugggcgaguucugugaggacaccaugacauacaaaugcccgagaaucaccgaggccgaaccagaugacguggacugcuggugcaaugccaccgacacgugggugaccuacgguaccugcucgcagaccggcgaacaccggcgggauaaacgguccguggcccuggcgccccaugugggccucgggcuggagacgcgcaccgagaccuggaugaguuccgagggcgccuggaagcaaauacaaaggguggagaccugggcacuccgccaccccggguucacgguuaucgccuuauuccuagcucaugccaucgggaccagcaucacccaaaaagggaucaucuucauacuccucaugcuggugacucccuccauggccaugagaugcguagggauuggcagccgcgacuucguggaggggcugagcggagcgacguggguggacgucgugcuggagcacggguccugcgugaccaccauggccaaagacaagcccacccuggacaucgagcugcucaagacggaagucaccaaccccgcggugcugcguaagcugugcaucgaagcaaagauauccaacaccaccacggacucgagaugcccgacccagggcgaggcaacccucguggaggagcaagacgccaacuucgugugccggcgcaccuucguagaccggggcuggggaaacgguugcggacuguucggcaaggggucccugaucacaugugccaaauuuaaaugcguuacuaagcucgagggcaagaucguccaguaugagaaccugaaguacucaguaaucgugacaguccacaccggcgaucagcaccagguggggaacgaauccaccgagcacggcaccaccgcgaccaucacgccccaggcucccagcacggagauccaacugaccgacuacggggcccucacccuggacugcagcccacggacuggccuggacuucaaugagaugguccucuugacgaugaaggagaaauccuggcuggugcacaaacagugguuccucgaccugccgcuucccuggacauccggagccaguaccagccaggagaccuggaaccggcaggaucuccuggugacuuucaagacggcccacgcaaagaagcaggaggucguggugcugggcucccaggagggcgcaaugcacaccgcccucacuggggccaccgagauccagaccagcggcaccacuacgaucuucgccggucaccugaagugucgacugaagauggacaaauugacccugaagggcauguccuacgucaugugcacagggagcuucaaguuggagaaggagguggcggagacccagcacggcacggugcucguacagaucaaguacgagggaaccgaugcccccuguaagauccccuucuccacccaagacgagaaggggguaacccagaauggccggcucauuacggcuaaucccaucguaaccgacaaggagaaacccgugaacaucgaggccgagccgcccuuuggggagucguacaucgugaucggcgcgggcgaaaaggcccugaaacugaguugguucaagaaaggaagcuccaucggcaagauguuugaggccaccgcccguggagccagacgaauggcgauccucggcgacaccgcuugggauuucggcucaauaggcgggguguucacguccguagggaagcuggugcaccaaaucuucggcaccgccuacggggugcuguucagcggagucucguggaccaugaagauagggaucggcgugcuccugaccuggcugggccucaacagccgcagcacaaguuuauccaugaccugcaucgccguggguuuagucacccucuaccuaggcgugauggugcaggccgacagcggaugcgucaucaacuggaagggccgggagcugaaaugcgggagcgggaucuucgugaccaacgaggugcacacauggacagaacaguacaaguuccaggcggacuccccuaagcgccucuccgccgcuaucggcaaggccugggaggagggggucuguggcauccggucugccacccgccuggagaacaucauguggaagcagaucagcaacgagcuaaaucauauccuccuugagaacgauaugaaguucaccguuguggucggugauguugcuggcauucuagcccaggggaaaaagaugauacggccccaaccaauggaguacaaguacuccuggaaguccugggggaaagcccgcaucaucggcgccgacguucagaacaccacguucaucaucgacgggcccaacaccccagagugccccgacgaucagcgagcguggaacaucugggaggucgaggacuacggcuucgguaucuucaccaccaacaucuggcugcgccugcgggacuccuacacccaggugugcgaccacagauugaugucagccgccaucaaggacuccaaggccgugcacgccgacaugggcuauuggaucgagucugagaaaaacgagaccuggaagcucgcgcgggcguccuucaucgagguuaagaccugcaucuggcccaagagccacacccuuugguccaauggggugcuggagagcgagaugaucaucccaaaaaucuacggagguccgaucucccagcacaacuaccgcccaggguacuucacgcagacagccggccccuggcaccugggcaagcuggagcuggauuucgaccucugcgagggcaccaccguugucgucgacgagcacugcggcaaccgggggccuucucugcgaaccaccaccgugaccggcaagaucguccacgaguggugcuguagauccuguacccuuccgccccugagauucaagggggaggauggcugcugguacggcauggagauccggcccgugaaggagaaggaggagaaccuggucaagagcaugguuagcgccggguccggcgagguggacagcuuuucccuugggcuccugugcaucagcaucaugaucgaggaggugaugcggucccgguggucccgcaagauguugaugaccggcacucuugcugucuucuuccugcugaucaugggucagcucaccuggaacgacuugauucgccugugcaucauggugggcgcgaacgcgucagaccgaauggggaugggcaugaccuacuuggcccugauggccaccuuuaagaugcggccgauguucgcggucggccuccucuuccggcggcugaccagccgggaaguccugcucuugaccaucgggcugucccuuguggccagcgcagagcugccgaacucccuggaggagcucggcgacgggcuggcuaugggcaucaugauccugaagcuccugacggauuuccagagccaccagcugugggccacccuccugucccugaccuucauuaagacuacauucucccuccauuaugcguggaaaaccauggccaugguccucuccaucgucucucuguucccccucugccuguccaccaccagccagaagaccaccugguuacccgugcuacugggcuccuuggggugcaagccgcucaccauguuccuuaucgccgagaacaagauauggggccgcaagaguuggcccuuaaacgaagguauuauggccgucggcaucgugucaauccuguuauccagccugcucaagaaugacgugccccuggcugggccccucaucgcgggcgggaugcucaucgccugcuacgucaucuccgggagcagcgccgaccugucacuggagaaggccgccgaggugucuugggaggaggaggcggagcacagcggcgcaucacacaauauccucguggaaguccaggacgacggcaccaugaagaucaaggacgaggagcgggacgacacgcugacgauucugcucaaggcaaccuuacuagccgugucaggcguguacccgcucucaauucccgccacccuguuugugugguacuucuggcagaagaagaagcagcggagcggggugcugugggacacgcccagcccacccgagguggagcgugcgguccuggacgacggcauuuaccgcaucaugcagcggggucugcuggggcggagccaggugggcgugggugucuuccaggagaacguguuccacacgauguggcacgugacccggggcgccguccugauguaccaggggaaacgccucgagcccuccugggccucagugaaaaaggacuugaucaguuacggcggcggguggcggcugcagggcagcuggaacacaggggaggagguacaggucaucgccguggagccuggcaagaaccccaagaacguacagaccgccccugggacguucaagaccucagagggugaagucggcgcgaucgcauuggacuucaagccggggacaagcgguagccccaucgugaaccgcgaggggaagaucgugggccuguacggcaacggggucguaacgacguccggaacauacgugagcgccauagcccaggcgaaagccucccaggaggggccucugccggagaucgaagaugaggucuuccguaagcgcaaucucaccauuauggaucuucauccgggcagcgggaagacccggcgcuauuugcccgccaucgugagagaggccaucaagcgcaagcuccgaacgcucaucuuggcuccgacaaggguggucgcguccgagauggccgaggcccucaagggcaugccaauccgcuaccagaccacggccgucaaaagcgagcauacggggaaggagaucguggaccugaugugccaugccaccuucaccaugcgccugcucucccccguccgcguucccaauuacaacaugaucauaauggacgaggcgcacuucaccgacccgagcuccaucgcagcccggggcuacauaucgacgagagugggcaugggagaggccgcagcgaucuuuaugaccgcgacgccucccgguuccgucgaggccuucccgcagagcaacgccguaauccaggaugaggagcgggacaucccugagagguccuggaauagcggguacgaguggaucaccgacuuccccggcaaaacggugugguucguacccucgaucaaguccggcaacgauaucgcgaacugccugcgaaagaacggcaaacgagugauccagcuaucccggaagaccuucgauaccgaguaccagaaaacaaagaacaacgacugggauuacguugucacgacugacauaagugagaugggcgccaacuuccgcgcugacaggguaaucgacccccgccggugccucaagccggugauccuaaaggacgguccugagagggucauccuggcaggcccgaugccagugaccgucgccuccgcggcccagcggcgcgggcggaucgggcguaaccacaacaaggagggcgaccaguacaucuacaugggucagccauugaacaacgacgaggaccacgcccacuggaccgaggccaaaaugcugcuggacaacaucaacacgcccgaggguauaauccccgcacuguucgagcccgaacgcgagaaguccgcggccaucgacggugaauaccggcugcggggugaggcccggaagaccuucguggagcugaugcgccguggggaucucccgguguggcugagcuacaaggucgccuccgagggguuucaauauagcgacagacguuggugcuucgacggcgagcgcaacaaccagguucuggaggaaaacauggacguggaaaucuggaccaaggagggggagcggaagaagcuacggcccagauggcuggacgcccgcaccuacagugacccccuggcguuacgggaguucaaggaguucgcugccggacgccggagcgucuccggggaccugauacuggaaaucggcaagcucccccagcacuuaacucaacgcgcccagaacgcgcuggacaaccuuguuaugcugcacaacagcgagcagggcgggcgggcauacagacacgccauggaggagcugccggacaccaucgagacccucaugcugcuggcccucaucgccguacugaccggagggguuacgcuguucuuccucuccggucgugggcuggggaaaaccagcaucggccugcucugcguaauggccuccagcgugcuacucuggauggccuccgucgagccccacuggauagccgccagcaucauacucgaguucuuucuuauggugcuucucauccccgagcccgaccgccagcggaccccgcaggacaaccagcuggccuacgugguaaucgggcuccucuuuaugauccugaccguggcggccaacgaaaugggacuucuagagaccacgaagaaggaccuggggaucggucauguggccgucgagaaccaccaccacgccgccauguuggacguggaucuccaccccgcgucggccuggacccuguacgcgguugccaccaccaucauuacgcccaugaugcgccacaccaucgagaacaccaccgccaacaucagccuuacggccaucgccaaccaggccgccauccucauggggcuggauaagggcuggccgauuuccaagauggacaucggcguacccuugcucgcgcuagggugcuauagccaggugaacccgcugacccucaccgcggcagugcugaugcugguagcccacuaugcuauuaucggucccgggcuccaggccaaggccacaagggaggcccagaagcggacagccgccggcaucaugaagaacccuaccguggacgggaucguggcgaucgaccuggaccccgucguauaugacgccaaguucgaaaagcagcugggccagaucaugcuccugauccuuugcacaucccagauccuccuuaugcgaaccacuugggcacugugugaguccaucacccucgccaccggcccccucaccacucugugggaggggagccccggaaaguucuggaacaccaccaucgcggugucaauggcgaacaucuuccggggaucguacuuagccggcgccggccuggccuucucccugaugaagucccucgggggcgggaggcggggcaccggugcgcagggcgagacgcugggcgagaaguggaagcgacagcugaaccaacucuccaagucggaguucaacaccuacaagcggaguggaaucauggaggucgaccggagcgaggccaaggagggccugaagcgcggggagaccaccaagcacgcugugucccgcggcacugccaagcugcggugguucguggaacgcaaccucgucaagccggaggguaaaguuaucgaccucggcugcggccgcggcggguggagcuacuacugcgccgggcugaaaaaggugaccgaggucaagggguacaccaagggcgggccaggccacgaggagcccaucccaauggccaccuacggcuggaaccuagugcgccugcacucgggcaaagacguguucuucacgccgccagaaaagugcgacacccugcugugcgauaucggggagucaucgcccaaucccaccauagaggagggccggacccuccggguucugaaaaugguggagccguggcugcgggggaaccaguuuuguauaaagauacucaaccccuacaugcccagcgucgucgagacgcuggagcagaugcagcgcaagcauggcgguaugcuggugcguaacccccucucccgcaacagcacccacgagauguacuggguguccugugggaccggcaacaucgucagcgcagugaacaugaccagccgcaugcugcugaaccgguucaccauggcccaucgcaagcccacguacgagcgggacguggaccucggggcuggcacccgucacguugccguggagcccgagguggcgaaucuggacaucaucggccagcggaucgagaacaucaagcacgagcacaagagcaccuggcacuacgacgaggacaaccccuacaagacuugggccuaccacggauccuacgagguaaagccgagcgggagcgccagcagcauggugaacggggucgucaagcugcuaacgaagccgugggacguaauccccauggucacacagauugccaugacagacaccacgcccuucggccagcaacgcguguucaaggagaagguggauaccagaacacccaaggcuaagcgcggaacuguccagaucauggaggugacggcgaaguggcuguggggcuucuugucccggaacaagaagccgcgcaucugcacccgggaggaguucacccgcaaagugagaucaaacgccgccaucggcgccgucuuuguggaugagaaucaguggaacuccgccaaggaggccguggaggacgagcgcuucugggacuugguccaccgggagcgagagcugcacaagcaggggaaaugcgcgaccugcguguacaauaugaugggcaaacgggagaagaaacugggggaguuuggcaaggccaaggggagccgugcuaucugguacauguggcucggagcgcgguuucuggaguucgaggcccugggcuucaugaacgaggaccacugguucucccgcgaaaacucgcucuccggaguggaaggcgagggguugcacaagcuggguuacauccuccgggacaucucuaaaauaccugggggcaacauguacgccgacgacacggcaggcugggacacccggaucaccgaggacgaccugcagaacgaggccaagaucacugacaucauggagcccgagcacgcacugcucgccaaguccauuuucaagcugacguaccagaauaaggucgugcgcgugcagcgaccggccaagaaugggacggucauggacgugaucagccgccgggaccagagggguucgggccaggugggaaccuauggccugaacaccuucacgaacauggaggcccagcucauccggcagauggagagcgaggggaucuuuucccccucggagcuggagacgccgaaccuggcagaacgcgcgcucgacuggcuggagaagcacggcgucgagcggcugaagcgcauggcaauuaguggagaugacugcguggugaagcccauugacgaccgguucgccaccgcccuaaccgccuuaaacgauauggguaagguccgcaaggacauaccgcagugggagcccagcaagggguggaacgauuggcaacaggugccguuuugcagccaccacuuucaccagcugaucaugaaggacggccgcgagaucguggugccaugccgcaaccaggacgaacucgugggccgggcgcgugugucccagggggcaggcuggagccugcgggagacggccugccuggggaaguccuacgcccagauguggcagcucauguacuuccaccgccgggaucugcgcuuggcggccaacgccaucugcagcgccgucccgguugacugggugccuaccucccggaccaccuggagcauccacgcacaccaccaguggaugacgacugaagacaugcuauccgucuggaacagagucuggaucgaggagaaccccuggauggaggacaaaacccacaucagcuccuggggagacgugcccuacuuggggaagcgugaagaucaguggugcgggagccugaucggccucaccgcucgggccacuugggccaccaacauccaggucgcuaucaaccaggugcgcagauuaaucgggaacgagaacuaccuggacuacaugacauccaugaagcgcuuuaagaaugagagcgacccggagggcgcacucugguga

SEQ ID NO: 24343 - RNA, 9879 nt, Artificial Sequence
  derived and/or modified CDS sequence (opt11) from DENV-1__GQ199828__SS-prME
agugugaccaugcuccucaugcugaugccgaccgcccuggcguuccaccucaccacccggggaggugagccccacaugaucgugucgaagcaggaaaggggaaagagucugcuguucaagaccagcgcgggggugaacauguguacacucaucgccauggaccugggcgaacugugcgaggacaccaugaccuacaagugccccagaaucaccgaggcggagcccgacgacguggacugcuggugcaacgccacugacacgugggugaccuacgggacuugcagucaaaccggcgaacaucggcgcgacaaacgguccguggcucucgcgccucauguaggccuggggcuggagacgcgcaccgagacuuggaugagcuccgaaggcgccuggaagcagauccagcggguggagaccugggcccugcgccaccccggguucacggucauugcccuguuccuggcgcacgcuaucggcacuagcauaacacagaaggggauaaucuucauucuccugauguuagugacccccuccauggccaugcggugcgucggcaucggcagccgcgacuucguggaggggcucuccggagcuacguggguggacguaguccuggagcacgggagcugcgugacgaccauggccaaggacaagccuacauuagacaucgaguugcugaagacagaggucaccaaccccgcuguacugcggaagcucugcauagaggccaaaaucuccaauacgaccacggacucaaggugcccgacccagggcgaggccacccuaguugaggagcaggacgccaauuucgugugucggcgcaccuuuguugaucggggcugggggaacggcugcgggcuguucgggaagggguccuuaaucaccugcgccaaguucaagugcgugacgaagcuugagggcaagauaguccaguaugaaaaccugaaguacagugugauugugacaguccacaccggggaucaacaccaggucggcaacgaguccacggagcauggcaccaccgcgaccauuacaccucaggcccccacgaccgagauacagcucaccgacuacggggcccugacccuggacugcucuccacgcacaggccucgacuucaacgagaugguucuacugacuaugaaggaaaagucguggcuagugcacaagcaaugguuucuggacuugcccuuacccuggacgaguggggccagcaccucccaagagaccuggaaccggcaagaccugcuaguaacauucaagaccgcgcaugcaaaaaagcaggagguugucgugcucggcagccaggagggcgccaugcauaccgcgcugacgggggccaccgaaauccagaccucaggcacuacgaccaucuuugcugggcaucugaagugucgacucaagauggacaagcuuacucugaaggggaugagcuacgucaugugcacuggguccuucaaguuagagaaggagguggcggagacgcagcacggcaccgugcugguucagaucaaguacgaggggaccgacgcgcccugcaagauacccuuuagcacccaggacgaaaagggagugacgcagaacggcagacugaucacugccaacccgaucguaacugacaaggagaagccagucaacaucgaggccgagccgcccuucggggaguccuauauugugaucggcgcgggcgaaaaggcacugaagcucagcugguucaagaaaggguccagcaucggcaagauguucgaagccaccgcccgcggggcccgccgcauggccauccugggcgacacggcgugggauuucggcagcaucggcggaguauucaccagcguuggcaagcuggugcaccagaucuucggaacugcguaugggguccucuuuuccggcgucagcuggacgaugaagaucgggaucggugugcugcugacuugguuaggccugaauucccgcagcaccucccugagcaugaccugcaucgccguggggcucguaacccuguaccugggggugaugguucaggccgacuccgggugcgugaucaacuggaagggccgagaacucaagugcgggagcggcauauucgugacgaacgaggugcacaccuggaccgagcaguauaaguuccaagcggacagcccgaagcgccucuccgcggccaucgguaaagccugggaagagggggucuguggcauucggagcgccacccgucuggagaacaucauguggaagcagaucucaaacgagcucaaccacauacugcuggaaaacgacaugaaacucaccgugguggucggggacguggcagguauccuggggcagggcaagaagaugaucagaccccagcccauggaguacaaguacucuuggaagucguggggcaaggccaagauuauaggggccgacgcccagaacacgaccuucaucauugacggcccuaacacaccggagugcccggacgaccagcgcgcguggaacaucugggagguugaggacuauggguucgggauauucaccacgaacaucuggcugaaguugcgggacagcuauacccagguuugcgaccaccgccugaugagcgccgcgaucaaggacagcaaggccgugcacgccgacaugggcuacuggauagaauccgagaaaaacgagaccuggaagcuggcacgggccagcuucauagagguaaagacaugcgucuggcccaagucccacacgcucuggucuaacgggguccgcgaguccgaaaugaucauccccaagaucuacggcgguccgaucagccagcacaacuaccggcccggauacuucacccagaccgccgggcccuggcaucugggcaagcucgagcucgacuucgacuuaugcgagggcaccacgguggucguggacgagcacugcgggaaucgcggcccgucccuccggacgaccaccguaacuggcaagaucauccacgagugguguugccgaagcugcacccugcccccacuucguuuucgcggcgaagaugguugcugguacgguauggagauccggcccgucaaggagaaagaggagaaccuggugaagucuauggugucagccggcagcggcgaggucgacuccuucagucucggccucuugugcaucuccauuaugaucgaggaggugaugcgcagccggugguccagaaagaugcucaugaucgggacccuugcgguguucuuccugcucauaaugggccaacugaccuggaacgaccugauccgccucugcaucauggucggggcgaacgcuucagaccggauggggauggggacuaccuaccuggcacugauggcaaccuucaagaugcgcccgauguucgccgugggacuccucuucaggcgccugaccucccgggagguccuguuacugacgauagggcucagccuggucgcgaguguugagcugcccaacucucucgaggagcugggggacggccuggcuaugggcaucaugauccucaagcuacugaccgacuuccaaucccaccagcucugggccacucugcugagccucacguuuauaaagacgaccuucuccuugcacuacgccuggaagaccauggcuaugguccugucgaucguguccuuauuuccccuaugucuguccaccacaucccagaagaccacguggcuccccguguugcuagggucucucggcugcaagccgcugaccauguucuuaaucgcugagaacaagaucuggggucgcaaguccuggccacuuaacgagggcaucauggccguugggauugugagcauccugcugucgucccuccugaagaacgaugugccccuggccggcccgcucauagcuggcgggauguuaauugcguguuacgucaucagcggcuccagcgccgaccugucccucgagaaggccgccgaggugucaugggaggaagaggccgaacauuccggggcgagccacaacauccugguggaggugcaagacgauggaacaaugaagauuaagaacgaggaaagagaugauacucuaaccauccuccugaaggccacccugcuggccguuagcgggguguacccgcugagcauccccgccacccuguucgucugguacuucuggcagaaaaagaagcagcgcuccggcguacugugggauacgcccagcccucccgagguagagcgggcuguucucgacgacggcaucuaccgaaucaugcaaagggggcugcugggcagaucccaaguggggguaggcguuuuucaggagaacguguuccacacgauguggcacgugacgcgcggggcgguccucauguaccagggcaaacgccuggaaccuagcugggccuccgugaagaaggacuuaauaagcuauggcggcggauggcggcuucgcggguccuggaacaccggcgaggaggugcaggucaucgcagucgagcccggcaagaaccccaaaaaugugcagacggcccccggcacguucaaaacccccgagggagaggucggggccaucgcgcuggacuucaaaccaggcacgucugggucccccaucgugaaccgggagggcaaaaucgucggacucuacgggaacggcgucguuacgaccucagggaccuacgugagcgcgaucgcgcaggcgaaagcgucacaggaggggccgcuccccgagauagaagacgaggucuuccgcaagcggaaccugaccaucauggaucuucacccugggagcgggaagacgcgccgguaccuuccggccaucgugcgcgaggcgaucaagcgcaagcugcggacccuaauccucgccccgacccgcguggucgccuccgaaauggcggaggcccugaagggcaugccuauccgauaucagaccacggccgucaaaagugaacacaccgggaaggagaucguagaucugaugugccaugcaaccuuuacgaugcgccugcugagccccguccgggugccaaacuacaacaugauaaucauggacgaggcccacuucacagacccuuccuccaucgcugcccgcggcuacaucagcacccggguagggaugggcgaagccgcugccaucuucaugaccgcgacgccgcccgggucgguagaggcuuucccccagagcaacgcgguaauccaggacgaggagagagacauucccgagcggaguuggaacagcggcuacgaguggauaacggauuuccccggcaaaaccgugugguucgucccaagcaucaaaagcgggaaugauaucgccaacugccugcguaagaacggcaagcgggugauccagcucucccgcaagacguucgacacggaguaucagaagacgaagaacaacgacugggauuacguggucaccaccgacaucuccgagaugggggcgaacuuccgggcagaccgcguuaucgacccgcggagaugccugaagcccgucauccugaaggacgggccggagcgggucauucucgccgggcccaugcccguaaccgucgccuccgccgcgcagcgccgugggcgaaucggcagaaaucacaauaaagagggggaccaguauaucuacaugggccaaccccucaacaacgacgaggaccacgcucacuggacggaagcgaaaaugcuguuagacaacaucaauacccccgaggggauuaucccagcuuuauucgaaccggaacgggagaaauccgccgcgguagacggcgaguaccgccugcgcggagaagcccgcaagaccuucguggagcuuaugcggcgcggagaccugcccgucuggcuguccuacaagguggcgagugaggguuuccaguacagcgaccggcgcuggugcuucgacggggagcggaauaaccagguacucgaggagaacauggacguugagaucuggacgaaggagggcgagcgcaaaaagcuacggccccgcugguuggacgcccgaacuuacuccgaccccuuagcccuucgagaauucaaagaguucgcggccgggcggcgcagcgucagcggcgaucugauccuugagaucggcaaacugccgcagcaccugacccagcgugcgcagaacgcccuggacaaccuggugaugcuccacaacagcgaacagggcgggcgcgcguaccgucacgccauggaggagcucccugacaccaucgagacccugaugcuguuggcgcugaucgccguccugaccggcggcgugacguuauucuuccuguccgggcgggggcucggaaagaccagcaucggucuccugugcgucauggccuccagcguccugcucuggauggcguccguggagccccacuggauugccgccagcaucauccucgaguucuuccugauggugcuacugaucccggagccggaccgacagcgcacgccccaggacaaccagcuagccuacgucgugaucggccuccuguucaugauacugacggucgccgccaaugagauggggcuccuggagacgaccaagaaggaccugggcaucgggcacgucgccguggagaaccaccaucacgccgccaugcucgacguggaucuacaccccgcaagcgcguggacccuguacgccgucgcuaccacgaucaucaccccgaugaugcgccacaccaucgaaaacaccacggccaacaucagcuuaaccgcgaucgcuaaccaggccgccauccugaugggccuggacaagggcuggcccaucuccaagauggacaucggugucccccuccuggcccuggguuguuacucucaggugaacccccuuacccugaccgcggccgucuugauguuaguggcacauuacgcuaucaucgggccgggacugcaagccaaggcgacucgggaggcacaaaaacgcaccgcagccgggaucaugaagaaccccacagucgacggcaucguugccaucgaucuggaccccgugguguacgacgcgaaguuugaaaagcagcucggucaaaucaugcugcugaucuugugcaccucacagauccugcugaugcggacaaccugggcccucugcgagucgaucacgcuggcuaccggaccccuuacgacgcucugggagggcucuccggggaaguucuggaacaccaccaucgccgucagcauggccaauauauuccgcggcagcuacuuggcgggcgccgggcuggcguuuagcuuaaugaagagucucggcgggggccggcgcgggacgggcgcucagggcgagacccugggggaaaaguggaagcggcagcuaaaccagcuguccaagagugaauucaacacauacaagagauccggcaucauggaaguggaccggagcgaggcuaaagaggggcugaagcgcggcgagaccacgaaacaugccgugucccgggggacugccaaacuccgcugguucguagaacggaaccugguaaagcccgaggggaaggugaucgauuugggcugcgggagagguggauggagcuauuacugugccggccucaagaaggucaccgaggugaagggguacaccaagggcggccccgggcacgaggagcccauuccgauggccacguauggcuggaaccucgugaagcugcacuccgggaaggaugucuucuucaucccgcccgagaagugcgacacgcuguugugcgacauaggugaguccucccccaacccgaccaucgaggaggggcgcacccugcgagugcucaaaaugguagagcccuggcuccggggaaaccaauucuguaucaagauauuaaacccuuauaugccaagcgucgucgagacucuggagcagaugcagcgcaagcacggcgggaugcucgugcggaacccgcugucccgcaacucaacccacgagauguacuggguauccugcggcaccgggaacaucgucagcgcggugaacaugaccucccgcaugcugcucaaccgguucaccauggcucacagaaagcccacguacgagcgggacgucgaccuugggacuggcacccgccacguggccguagagcccgaggucgccaaccucgacauuaucgggcagagaaucgagaauaucaaacacgagcauaagucgacauggcacuaugacgaggacaaucccuacaagacaugggccuaccacggguccuacgaggugaagccgucuggguccgcuagcagcauggucaauggcgugguuaagcuccuuacuaaaccgugggacgucaucccaaugguaacgcaaaucgccaugacagacacuacccccuucgggcagcagcgcgucuucaaggaaaagguugacacccggacaccgaaggccaaacgcggcacugcucagaucauggaggugaccgcccggugguuauggggcuuccuuucccguaacaagaagccacggaucugcacccgcgaggaguucacacggaagguacgcagcaacgccgccaucggggcggucuucguggacgagaaccaguggaacuccgccaaagaagcgguggaagacgagcguuucugggaucuuguccaucgcgagagggagcugcauaagcaggguaaaugcgccacgugcguauauaauaugauggggaagcgcgaaaagaaacucggggaguuugggaaggccaagggcagccgggccaucugguacauguggcuuggcgcgcgcuuccuggaguucgaggcgcugggguuuaugaacgaagaucacugguucagccgggagaacucgcuguccgggguggagggggagggccugcacaagcucggguacauacugcgcgauauaagcaagauacccggcggcaacauguacgcugacgauaccgcagggugggauacccgcaucacagaggacgaccuccagaacgaggccaaaaucacggauauaauggagccggagcaugcccuccuggcaaaggccaucuucaaacugacauaccaaaacaaggucgugagaguacaacgccccgccaaaaacggcacagucauggacgucaucucccgucgcgaccagagagggagcggccaggucggcaccuacggucucaacacauucaccaacauggaggcacagcugauccggcagauggaguccgaggaaaucuucucgccuuccgagcuggagaccccuaacuuagccgagcgggcgcucgauuggcuggagaaguacggcguagaacgccucaagcggauggccauaucaggggaugacugcgucgugaagccgaucgaugaccgcuuugccaccgcccuaacggcccugaacgacaugggcaaaguacggaaggacaucccccagugggagcccagcaagggguggaacgacuggcagcaaguccccuucugcucucaccacuuccaccagcucaucaugaaggacggccgcgaaaucguagucccaugccguaaccaggaugaauuagugggccgcgcacgggugucccagggggccggcuggagccugcgagagaccgccugccucggcaagagcuacgcccagauguggcaacugauguacuuccaccggcgagaccuacggcucgcugacaaggcgaucggcuccgccgucccgguggacugggugcccaccucucgcaccacgugguccauccaugcccaccaccaguggaugaccaccgaggacaugcugagcgucuggaaucgcguguggaucgaggagaaccccuggauggaggacaagacccacauuuccucuugggaggacguaccguaccucggcaaacgggaggaccaaugguguggcucccugaucggcuuaacagcccgcgcgaccugggccaccaacauccaggucgcuaucaaccagguacgccgccugaucgggaaugaaaacuauuuagacuacaugaccagcaugaagcgguuuaagaacgagagugacccugagggcgcacugugguag

SEQ ID NO: 24344 - RNA, 9879 nt, Artificial Sequence
  derived and/or modified CDS sequence (opt11) from DENV-1__GQ199829__SS-prME
agcgugaccaugcugcucaugcuuaugcccaccgccuuagcguuccaucucaccacccgaggcggggagccccacaugaucgugagcaagcaggagcggggcaagucuuuguuauucaagaccagcgccggcgugaacaugugcaccuuaaucgccauggaccugggcgagcuaugcgaagacacgaugaccuauaagugcccucguauuaccgagaccgagcccgacgacguggacugcuggugcaacgccacggacaccugggugaccuacgguaccugcagccagacgggcgagcaccggcgcgacaagcgguccguggccuuggcgccccacgucggacuggggcuggagacccggacugagaccuggaugagcuccgaaggugcauggaagcaaauccagcgcgucgagacgugggcccuccgccaccccggguucaccgucauugcccuguuucuggcccaugcgaucggcacguccaucacgcagaaaggcauuaucuucauccuccugaugcuggugacgccuuccauggccaugagaugcgucggcaucgggucacgcgacuucguugaggggcuguccggcgccaccuggguggacgucgugcucgagcacgggagcugcgugacgacuauggcaaaggacaagcccacuuuagacaucgagcucuugaagaccgaggucacuaaucccgccguguugcggaagcucugcaucgaggcaaagaucucuaacaccacgaccgacagccgauguccuacccagggcgaggccacacugguggaagagcaggacgccaauuucgucugccggaggacgcuaguugaccggggcugggguaacggcugcggguuauucgggaagggcucccugaucacgugcgcuaaguucaagugcgugaccaaacuggaaggcaaaaucgugcaauacgagaaccucaaguacagcgugaucgucaccgugcauacgggcgaucagcaccagguggggaacgaauccacagagcacggcaccacggccaccaucacgccucaggcacccaccaccgagauccaguuaaccgacuacggagcccuuacccucgacugcagcccccgcacaggccuugacuucaaugagaugguccugcucaccaugaaggagaaguccuggcugguccacaagcagugguuucuggaccucccccugcccuggacaucgggggccucuacgucccaggagaccuggaaccggcaagaccugcucguuaccuucaaaaccgcucacgcgaagaagcaggaagugguggugcugggcagccaggagggcgcgaugcacacggcccuuaccggggcaaccgaaauacagaccuccgguacgacgacaaucuucgcugggcaucucaagugucgccugaaaauggacaagcuuacacucaagggcaugucauacgucaugugcaccgggaguuucaagcuagagaaggaaguggcggagacacagcacggaaccgugcugguccagaucaaguacgagggcaccgacgcgcccugcaaaauccccuucagcacucaggacgagaagggggugacucagaacggccggcugauuaccgcaaacccaaucgugacugacaaggagaagccggucaacaucgaggccgagccaccauuuggggaaucauacaucgugaucggcgcgggcgagaaagcgcucaaacugagcugguucaagaaggggaguagcauaggaaagauguuugaggccacggcucgcggggcccggcgcauggccauacugggcgacaccgcgugggacuuuggguccaucggaggcguuuucaccucagucggaaagcucguccaccagaucuucggcaccgccuauggcgugcuauucuccggcgucuccuggacgaugaagauagggauuggcgugcugcucaccuggcuaggguugaacucacgcaguacgagucucucuaugacuugcaucgccguggggcuggucacucuguaccucggcgugauggugcaggccgacuccgggugcgucaucaauuggaagggccgggaauugaaaugcgggagcggcauuuucgugaccaacgaggugcacaccuggaccgagcaguacaaauuccaggccgacagcccgaagcgccucuccgcggccaucgguaaggcaugggaggagggggucugcgggauccggagcgcaacucgauuggagaacauuauguggaagcagaucuccaacgagcuuaaccacauccugcucgagaacgacaugaaauucacgguagugguaggggacguggccggcauccuugcccaagggaagaaaaugauccggccccagcccauggaguacaaguacagcuggaaguccuggggcaaggccaaaaucaucggcgccgacgugcagaacaccaccuucaucaucgacgggccaaacaccccggagugccccgacgaccagcgagccuggaacaucugggaggucgaagacuacggcuucgggaucuuuacgaccaacaucuggcugaagcuccgggacagcuacacccaaguuugcgaucaccgccugaugucagcggccaucaaggacagcaaggccgugcacgccgacaugggcuacuggaucgaauccgagaagaaugagaccuggaaauuagcccgagcgagcuucauagaggucaagacgugcaucuggccccggagccauacccucuggagcaacggcgugcuggaaucugagaugauaauucccaagaucuacgggggcccgaucagccagcacaacuaccggccaggguacuuuacccaggcagccggccccuggcaccuggggaaacuggagcuggacuuugaccugugugagggcaccacggugguuguggaugagcauuguggcaaccgagggccgagucuccggacuaccaccguaacggguaagauuauccacgaaugguguugccgcagcuguacccuuccuccucugagauuccgcggagaggaugguugcugguauggcauggagauccgucccgucaaggagaaggaggagaaccuagugaagaguaugguaucugcgggcagcggcgaggucgacuccuuuagccugggccuacucugcaucuccauuaugaucgaggaggugaugcgcagccgguggucccgccgcaugcugaugaccggcacccuggccgucuucuuccuccugauuauggggcagcugacauggaacgaccucauccggcuguguaucauggucggcgcgaacgcaagcgaccgcaugggaaugggcaccaccuaccucgcccucauggccaccuucaagaugagaccuauguucgccgucggucuguuguuucgccggcucacgucacgcgaggugcugcuguuaacaauugggcugagccuggucgcgaguguggaacuccccaacucgcuggaggaacuuggcgacgggcucgcuaugggcauuaugaucuugaagcuucucacagacuuucagucccaccagcugugggccacacugcucucacugacguucaucaaaacuaccuucucgcugcacuacgccuggaaaacuauggcgauggucuuaagcauagugucacuguucccccugugccuaagcaccaccucccagaagaccaccuggcugcccgugcuguuggguagccugggcugcaagccccugacgauguuuuugaucgccgagaacaaaaucuggggacggcgcucauggccgcugaacgaggggaucauggccgucggcaucguaaguauccuucucagcucucugcucaagaacgacgugccccuugccgguccccucaucgcaggcggcaugcugauagcgugcuaugucaucagcggcucaagcgcggaucucucccuggagaaggccgccgaggucucuugggaagaagaggccgagcacaguggcgcgagccacaacauccugguggagguucaggaugacgggaccaugaagauaaaagacgaggagcgggaugauacgcucaccauucugcugaaagccacacuccuggcagugaguggcguguacccgcugagcaucccggccacccucuucgucugguauuucuggcagaaaaagaaacagcgcuccgggguccuuugggacacccccucgccuccggagguggagcgggccguacuugacgacgguauauaccgcaucaugcagcgggggcugcucgggcgcagccagguuggagugggggucuuccaggagaauguguuccacaccauguggcacgugaccaggggugcgguccugauguaucaggggaaacgccuagagcccagcugggccucagugaaaaaggaccucaucagcuacggcggcggauggagguuacaggggucauggaacacgggagaggaggugcaggucauugcuguggagccaggcaagaaucccaaaaacguacagacggcccccgggaccuucaagacccccgagggcgaggucggcgccaucgcacucgacuucaagccggggacgucagggucacccaucguaaaccgggaggggaagaucgucggccucuacggcaacggggucgugaccacgagcgguaccuacguuagcgccauugcccaagccaaagcgagucaagaggggccucugcccgagaucgaggacgagguuuuucggaagcgcaaucugacgaucauggaccuucaccccggcuccgggaagacucggagauaucugccggccaucgugcgggaggcgaucaagcggaaguugcgcacccucauccuagcuccgacccgaguaguggccuccgagauggcggaggcccugaagggcaugcccauucgcuaccagacgaccgccgugaagagcgagcacacuggcaaggagaucguggaucucaugugccacgccaccuuuacgaugagacugcucuccccgguacgcgucccgaacuacaauaugaucauuauggacgaggcccacuucaccgaccccagcaguaucgcugcccgugguuacaucagcacccgcguggguaugggggaggccgcugcaaucuucaugaccgcgacgccgcccggcuccgucgaggccuucccgcagucaaacgccgugauucaggaugaggagcgggacauccccgaacguaguuggaacaguggguacgaguggauuacggacuuccccggcaagaccgugugguucguccccagcaucaagagcggaaacgauaucgccaacugccuccggaagaacgggaagcgcgugauccaacugucccgaaagaccuucgauacggaauaccagaagaccaaaaauaacgacugggacuacgugguuaccacggacaucagcgagaugggcgcgaacuuccgcgcagaucgagugaucgacccgcgcagaugccugaaacccgugauccucaaagacgggcccgagcgcgucaucuuagcaggccccaugccagugacgguagccuccgccgcgcagcggcgugggcgcauaggccggaaccacaacaaagagggcgaccaguacaucuacaugggccagcccuuaaacaaugaugaggaccacgcgcacuggaccgaggccaagaugcuccuggacaacaucaauacccccgaggguauaauccccgcccuguuugagccggagcgcgagaaguccgccgcuaucgacggggaguaccgguuacgcggugaggcccggaagacguucgucgagcuuaugcgcaggggggaccugccagugugguugucguacaagguggcaagcgaaggcuuccaguacagcgaccgccgguggugcuucgacggagagcgcaacaaccaggugcuggaggagaauauggacguggaaauuuggacgaaggagggggaacggaagaaguugcguccgagauggcuagacgccaggaccuacagcgacccccuggcgcugcgggaguucaaagaguucgcggcgggucgccgguccgucuccggugaccucauccuggagauaggaaaguuaccucagcaccucacccagagagcucagaacgcuuuggacaaccuugugaugcuccauaauucugagcagggaggacgggcguaccgccacgccauggaggagcugcccgacaccauagagacgcugaugcuccuagcccuaaucgcagugcuuacaggaggggucacacuguucuuucuguccggccgggggcuugguaagaccagcaucggcuugcugugcgugauggcgucuagcgugcuccucuggauggcuagcguugagccccacuggauagccgccuccaucauccuggaguucuucuugauggugcugcugauacccgagccggaucgccagcgcacgccccaagauaaccagcuagccuacguggucaucggguugcuguuuaugauccucacgguggcugcaaacgaaaugggccuuuuggagaccaccaagaaggaccucggcauuggucacguggcggucgagaaccaccaccacgcugcaaugcuagacguggaccugcaccccgcuuccgcguggacccuuuacgccguggccacgaccaucaucaccccgaugaugcggcacaccaucgaaaacacgaccgccaacaucagccugaccgccaucgcuaaccaagccgccauccugaugggccucgacaaaggcuggcccauuucaaagauggauaucggcgucccccuguuggcccucgggugcuacucucaggugaacccccugacccucacggcggccgugcucaugcugguggcccauuacgccauuaucgggccagggcugcaggcaaaagcgacccgcgaggcccagaagcgcaccgccgccggcaucaugaaaaaccccaccguggacgguaucguggccaucgaccuagaccccguaguauacgacgcgaaauucgagaaacagcuuggccagaucaugcugcucauccugugcacgucccaaauccugcucaugcggaccaccugggcccugugcgaauccaucacccuggcaacgggcccccucaccacccuaugggaggggucaccgggcaaauucuggaacacuacgaucgccgugagcauggccaauauauuccggggguccuaccuggcaggcgcgggauuagccuucagccugaugaagucccucggcggcgggaggagggggaccggggcccagggcgagacccucggcgagaaguggaagcgccagcugaaccaguuauccaagucugaauuuaauaccuacaagcgguccgguaucauggaagucgaucgcagcgaggccaaggaaggccuaaaacgcggggagacgaccaagcacgccgugucccgcggcaccgccaagcugcggugguuuguggagcgcaaccuggucaagcccgaggggaaggugaucgaucugggguguggccggggcggguggagcuacuacugcgccggguugaagaaaguuaccgagguuaagggguacacgaaaggcggccccggccacgaggagcccaucccgauggccacauacggguggaaccuuguuaagcugcauagugguaaggacguguucuucaucccgcccgagaagugcgacacccuccugugcgauaucggggagagcucccccaacccgaccaucgaggagggccgcacucugcguguccugaagauggucgagcccuggcugcgugggaaccaguucuguauaaagauccuaaaccccuacaugcccagcgugguugagacccucgagcaaaugcaacgcaaacacggcggcaugcuggugcguaacccgcugucccgcaauagcacccacgagauguauugggucuccuguggcaccgguaacaucgucagcgcugugaauaugaccucccggaugcuccuuaaccgcuucacgauggcucaccgcaagcccaccuacgagcgcgauguggaccuaggggccggcacccggcacgucgcggucgaacccgagguagcaaacuuagacaucaucggccagcgcaucgagaacaucaagcacgagcacaaaagcaccuggcacuacgacgaggauaaccccuacaagacaugggcguaccacggguccuacgaggucaaaccgagcggcuccgccagcucaauggugaacggcgucgugaagcuccugaccaagcccugggaugugauccccaugguaacucagaucgccaugaccgacacgaccccauucggccagcagcggguguucaaggagaagguggacacgcgcaccccgaaggccaagcgggggacugcacaaaucauggaaguaaccgcgaaguggcucuggggcuuccuaucccgcaacaagaagccuaggauauguacucgggaagaguucacccggaaggugcgcuccaaugccgccaucggggccguguucguagacgagaaccaguggaacuccgcgaaggaagccguggaagacgagcgguucugggaccuagugcaccgcgagcgggagcuacacaaacaggggaagugugcgacgugugucuacaacaugaugggaaagcgcgaaaagaagcugggcgaauucggcaaagccaagggcagccgggccaucugguacauguggcugggcgcgcguuuccucgaguuugaggcucugggguucaugaacgaagaucacugguucucccgggagaacucccuguccgggguggagggcgaaggguuacacaagcucggcuacauccugcgcgauaucagcaagauacccgggggcaacauguacgcagaugauaccgcaggaugggacacccggaucacagaagaugaccuccagaacgaggcccggauaacggacauaauggaaccggagcaugcgcugcuugcuaaauccauauucaagcucaccuaccaaaacaaggugguccgcgugcagcggcccgccaagaacggaacagugauggaugucaucagucgccgggaccagcgcggcaguggccaggugggcaccuacggacugaauacguuuaccaacauggaggcccagcugauccggcagauggaaagcgaggguaucuucucgcccuccgagcucgagacccccaauuuggccgaacgagugcuggacuggcucgagaaguauggcgucgagaggcucaagcgcauggcgauuuccggggacgacugugucgugaagccgaucgacgaccgguucgcaacagcccugacggcccucaacgacaugggcaaaguccgcaaagauauuccccagugggaaccgagcaaggguuggaacgauuggcagcagguccccuuuugcucccaccauuuccaccagcugauuaugaaggacggccgggagauuguggucccgugucgcaaccaagacgagcucgugggccgggcacgggucucacagggggcuggcuggagccucagagaaacggccugucuggggaagucguaugcccagauguggcaguuaauguacuuccaucgucgggaccuccgccuggccgcgaacgccaucugcagcgcuguccccguggacuggaucccaaccucccgcacaacguggagcauccacgcucaccaccaguggaugaccaccgaggacaugcuuuccguauggaaccgggucuggaucgaagagaaccccuggauggaggacaagacccacauaucauccuggggcgaugugccguaccucgggaagcgcgaagaucaguggugcggcuccuuaaucggccugacggcccgggcgacaugggccacaaacauccagguugccaucaaccagguccgccggcucaucgggaacgagaacuaccuggacuauaugaccucuaugaagagauucaagaacgagucugaccccgaaggcgcccugugguga

SEQ ID NO: 24345 - RNA, 9879 nt, Artificial Sequence
  derived and/or modified CDS sequence (opt11) from DENV-1__FJ882562__SS-prME
uccguuaccaugcugcucaugcuuaugccuaccgcucuggccuuccaccucaccacccggggcggggagccccacaugaucgucucuaagcaggaacggggcaagagccugcuguucaagacaagcgccggagugaacauguguacccucaucgccauggaccugggcgagcugugcgaggacacgaugacauauaagugcccucggaucaccgaggccgagcccgacgacguggacugcuggugcaaugccacggacacgugggugacuuaugggaccugcucccagaccggcgaacaccgacgcgacaagcgcagcguggcccucgcaccacacguaggccuagggcuugagacccgcaccgagaccuggaugagcuccgagggcgcuuggaagcagauucagcgggucgagacgugggcgcuccgccaucccggauucacggugauugcccuguuucuggcucaugccaucggcaccucuaucacccagaaaggaaucaucuucauucuucuaauguuggugaccccauccauggccaugaggugcguuggcauagggagccgagacuuuguggagggacucucuggcgccaccuggguggacguugugcuggagcacgggucuugcgugaccaccauggccaaagacaagccgacccuggacaucgagcuccugaagacggaggucaccaaccccgcuguccugcggaagcucugcaucgaggccaagauuuccaacaccaccacugacagcaggugccccacccagggcgaggcgacccuaguggaggagcaggacgccaacuucgugugcaggcgcaccuuuguggaccggggcugggggaauggcugcggguuauuugggaaagggucacucaucacuugcgccaaguuuaagugcgugaccaagcuggagggcaaaaucguccaguaugagaacuuaaaguacagcgugaucgugaccgugcacaccggugaccagcaccagguggggaaugagucaacggagcacgguaccaccgcaaccauuacgccccaggcgccgacuaccgagauccagcucaccgacuacggggcccugacccuggacugcucaccgcgcacgggauuagacuucaacgaaaugguacugcugaccaugaaggagaagucauggcucgugcacaaacagugguuccuggaccugccccugcccuggacgagcggggccagcaccucccaggagacuuggaaccgacaagaccugcuggugaccuuuaagaccgcacacgcgaagaaacaggaggucgucgugcugggcagccaggagggcgccaugcauacggcccuuacgggagcgacugaaauucagaccuccggcacgacaaccauuuucgccgggcaccugaagugccgccucaagauggacaagcugacccugaaggguaugucauacgucauguguaccggauccuucaaacucgagaaggaaguagcggagacccagcaugguaccgugcugguccaaaucaaguaugagggcaccgaugcccccugcaaaauccccuucagcacccaggacgagaagggagugacgcagaauggucggcugauaaccgcuaacccuaucgugaccgacaaggagaaaccagucaacaucgaagccgaaccgcccuucggugagucuuacaucgugaucggugcgggcgagaaggccuugaagcucagcugguuuaagaagggguccagcauagggaagauguucgaggccaccgcccgcggggccagacgcauggcgauacugggcgacacugcuugggacuucggguccaucggcggccuguucaccaguguggguaagcucguccaccagaucuucggcaccgccuacgggguccuguucucuggcguaagcuggaccaugaagauaggaauaggcguacugcucacguggcugggccugaauucucgcucuaccucacucagcaugaccugcaucgccgugggacuggugacuuuauaccucggcguaauggugcaggccgacuccggcugcgugauaaacuggaagggucgcgagcugaagugcgggagcggcaucuucguaacgaacgaggugcacaccuggaccgagcaguacaaauuccaggcggacagcccgaagcgccuguccgccgcgauaggcaaagccugggaagaggggguauguggcauaagaagcgcgacacggcucgagaacaucauguggaagcagaucuccaacgagcugaaccauaucuugcucgagaaugacaugaagcugaccgucguggugggugacgucgcgggcauacuggcccaggggaagaagaugauccgaccccagccuauggaguacaaguacagcuggaaauccuggggcaaggcuaagauaaucggggcugacgcacagaauacgaccuucaucaucgacgggcccaacaccccggagugccccgacgaccagcgcgcauggaacaucugggagguggaggacuacggcuucggaaucuucaccacgaacaucuggcucaagcugcgggacagcuauacacaggugugcgaccacagacugauguccgcggccauuaaggacagcaaggccguucacgcagacaugggcuacuggaucgaguccgaaaagaacgagacguggaaguuggccagggccagcuucauugaggugaagaccuguaucuggcccaaaagccacacucucuggaguaacggugugcuugaguccgaaaugauuauccccaagaucuacgggggcccgaucagccagcacaacuacaggcccggguacuucacacaaacugccggcccguggcaccucgguaagcuggagcuggacuucgaccucugcgagggaaccacggucgugguugacgagcacugcggcaaccgggguccuuccuuacgcaccaccacuguuacgggcaagaucauucacgagugguguugccggagcugcacccugccgcccuuaagauuccguggggaggacggcuguugguacgggauggagauccgccccguuaaggagaaggaggagaaucuggugaaaucgauggucagcgccgggagcggcgaagucgacucauucagcuuggggcuccugugcauauccaucaugaucgaggaggugaugcggucacgcuggucccgaaaaaugcugaugaccggcacccuugcgguauucuuccuguugaucaugggccagcucaccuggaacgaccugauucgccugugcaucauggugggugcuaacgccagugaccgcauggggaugggcaccacauaccucgccuuaauggcgaccuucaagaugcgucccauguucgcgguggggcuccuguucagacggcugaccucgcgcgagguccugcucuugacuauagggcugucacucguggccuccguggagcugccaaacucucuggaggagcucggcgacgggcuugcgaugggcauaaugauccuuaagcuccuaaccgacuuccagucccaccaguugugggccaccuuacugucucugacguuuauaaaaacuacguuuucuuuacacuacgcuuggaagaccauggccaugguccugagcaucgucucccuguucccccucugccugagcacgaccagccagaagacuaccuggcugccuguucucuugggcagccucggaugcaaaccucucacgauguuccucauugcggagaacaagauauggggaaggaaguccuggccacugaacgaggggaucauggcgguggguaucgugagcauccuucuuagcucccuacucaagaacgacgucccgcucgccgggcccuuaaucgcuggcggcaugcucaucgcgugcuacgugauuagcggguccucagccgaccuuucccuggagaaggccgcugaggugagcugggaggaggaggcggagcacuccggggcuagucacaacauccucgucgaaguccaggacgacgggaccaugaaaauaaaagacgaggagcgugacgacacccugaccauacugcucaaagccacacuguuagccguguccgggguguacccgcuaagcauccccgcgacgcuauuugucugguacuucuggcagaaaaagaaacagcggucaggagugcugugggacacccccagcccgccagaggucgagcgcgcuguguuagaugacggcaucuaccggauuaugcagcgcggccuccuggggagaucacaggugggcgucggcguauuccaagagaacguguuucacacuauguggcacgucacccgcggcgccguacugauguaccagggcaaaaggcucgaacccagcugggcgagcgugaaaaaggaccuaauuagcuacggcggcggguggcgccugcaaggcuccuggaauacgggggaggagguccaggugauagccguugagcccggcaagaacccaaagaacguccagaccgcucccgguaccuucaaaacccccgaaggcgagguaggagcgaucgcccucgacuucaagcccggaacgagcggcuccccuaucgugaaccgggagggcaagauuguugggcucuacgggaacggcguggugacuaccagcggcaccuacguaagcgcaauugcccaggccaaagccucccaagaggggccgcuuccggagauagaggacgagguguuccgcaagcggaacuuaacgaucauggaccugcaccccggcagcggcaagacucgccgguaccugccggccaucguaagggaagccaucaaacggaagcuccgcacccugauccuggcccccacccgcgucguggcuuccgagauggcagaggcccucaaaggcaugcccauucgguaucagacgacagcggucaagucagagcacacaggcaaggagaucguggaccugaugugccacgccaccuucaccaugaggcugcucuccccuguccggguaccgaacuacaacaugaucaucauggacgaggcgcacuucaccgaccccagcaguaucgccgcccgcggguacaucagcacccggguuggcaugggggaggccgccgcgaucuucaugacugccacgccgcccgguaguguggaagcuuuuccgcagaguaacgccgugauccaggacgaagagcgugacaucccagagcgguccuggaacagcggguacgaguggaucaccgacuuccccggcaagaccgucugguucgugccuuccaucaaguccggcaaugacaucgcuaacugcuugcgaaagaacgggaaacggguaauccagcucagucgcaagaccuucgacacagaguaccagaagacuaaaaacaacgacugggauuacgucgugaccacugacaucagugagaugggcgccaacuuucgcgccgaucgcguuauugacccacggcgcugucucaagccugucauccugaaggacgggcccgagcgagugauccuggccggaccaaugccugugacggucgccuccgcggcccagcgccgggggcgcaucggaaggaaccacaacaaggagggcgaccaguacauuuacauggggcagccccucaauaacgaugaggaccaugcccacuggaccgaggccaagaugcugcuggacaacaucaauacgcccgagggcauuauccccgcccucuucgagccggagagagagaaguccgcggccauagacggggaguacagacuacggggcgaagcccgaaagacauucguggagcugaugagacguggggaccuccccgucuggcuguccuacaagguggccagcgagggauuccaguacagcgaccggcgguggugcuucgacggcgaacggaacaaccaaguacuggaggagaacauggacgucgagaucuggacgaaggagggggagcgcaagaaacuccggccccgguggcuagacgccagaacauacuccgacccgcuggcguuacgcgaguucaaagaguucgccgccggccgucgcagcgugaguggagaucugauccuggagauaggcaagcugccgcagcaccuuacccagcgggcccaaaaugcguuagacaacuuaguaaugcugcacaacagcgagcaggguggacgcgccuaccggcacgccauggaggagcugcccgacaccaucgagacauugaugcuccucgcccucauagcgguucuaaccggcggagugacccuguucuuccucucuggccgcgggcugggcaaaacuaguaucggccugcucugcgugaugaccucgucaguccugcuguggauggcgagcguggagccccacuggaucgccgccagcauaauccucgaguucuuccugauggugcugcucaucccugaaccggaccggcagcgcacgccucaggacaaucagcuggccuaugucgugaucggucuccucuucaugauccugaccguggcagcgaacgagaugggccuguuagagacuaccaaaaaggaccugggaaucggccacgucgccguggagaaccaccaccaugccgccaugcuggacguggaccuccauccagccuccgcguggacuuuguacgccgucgccaccacuaucaucaccccgaugaugcgucauacgaucgagaacaccaccgcaaauaucucucugacugcaaucgcgaaucaggccgcgauccucaugggucuggacaagggguggcccauuuccaagauggacaucggcguuccucugcucgcccuugggugcuauucgcaggugaacccacugacacucaccgcugccguccugaugcugguggcccacuaugcaauuaucggaccggggcuccaggcuaaggcgacucgugaggcccagaagcgcaccgccgccggcaucaugaagaaccccacaguggacgggaucgucgccaucgaccuugaccccguuguguacgacgcgaaguucgagaaacagcucggccagaucaugcuccugaucuuaugcaccucccagauccuucugaugcggaccaccugggcccugugugagagcauuacgcucgccacggggccccuuacuacccugugggaggggucuccgggcaaauucuggaacacgaccaucgccgucagcauggccaacauauuucgcggguccuaccucgcgggcgccgggcuagccuuuagccucaugaagagucucgguggggggagaaggggcaccggggcgcagggcgagacacugggugagaaguggaagcggcagcugaaccaauuauccaagagcgaauucaacacguacaagcguagcgggaucauggagguggaccggagcgaggcgaaggagggccugaagcgcggugagacgaccaagcacgcugugucccggggaaccgccaaacucaggugguucgucgagcggaacuuagugaaacccgaggggaaagugaucgaccucggcugcggccgcggcggcuggagcuacuauugcgccgggcugaagaaaguuacggaggugaaaggcuacaccaagggcgggcccggccacgaagagccuaucccgauggccacguacggguggaaccuggugaagcuccacuccggcaaggacgucuucuucauuccacccgaaaagugcgacacccugcucugcgacaucggggagagcucucccaacccgacgaucgaggaaggccggacccuucgagugcugaagaugguagaaccguggcugcgcggcaaccaguucugcauaaagaucuuaaauccguacaugcccagcgucguggagacacuggagcaaaugcagcgcaaacacggcgggaugcugguacggaacccgcugucgcgcaacagcacccacgaaauguacugggucaguugcgggaccggcaauaucgugagcgcggugaacaugacgucccgaaugcuucugaaccgcuuuacgauggcccaccgcaaacccaccuacgagcgggaugucgaccucgggacgggcacgagacacguggccguggagcccgaggucgcaaaccucgacaucaucgggcaacguaucgagaacauaaaacacgagcacaaaucgaccuggcacuacgacgaagacaaccccuacaagaccugggccuaccacgguuccuacgaagugaagcccagcggcuccgcgagcuccauggugaacggggucgugaaacugcucaccaagcccugggacgucaucccuauggugacgcagauagcuaugaccgacaccacccccuuuggccagcagcgcguauucaaggaaaagguugacacgcguacccccaaggccaagagagggaccgcccaaaucauggaggugacggcccgguggcuguggggcuucuuaucgcgcaacaagaagccacggaucugcacgcgagaggaguucacccggaaagugcgcagcaaugcagccauuggcgcagucuucguggacgagaaucaguggaauagcgccaaggaggcgguugaggacgaacgguucugggaccucgugcaccgcgaacgggagcugcacaagcaagggaagugcgcgaccugcguguacaacaugaugggaaagagggagaagaaacuaggugaguucggaaaggccaaagggagccgagcgaucugguacauguggcucggggcacgauuccuggaauucgaggcguuaggcuucaugaaugaagaucacugguucucaagagagaacagccucuccggcguggagggcgaggggcugcauaagcuuggauacauccuacgcgacaucagcaagauccccggagggaacauguacgcagacgacacggccgggugggauacgcggauaaccgaggacgacuugcaaaacgaggccaagauaacugacaucauggagccggagcacgcccugcucgcgaaagcaauauucaagcucaccuaccaaaacaaggucgugcgcgugcagcgccccgccaagaacgggacgguuauggacguuauaucucggcgcgaccagcgggguagcggccaaguggggaccuacggccugaacaccuucacuaacauggaggcccagcucaucaggcagauggaguccgaggggaucuuuucgccaucagagcuugagacgcccaaccuggcugaacgggcgcuagacuggcuagagaaguacggcgucgaaaggcugaagcguauggcuaucagcggggaugacugcgugguuaagccgauagacgaucgcuuugccaccgcgcucaccgcacugaacgauaugggcaaaguccggaaagauauaccccagugggagcccuccaaaggguggaaugacuggcagcaagucccauucugcagucaccacuuccaccagcuaauuaugaaggacggccgggagauugucgucccuugccggaaccaggacgagcuggucggcagggcacgggucucacagggagccggauggucgcuacgcgagaccgcuugccugggcaaaagcuaugcucagauguggcaacucauguauuuucaccggcgugaccuccggcuagcagcuaacgccaucuguuccgcagucccaguggacugggugcccaccagccgcaccacaugguccauucacgcgcaccaccaguggaugaccacggaagacauguuaagugucuggaaccggguguggaucgaagagaacccuuggauggaggacaagacccacaucuccagcugggaggacgugccauaccugggcaagcgggaagaucaguggugcgguucccucaucggcuuaacagcacgcgcuaccugggccaccaacauccaggucgccaucaaccaagugcggcgcuuaaucgggaacgagaacuaccuggacuacaugacgucaaugaagagguucaagaacgaguccgaccccgaaggagcccucugguaa

SEQ ID NO: 24346 - RNA, 9879 nt, Artificial Sequence
  derived and/or modified CDS sequence (opt11) from DENV-1__FJ882564__SS-prME
ucggugacuaugcugcugaugcucaugccuacugccuuagccuuccacuuaaccacgcggggcggggagccccacaugaucgugacuaaacaggagcgggguaaaucccugcuguucaagaccagcgcuggggugaacaugugcaccuugaucgcaauggaccugggcgagcugugcgaggacacgaugaccuauaaaugcccucgcaucaccgaggccgagccggacgacguggacugcuggugcaacgccacugauacgugggugaccuacggaaccugcagccagacgggggaacaucggcgcgauaagcgguccguagcacuugcgccccacguaggucucgggcuggagacccgcacagaaaccuggauguccagcgaaggugccuggaagcagauccagcgggucgagacaugggccuuacgacaccccggguucaccgugaucgcgcuguuucuggcgcaugccaucgggaccuccaucacccagaagggcaucauauucauucuccugaugcugguaacgcccagcauggccaugaggugcgucggcaucggcucccgcgacuucguggaggggcucagcggcgccacuuggguggacgucguguuagagcacgggucauguguaaccacgauggccaaggauaagcccacccuggacaucgagcuucuaaagacugaggucaccaaccccgcgguccugcguaagcugugcaucgaggccaagaucagcaacaccaccaccgacucccgcugcccgacccaaggcgaggccacccugauggaggaacaagacgccaacuucgugugccggcgaacguucgucgauagaggcugggggaacggcugcggcuuguucggcaaggggagccucaucaccugugcgaaguucaagugugugaccaagcuagagggcaagauuguccaguacgagaaccugaaguacuccgucaucgugaccguucacacgggugaccaacaccaggucgggaacgagagcaccgagcacggcaccaccgcgacgaucacgccccaggcccccacgucggagauccaacucaccgacuacggggcucugacccuagauugcagcccccgcacgggccucgauuucaacgaaaugguuuugcuaaccaugaaggagaaguccuggcucguccacaagcagugguucuuagacuuaccgcuccccuggaccagcggggccagcaccucccaggagacguggaaccggcaggaccuguuggucaccuucaagacggcccacgcgaagaagcaggagguggucgugcucggaagccaggaaggcgcuaugcacaccgccuuaacgggggcuaccgagauccagaccuccggcaccacgacaaucuucgccggacaccugaagugccgccuaaaaauggacaagcugaccuugaaggggaugagcuacgugauguguaccggguccuucaaauuagagaaggaaguggcggagacgcagcacggcaccguucuggugcagaucaaauacgaaggcacagaugcgcccugcaagauccccuucagcacccaggacgagaaaggggucacgcagaacggucgguuaauaaccgccaacccgaucgugacggacaaggaaaagcccgugaacaucgaagccgagccacccuucggggaguccuacaucgucaucggugcgggcgagaaggcucugaagcucucaugguucaagaaggguagcagcaucggcaagauguucgaggccacggccaggggcgcccggcgcauggcaauccugggggauacggccugggacuucggguccaucggcggcguguuuaccagcguggggaaauuaguacaccagaucuucgggaccgccuaugggguccuguucucuggcgugucuuggaccaugaaaaucgggauaggcguccugcugacguggcucggacugaacucccgcuccacgagccugagcaugaccugcaucgccguggggcucgugacccuguaccugggcgucauggugcaggccgacuccgggugugugaucaacuggaaaggccgcgagcucaagugcggcagcggcaucuucguaacgaacgaagugcacaccuggaccgagcaguacaaguuucaggcugacucgccgaagaggcugagcgccgccauuggaaaggccugggaggagggggugugcggcaucagaagcgcuacucgccuggagaacauuauguggaagcagaucuccaacgagcugaaccacauccugcuggagaacgggaugaaguucacgguuguugugggugacgucguggggauccucgcgcaaggaaagaagaugauccgaccccagcccauggagcacaaguacagcuggaaaagcuggggcaaggcgaagaucauaggcgccgacgugcagaauacaacauucaucauugacgguccaaacacaccggagugccccgacgaucaacgggccuggaacaucugggagguagaggacuacggguucggcaucuucaccacgaacaucuggcuaaagcugcgggacagcuacacacaggucugcgaucaucgccucaugucagcggccauuaaggacagcaaggccgugcacgcugacaugggcuacuggaucgaguccgagaagaacgagaccuggaagcuggcccgagcgagcuucaucgaggucaagaccugcaucuggcccaagucgcauacucuguggagcaacgggguccucgaguccgagaugaucauccccaagauuuauggagggccgaucagccagcacaacuaccgccccggguacuucacccagaccgccggucccuggcaccuaggaaaauuggagcuagauuucgaucugugugagggcaccacgguggucgucgacgagcacugcgguaaccggggaccgucccugcgcaccaccaccgugacagggaagaucauccacgaguggugcugucggagcugcacccugccuccucuccgcuuuaaaggcgaggaugguugcugguacggaauggagauccggcccguuaaggagaaggaggagaauuugguaaaguccaugguuagcgcaggcuccggggaagucgauuccuucagccucggccugcugugcaccuccauuaugaucgaggaggucaugcgcagccgguggucccgcaagauguugaugacugggacguuggccguauuuuuacuccuuauuaugggccagcugacauggaacgaccucauacgacugugcaucauggucggggccaaugcaagcgaccguaugggcaugggcaccacauaccucgcgcucauggcgacguucaagaugcgaccgaugguggccgugggucugcuguuucggcgccuaaccucccgcgagguccugcugcuuacgauugggcugagccugguggccucugucgagcuccccaacucucuggaggaauugggugacggccucgcgaugggcaucaugauccugaaacugcuaacggacuuccaaucccaccagcugugggccacgcuguuaagccuaaccuucaucaagacuacccucucucuccauuacgccuggaaaacgauggccaugguuuugagcaucgugucccuguucccccuaugccugucgaccaccucccagaagaccacuuggcugccaguccuccuugggagccugggcugcaagccgcucaccauguuccugaucgcggagaacaagaucugggggcgcaagucguggcccuuaaacgaggguaucauggccguggggguagugagcauccucuuaagcucgcugcucaagaacgauguuccccuagccggcccccugaucgccggcgggaugcucaucgccugcuaugugaucagcggguccagcgcggaucuuucccuggagaaggcugcugaggucaguugggaggaggaggcggaacacucaggggccagccacaacauucucguagaggugcaggacgacggcacgaugaagaucaaggacgaggagcgggacgacacccugaccaucuugcucaaggcgacguuacuggcagucuccgggguguacccgcucagcauccccgccacccuguucgugugguauuucuggcagaagaagaagcagcgcaguggcguccugugggacacucccagcccgcccgagguggagcgggccgugcuagacgacggcauuuaccgcauaaugcagcggggguuacugggccgcagucaggucggugugggaguauuccaggagaaugucuuccacaccauguggcacgugacgcgcggggccguucugauguaccagggcaaacgcuuagagcccagcugggcuuccgucaagaaggaccugauaagcuacggcggggguuggcggcugcagggguccuggaacacuggcgaggagguccaggugauugccgucgagccagggaagaauccaaagaauguccagacggcccccggcaccuucaaaacgcccgaaggagaggugggggccauagcccucgauuucaagcccggcaccagcgggucccccaucgucaaccgcgaggggaagaucgugggcuuauacggcaacggcguugucaccaccagcggcacguaugugucagcgaucgcccaggccaaggccucccaggaggguccgcugcccgaaauagaggacgagguguuccguaagcgcaaccucaccaucauggaccugcaccccgggagcgggaagaccagacgcuaccugccggcuauagucagggaagcaauuaagcgcaagcuccggacccugauccuggcccccacacgcguaguagccuccgaaauggccgaggcgcucaagggaaugcccauccgguaccagaccacggccgucaagucugagcauaccgggaaggagaucguggacuugaugugucacgcuacguuuacuaugcgguugcucuccccgguccgcgucccgaacuacaacaugaucaucauggacgaggcccauuucaccgaccccaguucgaucgcagcgcggggcuacaucagcaccaggguggguaugggcgaagccgcugcaaucuucaugacugcaacgccgccaggcuccguggaggcguuuccgcagagcaacgcuguuauucaggacgaagagagggacauccccgagcgauccuggaacagcggcuacgaguggaucaccgauuuccccggcaagaccguaugguuugugcccuccaucaaauccgggaaugacaucgccaauugcuuacggaagaacggcaagcgcgucauccaacugucccggaagacuuucgacacggaguaccaaaagacgaagaauaacgauugggacuacguggugaccacugauauaagcgagaugggggcaaacuuccgcgcggaccgggucaucgacccgcgccgcugccugaaacccgugauacugaaggacgggccggagcgcgugauccuggccgggcccaugccggugaccguggccucugccgcacagaggcgcggccggaucgggcgcaaucacaacaaggagggggaccaauacaucuacaugggccagccgcucaauaacgacgaagaccacgcacacuggaccgaggcgaagauguuauuggacaacaucaacacacccgaggggauuauccccgcacucuucgagccggagcgggagaaguccgccgccaucgacggcgaguaccgcuugcgcggggaggcgcggaagacuuucgucgagcugaugaggagaggggaccuacccgugugguuauccuacaagguggccucggaaggauuccaguacagugaccgcagauggugcuucgacggggagcggaacaaccagguucuggaggagaacauggacguugaaaucuggaccaaggagggugaacggaagaaacuccgcccucgauggcuggaugcccgcaccuacuccgacccacuggcccuccgggaguucaaagaguuugccgcggggcgccgcuccguguccggcgaccugauacuggagaucgggaagcucccgcagcaucucacccagcgcgcucagaacgcccuugacaaccucgucaugcugcacaacagugaacagggcggacgggccuaucgccacgcgauggaggaacugcccgacacgaucgagacccucauguugcuggcccucauagccgugcuaaccgggggcgugaccuuauucuucuugucagggcgcggccugggaaagacgagcaucggguuacugugcgucauggccuccagcgugcugcuguggauggcauccguggagccccacuggaucgccgcgucaauaauucucgaguucuuucugaugguccucuuaauccccgagcccgaccgccagcggacgccccaagacaaccaguuagccuacguagugaucggccuccucuuuaugauccuaacugucgccgccaaugagauggggcugcucgagaccaccaagaaagaccugggcaucgggcacguggcgguggaaaaccaccaccaugccacgaugcuggacgucgaccuccaucccgcuagugccuggaccuuauacgccguggcgaccaccauaaucacgccgaugaugcgccacaccaucgagaauaccaccgccaacauaagccuaacggccaucgccaaccaggcggcgauccucaugggccuggauaagggcuggccaauuuccaagauggacaucggggucccccugcucgcucugggauguuauagccaggucaacccccugacgcucacagcugccgugcugauguugguggcgcacuacgcgaucaucgggccaggacuccaagccaaggcuaccagggaggcccaaaagcguacggcggccgguaucaugaaaaaccccaccgucgacggcaucguggccaucgaccuugaccccgucguauacgaugccaaauucgagaaacaacugggccaaauaaugcuccuaauccugugcacaucccaaauccuccugaugcgcacgacgugggcccugugcgagagcaucacccucgcgacggggccccugaccacgcugugggaaggcuccccugggaaauucuggaacaccaccaucgccguguccauggcgaacaucuuccggggcuccuaucucgccggagccgggcuggcguucagccugaugaagucccucggcgggggccgccgggggaccggagcccagggcgagacgcugggggagaaguggaaacggcaacugaaccagcucuccaagagcgaguucaauauauacaaacgguccggaaucauggagguggaucgcucagaggccaaggaggggcuaaaacggggcgagacaacccgccacgccgucucacgggggaccgccaagcuccgcugguucguggagcggaaucuggugaagccggagggcaaggucaucgaccuuggcugcggacgcggcggguggagcuacuacugcgccggccuuaagaaagugacggaggugaagggguauacaaaaggaggcccugggcaugaggagccaaucccgauggcgaccuacggcuggaaccuggucaagcuccacuccgggaaggacguauucuucacgccgcccgagaaaugcgacacgcugcugugcgauaucggcgagagcucccccaauccgaccaucgaggaggggcgcacccuacgcguucugaagauggucgagcccuggcugaggggaaaucaguucugcauaaagauccugaacccauacaugcccagcgugguggaaacccuggagcaaaugcaacgcaagcauggcggaaugcucguucggaacccgcucuccaggaacagcacccaugagauguacuggguguccugcgggacgggcaacauugucagcgcagucaauaugaccucucgaaugcugcugaaccgauucacgauggcucaccgaaagccuaccuacgagcgggacguggaccuuggagcgggcacccgccacguggccgucgagcccgagguggccaacuuggacauuaucgggcagcggaucgagaacaucaagcacgagcacaaaagcaccuggcacuaugacgaggacaaccccuacaagaccugggcuuaucacggcuccuacgagguuaagccuagcggauccgcguccagcauggugaauggcguggucaagcuguuaaccaagcccugggacgugauccccauggugacgcagaucgcgaugaccgacaccacccccuucggccagcagcgcgucuucaaggagaagguggacacgcggaccccaaaggcgaagcgcgggaccgcccagaucauggaaguaaccgcccgauggcuguggggcuuccugucccggaacaagaaaccucggaucugcacgcgcgaggaguucacccgcaagguccgcuccaaugcugcaaucggggccguguuuguggaugagaaucaguggaacucugccaaggaagccgucgaggacgagcgauucugggaucucgugcagaaagagcgggaacuccauaagcaggggaagugugcgaccugugucuacaacaugauggggaagcgggagaaaaagcugggcgaguucgggaaggccaagggcagcagagcaaucugguacauguggcucggcgcccgcuuccuugaguuugaggcccugggguucaugaaugaggaucacugguucucccgcgagaacucgcucucuggcgucgagggggagggccugcacaagcuagguuacauccuccgggacaucagcaagauccccggcggcaauauguacgcugacgacaccgccgguugggacacccgcaucaccgaggacgaccugcagaacgaggcaaagaucacugacaucauggagccggagcaugcucugcuugcuaccuccaucuucaagcugacguaucagaauaagguggugcggguccagcgccccgcgaaaaacggaaccgugauggacgucaucagccgccgugaccaacgagggucaggccaggucggcacauaugggcugaacaccuucacgaacauggaggcccaacucaucagacaaauggagagcgagggcaucuuccugcccuccgaacuggagacccccaaccucgccgagcgcgugcuagacuggcuggagaaguacgggguggagcggcucaagcgcauggcuaucagcggcgacgauugcgucgugaagccaaucgacgaccgguucgccaccgcccugacugcccugaaugacauggggaaggugcgcaaggacaucccccaaugggagcccuccaagggguggaaugacuggcagcagguccccuucugcucacaccacuuccaccagcugaucaugaaggacggccgcgagaucgugguuccgugccguaaccaggacgagcugguagggagagcccgcgugucccagggagccggguggagcuuacgggagacggcuugccuaggcaagaguuaugcacagauguggcagcugauguacuuccacaggcgggacuugcgccucgcugccaaugccaucuguuccgccguacccgucgacugggugcccaccucccggaccaccugguccauacacgcccaccaccaauggaugacgaccgaggauaugcugagcgucuggaaccgcgucuggaucgaggagaaccccuggauggaggauaaaacgcacguguccaguuggggcgacgugccguaccugggcaagcgugaggaccaguggugcggcucccucauugggcugacugcccgcgccaccugggccuccaauauccaggucgcgaucaaccaagugcgcaggcugaucgguaacgagaacuaccucgacuauaugacgagcaugaagagguucaaaaacgagggggaccccgagggcgcacugugguga

SEQ ID NO: 24347 - RNA, 9879 nt, Artificial Sequence
  derived and/or modified CDS sequence (opt11) from DENV-1__FJ882565__SS-prME
agcgugaccaugcugcucaugcugaugcccaccgcccuggcguuccaucuaaccacccggggcggagagccacacaugauuguuaccaagcaggaacggggcaagucgcugcuguucaagaccucggcgggggucaacaugugcacucugaucgccauggaccugggcgagcugugugaggacacgaugacuuacaagugcccucgcaucaccgaggccgagcccgacgacguagacugcuggugcaacgccaccgacacuugggugacguacgggaccugcucucagacgggcgagcacagacgcgacaagcgguccguggcgcucgcgccccacguaggccucggccuggagacuaggacugaaaccuggauguccagcgaaggagccuggaaacagauccagcgcguggagacaugggcccuccgccaccccgguuucaccgucaucgcccuguuccucgcgcacgccaucgggacauccaucacccagaaggguauaauuuucauccuccugauguuggugacgcccagcauggcaaugcggugcgucggcaucgggucccgcgauuucguggaggggcucaguggugccacguggguggacgucgugcuggagcacgggaguugcgugaccaccauggccaaggacaagccaacccuggacaucgagcuccugaagaccgaggucaccaacccggcggugcugcguaagcucuguauagaggccaaaauaagcaauaccacgaccgauucccgcugccccacccagggggaggcaacccugauggaggagcaagacgcgaacuucgugugccgucgcacguucgucgaccggggcugggggaacgguugcgggcuguucggcaaggggagccucauuacgugcgccaaguucaagugcgugaccaaacuggagggcaaaaucguucaauacgagaaccugaaguacuccgucauuguuaccgugcacacgggcgaccagcaccaggucgggaacgagagcaccgagcacggcaccacugcgaccauaacgccccaggcccccaccucagagauacagcucacggacuacggggcccugacccuggacugcagcccccgcacgggccuugacuucaacgagaugguacugcugaccaugaaggagaaauccuggcucguccacaagcagugguuccuggauuuaccgcuucccuggaccuccggggccagcaccucccaggagacguggaaccggcaggaucugcuagugaccuucaagaccgcccacgcgaagaagcaggagguggucguccucggcagccaagagggggccaugcacacugcccugaccggggccaccgagauacagaccucaggcaccacgacgauauucgccgggcaucugaagugcaggcugaagauggacaagcugacuuuaaagggcaugagcuacgugaugugcaccggguccuucaaguuggagaaggaggucgccgagacgcagcacggcacuguucuugugcagauuaaguacgagggcaccgacgcccccugcaagauccccuucagcacacaggaugagaaaggggucacgcagaacggccgacuaauuacagcaaacccgaucgugaccgacaaggagaagcccgugaacauagaggccgagccacccuucggggaguccuacaucgucaucggcgcgggcgagaaggcacugaaacucagcugguucaaaaagggguccagcaucggaaagauguucgaggccacagcccgcggggcacggcgcauggcgauucugggagauacggccugggacuucggauccauuggcggcguauucacaagcguggggaaacugguccaccagauuuucggcacggccuacgggguccucuucuccggcguuagcuggaccaugaagaucgggauaggagugcugcuuacguggcuaggccucaauucccgcucuacaucccugagcaugaccugcaucgccgugggacucgugacccuguacuuaggcgucauggugcaggccgacuccggaugcgugauuaacuggaagggccgagagcucaagugcgggagcgggauauucgucacgaacgaggugcacacuuggaccgagcaguacaaguuccaggccgacagcccgaagcgcuuaucggccgcgaucggcaaggcgugggaggagggggugugcggcauucggagugccacccgccuggaaaacaucauguggaaacagauuuccaacgagcucaaccacauccugcuggaaaaugacaugaaguucaccgucguggugggugacguugugggcauccucgcgcaggggaagaagaugauacggccccagcccauggagcacaaguauagcuggaagucguggggcaaggccaagaucaucggcgccgauguucagaacacgaccuucaucaucgacgggcccaacaccccggaaugccccgacgaccagcgugcuuggaacaucugggaagucgaggacuacgguuucgggaucuuuaccacuaauauauggcuaaagcugcgggggagcuacacccaggucugcgaccaccgccucauguccgcggccaucaaggacucgaaggcggugcacgccgacaugggauacuggauugaguccgagaagaaugagacguggaagcuggcccgggcaagcuucaucgaggucaagacuuguaucuggcccaaaucccacacgcuaugguccaacgggguguuggagagcgagaugaucauucccaagauuuacggcgggccgaucagccaacacaauuaccgccccggcuacuucacccagaccgccgggcccuggcaccugggcaagcuggagcucgacuucgaucugugcgagggcaccaccgucgucguggaugaacauugugggaaucggggcccgucccugcgcaccaccaccgugacggggaagauuauacacgaaugguguugccggagcugcacacugccaccauugcgauucaagggcgaggacggguguugguacggcauggagauccgacccguaaaagagaaggaagagaaccuugucaaauccauggugagcgccggcaguggggaggucgacaguuucagucucggccuguugugcaucuccaucaugaucgaggaggucaugcgcucgcgguggucgcgcaaaaugcucaugaccgggacccuggccguguuccuucucuugaucaugggccagcugacguggaacgaucuaauuaggcugugcaucauggucggggccaacgcgucggaccgcaugggcaugggcacgaccuaccuggcauugauggcaaccuucaagaugcgaccuauguucgcaguggggcugcuuuuccggcgccucacgagucgggagguacugcugcucaccaucggauugagccuggucgcuuccguggagcuccccaacucccuagaggagcugggagacggccucgccaugggaauuaugauccugaaguuacuaaccgauuuucagucccaccagcuuugggccacccugcucagucugacguuuaucaaaaccacccucucccuucacuaugccuggaagaccauggccaugguccugagcauuguaucgcucuucccccuaugccugagcacgaccucccagaagacaaccuggcugcccguguugcugggcucucugggcugcaagccauuaacaauguuccugaucgcggagaacaagauuugggggcgcaagucauggcccuugaacgaaggaaucauggccguugggguggugagcauucuccuguccucccugcuuaagaacgacgucccccuggcaggcccccugaucgcuggcgggaugcucaucgccugcuacgugaucaguggcucuagcgcggaucugucccuggagaaggcggccgaagugucuugggaggaggaggccgagcacuccggggcgagccacaacauccucgucgaggugcaggacgacggaaccaugaagaucaaagaugaggagcgggaugacaccuugacaauucugcuaaaggcgacucugcuggccgugaguggggucuacccgcucagcauucccgcuacacuauucgugugguacuucuggcagaagaagaagcagcgcuccggcgugcuaugggacacucccucgccucccgaggucgaaagggccgugcucgacgacggaaucuaccgcaucaugcagcgggggcugcugggucgcucucagguagguguuggaguguuucaggagaacguguuccacaccauguggcacgucacccgcggggccgugcugauguaucaaggaaaacgccucgagccaagcugggcgucggucaagaaggaccugaucucuuacggugggggauggcggcugcagggcuccuggaacacaggugaggagguccaggugaucgcagucgagcccgguaaaaaccccaaaaacgugcagaccgcccccggcaccuucaaaacccccgagggcgaggugggggccaucgcacucgacuuuaagcccggcaccagcgggagucccaucgugaaccgcgaggggaagaucgucggccuguacggaaacggcguggugaccaccagcgggaccuacgucagcgcgauagcccaggccaaggccucccaggaggguccgcugcccgaaaucgaggacgaaguguuccggaaacgcaaccucacgaucauggaucugcaccccgggagcggcaagacccggcgcuaucugccggcgaucgugagagaggcaaucaagcgcaagcugcggacccugauccuggcccccacccgcgucguggccuccgagauggcagaggcgcuaaagggaaugcccauccgcuaccagacgaccgccgucaagagcgagcacacaggcaaggagaucgucgaccugaugugccaugccaccuucacgaugcggcugcuaucccccgugcgcgugccaaacuacaacaugauaaucauggacgaggcccauuucaccgacccuagcuccaucgccgcgcggggguacaucagcaccagagucggcaugggcgaggccgccgccaucuucaugaccgccacuccucccggguccguggaagccuuuccccagagcaacgccgugauucaggacgaggagcgcgacaucccagagcgcuccuggaacagcggcuacgaguggaucaccgacuuccccggcaagaccgucugguucgugcccucaaucaagagcgguaacgacaucgccaacugucugcggaagaacggcaagcgcgugauucagcugucccggaagaccuucgacacggaauaccaaaagacuaagaacaacgacugggacuauguugugaccaccgacauauccgagaugggagccaauuuccgcgcggaccgggucaucgacccgcggcggugccucaagcccgucauacuaaaggacggccccgagcgcgugauccuggccggaccaaugccugucacgguggccucugccgcccagcggcguggccggaucggccgcaaccacaauaaggagggggaccaguauaucuauaugggccagccccuaaacaacgacgaggaccacgcgcacuggaccgaagccaagaugcuucuggacaacaucaacaccccagaggggaucaucccggcccuuuucgagccggagcgggagaaauccgccgccaucgauggcgaguaccgccugaggggagaggcucggaagacguucguggaguugaugcgcaggggcgacuugccugucuggcugucuuacaaaguggccagcgaggguuuccaguacagcgaccgccggugguguuucgacggggagcgcaacaaccaggugcuggaggagaacauggacgucgagaucuggacgaaggagggcgaacggaaaaagcuccgcccccgcuggcuggacgcccgcaccuacucagacccccuggcccuccgggaguuuaaggaguucgccgcggggcgccggagcguuaguggggaccucauauuggaaaucggaaagcucccgcagcaccugacccagagggcccaaaacgcccucgacaaccucgugaugcuccauaacagcgagcagggcgggagggcuuaccgccacgcuauggaagagcugcccgacacgaucgagacucucaugcuccuggcccucauugccguccuaaccgggggcguaacgcuguucuucuuguccggccgcggccugggaaaaacgucaauuggguugcucugugugauggccuccagcguccugcuguggauggccuccguggagccccacuggaucgcggccagcaucauccucgaguucuuccugaugguguuacucaucccagaaccggaccgccagaggacgccccaggacaaccaguuggcauacgucgugaucggccuccucuuuaugauacugacuguggcagccaacgagaugggguuacucgagaccaccaagaaggacuuaggcaucggucaugucgcugucgaaaaccaccaccacgcgaccaugcuggacgucgaccuccaccccgccuccgccuggacguuguacgccgucgcgaccacaaucaucacaccgaugaugcgccacacaaucgagaacaccacugccaacaucagcuugaccgccaucgccaaccaggccgcgauccucaugggccuggacaagggguggcccaucuccaagauggacauaggagugccccugcucgcgcugggaugcuacagccaggugaacccucugacccucaccgccgcgguccugaugcugguggcgcacuacgccaucauaggccccggucuccaggcgaaggccacccgggaggcccaaaagcgcaccgcggccgggaucaugaagaaccccacgguagauggcaucgucgccaucgaccuggaccccgugguuuacgacgccaaguucgagaagcaacugggccagauaaugcuccugauucugugcaccucccaaauccuccugaugcgcaccaccugggcccugugcgagucuaucacauuagcgaccgguccuuugaccacccugugggagggcucaccggggaaauuuuggaacacgaccauugccgucagcauggccaacaucuuccggggcuccuaccucgccggcgccgggcuggcguucagccugaugaagucccucggcgggggacgccgggggacaggcgcccagggcgagacccugggggagaaguggaaacgccagcugaaccagcucagcaaaagcgaguucaacauuuacaagcgguccggcaucauggagguagaccgcagcgaggccaaggaggggcugaagcggggcgagacgacccgccacgccgugucccgggggaccgcgaagcugcgcugguucguugaacggaaccuggugaagcccgaggguaaggugaucgaccucggcugcggccguggcggguggagcuacuacugcgccggccugaagaaggucaccgaggugaaaggguacacgaagggcgggcccgggcacgaagagccgauccccauggcuaccuacggcuggaaucuugugaagcuccauuccggaaaggacgucuucuucacgccucccgagaaaugcgacacccugcugugcgacaucggcgagagcucccccaacccgaccaucgaggaggggcggacccuccgcgugcugaagaugguugaacccugguugcggggcaaucaguucugcaucaagauccucaaccccuacaugcccagcgucguggaaacccuagagcagaugcagcgcaagcacggcgggauguuggugcggaacccgcuuucccgcaacagcacgcacgagauguacugggucuccugcggcaccgggaacaucgugagcgccgugaauaugacuuccagaauguuacugaaccgcuucaccauggcccaccgaaaacccaccuacgagagagacguugaccucggcgcgggcacccgccauguggcgguggagcccgaagucgccaaccuggacauuaucggucagcggauugagaacaucaagcacgagcacaagagcacguggcauuaugacgaggacaacccguauaagaccugggcuuaccacggcuccuaugaggucaagccuagcggguccgcuucuaguauggucaacgggguggugaagcugcucacgaagcccugggacgugauaccgaugguaacccaaaucgcgaugaccgacaccacuccguucgggcagcagcgcguguuuaaggagaagguagacacccggacgccgaaggcaaagagaggcaccgcgcagauuauggagguaacggcccgguggcuguggggcuuccugucccgcaauaagaagccccggaucugcacccgcgaagaguucacgcggaagguucgcagcaacgccgcgauuggcgccguuuuugucgacgaaaaccaguggaacuccgccaaagaggcaguggaggacgagcgguuuugggaccucguccagaaggagcgcgagcugcacaagcagggcaagugugcgaccugcgucuacaacaugauggggaagcgggagaagaagcugggcgaguucgggaaggccaaggguagccgcgccaucugguacauguggcucggcgcccgauuccuggaguucgaggcccugggguuuaugaacgaagaucacugguucuccagagagaauagccucucuggcguggagggggaaggccugcacaagcugggcuacauccuccgugacaucagcaagauccccggcggcaacauguacgcggacgacaccgccgggugggacacucgcauaacggaggacgaccugcagaacgaggccaagauaaccgacauuauggagccggaacacgcccugcucgccaccuccauuuucaagcugaccuaccagaacaaggucguccgagugcagcgccccgcgaaaaacggcacggucauggacguaaucucucgccgcgaccagcgcggguccggccaaguugguaccuacggucugaacaccuucaccaacauggaggcccagcucauccggcaaauggagagcgaaggcaucuuccugcccuccgagcuggagacucccaaccucgccgagcgcgucuuggacugguuggagaaguauggcguggagcggcucaagcgcauggcaaucagcggcgacgacugcguggucaagccuaucgacgaccgguucgccaccgcgcugaccgcccugaacgacauggggaagguucgcaaggacaucccccagugggagcccagcaagggcuggaacgauuggcagcaggucccguucugcagccaccacuuccaccagcucauuaugaaggacggccgggagaucgucgucccgugcagaaaccaggacgagcuggugggacgggcgcgcgucucccagggcgccggguggagccugcgggaaacugcaugccucggcaagagcuacgcgcagauguggcagcugauguacuuccaccgccgggacuuacgccucgccgccaacgccaucugcucggcagugcccguggacuggguccccacgagccggaccaccuggagcauccacgcccaccaccaguggaugaccacggaggacaugcugagcguguggaaccgcguguggaucgaagagaaccccuggauggaggacaagacccacgucucuagcuggggcgauguuccguaccuuggcaagcgggaggaccaguggugcggcucgcucaucgggcuuaccgcccgcgccaccugggccagcaacauccagguggcgaucaaccagguccgccggcugaucggcaacgaaaacuaccucgacuacaugaccuccaugaagcgcuucaagaacgagggggacccugagggcgcccugugguga

SEQ ID NO: 24348 - RNA, 9879 nt, Artificial Sequence
  derived and/or modified CDS sequence (opt11) from DENV-1__FJ882567__SS-prME
ucggugaccaugcuucucaugcuuaugccuaccgcccuggccuuucaccugaccacgcggggcggggagccccacaugauugugaccaagcaggaacggggcaagagccugcuguucaagaccucagcgggggugaacaugugcacccucaucgccauggaccugggcgaacugugcgaagacaccaugaccuacaaguguccacgcaucaccgaggccgagccugacgacguggacugcuggugcaacgccaccgacaccugggugacauacgggaccugcucucaaacgggcgagcaccgccgcgacaagcggagcguggcccucgcgccccacgugggccuggggcuggaaacccguaccgagaccuggaugucaagcgagggugccuggaagcagauccagcgcgucgagacgugggcccuccgccaccccggguucaccgugaucgccuuauuuuuagcgcacgcaaucggcaccuccaucacccaaaagggaaucaucuucauccuccugaugcugguaacgcccagcauggccaugagaugcgucggcaucggcucccgcgacuucguggaggggcucagcggcgccaccuggguagacgucguucuggagcacggcuccugcgugaccaccauggccaaggacaagccgacgcuggacaucgaacugcuaaagaccgaggucaccaaccccgcugucuuacgaaagcucugcauagaggccaagaucagcaacacuaccaccgacagucgcugcccaacgcaaggcgaggccacgcugauggaggagcaggacgcaaacuucgucugccggcgcacguucgucgacagaggcugggggaacggcugcgggcuauucggcaaggguucacuaaucacgugcgccaaguucaaguguguaaccaagcuggagggcaagaucguccaguacgagaacuugaaguacuccgucaucgucaccgugcacacgggcgaccagcaccaagucgggaacgagucgacugaacacggcaccaccgcgaccaucacgccccaggcccccacgucugagauucaguugaccgacuacggugcccuuacccuugacugcagcccccguacaggcuuagacuucaacgagauggugcuucugaccaugaaggagaaguccuggcucguccacaagcagugguuccucgaccugccucuccccuggaccagcggggccagcacuucccaggagacguggaaucggcaggaccuuuuggugacauucaagaccgcacacgcgaagaagcaggagguggucgugcucggcagccaagaaggcgccaugcacaccgcccugacgggagccacugagauucaaacuuccggcaccacaaccaucuucgccgggcaccugaagugcaggcucaagauggacaaacugacgcuaaagggcaugagcuacgugaugugcacuggguccuucaagcucgaaaaagagguagccgagacacagcacggcaccguucuggugcagaucaaguacgaaggcaccgacgcccccugcaagauccccuucucuacucaggaugagaagggugucacgcaaaacggccggcuuauuaccgccaacccgaucgucaccgacaaggagaagcccgugaauaucgaagccgagccgcccuucggggaauccuacaucgucaucggcgcgggcgaaaaggcacugaagcucucaugguucaaaaagggguccagcaucggcaagauguucgaggccacugcgcgcggggcacggcgcauggcgauuuugggagacacugccugggacuucggguccauuggcggcguuuucaccagcguggggaagcugguccaccaaauauuuggcaccgccuacgggguccuguucuccggcgugucauggaccaugaagaucgggaucggcguccugcugacauggcucgggcugaacagucgcagcaccagccugagcaugaccugcaucgccguaggccucgugacccuguaccugggcgucauggugcaagccgauucuggcugcgucaucaauuggaagggccgggagcucaaaugcggaaguggcaucuucgucacaaacgaggugcacaccuggaccgagcaguacaaguuccaagcggacagcccgaagcgccuguccgccgcaaucggcaaggcgugggaagaaggugugugugggauucggagcgccaccagacuggagaacaucauguggaaacagaucuccaacgaguugaaucacaucuugcuggagaacgggaugaaguucacggucguagugggcgacgucguggggauccucgcgcagggcaagaagaugauccgaccccaaccuauggagcacaaguacucuuggaaguccuggggcaaagccaaaaucaucggggcggacgugcaaaacacgaccuucaucaucgacggccccaauacaccggagugucccgacgaccaacgggccuggaauaucugggaagucgaggacuacgguuucggcaucuucacuacgaacaucuggcugaagcugcgcgauagcuacacccaagugugcgaccaucgguugaugucggcggccauuaaggacuccaaggccgugcacgccgauaugggcuauuggaucgaguccgagaagaaugagaccuggaagcuggcccgggcuagcuucaucgaggucaagacaugcauauggcccaagucccacacccuguggagcaacgggguguuagagagcgagaugaucaucccaaagaucuacggagggccaaucagccagcauaacuaccgccccggcuacuucacccaaaccgccggcccauggcaccugggcaaacuggagcuggacuucgacuugugcgagggcacgacuguggucguggacgagcacugcgggaacaggggaccgucccugcgcacuacgacuguaacggggaaaaucauccaugagugguguugcaggagcugcacccugccgccacuccgcuucaagggcgaggacgggugcugguacggcauggagauccgacccgucaaggagaaggaggagaaccuggugaaguccauggugagcgccggcagcggugagguugacuccuucucacucggccugcugugcaccuccauuaugaucgaggaagugaugagaagccgguggucccgcaaaaugcucaugaccgggacgcuggccguguuccuguuauugauaaugggacagcugaccuggaacgaucucauccggcuguguaucauggucggggccaacgcgagcgaucgaaugggcaugggcaccaccuaccucgcacucauggccacguucaaaaugcgcccgauguucgccgugggccugcuguuccggcgccucacaagccgggaagugcugcugcucaccauuggacugagccuggucgcguccguggagcucccgaacagccuggaggaguugggggacggccucgcgaugggcaucaugauccugaagcugcucaccgacuuccagagucaccaacugugggcuacgcugcucagcuugaccuuuaucaagaccacccuaucccuccacuaugccuggaagacuauggcaaugguacugagcaucgugagccuguucccucucugucugagcaccacgucccaaaaaaccacguggcugccuguccuacuggggagccugggauguaagccgcucaccauguuccugauugcggagaacaagaucugggggcgcaaguccuggccccugaaugagggcaucauggccgucgggguggugagcauucuccugagcucccugcucaagaacgacgucccgcucgccggcccccugaucgcuggcgggaugcucaucgccuguuacgugaucucgggcaguagcgcggaucuguccuuagagaaggccgccgaggugagcugggaagaagaggccgagcacucuggggcuucccacaacauccucguagaggugcaggacgacggcaccaugaagaucaaggacgaggaacgggacgacaccuuaacuauccuccucaaggcgacguuacuggccgugucugggguuuacccgcucagcauccccgccacccuauucgugugguacuucuggcagaagaagaagcagcgcuccggagugcugugggacacccccagcccgccggaaguggaacgggcagugcuggaugacggcauuuaccgcaucaugcagcguggccuacugggccgaucccaggugggggucggcguuuuccaggagaacguuuuucacaccauguggcauguaacgcguggggccgugcugauguaccagggcaagcgccucgagcccagcugggcaucggugaagaaggaccugaucagcuacggcgggggcuggagacuccagggguccuggaacaccggugaggaaguccaggugaucgccgucgagcccgggaagaaccccaaaaacguccaaaccgcucccggcaccuucaagacgcccgagggagaggugggagcgaucgcccucgauuucaagccgggcaccagcgggagcccgaucgugaaccgcgagggcaagaucgucggccuguaugggaauggcguggugacuaccagcggaacguacgucagcgcaaucgcccaggccaaggccucccaggagggaccgcuacccgaaauagaggacgagguauuccgaaagcgcaaccucacuaucauggaucugcaccccgggagcgggaagacccggcgcuaccugccggcgaucgugcgggaggccauuaagcgcaagcuccggacccugauccuggccccaacgcgugucguggccucagagauggcagaggcgcucaaggggaugccaauccgcuaccagacaaccgccguuaagagcgagcacaccggcaaggaaaucgucgaccuaaugugccacgcgacguucacgaugcggcugcucucccccguccgcgugccgaacuacaacaugaucaucauggaugaggcccauuucaccgaccccucauccaucgccgcgagagguuacaucagcacccgagucgggaugggggaagccgcugccaucuuuaugacggccacgccccccggcucgguggaggcguucccgcagagcaaugccgugauccaggacgaggaacgagacauacccgagcgcuccuggaacagcggcuacgaguggaucaccgacuuccccggcaagaccguaugguucgugccuuccaucaagagcgggaacgacaucgcgaacugucugcguaaaaacggcaagcgcgugauacagcugucccggaagacguucgacaccgaauaucagaagaccaagaacaacgacugggacuacguggugacuacggacauauccgagaugggggccaacuuccgcgcagaccgggugaucgacccgcgccguugccucaagcccgucauccugaaggacggccccgaacgugugauccuggccgggcccaugccggucaccguugccuccgcugcccagcggcgcggccggaucggccgcaaccauaacaaggagggggaccaguauaucuacaugggccagccccucaacaacgaugaagaccaugcgcacuggaccgaggccaagaugcugcuggacaacaucaauacacccgaggggaucauccccgcccuauucgaaccggagcgggagaaguccgcggccaucgacggcgaguaccgccugcgaggggaggcgcggaagacguucguggagcugaugcgacggggagaccuccccgucuggcuguccuacaaaguggccagugagggcuuccaauacagcgacaggcgcuggugcuucgacggggagcgcaacaaccaggugcuggaggagaacauggacguagagaucuggaccaaggagggcgagcgcaagaagcuccgcccccgguggcuggacgcccgcaccuacuccgacccacuggcccuccgggaguucaaggaguucgccgcggggcgccggucgguuuccggcgaccugauccucgagaucggcaagcucccgcagcaccugacccagcgcgcccagaacgcacuggacaacuuagugaugcugcacaacagcgagcagggagggcgggccuaccgccacgcgauggaggagcugccugacacgaucgagacccucauguuacuggcccucaucgcgguccugacugggggcgucacccucuuuuuccuauccgggcggggccugggcaaaaccagcaucgggcugcucugcgugauggccucaagcguccuguuguggauggccucaguggagccccauuggaucgcggcaagcaucaucuuggaguucuuccugauggugcugcugauucccgagccggaccgccaaagaacgccccaggacaaccagcuggccuacgucgugaucggccugcuauucaugauccugacuguggccgcaaacgagaugggccugcuugaaaccaccaagaaggaccugggcaucgggcaugucgccguggagaaccaccaccacgccacgaugcuggacguggaccuccaccccgccagcgccuggacccuuuacgccgucgcgaccacaaucaucacgccgaugaugcgccacacuaucgaaaacacgaccgccaacaucagucuuaccgcuaucgcuaaccaagcagcaauccuaaugggacuagacaagggcuggcccaucuccaagauggauaucggggugccccugcucgcccugggcugcuacagccaggugaauccccugacccucaccgccgccguucugaugcugguggcgcacuacgcaaucaucgggccugggcuccaggccaaggcaacccgggaggcccagaagcgcacggccgccgggaucaugaaaaaucccaccguggacggcauugucgccaucgaccuggaccccgugguguacgacgcaaaguucgagaagcaguugggccagaucaugcugcugauucugugcacaucccagauccuccugaugcgcaccacgugggcccugugcgaaucaaucacccucgcuacggggccccuaaccacguuaugggaaggcaguccugggaaguucuggaauaccaccaucgccgucagcauggccaacaucuuccgaggcuccuaucuugccggagccgggcuggcguucagucuuaugaaaucccucggcgggggccggcgggggaccggcgcgcagggagagacgcugggggagaaguggaaacgccagcugaaccagcucucaaagucggaguuuaacauuuacaagcggucaggcauaauggagguggaccgcagcgaggccaaggaggggcuaaagcggggcgagacuacccgccacgccgugagccgggggaccgcgaagcuucgcugguucgucgagcgcaaccuggugaagcccgagggcaaggugaucgaccugggcugcggucgcggcggguggucauauuacugcgccggccugaagaaagucacggaggugaagggcuacaccaaaggcggacccggccacgaggagccgaucccgauggccaccuauggcuggaaccuggugaaacuccauuccgggaaggacgucuucuuuacgccgcccgagaagugcgacacgcuguuaugcgacauuggcgagagcucccccaaccccaccaucgaagaggggcggacccugcgcgugcuuaagaugguggagcccuggcugcggggaaaccaguucugcaucaaaauucugaauccguacaugcccagcgugguggagacacuggagcagaugcagcgcaagcacggcgggaugcuggugcggaaucccuuaucccgcaacagcacccacgagauguacugggucuccugcggcacggggaacaucgugagcgcugugaacaugaccucccggaugcuguugaauagauucaccauggcgcaccgcaagccgacuuaugagcgggacgucgaccugggcgcggggacgcgacacguggccguggagcccgaggucgccaaccuggacaucaucgggcagcggaucgagaacaucaagcacgagcacaaaagcaccuggcacuacgacgaggacaaccccuauaagaccugggccuaucacggcuccuaugagguuaagccgagcggguccgccagcagcauggucaacggcguggucaagcugcucacaaagcccugggacgucauccccaugguuacgcagaucgcuaugaccgauacaacucccuuugggcagcagcgcguguucaaggagaaggucgauacgcggacccccaaggccaagcgcgggaccgcccagaucauggaggugaccgcccgguggcuguggggcuuccugucacgcaauaaaaagccccggaucuguacucgcgaggaguucacccggaaggugcgcagcaacgccgcgaucggggccgucuuuguggacgagaaccaguggaacuccgcaaaggaggccgucgaggacgagcgauuuugggacuuaguccagaaggagcgcgagcugcacaagcagggcaagugcgcuacauguguguauaacaugauggggaaacgugaaaagaagcugggcgaguuugguaaagccaaaggcagccgcgccaucugguacauguggcucggugcccgguuccucgaguucgaagcccugggguucaugaacgaagaccauugguucagucgcgagaauaguuuauccggcguggagggggagggccugcacaaacugggcuacauccugcgggauaucagcaagaucccggguggcaauauguacgcggaugacacagccgggugggauacgcgcauaaccgaggacgaccugcagaaugaggccaagaucacggacaucauggagccggagcacgcccuccucgccaccuccaucuucaaacugacguaccaaaacaaggucguucggguucaacgcccagcgaagaacggcaccgucauggacgugaucagucgccgugaccagcgcgggucaggucaagugggcaccuacgggcugaacaccuucacuaauauggaggcccagcugauccggcagauggagagcgagggcaucuucuugcccuccgagcuggaaacccccaaccucgccgagcgcguucuggacuggcuggagaaacacggcguggagcgucuaaagcgcauggcaaucagcggcgaugauugcguggucaagccaaucgacgaccgguucgcaaccgcgcugacugcccugaacgacauggggaaagugcggaaggacaucccccagugggagcccuccaagggcuggaacgacuggcaacagguccccuucugcagccaccacuuccaccagcucaucaugaaagacggccgggagaucgucguuccgugccgcaaucaagacgagcugguggggcgugcccgcgucucccagggcgccggguggagccuccgggaaacggccugccucggaaaaagcuacgcacagauguggcagcugauguacuuccaccgccgggaccugcggcuugccgccaacgccaucugcuccgcgguccccguggacugggucccgaccagccggaccacgugguccauacacgcccaccaccaguggaugacgaccgaagacaugcucagcguguggaaucgcguuuggaucgaggagaaccccuggauggaggacaaaacccacgucuccagcuggggcgaugugccguaucucggcaagcgggaggaccaguggugcggcuccuuaaucgggcugaccgcccgagcaaccugggccucuaacauccaaguggcgaucaaccagguccgccggcugaucggcaacgaaaacuaccucgauuacaugacuucuaugaagagguucaagaacgagggugaccccgagggcgcccugugguag

SEQ ID NO: 24349 - RNA, 9879 nt, Artificial Sequence
  derived and/or modified CDS sequence (opt11) from DENV-1__GQ199831__SS-prME
agcguuaccaugcuucucaugcugaugcccacugcccuggccuuccaccucaccacccggggaggggaaccccacaugaucgugaccaagcaggagcggggcaaaagucugcuuuucaagaccagcgccggggugaacaugugcacccucaucgcgauggaccugggggagcugugcgaggacaccaugacuuacaagugcccacguauaaccgagaccgaacccgacgauguggauugcuggugcaacgcgaccgacaccugggugaccuacgguacuugcagccagaccggggaacaccggcgcgacaaaagaucuguggcccucgcgccacacgugggccugggccuggagacccgcaccgagacauggaugucgagcgagggcgccuggaagcagauccagcggguggagaccugggcccuacgccaccccgguuucaccgugaucgcccuguuccuggcccacgccauaggcaccucuauuacgcaaaaagggauuaucuucaucuuacuuaugcuggugacccccagcauggccaugcggugugucggcaucggcucccgcgacuucgucgagggucucagcggcgccaccuggguagacgucgugcuggaacauggguccugcgugacgaccauggcaaaggauaagccgaccuuggacaucgagcucuugaagacggaagucacuaaucccgccguucugcggaagcuaugcaucgaggcgaagaucagcaauacgaccaccgacuccagaugccccacccagggagaagccacgcugauggaggagcaggacgccaacuucgugugccggcgcaccuucguagaccgggggugggggaacgguugcgggcuguucgggaaggggagccucaucacgugcgccaaguucaaaugcgugacgaagcuggagggcaagaucgugcaguacgagaaucugaaauacucuguuaucgucacggugcacacgggcgaccaacaucagguagguaacgaaucuaccgagcaugguacgacugccacuauuacgccccaggcgcccaccuccgagauacagcucaccgacuacggugcccugacgcucgacuguagcccccgcacaggccucgacuucaacgagauggugcugcugaccaugaaggaaaaguccuggcucguccacaagcagugguuccuggaccugccgcuccccuggacgagcggggcgagcacgagccaagaaaccuggaaccggcaggaccugcuggugacauuuaaaaccgcacacgcgaagaaacaggagguggucguucucggcagccaggagggcgcgaugcacacggccuugaccggggcaaccgagauacagaccuccgguaccaccaccaucuucgccggucaccucaagugucgccucaagauggacaaacugacccugaaggggaugagcuacgugaugugcacgggguccuucaagcucgagaaagaggucgccgagacccagcacggcaccgugcucgugcagaucaaguacgagggcacggacgcgccaugcaagauccccuucuccacgcaggacgagaagggggucacccagaacgggcgacugaucacggcuaauccaaucgugaccgacaaggagaagcccgugaacaucgaggccgagccgcccuucggggaguccuacaucgucaucggcgccggcgagaaggcgcuuaagcucagcugguucaagaagggguccuccaucggcaagauguucgaggccacggcccgcggggcccgacgcauggccauccugggcgacaccgcgugggacuucggguccaucggcgguguguucacuagcguggggaagcuuguccaccagauuuuuggcaccgcguacggggucuuguucagcggcgugagcuggacaaugaagaucgggauuggcguccuguuaaccuggcucggacugaacuccaggucuaccucccugagcaugacuugcaucgcaguggggcucgugacgcuauaccuaggcgucauggugcaggccgacuccgggugcgugauuaacuggaagggucgggagcucaagugcgggagcggcaucuucgucaccaacgaggugcacaccuggaccgagcaauacaaguuccaggccgacucuccuaagcgccugucggcugccaucggcaaggccugggaggagggggugugcggcauccggagcgcuacucgccuggaaaacaucauguggaagcagauauccaacgagcuaaaucauauccuccuggagaacgacaugaaguucacggucgugguaggggacgucguggggauccucgcccaggggaagaagaugauccggccccagcccauggagcacaaguacagcuggaaguccuggggcaaggcgaagaucaucggcgcggaugugcagaacaccaccuucauaaucgacgggcccaacaccccagagugccccgacgaucagcgcgcauggaacaucugggaggucgaagacuacgguuucggaaucuucacgaccaacaucuggcugaaacugcgggacucauacacccaggugugcgaccacagacugauguccgccgcaauaaaggacagcaaggccgugcacgccgacaugggauacuggaucgaauccgagaagaacgagacguggaagcuggccagagccagcuucaucgaggucaagacgugcauuuggcccaagucccauacccuguggagcaacggcgugcucgaguccgaaaugaucauccccaagaucuaugggggcccgaucucucagcacaacuaccgccccggguacuuuacccagaccgcgggccccuggcaccuggggaagcuggagcucgauuucgaucugugcgagggcacgaccgugguuguggacgagcacugcgguaaccggggcccaucccuacgcaccaccacgguuaccggcaagauaauccacgaguggugcugccggagcuguacccugcccccucuacguuuuaagggggaggauggcugcugguacgggauggagauccggcccgucaaggagaaagaggagaaucuggucaagucuauggucagcgccggcagcggcgaggucgauuccuucagccucggucugcugugcaucuccauaaugaucgaggaggugaugcgcagucgguggucccgcaagaugcucaugaccggaacacuggcgguguuccuacuccuuaucauggggcagcugaccuggaacgaccucauccggcugugcaucauggucggcgcgaacgccagcgacaggauggggaugggcaccaccuaccuugcguuaauggccacguucaagaugcgcccaauguuugcuguggggcugcuuuucagacgccucaccucccgggaggugcugcugcuaaccaucggguuaucacuugucgccucuguggagcuacccaacagccuggaggagcugggcgauggucucgccaugggcaucaugauccugaagcuucucaccgacuuccagucccaccagcugugggcgacgcuguuaucccugaccuuuaucaagaccacccugucccuccacuacgccuggaagacuauggccauggucuuaagcaucgugucccuguucccccucugccugagcaccacaucccagaagaccacguggcuacccgugcucuugggcucacuggggugcaagccgcugaccauguuccugaucgcugagaacaagaucuggggucgcaaguccuggccccugaacgaggggaucauggcggucggagugguaaguauccuccugagcucccugcucaagaacgacgucccccuugccgggcccuugaucgccggcggaaugcucaucgcuuguuacgugaucucuggguccagcgcagaccugucccuggagaaggcggccgaggugucuugggaggaagaggcugagcacuccggcgcaagccacaacauccucguggaggugcaggacgacggcaccaugaagaucaaggacgaggagcgggacgacacacugacaauccugcucaaggccacgcuccucgcggugagcgguguauacccucucagcauccccgccacccuguucgugugguacuuuuggcagaagaagaaacagcgcuccggcgugcugugggacacccccagcccgcccgaagucgagcgggcugugcuggacgacggcaucuaccgcauaaugcagagaggccuccugggccgcucccaagugggcgucgggguguuccaggaaaacguguuccacacgauguggcacgucacgcggggcgcgguguuaauguaccaagggaagcgacucgaacccuccugggcauccgugaagaaagaucugaucagcuacggcggcggguggcggcugcaggguuccuggaacacgggcgaggagguccaggugaucgcgguggagcccggcaagaaccccaagaacguccagaccgcccccgggaccuucaagacgcccgagggugaggugggcgccaucgcccucgacuucaagccggggaccagcggguccccuaucgugaaccgcgaagguaagauagucggcuuauacggcaacggcguggucaccaccucaggcacauaugucagcgccaucgcgcaggccaaggccucccaggagggcccgcugcccgagaucgaagacgagguguuccggaaacgcaaccucacgauaauggaccugcaccccggcagcgggaagaccaggcgcuaccucccugccaucguccgggaagcgauaaagcgcaagcuccggacccugauucuggcgcccacccgcgucguagccuccgaaauggccgaggcucucaaggggaugcccauccgcuaccagacuaccgcgguaaaaagcgagcacaccggcaaggagaucgucgaccugaugugccacgccacguuuacuaugcggcuucuaucccccgugcgcgucccgaacuacaacaugauuaucauggacgaggcccacuucaccgaccccagcuccauugccgcccggggguacauauccacccgggugggcaugggugaggcggccgcgauauucaugacggccacgccuccaggauccgucgaggccuucccgcagucuaacgcggugauacaggaugaggagcgcgacauccccgagcgauccuggaacagcgguuacgaguggauaaccgacuuccccgggaaaaccgucugguuugugccuuccaucaagagcgggaacgacaucgcaaacugccugcggaagaacgggaagcgugugauacagcuaagcaggaagacauucgauacggaguaccagaagacaaagaacaacgacugggacuacgucgugaccaccgacaucagcgagaugggcgccaacuuccgcgccgaccgggugaucgauccgcgucggugccucaagccuguaauccugaaggacgggccagagcgcgugauucuggcgggccccaugccggucaccguggccuccgccgcccagcggcgcgggcgaaucggccgaaaucacaauaaggagggcgaccaguacauauauaugggacagccccucaacaaugacgaggaccacgcgcacuggaccgaagcgaagaugcugcuggacaacaucaacacccccgagggcaucauccccgcccucuucgagccggagcgggaaaaguccgccgccaucgacggcgaguaccgccugaggggcgaggcccggaagacguucguggaacugaugcgccgaggagacuugcccgucuggcuguccuacaagguggcgucggagggcuuccaguacagcgaccgccgguggugcuucgacggcgaacgaaacaaccagguguuggaggagaauauggacgucgagaucuggaccaaggagggggagcggaagaagcuccgcccccgguggcucgacgcccgcaccuacucggacccccuggcccuucgggaguucaaggaguucgccgccggccgccggagcguguccggggaucugauccuggagaucggaaagcucccgcaacaccugacccaacgugcgcaaaacgcucuugacaaccucgugauguugcacaacagcgagcagggcgggcgggccuaccgccacgccauggaggagcuacccgacacaaucgaaacucuaaugcugcuggcgcucaucgccguccugacgggcggggugacacuguucuuccucuccggccgggggcugggcaagaccagcauaggccugcucugcgugauggccuccagcgucuugcuguggauggcguccguggagccacacuggauagcagcgagcauuauccucgaauucuuucugaugguacugcugauccccgagccggaccgccagcggacgccccaggacaaccaacucgcguacgucguaaucgggcuccuuuucaugauacuuaccguggcggccaaugagaugggccugcucgagaccacaaagaaggaccuggggauuggccacgucgcuguggagaaccaccaccacgcgacgaugcuggacguggaccuucacccggcauccgccuggacccucuacgccgucgccaccaccaucaucacgccuaugaugcgccacacaaucgagaacacaaccgcgaacauaagccugacggccauagcaaaccaggcggccauucucauggggcuggacaaggguuggccaaucuccaagauggauaucggaguuccccugcucgcgcuggggugcuauagccaaguuaacccgcugacccugaccgccgccgucuugaugcugguggcccacuacgccaucaucgggccggggcuacaggccaaagccacccgggaagcccagaagaggacggccgcgggcauaaugaaaaaccccaccguggacggaauuguagcgaucgaccuggaccccguuguguaugaugccaaguucgagaagcagcugggccagauaaugcugcugauccugugcaccucccagauccuccugaugcgcaccacgugggcccugugcgagagcaucacccuugccaccggcccccugaccacccugugggaggggaguccgggcaaauuuuggaacacaaccaucgcggucagcauggccaacaucuuccgggggaguuaccucgccggcgccggccuggccuucagccugaugaagucccucgggggcgggcgccgcggcaccggggcgcagggcgagacccugggcgaaaaguggaagcgccagcugaaucaguugaguaagagcgaguuuaacaucuacaaaagauccgggauuauggagguggaccgcagugaggcgaaggagggccucaagcguggggagaccacccgucacgcugugagucggggcaccgcgaagcugcgcugguucgucgagcggaaccuggugaagcccgagggcaaagucaucgaccucggcuguggccgcgggggcuggagcuacuacugcgcggggcucaagaaggucacggaggugaaaggcuacacaaagggcgggcccggccacgaggagcccaucccaauggccacguacggcuggaaccuggugaagcuccauucgggcaaagacgucuucuucacgccucccgagaagugcgauacgcuacugugcgacaucggggagaguucccccaacccgacaaucgaagagggucgcacccuccgagugcuuaagaugguagagcccuggcugcgcgguaaccaauucugcaucaagauccucaaccccuacaugcccucuguggucgagacccuggagcagaugcagcgaaaguacggaggcaugcuggugcggaauccgcucucccgcaacagcacccacgagauguacugggucuccugcgggacuggaaacaucgugagcgccguaaacaugaccucccggaugcuguuaaaccgcuucaccauggcccaccgcaagccaaccuacgagcgagaugucgaccucggugccggcacgaggcacguugcgguggaaccggagguagcgaaccuggacaucauuggccagcggauugagaauauaaagcaugaacacaagaguacauggcacuacgacgaggacaaccccuacaaaaccugggccuaccacggauccuaugaggugaagccgagcggcuccgccagcagcauggucaacgggguagugaaacugcucaccaagccgugggacgucauccccauggugacacagaucgccaugacggauaccacccccuucggccagcagcguguguucaaggagaaggucgacacgcggaccccgaaggcuaagcgcgggaccgcccagauuauggaggugacggcacgguggcugugggguuuccucucccgcaacaagaagccucggaucugcacgcgcgaggaguucacccggaaggugcgcagcaacgccgcaauaggagcggucuucguggacgagaaucaauggaacuccgcuaaggaggccguggaggacgagcguuucugggaucucgugcaaaaggagcgagagcugcacaagcaggguaagugcgcgaccuguguguacaacaugaugggcaagcgggagaagaagcugggugaguucggcaaggcgaaagggucucgcgcgauaugguacauguggcucggugcuagauuccuggaguucgaggcccugggcuuuaugaacgaggaccauugguucucacgcgagaacagccucucuggugucgagggcgaggggcugcacaaacugggcuacauccuucgggacaucucgaagauccccgggggcaacauguacgccgacgauaccgcggguugggacacucggaucaccgaggaugaccugcagaacgaggcgaagaucaccgauauuauggagcccgagcacgcccugcucgccacgucaaucuuuaagcugacguaccagaauaaggucgugcgggugcagagacccgccaagaaugggacaguuauggacgugaucagcagacgggaccagcgcggcuccggccaggugggcaccuacggccugaacaccuuuacgaacauggaggcgcagcucaucagacagauggagagcgaggggaucuuccuacccuccgagcuggagaccccgaacuuggccgagcgcguccuggacuggcuggaaaaguacggcguggagcggcucaagcgcauggcuaucagcggggacgacugcguggucaaaccaaucgacgaccgguucgccaccgcccugaccgcgcugaacgauaugggcaaggugagaaaggacauuccccagugggagccuaguaagggauggaacgacuggcaacaggucccuuuuuguagccaucacuuccaccagcucauuaugaaggacggacgggagauagucguacccugucgcaaccaggacgagcuggugggccgggcccgcgucucucagggggcaggcuggagccuccgggaaacugccugccuagguaagagcuaugcccagauguggcagcugauguacuuccaccgccgggaccuccgccucgcggccaacgcuaucugcuccgccgaccccguggacugggugcccacaagccggaccaccuggucgauccaugcgcaccaccaauggaugacuaccgaggacaugcugagcgucuggaaccgcguauggaucgaggagaaccccuggauggaagauaagacccacguguccagcuggggcgacgucccguaccuugguaagcgcgaggaccaguggugcggcucgcucaucggccugacggcccgcgccaccugggcuucgaacauccagguggccaucaaccaggugcgccgacugaucgggaaugagaacuaccucgacuacaugacguccaugaaaagguucaagaacgaaggagaccccgagggggcucuuugguga

SEQ ID NO: 24350 - RNA, 9879 nt, Artificial Sequence
  derived and/or modified CDS sequence (opt11) from DENV-1__GQ199832__SS-prME
agcgugaccaugcugcucaugcugaugcccaccgcccuggccuuccaccucaccacccggggcggagagccccacaugaucgugacgaagcaggagagaggcaagagccugcuguuuaagaccagcgcgggagugaacaugugcacccucauagccauggacuuaggcgagcugugcgaagacaccaugaccuacaagugccccagaaucaccgaggccgagcccgacgauguggauugcuggugcaacgccacggacaccuggguaaccuaugggacuugcagccagacgggcgagcaccggcgggacaagcguagcguggcccucgcgccccacgucggccugggacuggagacccgcacggagaccuggauguccagcgaaggcgcauggaagcagauccagcgagucgagacgugggcccuucggcacccaggguucaccgugaucgcgcuguuccuagcccaugccauuggcaccuccaucacgcagaaggguaucaucuucauccuccugaugcuggugacgcccagcauggccaugagaugcgucggcauuggcucucgcgacuucguggaggggcucagcggcgccaccuggguggacgucgugcuggagcacggguccugcguuaccaccauggccaaggacaagccaacucuggacaucgagcuacugaaaacggaggugaccaaccccgcgguacugcggaagcucugcaucgaggcuaagaucagcaacaccaccaccgacucccgcuguccgacccagggcgaggccacccugauggaggagcaggacgccaacuucgugugccggcgcaccuucgucgaccggggcugggggaacgguugcgggcuguuuggcaaggggucccucaucacgugcgccaaguucaagugcgugaccaagcuggaggguaagaucguucaguaugagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggugcccuuacccuggacugcagcccccgcacuggccucgacuucaacgagaugguacuacuaaccaugaaggagaagagcuggcucguccacaagcaaugguuccuggaccugccgcuccccuggaccagcggggccagcaccucccaggagacguggaaccgacaagaccugcuggugaccuucaagaccgcucacgcgaagaaacaggagguggucgugcucggcagccaggaaggcgccaugcacaccgcccugacgggggccaccgagauccagacauccggcaccacuaccauauucgccggucaccugaaaugccgccuuaagauggauaagcugacccugaaggggaugagcuacguuauguguaccggguccuucaagcucgagaaggaggucgcggagacgcagcacggcacggugcuuguucagaucaaguaugagggcaccgacgccccgugcaagauacccuucagcacccaggacgagaaagggguuacgcagaacggccggcugauuaccgccaacccgaucgugacagauaaggagaagcccgugaacaucgaggccgagccgcccuuuggggagaguuacaucgucaucggcgcgggcgagaaggcccuuaagcucagcugguucaagaagggguccagcaucggcaagauguucgaggccaccgcccgcggggcccggcgaauggcgauccuuggcgacacagccugggacuucggcuccaucggcggcguguuuaccagcgugggcaagcugguccaccagaucuucggcaccgccuacggggucuuauucuccggcgugagcuggacuaugaagaucgggaucggcguacugcugacguggcucggccugaacucgcgcagcaccucccugagcaugaccugcauugcuguggggcucgugacccuguaccucggcgucauggugcaggccgacuccgggugcgugauaaacuggaagggccgggagcucaagugcggcagcggaauauucgucacgaacgaggugcacacguggaccgagcaguacaaguuccaggcggacagcccgaagcgccuguccgccgcaaucggcaaggccugggaggagggggugugcggcauccggucagcgacccgccuggagaacaucauguggaagcagaucaguaaugagcucaaccacauccugcuggagaacgggaugaaguucaccgucguggugggcgacgucguggggauccucgcucagggcaagaagaugaucaggccccaacccauggagcacaaguacagcuggaaguccuggggcaaggccaagaucauaggggccgacgugcaaaacacgaccuuuauaauagacggccccaacaccccggagugccccgacgaccagcgcgccuggaacaucugggaggucgaagacuacggguuuggaaucuucaccacgaacaucuggcugaagcugagggacagcuauacgcaggugugcgaccaccgccucauguccgcggccaucaaggacagcaaggccgugcacgcugacaugggcuacuggaucgagucugagaagaaugaaacguggaagcuggcccgggccagcuucaucgaggucaagaccugcaucuggcccaaaucccacacgcuguggagcaacgggguucucgaguccgaaaugaucauccccaagaucuacggcgguccuaucucccagcacaauuaccgcccagguuacuucacccagacugccgggcccuggcaccugggcaaacuggagcucgauuucgaccugugcgaaggcaccacuguggucgucgacgaacacugcggcaacagaggcccgucccuccgcaccaccaccgucacggggaagauaauacacgaaugguguugccgaagcugcacccugccgccucuccgcuucaagggcgaggauggguguugguacggcauggagauucggcccguaaaagagaaggaggagaaccuggugaaauccauggugagcgcaggcagcggcgaggucgacuccuucucucucggccugcugugcaccuccaucaugauagaggagguuaugagaagccgguggucccgcaagaugcucaugaccgggacgcuggccguguuccugcuccugaucaugggccagcugaccuggaacgaccucauccggcugugcaucaugguuggggccaacgcuagcgaccgcaugggcaugggcacaacguaccucgcucucauggccacguucaagaugcgcccgauguucgccguggguuuacuguuccggcgccucacaucccgggaggugcuccuguuaacaaucgggcugagccucgucgccuccguggagcuccccaacagucuggaggagcugggggacggccucgcgaugggcaucaugauucugaagcugcucacagacuuccagucccaccaacuuugggccacgcugcucagccugacuuucaucaagaccacccugagccuccacuacgccuggaagacgauggccaugguccugagcauagugucccuuuucccccucugccugagcaccacuucccagaagaccacguggcugcccguguugcuagggucucugggcugcaagccgcucaccauguuccugaucgcggagaacaagaucugggggcgcaaaaguuggccccugaacgagggcaucauggccguagggguggugucgauccuccugagcucccugcucaagaacgacgucccccuggccggcccacugaucgccggcgggaugcucaucgccugcuacgugaucagcggcuccagcgcggaccugucccuggaaaaggccgccgaggugucaugggaggaggaggccgagcacuccggggcgagccacaacauucucgucgaggugcaggacgacggcaccaugaagaucaaggaugaggagagagacgacacucugaccauccugcucaaggcgacauuacucgccgugagcggggucuacccgcuuagcauccccgcuacccuguucgugugguacuucuggcagaagaaaaaacagagauccggcgugcugugggacaccccuagcccgccugaggucgagcgggccgugcuggacgacggcaucuaccgcaucaugcaacguggucuccugggccggucccaggugggugucggcguguuucaggagaacguguuccacacuauguggcacguaacgcgcggggccgugcugauguaccagggcaagcgccucgagccgagcugggcgucugucaagaaggaccugaucaguuacggugguggguggcggcugcagggguccuggaacaccggcgaggagguucaggugaucgccguggagcccgggaagaaccccaagaacguccagaccgccccaggcaccuucaagacccccgaaggcgaggugggggcaaucgcccucgacuucaagccuggcaccagcggguccccuaucgugaaccgcgagggcaagaucgucggccuguacgggaacggcgucgugaccaccagcgggacguaugucagugcgaucgcccaggcaaaggccucccaggagggcccgcugcccgagaucgaggacgagguuuuccggaagcgcaaccucaccauaauggaccugcaccccgggagcgggaagacccggcgcuaccugccggcgaucgugcgggaggccaucaagcgcaagcuucggacccugaucuuggcccccacgcgcgucguggccuccgagauggccgaggcgcucaagggcaugcccauucguuaccagacuaccgcugucaagagcgaacauaccgggaaggaaaucgucgaccugaugugccaugcgaccuucaccaugcggcuucucucccccgugcgcgugccaaacuacaacaugauuaucauggacgaggcucacuucaccgaccccagcuccaucgccgcgcggggcuacaucagcacccgcguggggaugggcgaggccgccgccauuuuuaugacggccacgccgcccggguccguggaggcuuucccgcagagcaacgcagugauccaggacgaggagcgggacauccccgaacgcuccuggaacagcggcuacgaguggaucaccgacuuucccggcaagaccgucugguucgugcccuccaucaagagcggcaacgacaucgcaaacugccugaggaagaacggcaagcgcgugauccaacugucccggaagacauucgauaccgaguaccagaaaaccaagaacaacgauugggacuacgucgucaccacggacaucagcgagaugggggccaacuuccgcgcggaccggguuaucgacccgcgccggugccucaagcccgucauccugaaggacggccccgagcgagugauccuagccgggcccaugccggucaccguggccuccgcggcccaacggcgcggccggaucggccgcaaccacaacaaggagggggaccaguacauuuacaugggccagcccuuaaacaaugacgaggaccacgcgcacuggaccgaggccaaaauguuacuggacaacaucaacacccccgaggggaucauacccgcccucuucgaaccggagcgggagaaguccgccgccauugacggcgaguaccgccugcguggggaggcccggaagacguucguagaacugaugcgccggggugaccuccccguguggcuguccuacaagguugccagcgagggguuccaguacagcgaccgccggugguguuucgacggggagcgcaauaaccaggugcuggaggagaacauggaugucgagauuuggaccaaggagggcgagcggaagaagcuccgcccccgguggcucgacgcccgcaccuacagcgacccccuggcucuccgggaguucaaggaguucgcggcggggcgaaggagcgugucaggcgaccucauccuggagaucgguaaacucccgcagcaccugacgcagcgagcacagaacgcccuggacaaucucgugaugcugcacaacagcgaacagggcgggcgggccuacaaacacgcgauggaggaacugcccgacacuaucgagacacucaugcugcuggcccucaucgccguucucacugggggcgugacccuguucuucuuguccgggcgcggccugggaaagaccagcaucgggcuccucugcguaauggccuccagcguccugcuguggauggccuccguggagccccacuggauugcggccagcaucauccucgaguucuuccugauggugcugcucauacccgagccugaccggcagcgcaccccccaggacaaccaacuggccuacgucgucaucggccuccucuuuaucauccugaccguggcggcgaacgagauggggcugcucgagaccaccaagaaggaccugggcaucggacacgucgcgguggagaaccaccaccacgccacgaugcuugacguggaccuccaccccgcguccgccuggacccuguaugccgucgcgaccaccaucauaacgccgaugaugcggcacaccaucgagaacaccaccgcgaacaucagucuaacagccaucgcaaaccaggccgcgauccucaugggccuggacaagggcuggcccaucuccaagauggauaucggggugccgcugcucgcucugggcugcuauagccaagugaaucccuuaacccuuaccgccgccguccugaugcugguggcgcacuacgcuaucauugggccgggccuccaggccaaggccacccgcgaggcccagaagcggacggcggccgggaucaugaagaaccccaccguggacggcaucgucgccauugaccuggaucccgugguguaugaugccaaguucgaaaaacagcugggccagaucaugcuacucauccugugcacuucccaaauucuccugaugagaaccacgugggcccugugcgagucuaucacccucgcgaccgggccccugaccacacugugggagggcuccccggggaaguucuggaacaccaccaucgccgucagcauggccaacaucuuccgcggguccuaccucgccggcgccgggcuggcguucagccugaugaagucccucggcgggggccggagggggacgggcgcccagggugaaacgcugggggagaaguggaaacgccagcugaaccagcucuccaagagcgaguucaacauuuacaagcgcagugguauuauggagguggaccggagcgaggccaaggaggggcugaagcgcggcgaaaccacccggcacgccgugucccgcgggaccgcgaagcugcggugguucgucgagcguaaccuggugaagccugagggcaaggugaucgaccucggcugcgggcggggcggguggagcuacuauugcgccggccugaagaaggucacggaaguuaaaggguacaccaagggcggccccgggcacgaggagcccaucccgauggccaccuauggcuggaaucuggugaagcuccacuccgggaaggacgucuucuucaucccgcccgaaaagugcgauacccugcugugcgacaucggcgagagcaguccgaacccgacgaucgaggaggggcgcaccuugcggguucugaagaugguggaacccugguugcgcggcaaccaguucugcaucaagauccucaaccccuacaugcccagcgucguggagacccuggagcagaugcagcgaaagcacggcgggaugcuggugagaaacccgcucucccggaauagcacccaugagauguacugggucucaugcggcaccgggaacaucgugagcgccguaaacaugacgucccggaugcugcuuaaccgguucaccauggcccaccgcaagcccaccuacgagcgcgacgucgaccucggcgcggggacccggcacguggccguggagcccgaggucgccaaucuggacauaauugggcagcgcaucgaaaacaucaagcacgagcauaagagcacuuggcauuacgacgaggacaaccccuacaagaccugggcauaccacggcucguacgaggugaaaccuuccgggucggccucaagcauggucaacggcguggugaagcugcugaccaagccaugggacgucaucccgaugguaacccagaucgcgaugacggauacgacccccuuugggcagcagcggguuuucaaagagaaggucgacacccgcacgccgaaggcuaagcggggcaccgcccagauuauggaggugaccgcccgcuggcuuuggggcuuccugucccggaacaagaagccccgcaucugcacccgggaggaguucacgaggaaggugaggagcaacgccgcgauaggggcugucuucguggaugagaaccaguggaauuccgccaaggaggcaguggaagacgagcgcuucugggacuuaguccagaaggagcgcgagcugcacaagcagggcaagugcgcgaccuguguguacaacaugauggggaagcgcgagaagaagcugggcgaguucgggaaggcaaagggcagcagagccaucugguacauguggcucggcgcuagguuccuggaguuugaagcccugggguucaugaacgaggaucacugguuuucccgggagaacagccucuccggcguggagggggagggccugcacaagcugggguauauccuccgcgauauuaguaagauccccggcggcaacauguacgcggacgauacugcugggugggacacccggaucacggaagacgaccugcagaacgaagcuaagaucaccgacaucauggagccggagcacgcccugcuagcaaccuccaucuucaagcuaaccuaccagaacaaggucgugcgcgugcagaggcccgcgaagaacggcacggucauggacgugaucagccgaagggaccagcggggguccggccaggugggcaccuacgggcucaacaccuucaccaacauggaggcccagcucauccgccagauggagagcgagggcaucuuccugcccuccgagcuggagacgcccaaccucgccgagcggguacuggacuggcuggagaaauacgggguggaacgccucaagcggauggccaucagcggcgacgacugcguggucaagccgaucgacgaucgcuucgcgaccgcgcugaccgcccugaacgauauggggaaggugcggaaggacaucccccagugggagcccuccaagggcuggaaugauuggcagcaaguccccuuuugcagccaccacuuucaccagcucaucaugaaggacggccgcgagaucgucgugccgugcaggaaccaggacgagcugguggggcgugcccggguaucacaaggcgccggguggagccugcgagagacggccugccucggcaagagcuaugcgcagauguggcagcuaauguacuuccaccggcgcgaucugcggcucgccgccaacgccaucugcuccgcgguacccguggacuggguccccacaagccgcaccaccugguccauucacgcccaccaccaguggaugaccacggaggacaugcucaguguauggaaccggguguggauugaggaaaaccccuggauggaggacaagacccacguguccagcuggggcgacgugccguaccugggaaaacgugaagaccaguggugcggcucccucaucgggcugaccgcccgggccaccugggcuagcaacauccaggucgcgaucaaccagguccgccgccugaucggcaaugagaacuaccucgacuacaugaccuccaugaagcgguucaagaacgagggugaccccgagggcgcccugugguga

SEQ ID NO: 24351 - RNA, 9879 nt, Artificial Sequence
  derived and/or modified CDS sequence (opt11) from DENV-1__FJ882568__SS-prME
ucugugaccaugcugcugaugcugaugccuaccgcgcuugcguuucaccucacuacccggggcggggagccccacaugaucgugacaaagcaggagcggggcaagagccuacuuuuuaagaccucagcgggcguuaacaugugcaccuugauagcuauggaccuaggcgagcucugcgaggacaccaugacguacaaaugcccccggaucaccgaggccgagcccgacgacguugacugcuggugcaaugcuaccgacaccuggguuacuuacggaaccugcucacagacgggcgagcaccgcagggacaagcggagcguggcucucgcuccccacgugggccuugggcuggagacccgcacugaaaccuggauguccucugagggugcguggaagcagauccagcgggucgagacgugggcacuucgccaccccggguucacagugaucgcgcuguucuuagcucacgccaucgguacaucuaucacgcagaaagggaucauauucauucucuuaaugcuggugacgccuagcauggcuaugcggugcguaggcaucggaagccgcgacuucguggagggccugagcggcgccacguggguugacgucgugcuggagcacggguccugcgugacuaccauggccaaagacaagcccacgcuggacauagagcuccugaagaccgagguaaccaaucccgcgguucugcggaaguugugcauugaggccaaaauuagcaauaccacgacggauuccagaugccccacccagggcgaggccacucugauggaggaacaagacgcuaacuucgugugccggagaacggucguggaccggggaugggggaacggcugugggcuuuucggcaagggaucccucaucacgugugccaaguucaagugcgugaccaaguuagagggcaagaucgugcaguaugagaaccugaaguauucugugauugugaccguccacacaggcgaccagcaccagguggguaaugaaaguaccgaacacgggaccacagcgaccaucacuccccaggcccccaccagcgagauacaacuaaccgacuauggugcccucacccuggacugcagcccuaggacgggccucgacuuuaacgaaaugguauugcugaccaugaaagagaaguccuggcucguccacaaacagugguuccuggaccugccgcuccccuggaccagcggggccagcaccucccaggaaacguggaaccgacaagaccugcuaguuacuuucaagaccgcacacgcgaagaagcaagaggucgugguacucggcagccaggaaggugccaugcacaccgccuuaacuggggccaccgaaauacagacaucaggcacaacgaccauauuugccgggcaccugaagugucgccucaagauggacaagcugacccuuaaagggaugagcuacgucauguguacugguagcuuuaagcucgagaaggagguggcggagacgcagcacgguaccgugcugguccagaucaaguaugagggcaccgacgccccgugcaagauccccuuccuuacucaggacgagaagggggugacgcaaaaugggcgccugaucaccgccaacccgauagugacugacaaggagaagccgguuaacaucgaagccgagcccccuuucggggaaagcuacaucgugauaggcgcgggcgagaaggcccuuaaacugagcugguucaagaaagggaguuccaucggcaaaauguucgaagccaccgcacgcggagccagacgcauggcaauccugggcgacaccgccugggacuuugguagcauaggggguguguucacgucagucgggaagcucgugcaccagauauuugggacugcguacggagugcuguucagcggagucaguuggaccaugaagaucgggaucggcguacugcucacguggcucggacucaacagcagguccacuagccucucgaugaccuguauagcuguuggauuggucacccuauaccucggcgugauggugcaggccgacagugggugcguuaucaacuggaagggccgggagcugaagugcggguccggaaucuucgugacaaacgaaguacacacguggacggagcaguacaaguuccaagcggacagcccgaaacgcuuaagugccgccaucggcaaggccugggaggagggagucugcggcaucaggucugcaacccggcucgagaacaucauguggaagcagaucucgaacgaacugaaucacauucuucuugaaaacgggaugaaguucacgguggucgucggcgacgucguugggauacuggcgcagggaaagaaaaugauccggccccaacccauggagcacaaguacuccuggaaauccugggggaaggcaaagaucaucggcgccgacguccagaacacgaccuuuaucaucgacggccccaacaccccagagugcccugaugaccagagagcauggaauaucugggagguggaggacuacggguucgggaucuucacuacgaacauauggcuuaaguugcgugacuccuauacccagguuugcgaccaccgccugaugagcgcggcuaucaaggacucuaaagccgugcaugccgauaugggcuacuggauugagagcgagaagaacgagacauggaaauuggcaagagccuccuucaucgagguaaagaccugcauuuggcccaagagccacacgcuaugguccaacgguguacuggagucugagaugauuauccccaaaauuuacggggggccgauaucucagcacaauuaccgcccgggcuauuuuacccagaccgcggggccauggcaccugggcaaacucgagcuggacuucgaccugugcgaaggcacgaccgucguuguggacgaacacugugggaaccggggcccgucccugcgcaccacaaccgucacugggaagauuauccacgagugguguugccgguccugcacucugccgccguuacguuucaagggcgaagacgggugcugguacgggauggagauucggcccgucaaggagaaagaggagaaccucguuaagagcauggucucggcgggaagcggggaaguagacaguuucucccugggccuacugugcaccagcaucaugaucgaggaggugaugcgaaguagauggucucgcaaaaugcugaugaccgggacccuggcagucuuccuccugcugaucaugggccaacucacuuggaacgaucugauucgacuuuguaucauggugggggccaaugcauccgaucgcaugggcaugggcaccacuuaccucgcccugauggcgacuuuuaagaugcgccccauguucgcagucgggcuccuguuccggcgacugaccagccgggagguccuucuccugaccaucgggcugucccucguagccagcgucgaacuacccaacagccucgaagaauuaggcgacggacuagcgaugggcaucaugauccugaagcuccugaccgauuuucagagccaucagcugugggcgacgcuccugagccuaaccuuuauuaaaaccacccucagccugcacuaugcuuggaagacgauggccauggugcuguccauaguuagccuuuucccccucugccuuaguaccaccucgcagaagaccacgugguuaccuguccugcuggguucucucggcuguaagccgcugaccauguucuuaaucgcggagaauaagaucugggggcgcaaaagcuggccgcucaaugaaggcaucauggccguggggguggugaguaucuuacugagcagccuccugaagaacgaugucccgcuggcgggcccccucauagccggcgguauguugauugccugcuacguaaucuccggcagcucggcugaccuuagccucgagaaggcagccgaagucuccugggaggaggaggcagaacacagcggggccucccacaacauccuaguagaggugcaggacgacgggaccaugaagaucaaggacgaggagcgggacgacacccuuacgauccuccugaaggcgacgcugcucgccgucucaggcgucuacccgcugagcauccccgccacacuuuucgugugguacuuuuggcagaagaagaagcaacgcucgggcguccugugggacacccccagcccgccugaaguggagcgggccguucuggacgacggcaucuaccgcaucaugcagcgugggcugcugggacgcagccagguaggagugggcguguuccaggagaacguauuucacacaauguggcacguuacucgcggggccgugcucauguaccagggcaaacgcuuggagccgucaugggcguccgucaagaaggaccuaauaagcuacggcgggggcuggaggcuccagggaagcuggaacacuggcgaagaaguccaggugaucgccguugagcccgggaagaauccaaagaauguccagaccgcuccaggcacguucaaaacgcccgagggcgaaguuggggcaauugcccuagacuucaagcccgggacauccgguagccccaucguuaacagggagggcaaaaucgugggccucuauggcaaugggguggucaccaccuccggaacguacguguccgcgaucgcucaggccaaagcaagccaggagggcccccuccccgagaucgaggaugaaguguuccggaaacgcaaccugaccaucauggaccugcaccccggcucuggcaaaacccggcgcuaccucccggcgaucguacgggaggccaucaagcgcaaacugcggacccugauccuagcccccacacgcguuguggccagugagauggcggaggcccucaaaggcaugcccauucgcuaccagacgaccgcagucaaauccgagcacaccgggaaggaaauaguggaccugaugugccacgcaacuuucaccaugaggcuccugagccccgugcgcgucccgaacuacaacaugaucaucauggaugaggcccauuucaccgacccauccucuaucgcugcgcggggcuacaucuccaccagaguggggaugggcgaggcugcugccauauucaugacugccacgccgcccgggagcguggaagcguucccucaaucuaacgcagucauccaggacgaggagcgggacauacccgagcgaagcuggaacuccgguuaugaguggaucaccgacuucccgggaaaaacagugugguucguucccucuauuaaguccgggaacgauaucgcuaacugccugcggaaaaacggcaagagggucauccaauugagucggaagacguucgacacugaguaccagaagaccaagaacaaugacugggacuacguggugaccacggauaucagugagaugggggccaacuuucgggcggaucgugucauagauccgcgccggugccugaagccggucauccugaaggauggccccgaacgcgucauccucgcugggcccaugccgguaaccguggccucagccgcccagcguagaggccggaucggccgcaaucauaacaaggagggcgaccaguauaucuauaugggccagccccuuaacaacgacgaggaccacgcgcacuggaccgaggcaaagaugcugcuugacaacauaaauacccccgaggggauuauaccggcccuuuuugaaccggagcgggagaaguccgccgccaucgacggcgaauaccgcuugcgcggagaggcacggaagacguucguagagcucaugcgccggggggaccugcccguguggcugagcuacaagguggccuccgaaggcuuccaguacagcgaccgcagguggugcuucgacggggagcgcaacaaccagguccuugaggagaacauggacguggagauauggacuaaggagggcgagcggaagaagcugcgcccacgguggcuggaugcccggaccuacucggacccccuagcgcuccgugaauucaaagaguucgccgccggccgcaggucggugagcggcgaucugauacucgagaucggcaagcugccgcaacaccugacccagcgcgcccagaacgcucucgacaaucuggucaugcuacacaacucagagcagggcgggcgggcauacagacacgcgauggaggaacuccccgacacgaucgagacccucaugcugcucgcuuuaaucgccgugcugaccggaggcguaacccucuucuucuuaagcgggcgcggccucggcaagaccuccaucggccucuugugcgucauggccagcuccguacuauuauggauggccucggucgagccccacuggauagcggccucaaucauucucgaguucuuccugauggucuugcuuaucccggagccggaucgccagcggacaccacaggacaaccagcucgccuacgugguaauuggccucuuauucaucauccugaccguugccgccaacgagauggggcugcuggagaccacaaagaaggacuuaggcaucgggcacguggcgguggagaaccaccaccacgccaccaugcucgaugucgaccugcaccccgcaagcgccuggacucuguacgccguggcgacaaccaucaucacgccgaugaugcgccacacaaucgagaacaccaccgccaauaucucucucacggccaucgccaaucaggcagccauacugaugggccuggacaagggcuggcccaucagcaaaauggacaucgggguuccccucuuggcccugggcugcuacagccaggucaacccacugacgcugaccgccgccguguugaugcugguugcgcauuacgcuauaaucgggccgggucuucaagcuaaggccacccgggaggcucagaagcgcacggcugcggggaucaugaagaacccuaccgucgacggcaucgucgccaucgaccuagaccccguagucuacgacgccaaguucgaaaagcagcucggacagaucaugcuguugaucuuaugcaccucccaaaucuugcugaugcgcacaacgugggcauugugugaguccaucacgcuugcgacggggccccuaacaacucugugggaaggcuccccggggaaguucuggaacaccacuauagcuguguccauggccaacaucuuccgggggagcuauuuggccggcgcugggcuggcguucucgcucaugaagucccugggagggggucgcagggguaccggcgcccaaggcgagacgcuuggggagaaguggaagcgccaauugaaccaacugagcaaguccgaguuuaacaucuacaagcggagcgggauuauggagguugacagguccgaagcuaaggaggggcugaagcgaggagagaccacccgccaugccgucagccggggcaccgcuaaacucagaugguucguggagagaaaccucgugaagcccgagggcaaggucauugaccucggcugcgggaggggcggguggagcuacuacugcgcuggccugaagaaggugacggagguuaagggguacaccaaggguggccccggucacgaggagcccaucccgauggccaccuacggcuggaaccucgucaagcugcauagugguaaggaugucuucuucacgccgcccgagaagugcgacacgcugcucugcgacaucggcgagucuagccccaauccgaccaucgaggaagggcggaccuugcgcgugcucaagauggucgagcccuggcuccgggguaaucaguuuugcaucaagauccugaaccccuacaugcccucagugguggaaaccuuggaacagaugcagcgcaagcacgguggaaugcucguccguaacccccugagccgcaauagcacccacgagauguacuggguuaguugcggcacggggaacaucguuagcgccgucaacaugacaagucggaugcuguugaaccgcuucacuauggcccaucgcaagcccaccuacgaacgggacgucgauuugggcgcaggaacaagacacguugcaguggagcccgagguggcgaacuuggacaucaucgggcagcggauagagaacaucaagcacgagcacaaguccacguggcacuacgacgaagacaaucccuacaagaccugggcguaucauggcagcuacgaggucaagccuuccggguccgccaguucgauggugaacggcguugucaagcuccugacaaaaccaugggacgugaucccuaugguuacucaaaucgcgaugaccgacacgacgcccuuugggcaacaacgggucuucaaagagaaagucgacacccggacuccgaaggccaagcgcgggacagcacagaucauggagguaaccgcucggugguuauggggcuuucuuagccgcaacaagaaaccccggauaugcacaagggaggaguucacccggaagguccgcuccaacgccgcgaucggcgccguguucguggaugagaaucaguggaacagcgccaaggaagccguugaagacgagcguuuuugggaccuggugcagaaggaacgcgaguugcacaaacaggggaagugcgccacgugcguguauaacaugaugggaaaacgagagaagaaguugggcgaguuuggcaaggcgaagggcucucgcgcaaucugguacauguggcugggggcccgguuccuggaguuugaagcccucgguuuuaugaaugaagaccacugguucagccgggagaacagccugagcggcgucgagggggagggccugcauaagcuaggguacauccugcgggauaucagcaagauacccggggguaacauguaugcggaugacaccgccggaugggacacccguaucaccgaagacgaccugcagaaugaggccaagaucaccgauaucauggagccggaacacgcgcucuuagccaccagcaucuucaagcugacguaccagaacaaggucguacgcguccagagaccagcgaaaaacggcacugugauggacgugaucucccgacgcgaccagagggggagcggccaggucggcaccuacgggcucaauaccuucacgaacauggaggcccaacugauccggcaaauggaauccgagggcaucuuuuugcccagcgaacuugagacaccgaaccuggcugaacgcguccuggacuggcucgagaaguacgggguugagcggcugaaaaggauggccaucucaggcgaugacugcguaguaaagccgaucgacgaccgguucgcaaccgcgcugaccgcccucaacgacauggggaaggugaggaaggacaucccacagugggagcccucgaagggcuggaacgacuggcagcaaguccccuucugcucgcaccacuuucaccagcuaaucaugaaagauggccgggagaucgugguuccgugccgcaaccaggacgaacuggucgggcgggcucgcgugagccagggcgccggguggucccuccgggagacggccugccugggcaagagcuacgcgcagauguggcagcugauguauuuccaccgccgugaucuccgccuggccgccaacgccaucugcucugcuguacccguugacuggguccccaccucccggaccacguggagcauccacgcacaccaccaguggaugacgacagaggacauguuauccguguggaaucgcguguggaucgaagagaaccccuggauggaggacaagacccaugugucauccuggggcgaugugccauaucuaggcaagcgggaagaccaguggugugguagcuugaucgggcugaccgcccgagccaccugggccuccaacauccagguugcgauuaaccaagugcgccggcucaucggcaaugagaauuaccuggacuauaugacuagcaugaagcgcuucaagaacgagggagauccugagggcgcccugugguaa

SEQ ID NO: 24352 - RNA, 9879 nt, Artificial Sequence
  derived and/or modified CDS sequence (opt11) from DENV-1__FJ882569__SS-prME
ucugugaccaugcugcugaugcugaugccuaccgcccucgcuuuccaucucacuaccagaggcggggagccccacaugaucgugacuaagcaggagcggggcaagagccuucuguucaagaccagcgcgggggugaacaugugcaccuugauugccauggauuugggcgagcuuugcgaggacaccaugaccuacaagugcccgcgaaucaccgaagccgagcccgacgacguggacugcugguguaacgccacagacacgugggugacuuacgggaccugcagccagacgggcgaacaucgcagggauaagcggucuguggcccucgcgccccaugucgggcugggauuagaaacccgcaccgagaccuggauguccucagagggagccuggaagcaaauccagcggguugagacgugggccuuacgccaccccggcuucaccgugaucgccuuauucuuggcgcacgcuauaggcacguccaucacccagaaggggauaaucuuuauccuccugaugcuggugacucccagcauggccaugcguugcgucggcauuggcucccgcgacuucgucgagggucucagcggcgccaccuggguggacgucgugcuggagcacggguccugcguuaccacaauggcgaaggacaagcccacgcuagauaucgagcuacugaaaacagaggucaccaaccccgcggugcugcguaaguuguguaucgaggccaagaucagcaacaccacgacggacucccgcuguccaacgcagggcgaggccacgcugauggaggagcaggacgcgaacuuugugugccggcguacguucgucgaccgaggcugggggaauggcugcggacuguucggcaaggggagccucaucacgugcgccaaguucaagugcgugaccaagcuggagggcaagauugugcaguacgagaaccucaaguauuccgucaucgugaccguccacacuggcgaccagcaucaagucgggaacgagagcaccgagcacggcaccaccgcgaccaucacgccacaggcccccacuuccgagauccaauugacggacuacggcgcccugacccuggacugcucuccccgcacgggccuugacuucaacgagauggugcugcugaccaugaaggagaagaguuggcucguucacaagcagugguuccuggaccuaccgcucccguggaccagcggggccucuacgucgcaggagacauggaaucggcaggaccugcuaguuaccuucaagacggcgcacgccaagaaacaggaaguggucgugcucggcagccaggagggcgcgaugcacaccgcgcuaacgggcgccacggaaauccagaccuccggcacaacuaccaucuucgccgggcaucugaagugccgccucaagauggacaaacugacgcugaagggcaugagcuacgugaugugcaccgggaguuucaagcucgagaaagaagucgcggagacgcagcaugguaccgugcuggugcaaaucaaguaugaaggcacagacgcccccuguaagauccccuucagcacccaggacgagaagggugucacgcagaacggccguuugaucaccgcuaacccgaucgugaccgacaaggagaagcccgucaacaucgaggccgagccgcccuucggggaaucauacaucgugaucggcgcgggcgagaaggcccugaagcucagcugguucaagaaagguuccagcauaggcaagauguucgaggcaaccgcccgcggcgcccggcgcauggcuauucugggugacacggccugggacuuuggaaguaucggcggcguguuuaccagcguagggaagcugguccaccagaucuucggcaccgccuacgguguccuguucucuggcgucagcuggacuaugaagauaggcauuggcguccugcuaacuuggcucggacugaacucgcggucuacgucucugagcaugaccugcaucgcuguggggcucgugacccuguaccugggcgugauggugcaggccgacagugguugcgugauaaacuggaaaggacgggagcuaaagugcgggagcggcauuuucgucacgaaugaggugcacaccuggaccgagcaguacaaguuccaggcggacucaccaaagcguuuguccgccgccaucggcaaggccugggaggaggggguuugcggcauccggagcgcuacccguuuagagaauaucauguggaaacagaucucaaaugagcucaaccauauccugcuagaaaacgggaugaaguucacugugguggugggcgacgugguugggauccuggcgcagggcaagaagaugaucagaccucagcccauggagcacaaguacagcuggaaguccuggggcaaagccaagaucaucggggccgacgugcagaacacuacuuucaucaucgauggccccaauaccccggagugucccgacgaucaacgcgccuggaauaucugggagguagaggacuacggguucggcaucuucaccacuaacaucuggcugaaguuacgggauagcuacacccaagucugugaccaccggcucauguccgcggcuaucaaggauucgaaggccgugcacgccgauaugggcuacuggauugaauccgagaagaacgaaaccuggaaacuggcccgggcgagcuucaucgaagucaaaacguguaucuggcccaagucccauacacugugguccaacgggguccucgagucggaaaugaucauccccaaaaucuacggcgggccgaucagccagcacaacuaccgccccggcuacuucacccagaccgccgggcccuggcaucugggcaagcucgagcucgacuucgaccugugugagggcaccacgguggucguggacgagcacuguggcaaucggggcccaucacugagaacaaccaccgugacaggaaagaucauccacgaauggugcugccggaguugcacgcugccgccacugcgcuuuaagggcgaggacgggugcugguacggcauggagauccgaccggucaaggagaaggaggagaaccugguaaagucuaugguaagcgccggaagcggcgaggucgacuccuucucucucggccugcugugcaccaguaucaugauugaggaggugaugcgcagucgauggucccgcaaaaugcucaugaccgggacgcuggccguuuuucuauuacuuaucaugggccagcucaccuggaacgacuuaauccggcugugcaucauggucggggcaaacgcgagcgaccgcaugggcaugggcaccacauaccuggcacuaauggccacguuuaagaugcgcccgauguucgcuguggggcugcuguucaggcgucucaccucccgggaggugcugcugcucaccaucgggcugucauugguugccuccguggaacuccccaacagccuggaggagcugggagacggcuuggcgaugggcaucaugauccugaaacuucucaccgacuuccagucucaccagcugugggccacccuacucagucugaccuucauuaagacgacccugucgcuccacuacgccuggaagacaauggcaaugguccugagcauaguuucccuguucccccuaugccuguccaccaccucccagaaaacgacguggcugcccguuuugcugggcagccugggcugcaagccguugaccauguuccugaucgcugagaauaaaaucugggggcgucgguccuggccccugaacgagggaaucauggcugucggggucgucucgauccuccugagcucccuacucaagaacgacgucccucuggccggcccacugaucgcaggggguaugcucauugcgugcuacgucaucuccggcuccucugcggaccucucccuggagaaagcugccgagguuucgugggaagaggaggcugagcacuccggcgccucucauaacauucucgucgaagugcaggacgacggcaccaugaaaaucaaggaugaggagcgcgaugauacccugaccauccuguuaaaggcaacgcuacuggccguuucaggggucuauccccucagcauccccgccacccuguucgugugguauuucuggcagaagaagaagcaaagguccggaguucugugggacacccccagcccgcccgagguggagagagccgugcuggacgacgggaucuaccggaucaugcagcgcggucuccugggccguagccagguaggggucggcgucuuccaggagaacguguuccacacaauguggcacgucacucgcggggccgugcugauguaccaaggcaagcgauuagagcccagcugggccuccgucaaaaaggaucugaucagcuacggcgggggguggcgccugcagggguccuggaacaccggcgaggagguccaggugaucgccgucgagcccggcaagaaccccaaaaacguccaaacugcccccgggaccuucaagacgcccgagggugaggugggcgccaucgcccuagacuucaagccaggcaccagcgguucucccaucguaaaccgggagggcaagauugucggccuguacgggaacggcguggugaccacgagcgggacguacgucucggcgauugcgcaagcuaaggcuucccaggagggcccgcugcccgagaucgaggacgaaguguuccgcaagcgaaaucucaccauuauggaucugcaccccgggagcggcaagacccgacgguacuuaccugcaaucgugcgcgaggccauuaaacggaagcugcgcacccugauccuagcccccacgagggucguagccuccgagauggccgaggcgcucaagggcaugccuauccgguaccaaaccaccgccgucaagagcgagcacacugggaaggagaucgucgaccugaugugccacgccaccuucaccaugcgucucuuauccccagugcgggugccgaacuacaacaugauaauuauggaugaggcccacuuuacggaccccagcuccaucgccgcgcgcggauacaucagcacacgggucggaaugggugaggccgcggccauauuuaugacagccacgccgccagguagcguggaggcauucccucaaagcaaugcagucauccaggacgaggagcgcgacauccccgaacgguccuggaacucaggcuacgaauggauuaccgacuucccuggcaagaccgugugguucgugcccuccaucaagagcgggaacgacaucgccaacugccugcgaaagaacgguaaacgcgugauccagcugucgcgcaagacuuucgacaccgaguaccagaagacgaaaaacaacgacugggacuacgucguaaccacggauaucucggagaugggugccaacuucagggcggaccgcgugaucgacccgcgacggugccucaagcccgucauccugaaggacggucccgagcgggugaucuuggcuggaccgaugcccgugacaguggccuccgcggcccagcgccggggcaggaucggccggaaccacaacaaggagggggaccaguacaucuacaugggccagccacuaaauaacgacgaggaccacgcgcacuggaccgaggccaagaugcuccuagacaacaucaacaccccggaggggaucauucccgcccucuucgagccggagcgcgagaaaagugccgccaucgacggagaguaccgccugcgcggggaggcucgcaagaccuucguggagcugaugcggcgaggcgaccucccgguuuggcuguccuacaagguugccuccgagggcuuccaguacucugaccggcgguggugcuucgacggcgagcguaauaaucagguucuugaagagaacauggaugucgagaucuggaccaaggaaggugagcgcaagaagcuccggccccgcuggcuggacgccaggaccuacuccgacccccuggcccugcgcgaguucaaagaauuugcugccgggcgacgaagcguuuccggugaucugauccuggaaaucggcaaacucccgcaacaccuuacccagcgggcccagaacgcccucgacaaccucguuaugcugcacaacagcgagcagggcgggcgcgccuaccggcacgcgauggaggagcugccugacacaauagagaccuuaaugcugcuggcccucaucgccguucugaccgggggaguaacucuguucuuccucucaggccgcggccuuggcaaaaccagcaucggauugcucugcgugauggccuccagcguucuguuguggauggcguccguggagccacacuggauugcagcuagcaucauccucgaguucuuuuuaauggugcugcucauccccgagccggacaggcagcgcacgccacaggacaaucaguuagccuacgucguaaucggccuccuauucaugauccugaccguggccgccaacgaaaugggguugcuugagaccacgaaaaaggaccugggcaucgggcaugucgccguggagaaccaccaccaugccacaaugcuggacgucgauuugcaucccgccuccgccuggacccuguacgccguugcgaccacuaucaucaccccgaugaugcggcauaccaucgagaacaccaccgccaacauaucccucacggcuaucgccaaccaggcagcgauccucaugggccuggauaagggcuggccuauuuccaaaauggacaucggggugccccuguuggcucugggcugcuacagccaagugaacccucuuacucuuaccgccgccgucuugaugcugguggcccacuacgccauuaucgggcccggccuccaggccaaggcuacccgcgaagcccaaaagcggacugcagccgggaucaugaaaaaccccaccguggacggcauagucgccaucgaccuggaucccgucguguaugacgccaaauucgagaagcagcugggacagaucaugcuccugauccugugcaccucccaaauccuccugaugcggaccacgugggcccugugcgagagcauaacccuggcuacagggccccugaccacucugugggagggcucaccggggaaguucuggaacacgacaaucgccgucagcauggccaacaucuucagagguucauacuuggccggcgccgggcuugcguucagccucaugaaguccuuaggugggggccggcgcggcacgggcgcccagggcgaaacgcugggcgagaaguggaagaggcagcugaaccaacuauccaagagcgaauucaacaucuacaagcgcagcgguauuauggagguggaccggagcgaggcuaaggaggggcugaagcgcggcgaaaccacccggcacgccguguccagggggaccgcgaaguuacggugguuugucgagagaaaccuggugaagcccgagggcaaagugaucgaccucggcugcggccggggcggguggaguuacuacugcgccgggcugaagaaaguuacggaggugaagggguacaccaagggcgggccugggcacgaggagcccaucccgauggccacauauggcuggaaccuugugaaacuccacuccgggaaggacgucuuuuucacuccgcccgaaaagugugacacccuguugugcgacauuggcgagagcaguccuaacccgaccaucgaggaaggucgcacccuccggguccugaagaugguggagcccuggcuucgcggcaaccaguuuugcaucaagauccucaaccccuacaugcccagcgugguagagacccuggagcagaugcaacggaagcauggcgggaugcuggugcgcaacccccuaucucggaacagcacccacgagauguauugggucuccugcggcacgggaaacaucgugagugcaguuaacaugaccagucgcaugcugcucaaccgcuucaccauggcccaccggaaacccaccuaugaaagagacguugaccucggcgcgggcacgcggcacgucgccguggagcccgaagucgcgaaccuggauaucaucgggcagcgcaucgaaaacaucaaacacgagcacaagucaaccuggcacuacgacgaagacaaccccuacaagacgugggcguaccacggcuccuacgaggugaagccguccggcagcgccagcuccauggucaacggcgugguaaagcuccucaccaagcccugggacgugauccccaugguaacgcagaucgcgaugaccgacaccacucccuucggccagcagcggguguucaaggagaagguugacacgcggacuccgaaagccaagcgaggcacggcccagauaauggaggucacagcucgcuggcugugggguuucuuaucccggaacaagaagccccgcaucuguacgcgggaggaguuuacucggaaaguuagaagcaacgcugcgaucggggccgucuucguggacgagaaucaguggaacuccgccaaggaggccguagaggacgagcgguucugggauuugguucagaaggagcgggagcugcacaagcagggcaagugcgcgacuugcguauauaacaugauggggaagcgagagaagaaacugggcgaguucggaaaagccaaaggcuccagagccauuugguauauguggcucggcgcccgcuuccuugaguuugaggcccuaggguucaugaacgaggaccacugguuuucccgggagaauucacucuccggcguggagggggagggcuuacacaagcucggguacauccucagggacauuagcaaaaucccgggcggcaacauguaugcagacgacaccgccgggugggacacacggaucaccgaggacgauuuacaaaaugaagcgaagauuaccgacaucauggagccggagcacgcccugcuggccaccuccaucuucaagcugacguaccagaacaaggucguccgcgugcagcgcccggcgaagaacggcaccgucauggacgugaucucacggcgcgaccaacgggggucugggcaggugggcaccuacgggcucaacaccuucacaaauauggaagcccagcucauccgccagauggaaagugagggcaucuuccugcccuccgagcuggaaaccccuaaccucgccgagcggguccuggauuggcuggagaaguaugggguagagcgccucaagcggauggccaucagcggcgacgacuguguggucaagcccaucgacgaccgcuucgcaacugcacugacugcccucaacgacauggggaaggugaggaaggacaucccccagugggagcccuccaagggcuggaacgacuggcagcaaguccccuuuuguagccaccacuuucaccaguuaauaaugaaggacgggcgcgagauagucgucccgugucguaaccaggacgagcugguagggcgcgccagagucucccagggcgcgggguggagccugcgcgagacggcgugccucggcaaaagcuacgcgcagauguggcagcugauguacuuccaccgucgcgaucuccggcuagccgcuaacgcuaucugcuccgcggugcccguggacugggucccgaccagccgcacaacuugguccauacacgcccaccaccaguggaugacgaccgaggauaugcugagcguguggaaccgaguauggaucgaggagaaucccuggauggaagacaagacacacgucuccuccuggggggacgugccguaccugggcaagcgcgaagaccaguggugcggaucccucauagggcugaccgcccgcgccaccugggccagcaacauccagguggcgaucaaccaaguacggcgccugaucggaaacgaaaacuaccucgacuacaugacaagcaugaaacgguuuaagaaugagggggaucccgagggcgcccugugguaa

SEQ ID NO: 24353 - RNA, 9879 nt, Artificial Sequence
  derived and/or modified CDS sequence (opt11) from DENV-1__GQ199833__SS-prME
agcgugacgaugcuacucaugcugaugcccacagcccuggcauuccaccuuaccacccgcggcggggagccccacaugaucguuaccaagcaggagcgggguaaaucccuucuguucaagacuucagcgggugugaacauguguacccucaucgccauggaccugggggagcugugugaggauaccaugaccuauaagugcccgcggaucaccgaggcagagccagaugacguggacugcuggugcaacgccaccgacaccuggguaacguaugggacuugcagccagacgggagagcacagacgcgaccggcgcagcguugcccucgcgccccacgugggccuugggcuggagacccgcacggagaccuggaugucgagcgaaggcgccuggaagcagauccagagaguggaaacgugggccuuacggcaccccggguucacagugaucgcgcuguuccuggcucacgcgaucggcaccuccaucacgcagaagggaaucaucuucaucuugcugaugcuggugacucccucuauggcuaugcggugcguaggcauuggcagccgggacuucguagaggggcuaagcggcgccaccuggguggacgucguucuggagcauggguccugcgucacuaccauggccaaggacaaacccacgcuggauaucgagcuacugaaaacggaggucaccaaccccgcagugcuucgcaaacucugcaucgaggccaagaucagcaacaccaccacagacucccggugccccacccagggcgaggcgacccugauggaagagcaggacgccaacuucguaugucgaagaacauucgucgaccgcggguggggaaaugguugcgggcuguucggcaaggggagccucaucacgugcgccaaguuuaaaugcguaaccaaguuagaaggcaagaucgugcaauaugaaaaccugaaguacucgguaauagugaccguucacacgggagaccagcaccaggucgggaacgagagcaccgagcacgguacaacugcgacuaucacaccccaggcccccaccucagagauccagcucaccgacuacggggcccuaaccuuagacugcagcccgcggacgggcuuggacuucaacgagauggugcugcuaacuaugaaggggaagucauggcucguccacaagcagugguuucuggacuugccgcucccauggaccagcggcgccagcaccucccaggagacguggaaccgucaggaccuucucgucaccuuuaagacugcccacgcgaagaagcaggagguugucgugcucggcucucaggagggggccaugcacaccgcacugaccggcgccacggagauccagacuucugggacgaccaccaucuucgccggccaccuuaagugccggcucaagauggacaagcugacccugaaggggaugagcuaugugaugugcaccgguagcuucaagcucgagaaggagguagcggagacgcagcacggcaccguacuggugcaaauuaaguacgagggcacugaugcccccugcaaaauccccuucagcacacaagacgagaaagggguuacgcagaacgggcgucucaucacggccaacccgaucgugacugacaaggagaagcccgugaauauagaagcggagccgccguuuggggaguccuacaucgucaucggcgcgggagaaaaggcccugaaacucagcugguucaagaagggcuccagcaucgguaagauguucgaggccacugcccgcggcgcucgccgcauggcgauccuuggggacacggccugggauuuuggguccaucggcggugucuucaccagugucggcaagcucguucaccagaucuucgggacggccuacggcguccuauucuccgggguguccuggaccaugaaaaucgguauaggcguccugcuuacguggcuggguuugaacucccggaguaccuccuuguccaugaccugcauagccguuggccucgugacguuguaucugggggucaugguucaggcggauuccgggugcgugaucaacuggaagggccgcgagcucaaguguggcagcggcauauucgucacuaacgagguacacaccuggacagagcaguacaaguuccaggcugauuccccgaaacggcucagugcggccauugggaaggccugggaggagggcguaugcgggauucgcagcgcgacaaggcuggagaacaucauguggaaacagaucuccaacgagcugaaccacauccugcuggagaacgggaugaaguuuaccgucguuguaggggacgucgugggaauccucgcgcagggcaagaagaugauccgcccacagcccauggagcauaaguacagcuggaagaguugggggaaggccaagauuauaggggccgaugugcagaacacgaccuucauaauagacgggcccaacaccccggagugccccgaugaccagcgggcguggaacauuugggagguugaagacuauggauucggcauauucaccacaaacaucuggcucaaguugcgagacagcuacacccaggugugugaucaucggcucauguccgcggccaucaaggacucaaaagccgugcacgccgacaugggguacuggaucgaauccgagaagaacgagaccuggaaacuggcgcgggcuucuuucauagaagucaaaacaugcaucuggccaaagucccauacgcuguggagcaacggcguacucgagagugagaugauuauaccaaagaucuacgggggcccgaucucgcagcacaacuaucggccgggcuacuucacccagacggccggccccuggcaccucggcaagcuggagcucgauuucgacuuaugugaagggacuacgguugucguggacgaacacugcggcaaccgagggccgagccugcggaccaccaccguaacuggcaagaucauccacgaguggugcugccgcaguugcacgcugcccccccugcgguucaaaggcgaggacggcuguugguauggcauggaaauccgcccugucaaggaaaaggaggagaaccuggucaaaucuauggugagugccggcagcggcgagguggacucauucucccucggguuacuguguauaucaaucaugaucgaggaggugaugcgcagccggugguccaggaaaaugcuuaugaccggcaccuuagccguguuccuguugcugaucaugggacagcugacguggaaugaucucauucgccugugcaucauggucggcgcuaacgcgagugaccggaugggaauggggaccaccuacuuagcauuaauggccaccuucaagaugcggcccauguucgcagugggccugcuguuccgccgccugacgucccgcgaagugcuuuuacucaccaucgguuugagcuugguggccucaguugagcuccccaacucauuggaggaacugggugacggccucgccauggggaucaugauucugaagcuguuaaccgacuuccagucccaccagcugugggccacccuguuaucccugacguuuauaaaaacgacccuuucccuucacuacgcguggaagaccauggccaugguccugagcaucgugucguuguucccccucuguuuaagcacgaccucccagaagacgacaugguuacccgugcuccugggcucgcuugggugcaagccguugacgauguuccugauagcggagaacaaaaucuggggccgcaaguccuggccguuaaaugaggggaucauggccgucgggguaguguccauccuacuguccucccuacuuaaaaacgacgucccccuggccggcccccugaucgcgggcggcaugcucauugccugcuacgugaucagcggguccagcgcugacuuaucccuggagaaggccgccgaaguaucgugggaggaggaggccgagcauuccggcgccucccacaauauccuaguagaagugcaggacgacgggaccaugaagaucaaggaugaggagagggacgacacuuugaccaucuuacuuaaagcgacccuacuagcaguuuccggcguuuacccucuuagcaucccugccacccuauucgugugguacuuuuggcaaaaaaaaaagcaacggaguggcgugcugugggacacucccagcccgcccgaggucgagagagccguauuagacgacgggauauaucggaucaugcagcgcggccugcuggggcgaagccaagugggcgucgggguguuucaggagaacguguuccacacgauguggcauguaacucgcggcgcuguacugauguaccaaggcaagcgacucgagcccucuugggcuucggugaagaaggaccugaucagcuacggggguggguggcgccugcagggcuccuggaacacgggggaggagguucaaguaauagccguggaaccaggcaagaacccgaagaacguacagaccgcucccggcacguucaagacgcccgagggcgaggugggcgccauagcccucgauuucaagccuggcacguccggauccccuauugugaaccgggagggcaagauagucggacuguacggaaacgggguggugaccaccagcggcacauaugucagcgccaucgcccaggccaaggccagucaggaggggccucugcccgaaaucgaggacgaaguguuucggaagcggaaccucacgauuauggaccugcaucccggcaguggcaaaacccggcgguaccugcccgcgaucgucagagaggccauaaagaggaagcuccgcacgcuuaucuuggcuccgacccgcguuguggccagcgagauggcggaagcgcuaaaggggaugccuauacgauaccagacgaccgcagucaagucggagcacacaggcaaggagauaguggaccugaugugccaugccaccuuuacuaugcgccugcuuuccccgguacgggugccaaacuacaacaugaucaucauggaugaagcccacuucaccgaccccagcuccaucgccgcgcguggguacaucagcacccgggucggcaugggcgaggccgccgccaucuucaugacggcaaccccgcccgguucaguggaggcguucccgcagagcaacgccgugauccaggacgaggagcgugacaucccagagcguuccuggaauucuggcuaugaguggaucaccgacuuccccgguaagacagucugguuugugccuuccaucaagagcggcaaugacauugccaacugccugcgcaaaaacgggaagcgggugauccagcucucccgcaagacauucgacacagaauaccaaaagacgaagaacaaugacugggacuacgucgugaccaccgauaucagcgagaugggcgccaacuuccgggccgaucgcguuaucgacccgagacgcugccuaaaacccgucauccugaaagacgggcccgagcgggugauccuggcaggccccaugccggugaccguggccuccgcagcccagcgccguggaagaauaggcaggaaccacaacaaggagggagaucaguacauauacauggggcagccccugaacaacgacgaggaccaugcgcauuggacagaggccaagaugcugcuggacaacaucaacaccccggaggggaucauccccgccuuauuugagccggagagagagaagagcgcggccaucgacggggaguaccgccugcggggcgaggcgcgcaagaccuuuguggagcuuaugagacgcggcgaccugcccgucuggcugucguacaagguggccagcgagggguuucaauauagugaccggagauggugcuucgacggcgagcggaacaaccaggugcuggaggagaacauggacguagagauauggacgaaggaaggggagaggaaaaagcugcggccgcgcuggcuggacgcccggaccuacucggaccccuuggccuugcgcgaguuuaaggaguucgccgcgggccggcgcagcgucuccggcgaccugauacuggaaaucgggaagcuaccgcagcaccucacccagagggcccaaaacgcccuggacaaucucgugaugcuacauaacagcgagcagggcggucgagcuuacagacacgcgauggaggagcugccagauaccaucgagacgcucaugcuacuggcccucaucgccguguugacuggcgguguaacacuguuuuuccucuccggccgcggccuuggcaagaccagcauuggcuuacugugcguuauggcuucaagcguccugcuguggauggccuccgucgagccccacuggauugcagcuucgauuauccucgaguucuuccugauggugcuccucauccccgagccggaccgucagaggacgccccaggacaaucagcuagccuacgucguuaucgggcugcuauucaugauacuaacgguggccgccaacgagaugggcuuacucgagaccacgaagaaagacuuggggaucggccacguagcgguggagaaccaccaccacgccacaaugcuggauguggaccuccaucccgccucagccuggacgcuguacgcgguagcgacuaccaucaucacaccgaugaugcggcauacgaucgaaaacacaacggccaauaucucccuuaccgccauagccaaccaggccgcgauccucaugggccuggacaaaggguggcccaucuccaaaauggauaucggcgugccccuauuagcccuagggugcuacagccaggugaacccccugacgcucaccgccgccguccugauguuaguggcccacuacgccauaaucgggccggggcuccaggcuaaggccacuagagaagcucagaagcgcaccgcggccggcauuaugaagaaccccacgguggacggcauaguggccaucgacuuggacccggugguguacgaugcgaaguuugagaagcaacuggggcagaucaugcuccugauacugugcaccucucagauccucuuaaugcggaccaccugggcccugugcgagucaaucacacucgcuacgggcccacugacaaccuuaugggagggcagcccgggcaaguucuggaacacgaccaucgcggucagcauggcaaacauuuuccgcggcuccuaccucgccggggcuggccuggcguucucccugaugaagucccucgggggcgggcgucggggcacaggcgcccagggggagacccugggcgagaaguggaagcggcagcugaaucagcucagcaagucagaguucaacauuuauaagcgcagcggaaucauggagguggaucgaagcgaagcgaaggagggccugaagcgcggggagacgacccggcacgccgucucccgcgggaccgcuaagcugcgaugguucgucgagaggaaucugguaaaacccgagggcaaggugaucgaucucggaugcggacgcggaggguggagcuacuacugcgccggcuugaagaaggucacugaaguaaagggguacaccaaaggcgggccuggucacgaggagcccauuccgauggccacauacggguggaauuugguuaaacuucacuccgguaaggacguguucuucacgccccccgaaaaaugcgauaccuugcugugcgauaucggugagagcucucccaauccaacgaucgaggagggccgcacacuccggguucugaagaugguagagcccuggcugcggggcaaccaauucugcaucaagauuuuaaacccuuacaugccuagcguuguggagacgcuggagcagaugcagcggaagcaugggggcauguuagugcgcaacccguuguccaggaacucgacucacgagauguacugggucuccugcggcaccggcaauauuguguccgccguuaacaugaccucccgcaugcugcugaacagauucacgauggcccaccguaaacccacauacgagcgcgacgucgaccugggcgccgggacgcggcacguggccguggagccagaagucgccaaucuggacauuaucggccagcggauagagaacaucaaacaugagcacaagaguacguggcacuacgacgaggacaaccccuauaaaaccugggccuaucauggcuccuacgaggugaagcccagcggaucagccagcagcaugguuaacggggugguuaagcugcucaccaagcccugggacgucaucccgauggugacccagaucgcgaugacggacaccaccccguucggccagcaacgugucuucaaggagaaggucgacacacgcacgccuaaagcaaagcggggcacugcucagauaauggaggugaccgcccgcuggcugugggguuuccugucucggaacaagaagccccgcauuugcacccgggaggaguucacgaggaaggugcguucuaaugcagcaaucggcgccgucuuuguggacgaaaaccaauggaacagcgcaaaggaggccguggaggaugagcgcuucugggaccucguccagaaagagcgagaacugcauaaacaggggaaaugugcgaccugcguguacaacaugaugggaaagcgagagaagaagcugggggaauucggcaaggccaagggcagccgugccauuugguacauguggcucggagcucgcuucuuagaguucgaggcccugggcuuuaugaacgaagaccacugguucucucgggaaaacagccucuccgggguggagggcgaaggucugcauaagcuggguuacauauuacgcgacauuucgaaaaucccaggcgggaacauguacgcggacgacacggcuggcugggacacacguauaacggaggacgaccugcagaacgaggccaagauuacagauaucauggagccggagcacgcccuacuugccaccaguauauucaaacugacuuaccagaacaaggucguucgggugcaacgccccgcgaaaaacggaacaguuauggacgugaucucgcggagggaccagcggggaucuggccaaguggggaccuaugggcuaaacaccuucacuaacauggaggcucagcugauccgccagauggaaagcgaggggaucuucuuacccucggagcuggagacgcccaaccucgcggagcggguccuugauuggcuggagaaguacggcguggagcgccuaaagcgaauggcaaucagcggagacgacugcguugucaagccgaucgacgaccguuuugccacugcccugaccgcccucaacgacaugggcaaagugcggaaggacaucccccagugggagcccuccaagggcuggaacgacuggcagcagguccccuucugcucacaucacuuccaccaauuaaucaugaaggacggacgcgagauagucgugccaugccguaaucaggacgaguuggucggccgugcccgggucucccagggugccggcuggucacugcgcgagaccgcgugucucgggaagaguuacgcgcagauguggcagcugauguacuuucaccgucgcgaccugcggcuugccgcgaacgccaucugcuccgccgugcccgucgauuggguucccacuagcaggaccaccugguccauccacgcccaccaccaguggaugaccacggaggacaugcugagcguguggaaucggguuuggaucgaggagaaucccuggauggaggauaagacccaugucuccagcuggggugaugugccauaccugggcaaacgcgaagaccagugguguggcucccuuaucggcuugacagcccgcgcgaccugggcgucaaacauccagguggcgaucaaucaggucagacgccugaucgguaaugagaacuauuuggacuauaugaccuccaugaagcgguucaagaaugagggggaccccgagggggcccugugguga

SEQ ID NO: 24354 - RNA, 9879 nt, Artificial Sequence
  derived and/or modified CDS sequence (opt11) from DENV-1__FJ882570__SS-prME
agcgugaccaugcugcucaugcugaugcccaccgcccuggcguuccaccugacuacgcgggguggugaaccccacaugaucgugacaaagcaggagcgggggaaaagccugcucuucaagaccagcgccggcgucaacaugugcacccuuaucgccauggaccugggcgagcugugcgaggacaccaugaccuacaagugcccccggauuaccgaagccgagcccgacgacguugacugcugguguaaugccaccgacaccugggugaccuaugggacgugcagccagacgggcgagcaccggcgcgacaaacggagcguggcccuggcgccccacgugggccugggacuggagacccgcaccgagaccuggauguccagcgagggcgccuggaaacagauucagcgggucgagacgugggcccugcgccaccccggguucacggugaucgcccuauuucuggcgcacgccauuggcaccagcaucacccagaaggggaucaucuucauacuccugaugcuggugacgccuucuauggccaugcggugcguaggcaucggcucccgcgacuucguggagggucucaguggcgccaccuggguggacgucgugcuggagcacgggucgugcgugaccaccauggccaaggauaagcccacacuggacauugaguugcugaagaccgaggucaccaaccccgcugugcugcggaagcugugcaucgaggccaagaucaguaacacaacgaccgacucccgcugccccacucagggcgaagccacgcugauggaagagcaggacgccaacuucgugugucggcgcacguucgucgaccggggcugggggaacggcugcgggcuguucggcaaggguagccucaucacgugcgccaaguuuaagugcgugaccaagcucgagggcaagauuguacaguacgagaaccugaaguacucagugaucgugaccgugcacacgggcgaccagcaccaggucgggaacgagagcaccgagcacggcaccaccgcgacgaucacgccccaggcccccaccuccgagauucagcugaccgauuacggcgcccuaacccuggacugcucuccacgcacgggccucgacuucaacgagaugguccugcugaccaugaaggagaagagcuggcucguccacaaacagugguuccuggaucugccguuaccauggaccagcggggcuagcaccucccaggagaccuggaacaggcaggaccugcuagucaccuucaagaccgcccacgcgaagaaacaagaggucgucgugcucggcagccaggagggcgccaugcacacggcacugacgggggcgaccgagauccagaccuccggcacaacaaccaucuuugccgggcaccugaagugccgccucaagauggacaagcugacccugaagggcaugagcuacgugaugugcaccgguuccuuuaagcucgagaaggaggucgcagagacgcagcacggaaccgugcuggugcagauaaaguacgagggcacagacgcaccgugcaagauccccuucagcacccaggacgggaagggcguaacgcagaacgggcggcugaucaccgcuaacccgaucgugaccgacaaggagaagccaguaaacauagaggcugagccccccuucggcgaguccuacaucgucaucggcgcgggggagaaggcccugaaacucucuugguucaaaaagggcucuagcaucgggaagauguuugaggccacugcccgcggcgcccgucgcauggcgauccugggggacacggccugggacuuuggguccaucggcggaguuuucaccagcgugggcaagcugguccaccagaucuucgggaccgccuacggugugcucuuuuccggggugagcuggaccaugaagaucggcaucggcguccugcucacauggcucgggcugaacuccagaucaacgucacugagcaugaccuguaucgccguaggccucguaacccuguaccugggggucauggugcaagccgacuccggcugcgugaucaacuggaaggggagggagcucaaaugcggcagcggcaucuuuguuacaaacgaagugcacaccuggacagagcaauacaaguuucaggcugacucgccgaagagacuguccgccgccauaggcaaggcgugggaagaaggcguaugcggcaucaggagcgcaacacgacuggagaacaucauguggaagcagaucuccaacgagcucaaucacauccugcuugagaacggcaugaaguucacggugguggugggggacguagugggcauccucgcgcagggaaagaaaaugauccggccccaacccauggagcacaaguacagcuggaaguccuggggcaaggcuaagauaauaggcgccgacgugcagaacaccaccuucauaaucgacggcccaaacacaccggagugccccgacgaccaacgcgcuuggaauaucugggaggucgaagacuacggcuuuggcauauucaccacgaacaucuggcugaagcugcgggacucauacacacaagugugcgaccaccguuuaaugagugcggccauaaaggacagcaaggccgugcacgccgacaugggguauuggaucgaguccgagaaaaacgagacuuggaagcuggcccgggcaagcuucaucgaggucaagaccugcaucuggcccaagagccacacgcuguggagcaauggcguccucgaguccgaaaugaucauccccaaaaucuacgggggcccgaucagccagcauaacuaccgccccggguacuucacacagaccgccggccccuggcaccugggcaagcuggagcucgacuucgaccugugcgaaggcaccacggugguaguggacgagcacugcggcaaccggggaccgucccuacgaaccaccaccgugacgggcaaaaucauccacgaguggugcugccgaucgugcacccugccgccccuccgcuucaaaggggaggacggaugcugguacggcauggagauccggcccgucaaggagaaggaggagaaccucgugaaauccauggugagcgccgggagcggcgagguagacuccuucagccuggggcugcugugcaccucgaucaugaucgaggaggugaugcgcagccgguggucucgcaagaugcucaugaccgguacgcuugcgguguuccuacuccugaucaugggacagcucaccuggaacgacuuaauccggcuguguaucaugguuggcgcgaaugcgagcgaccguaugggaauggggaccaccuaccuggcguugauggccacguucaagaugcgcccgauguuugccgugggccuacuauuccggcgccucaccucccgggaaguacugcugcuuacuaucgggcugagccuggucgccuccguggagcuacccaauagccuggaggagcucggcgacggguuggcgauggggaucaugauucugaaacugcucaccgacuuccaaucccaccagcugugggccacucuucuuagccugaccuuuaucaagaccacacuuucccuccacuacgcuuggaagacgauggccaugguccugucaaucguuucccucuuuccgcucugcuuaagcaccaccucccaaaagaccacguggcugcccgugcuccugggcucucuggggugcaagccgcucaccauguuccugauagcggagaacaagaucuggggccggaaguccuggccccuaaaugagggaaucauggcgguagggguggugaguauuuuauugagcucccugcucaaaaacgacguaccccuggccggccccuugaucgccgggggcaugcucauagccuguuacgugauuucuggguccagcgcggaccugucccuugagaaggccgccgaagugucaugggaagaggaggccgagcacagcggcgccagccacaacaucuucguugaggugcaggacgacggcaccaugaaaaucaaggacgaagagcgagacgacacgcucaccauccugcugaaggcgacgcuccuggccguguccggcgucuacccgcugagcauccccgccacccucuucgugugguacuucuggcagaagaagaagcaacgcagcggcgugcuaugggacacuccaagcccgcccgagguugagcgggcugcgcuggacgacgggaucuaccgcaucaugcagcgggggcuguuggggcgaucccaggugggcgugggagucuuccaggagaacguauuucacaccauguggcacgugacccggggggcgguccugauguaccaggguaagcgccuggagcccagcugggccagcgugaagaaagaccucaucagcuacgggggaggguggcggcugcaggguagcuggaacacuggggaggaggugcaggucauagcuguggagccuggcaagaaccccaagaacgugcaaaccgcccccggcaccuucaagacgcccgaaggggaggucggggcuaucgcccuggacuuuaagcccgggaccagcggcucccccaucguuaaccgcgaaggcaagaucgugggacucuacggcaacggggucgucaccaccaguggcaccuaugucagcgcaaucgcccaggccaaggcuucgcaagaggggccgcugccugagaucgaagacgaggucuuccggaagcgcaaccugaccauaauggacuuacaccccggcagcggaaagacccggcgcuaucugccggccaucgugcgggaggccaucaagcgcaagcugcggacacucaucuuagcccccacgcgcguggucgccuccgagauggcggaagcccugaaggggaugcccauccgcuaccagaccaccgccguaaagagcgagcacacaggcaaggaaaucguggaccugaugugucacgccacguucaccaugcggcugcuuucacccguccgugugccuaacuacaacaugaucauaauggacgaggcucacuucacugacccguccucgaucgcggcccggggauacaucagcacccgcgugggcaugggcgaggccgccgccauauucaugacugcgacuccgccuggcuccgucgaggccuucccgcaguccaacgccgugauccaggacgaggagcgggacauccccgaacgcuccuggaacagcggcuacgaauggaucaccgacuuccccgggaagaccgugugguucguccccuccauuaagagcggcaacgacauugccaacugccuccgaaagaacgggaagcgcgugauccagcugucccggaagacguucgauaccgaauaccagaaaaccaagaacaacgacugggacuauguggugaccacggacaucagcgagaugggagcaaacuuccgagccgaccggguuaucgacccucgccgguguuugaagcccgugauccucaaagauggucccgagagagucaucuuagccgggcccaugcccgugaccguugccuccgccgcgcagcggcgcggccggaucggacggaaccacaacaaggaaggcgaucaguacauuuacaugggacagccccugaauaacgacgaggaccacgcccauuggacugaggcgaagaugcuccuggauaauaucaacacccccgagggcauaauccccgcccuguucgagccagagcgggaaaaaucggccgcgauugacggagaguaccgccucaggggcgaggccaggaagacguucguggagcucaugcgccggggcgaccugcccguguggcucuccuacaaggucgccuccgagggguuccaguacagcgaccgccggugguguuucgacggcgagcgcaacaaccaagugcuggaggaaaacauggacgucgagaucuggaccaaggaaggggagcggaaaaagcugcgcccccgguggcucgacgcccgcaccuacuccgacccguuggccuuacgagaauucaaggaguucgcggccggucgccggagcgucucuggugaccuuauccuggagauugggaagcugccgcagcaccucacucagcgcgcccagaacgcccuggauaaccugguaaugcuccacaauagcgaacagggcgggcgggcguaccgccacgccauggaagagcugcccgacaccaucgaaacccugaugcuacuggcucugaucgccgugcucacaggcggggucacccuguucuuccuguccggccggggccucgggaagaccagcaucggccugcugugcgugauggccucaagcgugcucuuauggauggccucagucgagccccacuggauugccgccucgaucaucuuggaguucuuccuaauggucuuguuaaucccagaacccgaccgccagcggacgccccaggacaaccagcucgcuuacguggugaucgggcuguuguucaucauccucaccguagccgcgaaugaaaugggacuacuggagaccaccaagaaggaccucgguaucggccauguugccgucgagaaucaccaccacgccacgaugcuggacguggaccugcaccccgccuccgcuuggaccuuauacgcuguggccaccaccaucaucaccccgaugaugcgccacaccauugagaauaccaccgccaacaucucauugacggcaaucgccaaucaggcugccauccugaugggccucgacaagggcuggcccaucuccaagauggacaucggcgucccccuguuagccuuagggugcuacagccaggugaacccccuaacccuuaccgccgcagugcucaugcugguggcccacuacgccaucauuggccccgggcugcaggcgaaggccacccgggaggcgcagaaacgcacugccgccggcaucaugaagaaccccaccguggauggcauaguggcgaucgaccucgaccccgucguguacgacgcaaaguucgaaaagcagcuggggcagaucaugcugcucaucuuaugcaccucccagauccugcucaugcgcacuacgugggcucugugcgagagcauuacccuggccaccggcccacucaccacacugugggagggguccccggguaaguucuggaacaccaccaucgccgucagcauggcuaauaucuucagaggcuccuaccuggccggggcgggacuggcuuuuucucugaugaagucccuagggggcgggcgccgggggaccggcgcgcagggggagacgcucggcgagaaauggaagcgccaguugaaccagcucuccaagagcgaauucaacauauauaagcggucagggaucauggaggucgaccguagcgaggccaaggagggccucaagcgcggcgagacaacccgccacgcggugucccggggcaccgccaaguuacgcugguucguggaaagaaaccuggucaagcccgagggcaaggugauugaucugggaugcggccgcgggggcuggucauacuacugcgcuggccucaagaaggugacggaggucaaggguuacaccaagggcgggcccggccacgaggagccaauuccuauggccaccuacggguggaaucuggugaagcugcacucugggaaggacguguuuuucacgccgcccgagaagugugacacgcuccugugugacaucggggaaagcagcccaaacccgaccaucgaggagggccggacccuccgcgugcuuaaaaugguggagccuuggcuucgggggaaccaguucugcaucaagauccugaaccccuacaugcccagcguggucgagacccucgagcagaugcaacgcaagcacgggggcaugcuggugcggaacccgcugucccgcaacagcacccacgagauguacuggguuuccugcgggacgggcaacaucgucucagccgugaacaugaccucccggaugcuccugaaucgcuucaccauggcgcaccgcaagcccaccuacgagcgggacguggaccuaggcgccgggacgcgucacguugcaguggagcccgagguggccaaccuugacaucaucggccagcggaucgaaaauaucaagcacgaacacaagagcaccuggcacuacgacgaggacaaccccuacaagaccugggccuaccacggguccuacgaggucaagccgagcgguuccgccagcagcauggugaauggggucgucaagcugcugaccaagcccugggacguaauccccauggucacgcagaucgccaugacagacaccacccccuucggucagcagcgcguauucaaggagaagguggacacgcggacgcccaaggccaagcgcggcaccgcacagauuauggaggucaccgcccgguggcucugggguuucuuaagccgcaacaagaagccccggaucuguacacgugaggaguuuacccggaaagugcgcaguaacgccgccaucggagccguguuuguagaugagaaccaguggaacuccgccaaggaggcagucgaggacgaacgguucugggaucuggugcagaaagagcgcgagcuccauaagcaggggaagugcgccaccugcgucuacaacaugaugggcaagagggagaagaagcugggggaguucggcaaggccaagggaagccgggccaucugguacauguggcucggggcccgauuccucgaguucgaggcgcugggcuucaugaacgaggaccauugguucucccgcgagaacagccugagcgggguggagggcgaagggcuccacaaguugggcuacauccugcgggacaucuccaagauacccgguggaaacauguacgccgacgacacugccggcugggacacgcgcaucaccgaggaugaccuccagaacgaggccaaaaucaccgacaucauggagccugaacacgcacuccuggcuaccuccaucuucaagcucacguaccaaaacaagguuguccgggugcaacgccccgccaagaacgggaccgugauggacgucaucuccaggcgggaccagagaggcuccgggcagguagggacguacggccugaacaccuucacgaacauggaggcccagcugauccggcagauggagagcgaggggauauuccuccccuccgagcuggaaacgcccaacuuggcggagcgcgugcucgacugguuagagaaguacggagucgagcgguuaaagcgaauggccauaagcggggacgauugugucgugaagcccaucgacgaccgguucgccaccgcgcucaccgcacugaacgauaugggcaaggugcguaaagacaucccucaaugggagcccuccaagggcuggaacgauuggcagcaggucccguucugcagucaccacuuucaccagcuuaucaugaaggacggacgggagauugucguacccugcaggaaccaggacgaacucguuggccgggcccgagugucccaaggggccggauggucucugcgagagacggcgugccuggguaagagcuacgcccagauguggcaguuaauguacuuccaccgucgggaccugcgacuggcggcaaacgcgauuuguuccgccguccccguggacugggugcccacuagccggaccacguggaguauucacgcccaucaccaguggaugacgaccgaagacaugcucagugucuggaaccgcguuuggaucgaggagaacccauggauggaggacaagacccacguguccaguuggggcgacguaccguacuugggcaagcgggaggaucaguggugcgggucccugaucggucuaacggcccgggccaccugggcgucuaacauccagguugccauuaaccagguucgccggcugauugggaaugagaacuaucuggauuauaugacaagcaugaagcgcuucaagaacgagggagacccugaaggugcgcucugguga

SEQ ID NO: 24355 - RNA, 9879 nt, Artificial Sequence
  derived and/or modified CDS sequence (opt11) from DENV-1__GQ199834__SS-prME
agcgugaccaugcugcucaugcugaugccuaccgcgcuggcauuccaucugaccaccagaggaggggaaccacacaugauugugaccaagcaagagcggggcaagagccugcuguucaagaccagcgcgggggugaacaugugcacccucaucgccauggacuugggcgagcugugcgaggacaccaugacuuacaagugcccccgaaucacggaagcagaacccgacgacguggacuguugguguaacgccaccgacaccugggucaccuaugggaccugcagccaaacgggugagcaccggcgcgauaaaagaucgguggcccuggcgccccacgugggccugggguuggaaacgcgcaccgaaaccuggaugucaagcgagggcgccuggaaacagauccagcgggucgagaccugggcccuacggcaccccggguucaccgugaucgcccuauuccuggcgcacgccaucggaaccuccauuacccagaaggggauuauuuucauccuccuaaugcuggugacucccucuauggcgaugcggugcgucgguaucggcagccgcgacuucguggaggggcucagcggcgccacuuggguggacgucguacuggagcacggguccugugugaccaccauggccaaggauaagcccacgcuggauaucgagcucuuaaagaccgaggugaccaaucccgccgugcugcggaagcucugcauagaggcuaagauaagcaacacgacaaccgacagccgcugccccacccagggcgaggccaccuuaauggaggagcaggacgcgaacuucgugugccggcgaacguucgucgaucgcggaugggguaacgguugcggauuguucggcaagggcagccucaucacuugugccaaauucaagugcgugaccaagcuggaaggcaagaucgugcaguacgagaaccuaaaguacucgguuaucgugaccguccacacuggcgaccagcaccaggucgggaacgagucaaccgaacacgggaccacagcgaccaucacgccccaagccccgaccuccgaaauccagcucaccgacuacggagcucugacucuagacuguagcccccgcacgggccucgacuucaacgagauggugcuccugacaaugaaggagaaguccuggcucgugcacaagcagugguuccuggaccugccgcuccccuggaccagcggggccucaacgucccaagagacguggaaucggcaggacuuacugguaacguucaagaccgcccacgccaagaagcaggagguggucgugcucggcagccaggagggagccaugcacaccgcccugacgggggccaccgaaauccaaaccuccggcacgacgacuaucuucgcagggcaccugaagugucgccucaagauggacaagcugacacugaagggcaugagcuacguuauguguaccgggagcuucaaacucgagaaagagcuggcggaaacgcaacacggcaccguccugguucagauaaaguacgaggguaccgacgcccccugcaagauccccuucagcacacaagacgagaagggggugacgcagaacggccggcugauuaccgccaacccgaucgucaccgacaaagagaaaccagugaauaucgaggccgagccucccuucggggagaguuacaucgugaucggcgcgggcgagaaggcccucaagcugagcugguucaagaagggguccucuauaggcaagauguucgaggccaccgcccgcggcgcccggcgcauggcgauccugggcgauacggcuugggacuucggguccaucggcggcgucuuuacaucgguugggaagcucguacaccagaucuucggcaccgccuauggggucuuauucuccggcgugucuuggaccaugaaaaucgguaucggcgugcuccucacguggcugggcuuaaacucccgcagcaccucccucagcaugaccugcaucgccguaggccuggugacccuuuaccugggcguaaugguccaggccgauucagggugcgucaucaacuggaagggccgugagcugaagugcgggucaggcaucuucguuacaaacgaggugcacaccuggaccgagcaguauaaguuccaggcagacagcccaaaacgccugucggcagccaucggcaaggccugggaggagggggucugcgggauccgcagcgcuaccagacucgagaacaucauguggaagcagaucuccaacgagcugaaucacauccugcucgaaaacgggaugaaauucaccguggucgugggcgauguggacgggauucuggcccagggcaagaagaugauccggccgcagccgauggagcacaaguacucuuggaaguccuggggcaaggccaagaucauuggggccgacguccagaauaccaccuucaucauagacggccccaacacuccggagugccccgaugaccagcgagccuggaacaucugggagguggaggacuacggguucgguaucuuuaccacgaacaucuggcugaaacuucgggacagcuacacccagguuugcgaccaccgccugauguccgcggcgaucaaagacagcaaggcuguccaugccgacaugggcuauuggaucgaauccgagaagaacgagacguggaagcuggcucgcgccagcuucaucgaggugaagacaugcaucuggcccaagagccauacgcuauggagcaacggggugcuggaguccgagaugaucauccccaaaaucuacggcgggccgaucagccaacacaacuaccgccccgguuacuucacucagacugccgggcccuggcaccugggaaaacuugaguuagacuucgacuugugcgaaggcaccaccgucgucguggacgagcacugcgggaaucguggcccgucccucaggacuaccaccgucacggggaaaauuauccacgagugguguugccggagcugcacccugccaccccugcgcuucaagggcgaggacgguugcugguacgggauggagauccggcccgugaaggagaaagaggagaaccucgugaagaguauggugagcgccggcucgggggaggucgacuccuucagccugggguugcucugcauuuccaucaugaucgaggaggugaugcgcagccgguggucucguaagaugcuaaugaccgggacucucgccgucuuccuucugcucaucaugggccagcucacguggaacgaccugauccggcuguguaucauggugggggccaacgcgagcgaccgcauggggaugggcaccaccuaccucgccuugauggccaccuucaagaugcgcccgauguucgccguggggcuacuauuccggcgcuugacgucccgggaaguccugcuccugacuaucgggcuuagucucguggccucuguggagcuucccaacaguuuagaggagcucggagacggucuggcgaugggcauuaugauccugaagcuacuuaccgauuuccagucacaccagcugugggccacccuucugagccugacguucaucaagaccacccucucccugcacuacgcauggaaaacuauggccaugguccugucgaucgugucucucuucccccugugucugagcacgacgucccagaagaccaccugguugcccguccugcuggggagccucggcugcaagccgcugacgauguuccugaucgcggagaacaagaucugggggcgcaagaguuggccguuaaacgagggcaucauggccgugggugucgucagcauccugcugagcucccuccugaaaaacgacgugcccuuggccgguccccucauugcgggcggaaugcugaucgccugcuacgucaucagcggcuccagcgcggaccugucccucgagaaggcugcugaggucagcugggaagaggaagccgaacacuccggggccagccacaacauccugguggaagugcaagaugacggcaccaugaagaucaaggacgaggaacgggaugacacccugaccauccuccugaaggcgaccuuacucgccgucuccgggguguacccgcucagcauccccgccacguuguuugugugguacuucuggcagaagaagaagcaaagaucuggcguccugugggacacucccagcccgccggaggucgaacgggccgugcucgaugacggcaucuaccgcaucaugcagcgggggcugcugggcagaucgcaagucgggguggggguguuccaggagaacguauuccacaccauguggcacgugacacgcggggccgugcucauguaccagggcaagcgccuggagcccagcugggcgagugucaagaaggaccugaucagcuauggcgggggauggcggcuccagggguccuggaacacgggggaggaggugcaagugauugccgucgagcccgggaagaaccccaagaacgugcagaccgcccccggcaccuucaagacccccgagggugaagugggggcuaucgcccuggacuucaagcccggcacguccgggagccccauagucaaccgcgagggcaagaucgugggccucuacgggaacggcguggucaccacaagcggcaccuacgugucugcgaucgcccaagccaaggcgucccaggaaggcccccuucccgagaucgaggacgagguauuccggaagcgcaaccuaacgaucauggaucugcaccccgggucaggcaagacccggcgauaccucccagcgaucgugcgggaagcgaucaagcggaagcugcggacgcugaucuuggcccccacgcgcgugguggcauccgagauggccgaggcgcuaaaaggcaugccaauccgauaccaaacgaccgcuguaaagagcgagcacaccgggaaggaaaucguggaccugaugugccacgccacguuuacgaugagacuccugucgcccguucgcgucccgaacuacaauaugaucaucauggacgaagcccauuucaccgacccaagcucuauagcagcgcggggcuacaucucaacccgcguggggaugggcgaggcugccgccaucuucaugaccgcgacgccgcccggguccguggaggcguucccgcaaagcaacgccgucauccaggacgaggagcgggauauccccgagagaucuuggaacagcggcuacgaguggaucaccgacuuccccggcaagaccgugugguuugugcccuccaucaagagcgggaacgacaucgcaaauugccugcggaagaacggcaagcgggucauucagcucucccggaagaccuucgacacggaguaccagaagaccaagaacaacgacugggacuacguugugaccacugacaucagcgagaugggugccaauuuccgcgcggaccgugucauagacccgagacggugucugaagcccgugaucuuaaaggaugggcccgaacgggugauccuagccgggcccaugccggucacggucgcguccgccgcccagcggcgugggcggaucgggcguaaccacaacaaggagggagaucaguauauuuacauggggcagccccuaaauaacgacgaggaccacgcgcacuggaccgaggccaagaugcugcucgacaacaucaacacccccgaggggaucauccccgcccuguuugagccggagcgggagaaauccgccgccaucgauggcgaguaccgccugcgcggggaggcgcggaagaccuucgucgagcucaugcgcaggggcgacuuacccgucuggcugucuuacaagguggccuccgaaggcuuccaguauagcgaccggcgauggugcuucgacggggagaggaacaaccagguccucgaagagaacauggacguggagaucuggacgaaggagggcgagcggaaaaagcugcgcccccgauggcuagacgcccgcaccuacuccgacccccucgcccugcgcgaguucaaggaguucgccgcggggcgccggagcgucaguggagaccugauccucgagaucggcaagcugccccagcaccugacccagcgcgcccagaacgcguuagacaaccuggucauguugcacaacagcgaacaaggcgggcgggcuuaccgccacgcgauggaggagcuccccgacaccaucgagacgcugaugcugcucgcccugauugcagugcugacgggaggggugacuuuguucuuccuguccgggcggggccuaggcaaaaccagcaucgggcuccugugcguaauggccuccuccguguugcucuggauggcuuccguggagccucacuggaucgcggccucgaucauccuggaguuuuuccugauggucuuacugauacccgagcccgaccgucagagaacgccgcaggacaaccaguuggccuacguggugaucggccuccuguucaugauccucacagucgccgccaacgagaugggacuccuggaaaccaccaagaaggaccugggcauugggcacguggccguugagaaccaccaccacgccaccaugcucgaugucgaccuacaccccgccuccgccuggacccuguacgcgguggcgaccacuaucaucacuccgaugaugcgccacacuaucgagaauacuaccgccaacaucagucugaccgccaucgccaaccaagcagcgauccugaugggcuuggacaaaggcuggcccauauccaagauggacauagggguuccucuccuggcguugggcugcuacagccaggucaacccacucacgcugaccgccgccgugcugaugcucguggcgcacuacgccauuaucgggccgggacugcaagcaaaggcaacccgggaggcccagaaacgcaccgcugccggaaucaugaagaaccccacggucgacggcaucguggccaucgaccuggaccccguggucuacgacgccaaguucgagaagcagcucgggcaaaucaugcugcugauccucugcaccucccagauccugcugaugcggaccaccugggccuuaugcgagagcaucacucuggcgaccgggcccuuaaccacacucugggaaggcuccccggggaaguucuggaacacgaccaucgccgugagcauggcgaacaucuuccggggcuccuaucuggcuggcgccgggcuggcguuuagccucaugaagucccugggcggaggccgucgggggacuggcgcccaaggcgaaacgcugggggagaaauggaaacgccagcugaaccaacuguccaagagcgaguucaacaucuacaaacggucgggcaucauggagguggaccgcagcgaggcuaaggagggacugaagcggggcgaaacgacccgccaugccguuucccgggggaccgcgaaacugcgcugguucguggaacgaaaccuggugaagcccgagggcaaggucaucgaccugggcugcgggaggggaggguggagcuauuauugcgcuggacuaaagaaggucacggaagugaagggguauaccaaaggcggacccgggcaugaggagcccaucccgauggcgacuuacggcuggaaucucgucaagcugcacagugggaaggacguguucuuuacgccgccugagaagugcgacacuuugcucugugacaucggcgagagcucccccaacccgacgauugaggaagggcggacgcuucgggugcugaagauggucgagcccuggcuccgggggaaccaguucugcauaaagauccugaaccccuacaugcccagcgugguagaaacccuggaacaaaugcagcgcaaacacggcgggaugcucguccggaauccgcugucccgcaacagcacccacgagauguacuggguguccuguggaaccgggaacaucguguccgccgucaacaugacgucccggaugcugcucaaccgauucaccauggcacaccguaagcccaccuacgagagggauguggaucugggcgcgggcacccgccacguggccguugagcccgagguggcgaaccuggacaucaucgggcagcggaucgagaacauuaagcacgagcacaagagcacguggcacuacgacgaggacaaccccuacaaaacuugggcauaccacggcuccuaugaggugaagccgagcggguccgccagcagcauggucaauggcguugucaagcuccucaccaagcccugggacguaauaccuauggugacccagaucgcgaugacggacacaacccccuucgggcagcagcgcgucuucaaggagaagguggacacccggacgccgaaagcgaagcgcggcaccgcacagaucauggaggugaccgcccgguggcugugggguuuccucucccgcaacaagaagccacggaucugcacccgcgaggaguuuacucggaagguccgcagcaacgccgcgaucggugcgguguucgucgacgagaaccaguggaacucagcgaaggaagccgucgaagacgaacgguuuugggaccuggugcagaaggagcgcgaguugcauaagcagggaaagugcgcaaccugcguguauaauaugauggggaagagagagaagaaguuaggagaguucgggaaggccaaaggcagccgcgccaucugguacauguggcugggcgcccgguucuuagaguucgaggcccucggguucaugaacgaggaccacugguucucccgggagaacucguuguccggugucgagggcgagggccugcacaagcucggguacauccugcgggacaucagcaagauccccggcggcaacauguacgcggacgacaccgccgggugggacaccagaaucacggaggacgaccuacagaacgaggccaagaucaccgacaucauggagccggagcacgcgcuccuggccacgaguaucuucaagcugaccuaccagaacaagguggugcggguccagcguccugcgaagaacggcacaguuauggacgugaucagccgcagggaccagcgcgggucgggccaggucggcacguaugggcucaauaccuuuaccaauauggaggcccagcugauccggcagauggagagcgaggggaucuuccuacccuccgaacucgaaacgcccaaccuggccgagagagugcuggacuggcucgaaaaguacgguguagagcggcugaaacgcauggcuaucucuggcgacgacugcgucgugaagccgaucgacgaucgguucgccaccgcgcugacagccuuaaacgacauggguaaagugcgcaaggacaucccccagugggaaccuucaaagggcuggaacgauuggcagcagguccccuucuguucucaucauuuucaccagcugaucaugaaggacggcagagagauuguggugccgugucgcaaccaggacgagcuggucgggcgggccagggugucccagggugcagguuggagccuccgugagaccgccugccugggcaagagcuaugcgcagauguggcagcugauguacuuucaccgccgggaccuacgacuggccgccaacgccauaugcuccgcggugcccgucgacugggugccgacgagccggacgaccugguccauccacgcccaccaucaauggaugacgacugaggacaugcugagcguguggaaucgugucuggaucgaggagaaccccuggauggaggacaagacucacguguccagcuggggagacgugccguaccuaggcaagcgugaagaccaauggugcgguucccugaucgggcucacggcccgcgccacuugggccagcaacauccaggucgcaaucaaccaagugcgccgguugaucggaaacgagaacuaccuggacuacaugacguccaugaagcgcuucaagaacgagggggaccccgagggcgcccuaugguga

SEQ ID NO: 24356 - RNA, 9879 nt, Artificial Sequence
  derived and/or modified CDS sequence (opt11) from DENV-1__GQ199835__SS-prME
agcgucaccaugcuguugaugcugaugccaacggcacuggccuuccaccucaccacccggggcggggagccccacaugaucgugacgaaacaggagcggggaaagagcuuacuguucaagaccagcgccgggguaaacaugugcacucucaucgccauggaccugggcgaacuuugugaagacaccaugacuuacaaguguccccggauuacagaagccgagcccgacgacguagacugcugguguaacgccacugacaccuggguaacuuaugggaccugcagccagacgggggagcaccgucgcgacaagcggaguguagcgcucgcgccccauguagggcucgggcuggagacccgaaccgagaccuggaugucaagcgagggcgccuggaagcaaauccagcgggucgagacgugggccuuacgccaccccggguucacugugauugcccuauuccucgcgcacgcgaucgggaccuccauuacccagaaggggaucaucuucauccuccugaugcuggugacgccuagcauggcgaugcggugugugggcaucggcucgcgcgacuucguggagggacucagcggggccacauggguggacgucgucuuagagcacggauccugugugaccaccauggccaaagacaagcccacgcuggacaucgagcuccugaagaccgaggucaccaaccccgcgguucugagaaaauugugcaucgaggcuaagaucagcaauacuacgaccgacucccguugucccacccagggcgaggcgacccugauggaggagcaggacgcuaacuucgucugccggcgcacuuucguagacagagggugggggaacggcugugggcuguucggcaaggggucccucaucacgugugccaaguucaaaugcguuaccaagcuggaggguaagaucgugcaguacgagaaccugaaguacuccgugauaguaaccgugcacacgggcgaucagcaccaggucgggaacgagagcacggagcacggcaccaccgcgaccaucacgccccaagcccccaccucugagauccagcucacagacuacggggcccugacccuggacugcagcccgcgcacgggacucgacuucaacgagaugguccugcuuaccaugaaggagaaguccuggcuuguccacaagcagugguuccucgaccuaccgcucccuuggaccaguggggcgucaaccucgcaggagacguggaaccggcaggaccugcuggucaccuucaaaaccgcccacgcaaagaaacaggagguggucgugcugggcagccaggagggagccaugcacacggcccugacgggggccaccgaaauccagaccuccggcacgaccaccauauuugccggucaucucaagugccgccugaagauggacaagcugacccugaagggcaugucauacgugaugugcaccgggagcuucaagcucgaaaaggaagucgcggagacccaacacggcacgguuuuggugcagaucaaguacgagggcaccgaugcuccaugcaaaauccccuucagcacccaggaugagaagggugucacgcaaaacggccgauugaucaccgccaacccgaucgugaccgacaaggagaagcccgugaacaucgaggccgagccccccuuuggcgaguccuacaucguaaucggcgcgggcgagaaggcguuaaaauuaagcugguucaagaaaggguccagcaucggcaagauguucgaggccaccgcccguggggcccggcgcauggcgauccugggcgacacagcaugggacuuugggucuaucggcggcguguucacgaguguagggaaguuaguccaccagaucuucggcaccgcguacggcgugcuguuuuccggcgugagcuggaccaugaagaucgggaucggcguccugcugacguggcucggccugaacucccgcucgaccucccugucuaugaccugcaucgccguugggcucgugacccuguaccugggggucauggugcaggccgacuccgguugcgucaucaacuggaagggccgggagcucaagugugggagcggcaucuucgucacgaacgaggugcacaccuggaccgaacaguacaaguuccaggcggacagcccaaagcgcuuauccgccgccaucggcaaggcgugggaggaagggguguguggcauucggagcgccacccgccuggagaacauaauguggaagcagauauccaacgagcuaaaccacauccugcuggagaacgacaugaaguucacggucguggugggggacguggugggcauccucgcccaagggaagaagaugauccggccccagcccauggaacacaaauacuccuggaaguccuggggcaaggccaagaucaucggcgccgaugugcaaaauacgaccuucaucauugacggucccaacaccccagagugccccgacgaccagcgcgcuuggaacaucugggaggucgaagauuacggcuucgggauauucaccacgaacaucuggcugaagcugcgggacagcuacacgcagguuugcgaccaccgcuuaauguccgcggcaaucaaggauucuaaggcagugcacgccgacaugggcuacuggaucgaauccgagaagaaugagacguggaagcuggcccgggcgaguuucaucgagguuaaaaccugcaucuggcccaagucccacacgcuguggagcaacggcguguuggaguccgagaugauuauccccaagaucuacgggggcccgaucagccagcauaacuaccgccccggguacuuuacccagaccgccggccccuggcaccuggggaagcuagagcucgacuucgaucugugcgagggcaccaccgugguaguugacgagcauugcggcaaccgggggccguccuuacgcaccaccaccgugacgggcaagaucauucacgaguggugcugccggaguugcacccuaccgccgcuccgcuuuaagggugaggacggcugcugguacgggauggagauccgacccgucaaggagaaggaggagaaccuugugaaguccauggugagcgccgggagcggcgagguagauuccuucagccucgggcugcuguguaucuccauuaugaucgaagagguaaugcgcagccgguggucccgcaagaugcucaugacgggcacccuagcaguguuccugcuucugaucauggggcagcugacguggaacgaccucauccgacuaugcauaauggucggcgccaaugcgagcgaccgcaugggaaugggcaccaccuaccugacccucauggccaccuucaagaugcgcccgauguuugccguugggcuguugcuccggcgccugacuucccgagaggugcugcuccugaccaucgggcuaagccucgucgcauccguggaauugccuaacagccuggaggagcucggcgacgggcuggccaugggaaucaugauucugaaacuccugacagacuuccagucccaccaacugugggcgacgcuccuaagccugaccuucaucaaaaccacgcucuccuugcauuaugcguggaagacaauggccaugguccuaagcaucgugucccuguucccacugugccugagcacaaccucccagaaaacgacguggcuccccgugcugcugggcagccucgggugcaagccucugaccauguucuuaauagccgaaaacaagaucuggggccgcaaguccuggccacucaacgaggguauaauggcggucggcguugugagcauccugcuguccucccuccucaagaaugacgucccccucgccgggccccugaucgccggcggcaugcugaucgccugcuacgugaucagcgggucgagcgccgaucuuucccucgaaaaagcggccgaggugagcugggaggaggaggcugaacacuccggcgccucucacaacauucuggucgaagugcaggacgacgggaccaugaagaucaaggacgaggaaagagaugacacguugacgauacuucugaaggccacgcugcucgcgguguccggcguauacccgcuuagcauccccgccacccuguuugugugguacuucuggcagaagaagaagcagcgcuccggagugcugugggauacccccagcccgccugaagucgagcgggcagugcuggacgacggcaucuaucgcaucaugcagcgcggccuccuagggcgcagccaggugggcgucgggguguuccaggaaaacguauuucacacgauguggcacgucacgcguggcgccgugcucauguaccaggggaagagacuggagccaagcugggccuccguaaagaaggaucugaucuccuacggcggcggguggcggcuccagggcuccuggaacaccggggaggagguccaggugaucgcgguggagccuggcaagaaucccaaaaacguacaaaccgcccccgggaccuucaaaacgcccgaaggcgaggugggcgccaucgcgcuagauuucaagcccgggaccagcggcucccccaucgugaaccgcgagggaaagauagucggccuguacggcaacgggguggugaccaccagcggcacguacgucagcgccaucgcgcaagcuaaagccucccaggaagggccacucccugagaucgaagacgaaguguuucggaagcgcaacuugaccaucauggaccugcaccccggauccggaaagacccggcgcuaccucccggcaauugugagggaggcgaucaagcgcaagcugcggacucugauccuagcccccacgcgcgucguugccucagagauggccgaggcucugaaaggcaugcccauacgcuaccagaccaccgcggucaagagcgagcacaccggcaaggagaucguggacuugaugugucacgcaacguucaccaugagacuccugucccccgugcgcguaccgaacuacaacaugaucauuauggacgaggcccacuucacagaccccagcagcaucgccgcccggggauauaucagcacccgcgucggcaugggggaggcggccgccaucuucaugacggccacaccccccggcuccguggaggccuuuccgcagagcaacgcagugauccaagacgaggagcgggacauccccgagcgcuccuggaacagcggguacgaguggaucaccgacuuccccggcaagaccgucugguucgugcccagcaucaagagcgggaacgacauagccaacugucugcgaaagaaugggaagcgagugauccagcucucccggaagacguucgacacagaauaccagaagaccaagaauaacgacugggacuacgucgugaccacggacaucagcgagaugggcgccaacuuccgcgccgaccgggucauagacccgcgccgaugucugaaaccggucauacugaaagacgggcccgagagggugauccuggcgggccccaugccggucaccguggccuccgccgcgcagcggcggggacggaucgggcgcaaccacaacaaggagggugaucaguauaucuauaugggacagccucugaacaaugaugaagaccacgcccauuggaccgaggcgaagaugcugcucgacaacaucaacaccccagagggaaucauacccgcccuguuugagccggagcgggaaaagucagccgccaucgacggggaguaccgccugcgcggcgaggcgcggaaaacguuuguggagcucaugcgccggggggaccugcccguuuggcuguccuacaagguggcgagcgagggcuuccaguacagcgaccgccgguggugcuucgacggugagcgaaacaaucaggugcucgaggagaacauggacgucgagaucuggacaaaggagggagagcggaagaagcugcgcccccgguggcuagacgccaggaccuacucagauccguuagcccugcgggaguucaaagaguucgcggcaggccgccggagcguguccggggaccugauccucgaaaucggcaaguuaccgcagcaccugacccagagagcgcagaacgcccucgacaaccuggucauguuacacaacucugagcagggcggacgcgccuaccgccaugcaauggaagagcuccccgacacgauugagacccugaugcuucucgcgcugaucgccguccugacgggcggugugacccucuucuuccuguccggacgggggcugggcaaaaccagcauuggccugcucugcguaauggcuuccucaguccugcucuggauggcguccguggagccccauuggaucgccgcaagcaucauccuagaguucuuccugaugguguugcugauccccgaaccggaccgccagcggacgccucaagacaaccagcuggcauauguggugaucgggcuccuguucaugauccugaccguggcggccaacgaaaugggccuccucgagaccaccaagaaggaccuggggaucggccacgucgcgguggagaaccaccaccacgcgaccaugcucgacgucgaccugcaucccgccuccgccuggaccuuauacgcuguagccacgacuaucaucacgccgaugaugcgccacaccauagagaacacaaccgcaaacaucagccucacggccaucgccaaccaggccgccauccucauggggcuggacaagggcuggccgauaagcaaaauggacauuggcgugccgcuccuggcguugggguguuauagccaggucaaccccuuaacgcugaccgccgcaguccugaugcucguagcccacuacgcaaucauaggcccugggcuccaggccaaggccaccagggaggcccagaagcgcacggccgcgggcauaaugaagaaccccacggucgacgggaucgucgcuaucgaccuggaucccgugguuuacgacgccaaauucgagaagcagcucggccagaucaugcuucugaucuuaugcaccucccagauucugcugaugcguaccaccugggcccuuugcgagagcaucaccuuagccacuggcccccugaccacgcucugggaggguuccccggguaaguuuuggaauaccaccauugccgucagcauggccaacaucuuccggggauccuaccuggccggcgcuggguuggccuucagccucaugaaguccuuggggggcgggcgccgagguaccggggcucagggcgagacgcugggcgagaaguggaagaggcagcucaaccagcuauccaagucagaguuuaacaucuauaagcgguccgggaucauggagguggaccgcagcgaggcuaaggagggccugaagagaggggaaaccacgcgacacgcaguaucccggggcaccgccaagcugagaugguucguggagcgcaaccuaguaaagcccgaggggaaggugaucgaccuaggguguggccgcgggggcuggagcuacuacugugcggggcuuaagaaggucacggaggugaagggguacacuaaggguggcccaggccaugaggaacccaucccgauggccaccuacggguggaaccucgugaagcugcacuccggcaaagaugucuucuuuacgccaccagagaagugcgacacgcugcucugcgacaucggggagaguucccccaacccgacgaucgaagagggacggacccugcgggugcugaagaugguggagcccuggcuccgggggaaccaguucugcauuaaaauccugaaccccuacaugcccagcgucguggagacccuggagcagaugcagcgaaaacacggcggaaugcuagucagaaacccgcuguccagaaacagcacccacgagauguacugggucuccugcgggacgggcaacaucguuagcgccgugaacaugaccagccggauguugcucaauagauucacaauggcgcaccgaaagccuaccuacgaacgcgacguugaucugggagccggcacgcgacacguggcgguggagcccgaagucgcgaaccuggauaucaucggccagcguaucgagaacaucaagcacgagcacaagagcaccuggcauuacgacgaggauaaccccuacaagaccugggccuaccacggguccuacgaggugaaaccaucugguuccgcgucaagcauggucaaugggguugugaaacuccugaccaagcccugggacguuauccccauggugacgcagaucgccaugacagauaccacgcccuucggccaacagcggguguucaaggagaaggucgacacgcggaccccgaaggcgaagcgcggcaccgcccagauuauggaggugaccgcccgguggcuguggggauuccucucccgcaacaagaagccccggaucugcacacgugaggaguucacccguaaggugcguagcaaugccgcuaucggcgcgguauucguugacgagaaccaguggaauucggccaaggaggccguggaggacgagcgguuuugggaccucguccagaaggagcgcgagcugcacaagcaggggaagugcgcgaccugcguauauaacaugaugggcaagcgggagaagaagcucggggaguucggaaaggcgaaggggagucgagccaucugguauauguggcuuggcgcaagauuccucgaguucgaagcccucggcuucaugaacgaggaccacugguucucacgggagaacagccuguccggcguggagggugaggggcugcacaaguuaggcuacauccugcgggacaucagcaagauacccgggggcaacauguacgccgaugacaccgcgggcugggacacgcggauuaccgaggacgaccugcagaaugaggcaaagaucaccgacaucauggagccugagcacgcccucuuagccaccuccaucuucaagcugacauaccagaacaaggucguccgggugcagcgccccgcaaagaacgggaccgucauggacgugauaagccgucgugaccagcgcggcucuggccaagugggaaccuacggccucaacaccuucacgaacauggaggcgcagcugauacggcagauggagagcgagggaaucuuccuccccuccgagcucgagacccccaaccuggccgagcgcguacuggauuggcucgagaaguacgguguggagaggcugaaacgcauggccauuagcggggacgacugcguggugaagccaauagaugacagauucgccaccgcccuaaccgcgcucaacgacaugggcaaggugaggaaagacaucccccagugggagccuuccaaaggauggaacgacuggcagcaaguccccuucugcagccaccacuuccaccagcucaucaugaaggacgggagagagauugucgugccgugccgcaaucaagacgagcuggugggccgggcccgcguaucccaaggugccggcuggagccuccgggagacggccugccugggcaagucuuacgcccaaauguggcagcugauguacuuccaccgccgggaucucaggcuagcggcaaacgcuauuugcuccgccgugcccguggacugggugcccaccagccggaccaccugguccauccacgcgcaccaccaguggaugacgaccgaggacaugcugucaguguggaaccgcguguggaucgaagagaaucccuggauggaggacaagacacacgucuccagcuggggcgacgucccguacuuggggaagagagaggaucaguggugcggcucccugaucggccugaccgcacgggccacgugggccagcaacauccagguggcuaucaaccaggugaggcggcucaucggcaacgagaacuaccuggacuacaugacguccaugaagcgcuucaaaaacgagggcgaccccgagggggcgcugugguga

SEQ ID NO: 24357 - RNA, 9879 nt, Artificial Sequence
  derived and/or modified CDS sequence (opt11) from DENV-1__FJ898386__SS-prME
ucugugaccaugcugcuaaugcugaugcccaccgcacuagcguuccaccugaccacccggggcggggagccucacaugauugugaccaagcaggagcgugggaaaagccugcuguucaagaccucggcgggugucaacauguguacacucaucgcuauggaucugggggagcugugcgaggacaccaugacauauaagugcccucggaucaccgaggcagagcccgacgauguugacugcuggugcaaugccaccgacacgugggucaccuacgggaccuguucucagacgggggagcauaggcgcgacaagcggagcguggcccucgcaccccacguuggucucggguuagagacccgcaccgagacauggaugucauccgagggggccuggaagcagauccagagaguggagacgugggcccuccggcaucccggguuuaccgugauugcccuuuuccuggcgcacgccaucgggacauccaucacccagaagggaaucaucuuuauucugcugaugcuggugacgcccucuauggccaugcguugcgucggcaucgguucccgcgacuuuguggagggguuaagcggcgccaccuggguggacgugguucuggagcauggaucgugugugacaaccauggccaaagacaagcccacgcuggacaucgagcuccugaagaccgaggucaccaaucccgcaguacuccggaaguuguguaucgaagcuaagaucucaaacaccacgacagacucccggugcccuacccagggugaggccaccuugauggaggaacaggacgccaauuucguuuguagacgcacguucgucgaccgggggugggggaacggcugcgggcuguuuggcaagggcucgcucauaacgugugcuaaguucaagugcguaacuaagcuggagggcaaaauagugcaguacgagaaccuuaaguacuccguuauuguaaccguucacacgggcgaccagcaucagguagggaacgagucuaccgagcacgguaccaccgcgacuaucacgccccaggcccccacaagugagauucaauuaacggacuacggcgcccugacccuggauuguagcccacgcacgggucucgacuucaacgagauggugcugcugacuaugaaagagaaauccuggcuaguucacaaacagugguuccuugaccuaccgcuccccuggacaucaggugccagcaccucccaagagacguggaaccgucaagacuuacuggugacauucaagaccgcacacgccaaaaagcaggagguggucgugcucggcucccaagaaggcgccaugcacaccgcccugaccggggcaaccgaaauccagaccuccggaaccaccacgauauuugcagggcaccugaagugccgccucaagauggacaaguuaacccugaagggcaugagcuacguuaugugcaccggguccuucaagcucgaaaaggaggucgccgaaacgcagcacggcaccguucuggugcagauaaaauaugagggcaccgacgcaccguguaagaucccauucagcacccaggaugagaagggggucacacagaacggccggcucaucaccgcgaaucccauagugacggacaaggagaagcccgucaacauagaggcggagccgccuuuuggagagucauauaucgucaucggcgcaggcgagaaggcccuuaagcugagcugguucaagaaaggguccagcaucggcaagauguucgaggccaccgcucggggcgcccgccgcauggcaauucugggagacaccgccugggacuucggauccaucggaggcguauucaccagcgucgggaagcuggugcaccagauauucggaaccgccuacgggguacuguucuccggcgugagcuggacgaugaagaucgggaucggcgugcugcugacguggcucggucuaaacucccgcucaacauccuugagcaugaccuguaucgccgugggccucgugacucuguaccuaggcgucaugguacaggcggauuccgggugcgugaucaacuggaagggccgggagcucaaaugcgggagugggaucuucgucacgaacgaggugcacaccuggaccgagcaguacaaguuucaagccgacuccccgaaacgccuuuccgccgccaucgguaaggccugggaggagggggucugcggaauccggagcgccacccgccuggagaacaucauguggaagcaaauuagcaacgagcucaaucacauccugcuggaaaaugacaugaaguucacugucguggugggcgacgucguuggcauccuagcgcaggggaagaagaugauucggccccaacccauggagcacaaguacagcuggaagucuuggggcaaggccaagaucauuggcgccgacgugcagaauacaaccuucauuaucgauggcccuaacaccccagagugccccgacgaccaacgagcauggaacaucugggagguagaggacuacggcuuugggauauucaccacuaacaucugguugaagcugcgggacagcuauacccaggucugcgaucaccgccuuauguccgcggcuaucaaggacucgaaggccgugcacgcggacaugggauacuggaucgaguccgagaagaacgagacauggaaacuggcccgggcuucauucaucgaagucaagaccugcaucuggccgaaaagucacacauuauggucaaacgggguguuggagucugagaugaucauaccgaagaucuauggcggcccgauaagccaacacaacuaccgacccggauacuucacccagaccgcgggucccuggcaucucgggaaacuggaacucgauuucgaccuuugcgaggggaccacgguggucguugacgagcauugcgguaaccggggcccguccuuacgcaccaccaccgugacgggcaaaauaauccacgaguggugcugccggaguugcacccugccgccccuccgcuucaaaggggaggacggcugcugguaugguauggagauccgacccgucaaggagaaggaagagaaccuggugaaguccauggugagcgccggcagcggggaagucgauucauucagccuugggcuguugugcaucuccauaaugaucgaggaggugaugagaagccgauggucccguaagaugcucaugaccgguacucuggcuguguuccuacuccugaucauggggcagcugacguggaacgaucugauccgguuauguaucauggugggcgccaacgccucagacaggauggggaugggcaccacauacuuggcacuuauggccacauucaagaugagaccgauguucgcagugggccugcuguuccggcgccucaccuccagggagguccugcuacuaacaauagggcugagccugguggccuccguggagcuccccaauagccucgaggagcuuggugacgggcuagcaaugggcaucaugauccugaaacuguugaccgauuuccagucccaccagcugugggcgacuuuacucagccuaacguucaucaagacaaccuuguccuugcauuacgccuggaagaccauggcuaugguacugagcaucgugucccuguucccgcucugccugagcaccaccucccagaaaaccaccuggcugcccguguugcugggcucucuggggugcaagccgcuaacgauguucuugaucgcggaaaacaagauuuggggccgcaaguccuggccccuuaacgaggguaucauggccgucggugugguaucaaucuuacugaguuccuugcuaaagaacgacgucccccuggccgggcccuugaucgccggaggcaugcucauagcguguuacgugauuagcggguccucggcggacuugucucuugaaaaagccgcagaggucagcugggaggaggaagccgaacacuccggcgccagccacaacauacucgucgagguucaggacgacgggacuaugaagaucaaagacgaggagcgggacgacacccuaaccauccugcucaaggcaacgcuguuggccgugagcggggucuacccccucagcauucccgccacguuguucgucugguacuucuggcagaagaagaagcagcgcagcggggugcugugggacacccccucuccgccggaggucgagcgagcgguccuggaugacgggauuuaucgcaucaugcagcggggccuccuggggagaucccaggugggcgucgguguuuuucaggagaaugucuuccacacgauguggcacgucacccguggcgccgugcugauguaccaggggaagcgccucgaacccagcugggcguccgucaaaaaggaccugaucagcuacggcgguggauggcgucugcaggggagcuggaacacgggggaggaaguccaggugauagccguugagcccgguaagaauccgaagaauguccagaccgcccccgggacauucaagacaccggagggagaggugggcgccauugcacucgacuucaagcccgggaccagcggcucccccaucgucaaccgcgaggggaagaucgucggccuguauggcaacgggguagugaccacgucaggcaccuacgucucagccaucgcccaggccaaagccagccaggaagggccgcugccagagauagaggacgagguauuucggaagcgcaaucucacgauuauggaccugcaccccggcagcggaaagacccgaagauacuuacccgcgaucgugcgggaggccauuaaacgcaagcucagaacccugauccuggcacccaccagggugguggccucggaaauggccgaggcucucaagggcaugcccauccgauaucagacgaccgccgucaagagcgaacacaccggcaaagagauugucgaccugaugugccacgcuaccuucacgaugcggcugcuauccccggugcgcgugccgaauuacaacaugauaaucauggacgaggcccacuuuaccgaccccucuuccaucgccgcucgggguuacaucucuacgagagugggaaugggagaggccgccgccaucuuuaugaccgccacaccgcccggguccguggaggccuuuccucagagcaacgcugugauccaggacgaggagcgggacauccccgaacgguccuggaacucgggguaugaguggauuacagauuuucccgguaagaccgucugguucguacccuccaucaagagcgguaacgacaucgccaacugucugcggaagaacggcaaacgagugauccagcugucgcggaagacauucgacacagaguaucagaagaccaagaacaacgauugggacuacgucgugacuaccgacaucucagagaugggcgccaacuuuagggcggaucgcgugaucgacccaagacggugccucaaacccguaauccugaaggaugggccggagcgugugauccuggcgggccccaugccggucacgguggccagugccgcccagcgacgcgggcgaauuggccgcaaucacaacaaggagggcgaccaguacaucuauauggggcagccccucaauaacgacgaggaccacgcgcacuggacggaggccaagaugcuacucgacaacaucaauacccccgaaggcaucauccccgcccucuucgagccugaaagggaaaaguccgccgcaaucgacggggaguacaggcugcgcggagaagcgagaaagaccuucguggaacuaaugcgccgcggugaccuccccguuugguuauccuacaagguggccucggagggcuuccaguacagcgacaggcgguggugcuucgacggugaacguaacaaccaaguguuagaagaaaacauggaugucgagauauggacgaaggagggggagcggaagaagcuccgcccuaggugguuagacgcccgaaccuacucggacccccucgcucuccgggaguucaaggaauucgccgcgggacgacggagcguguccggggaucugauccuggaaaucggcaagcugccccagcaucugacccagagagcacaaaaugcgcuggacaaccucgugauguugcauaacagcgagcaaggagguagagccuaccgccacgcgauggaggagcugcccgauaccaucgagacacucaugcugcuggcccucauugccguccugacgggcgggguuacacuguucuuccuaaguggucggggacugggcaagacaucgaucggccugcucugugucauggccuccagcguuuuacuguggauggcaagcguggagccccauuggaucgcggcgagcaucauccucgaguucuuccugaugguguuacugauccccgagccggaccgccagcggacgccucaggacaaccagcuggcauacgucgugauugggcuccucuuuaugauccuaacgguggccgccaacgagaugggccugcucgaaaccacgaagaaggaccugggaauuggccauguggcgguugagaaccaccaccacgccaccaugcuggauguggaccuccacccagccucagccuggacguuguacgcuguggcgaccacgauuaucacaccaaugaugcgucauacgaucgagaacacaaccgccaauaucagccugaccgccaucgcgaaucaggcagcgauccucaugggccuggacaagggguggccgaucuccaaaauggacaucgggguaccgcugcucgcccugggcugcuacagccaggugaacccgcugacgcucaccgccgccguucugaugcucguggcgcacuacgccauaaucgggcccgggcuccaagccaaggcuacccgcgaggcccagaagcgcacugccgccgguaucaugaagaaucccacgguggacggaauuguggccauugaccucgacccagucguauaugacgccaaguucgagaagcagcuaggccagaucaugcuccugauccuuugcaccucacagauccuccuaaugcgcacuaccugggcccucugugagucgaucacguuagcgaccggcccccuuaccacccugugggagggguccccggggaaguucuggaacacgacuauagccgucagcauggccaacaucuuucggggauccuaccucgcuggggcaggccuggcguucucgcugaugaagucccucggaggagggcguagaggcaccggggcccaaggagaaacacuaggugaaaaauggaagcggcagcugaaucaauuauccaagagugaguucaacaucuacaagagauccgggaucauggaaguggaccgcagcgaggcuaaggagggccugaagaggggugagacgaccagacacgccgugucacggggcacggcgaagcugaggugguucgucgaacggaaucuggugaaacccgaggggaaagugaucgaccucggcugcggcagaggagguuggagcuacuacugcgcagggcugaagaaggucacagaggugaagggcuacacgaagggcggacccgggcacgaggaacccaucccgauggccaccuacggauggaacuugguaaagcuccacuccggcaaggacguuuucuucacgccgcccgagaagugcgacacccuguuaugcgacaucggugagagcucgcccaaccccacaaucgaggaggggcgaacccuccgcguauuaaagauggucgagcccuggcugcgcgggaaccaguucugcaucaaaaucuugaacccguacaugcccagugucguagagacccuagagcaaaugcaacgcaaacacggcggcaugcuggugcggaacccgcucucgcggaauaguacccacgagauguacugggucagcuguggcaccggcaacauagugagcgcggugaacaugacaucacggaugcuguuaaaucgcuucacaauggcccaccgcaaaccuacguacgaaagagacguagaccucggggccggcacccgacacguggcuguggagcccgaggucgccaaccuggacaucaucggccagaggaucgagaacaucaagcacgagcauaagagcacguggcacuacgaugaggacaaccccuacaagacgugggccuaccaugguuccuacgaagugaagccgucuggcucggcuaguucgauggugaaugggguggugaagcugcucaccaagcccugggacgucauaccaauggugacccagaucgcaaugacugacacaaccccauucggucaacagcgcguguucaaagagaagguagacacacguacaccgaaggccaagcgcggaaccgcccagaucauggaggugaccgcucgguggcuguggggcuucuugucucgcaacaagaagccccggaucugcacccgcgaggaguucacgcggaagguacgcucaaacgcggcgauuggcgccgucuucguggacgaaaaccaauggaacagcgccaaggaggcgguagaagacgagcgguucugggaccucguccaaaaggagcgcgagcugcacaaacaggggaagugcgcgaccugcguguacaacaugaugggcaagagggaaaagaaacugggggaguuuggcaaagcaaaggggagccgcgcuauuugguauauguggcucggcgcccguuuccuggaguucgaggcgcuuggcuucaugaaugaagaucacugguucagucgcgagaacaguuuaagugggguagaaggcgaggggcugcacaagcucggcuacauccugcgggacauuagcaagaucccgggaggcaacauguacgcggacgacacagcaggaugggacaccaggaucacggaagaugaccugcagaacgaggcuaaaaucaccgacaucauggaaccugagcaugcgcugcuggccaccuccaucuuuaagcugaccuaucagaacaaggucgugcggguccagcgcccugcgaagaacgggacgguaauggacgugauuucacgccgggaccagcgcggcuccggccagguggggacguauggccuuaacaccuuuaccaacauggaggcccagcucauccggcagauggagucggaggggauauuccugcccuccgaguuagagacgccgaaccuugccgaacgcguacuagacuggcuggagaaauacggaguggagaggcucaagaggauggccaucagcggggacgacugcgugguaaagccgaucgacgaccgauucgcuaccgcgcugacagccuuaaacgacaugggcaaagugcgcaaagauaucccccagugggagcccuccaagggguggaaugacuggcagcaaguccccuucugcucucaccacuuccaccagcucaucaugaaggacggccgggagaucgucgugccgugccgcaaccaagacgagcuggugggccgugcucgugucucccaaggggcuggauggagccuccgggagaccgccugccugggcaaaagcuacgcccagauguggcagcuaauguauuuucaccgccgcgaccuuaggcucgccgccaacgccaucugcucagcugugccagucgacuggguccccacgagcagaaccaccuggucuauccacgcccaccaucaguggaugacgacggaagacaugcugagcgucuggaaccgcguguggaucgaggagaaccccuggauggaggacaagacccacgucuccucaugggaggacgugccguaccuuggcaagcgggaggaccaguggugcgggucccuaaucggccugacugcacgcgcaaccugggcuucuaauauccagguggcgaucaaccagguccgaagacugauagggaacgagaauuaccuugacuacaugacauccaugaaacguuuuaagaacgaaggggacccugagggcgccuucugguga

SEQ ID NO: 24358 - RNA, 9879 nt, Artificial Sequence
  derived and/or modified CDS sequence (opt11) from DENV-1__FJ898387__SS-prME
agcgugaccaugcuucucaugcugaugccuaccgcccucgcuuuccaccucacaacccgcggcggggagccucacaugaucgugucaaagcaggaacgggguaaaagccugcuguucaagaccagcgccggggugaauaugugcacucugauagcuauggaccucggcgaguucugcgaggacacgaugaccuauaaguguccccgcauaaccgaggccgagcccgacgacguggacugcuggugcaacgcaacugacacuuggguuaccuacgguaccugcagccagaccggugagcacagaagggacaagcgguccguggcccuggcgccccacguaggccucgggcuugagacgcgcaccgagaccuggaugagcuccgaaggcgccuggaagcagauccagagaguggagacgugggcccugcgccaucccggguucacagugauugcacuauuccuggcgcaugcuaucgguaccagcaucacacagaaggggaucauauucauccugcuaaugcugguaacacccuccauggccaugcggugcgucgguaucggaagccgcgacuucguggaaggccuuucaggggccacuuggguggacgucgugcucgagcauggaagcugugucaccacaauggcgaaggacaagcccacgcuugacaucgagcuucuuaagacggaagucaccaaccccgcggugcugcggaaacugugcaucgaggcaaagaucucgaauaccacaacggauagccgcugcccgacccaaggcgaagccacccugguagaggaacaggacgccaacuucgugugucggcgcaccuucguggaccgcgggugggggaacggcugcggacuauucggcaaggggucccugauaacaugugccaaguucaaaugcgugaccaagcucgaggguaaaacuguccaguacgaaaaucugaaguauucggugauagugaccguccauacgggugaccaacaccagguuggaaacgaguccaccgagcacggcaccacagccacuaucacgccccaggcgcccagcaccgaaauccaguuaacugacuacggagcccuuacccuggacugcagcccccguacgggccuggacuucaacgagaugguccuguugaccaugaaggagaagaguuggcuggugcauaagcagugguuccucgaccucccgcuacccuggacaagcggggccagcacgagccaggagacauggaacagaaaggaccuucuggugaccuucaagaccgcgcacgcaaaaaagcaggaagugguggugcucggcucccaagaaggcgccaugcacaccgcacucacaggggcuacggagauccaaaccuccgguacuacuaccauauucgcugggcacuugaagugccgccugaagauggacaagcucacccugaagggcauguccuacgugauguguacgggaagcuuuaaauuagaaaaagagguggcggagacccagcacggaaccgugcucguccagauuaaguacgaaggcaccgaugcccccugcaagauccccuucucgacccaggacgagaaaggagugacccagaacggacggcugaucaccgccaacccuaucgugaccgacaaggaaaagcccgucaacaucgaggccgagccgccguucggcgagagcuacauagugaucggcgcgggcgagaaggccuugaaguuguccugguucaagaaagggucauccaucgggaaaauguucgaagcgaccgcccguggggcaagacgcauggcuauccuaggugauacugcaugggacuucggcucuaucggcgguguuuucaccuccguggggaaacuggugcaccaaaucuuuggcacggccuacgggguacuguucagcggcgucagcuggacuaugaagaucgggauuggcguucuccugacuugguuaggccucaacagccguuccacaagcuuauccaugacuugcaucgccguggggcuggugacauuauaccugggggugauggugcaagcggacaguggaugcgugaucaacuggaagggccgggaacuuaagugcgguucgggcauuuuugugacgaacgagguccacaccuggaccgaacaguacaaauuccaagccgacagccccaagcgucucagcgccgccaucgguaaagcgugggaggagggugugugcgggauccgguccgcaacccgccuggagaacaucauguggaagcagaucagcaaugaacugaaccauauucucuuggagaacgauaugaaguucaccgugguugucggcgacguggcugggauccuugcccaggggaagaagaugauuagaccucagccgauggaauacaaauacucuuggaaaucgugggguaaagccaaaauaaucggugccgacgugcaaaacacuaccuuuauaaucgacgggccaaacaccccggaaugucccgacgaccagagggcauggaauauaugggaggucgaggacuaugguuucgggaucuucaccacgaauauuuggcugaagcugcgggacuccuacacgcaggucugcgaccaccggcugaugagcgccgccaucaaggacuccaaggccgugcaugcugacaugggcuauuggaucgaauccgagaaaaaugagaccuggaagcucgcgcgggcuagcuucaucgaagucaaaaccugcaucuggccaaagagucacacgcuguggucgaacggcguacuggagagcgaaaugauuauaccaaagaucuacgggggcccgaucagccaacauaacuaccgcccggguuacuucacccagaccgcgggcccguggcacuuagguaagcuagagcuggacuucgaccugugugagggcacaacggugguuguugacgagcauuguggcaaccgcggacccucccugagaaccaccaccgugacgggcaagauaauacacgagugguguugccggagcugcaccuuaccgccacugagauucaagggggaggacggcugcugguacgggauggagauacggcccguaaaggaaaaggaggagaaucuggucaagagcaugguaagugcgggcuccggcgagguagacucguucucccugggguugcucugcauuagcaucaugaucgaggagguuaugcgcucccgguggagccggaagaugcugaugaccggcacgcucgccguguucuuccugcucaucaugggucaauugacguggaacgaccugauccggcugugcaucauggucggcgcgaacgccagcgaucgcauggggaugggaacaaccuaccucgcccuaauggcaacguuuaagaugcgucccauguucgccgugggucuccuguuccgucgccuuacaagccgggagguacuccuccugaccaucggucucucucuuguagcgagcguagagcuucccaauuccuuagaggagcucggggacgggcuggccaugggcaucaugauucugaaacuccuuacggacuuccagagccaccagcucugggcuacccuccuaucgcuuacguucaucaaaaccacuuucucccuccauuacgccuggaagaccauggcgauggugcuauccauuguaagccucuucccacucugucucaguacgacgagccagaagacaaccuggcugcccgugcuccucggcucgcuuggcuguaagccguuaacgauguuccugauagccgagaacaagaucuggggcaggaagucguggccccugaacgagggaauaauggccgucggcauugugucgauacuucugaguucacugcucaagaaugacgugccccuggcagguccucugauagccggcgguaugcuuauugcgugcuacgucaucuccggaagcagugcugaccuaagccuggagaaagccgccgaggugaguugggaagaggaggcugaacacuccggugccagccauaauauccucguggagguccaggaugaugggacgaugaagauuaaagacgaagagcgggaugacacccugaccauacugcucaaagccacucugcuggcugucagcggcgucuacccccuuucuauccccgcaacgcuuuucgucugguacuucuggcagaagaagaaacagcgaagcggggugcugugggauacgccaagcccgccugaagucgagcgggccguccuagacgauggaauuuaccgcaucaugcagcggggcuuacugggacggagccagguggguguggggguguuccaagaaaacguguuccauacgauguggcacgugacccggggagcgguguugauguaucagggcaagagacucgagcccuccugggcgucaguuaagaaggaucugaucuccuacggcggcggauggagacugcaggggagcuggaacacaggggaagaagugcaggucaucgccguggagcccggcaagaaucccaagaacguccagaccgccccugggaccuucaagaccucggagggcgaggucggggcaaucgcucuggacuucaaacccgggacgagcgggagcccaaucgugaaccgggagggcaagaucguggggcuguacgguaacgguguugugaccaccuccggaaccuaugugagcgccaucgcacaggccaaggcgucccaggaaggaccccuaccugagaucgaggacgagguauuccggaagcgcaaccuuacgauuauggaccuucaccccgggagcggaaagacacggcgcuaccugcccgcuaucgucagggaggcaauaaaaaggaaauuacgaacccugaucuuggcccccacccgggugguggccuccgagauggcggaagcacuaaagggaaugcccauucgauaccaaacuaccgccgucaagagcgagcacaccggcaaggagaucguagaucugaugugccacgcuacuuucacuaugcggcuccucucccccgucaggguacccaacuacaacaugaucauuauggacgaggcccacuucaccgacccaagcuccaucgcugcccgaggguacaucaguacccgcguggggaugggagaggccgccgcgaucuucaugacggcaacgccgccuggcuccgucgaggcauucccccaaagcaacgccgugauacaagaugaggagcgggacaucccggagcguucguggaacuccggauaugaguggaucaccgacuuccccgguaagacugugugguucguaccauccaucaaguccggcaacgacaucgccaacugucugcggaagaacgggaaacggguuauucagcugucccgcaagaccuuugauacggaauaccagaagacuaagaacaacgacugggacuacguggucacuaccgauaucagcgaaaugggagcgaauuuccgcgccgaccgggugauagauccgagacgcugcuugaaacccgugauccugaaggacggccccgaaagggucauacuggccgguccuaugcccguaaccguagccucggcugcgcagcggcgcgggaggaucggccgcaaccacaacaaggagggagaccaguacaucuauaugggccaacccuugaacaaugacgaggaccaugcccauuggacagaggcuaagaugcuucuugacaacaucaacacgccggagggcauaauccccgcucucuucgagccggagcgagagaaguccgccgcuaucgacggggaguauaggcuucgcggugaggccagaaaaaccuucguggaacugaugcgccgcggggaccucccgguguggcucucguacaagguugcgagugagggguuucaguacucggaccgcagguggugcuuugacggcgaacgcaacaaccaaguacuggaagagaauauggacguggagauuuggacgaaggagggggagcguaagaagcucaggccgcgcuggcuggaugcccgcaccuauuccgauccacuggcacuccgggaauucaaagaauucgcggccggccgccgcucagucuccggggaccugauucuggagaucggaaaacugccacagcaccugacgcagcgggcucagaacgcccuagacaaucuagugaugcuucauaacagcgagcaaggagggagagccuaccgccacgcgauggaggagcucccugauaccaucgagacucucaugcuucuggcccucaucgccguacugaccggggguguuaccuuguucuuccucaguggccgggggcugggcaaaaccagcaucggccugcucugcgucauggcgucaucagugcuucuguggauggcuuccgucgagccccacuggaucgccgccagcaucauccuggaauuuuuccucaugguccugcucauccccgagccugaccgucaacgcacuccgcaagacaaccaacuggccuacgucgucaucggacuacucuucaugauccucacuguggccgcgaacgagaugggccuacucgagaccacuaaaaaagaccuggggauaggucacguugccguggagaaccaccaccacgcggccaugcuggaugucgaccuccaccccgccucagcguggacguuauacgccguugccacgaccaucaucacccccaugaugcgccacaccaucgagaacaccacagccaacauaagcuugaccgcgaucgcgaaccaggccgccauucucauggggcuggauaaaggauggccgaucagcaagauggauaucggcgucccccugcucgcccugggguguuauucucaaguaaacccccuuacgcucacggcggccguccuaaugcuugucgcgcacuaugcuaucauaggccccggccuacaggccaaggcgacccgugaggcccagaaacggaccgccgccggaaucaugaaaaacccgacgguagaugggauaguagccauagaccuggaccccguuguuuacgacacgaaauucgagaagcagcugggacagauaauguuguuaauccuaugcaccucccagauccuccucaugcgaaccacaugggcgcuaugcgaaagcauuacgcucgcuaccggcccccugaccacucucugggaaggaucacccgggaaauucuggaacacuaccauagccguguccauggcgaacauauuuagggggagcuaccuugcuggcgcuggccuggcguucucccugaugaaaucccugggcgguggucgccggggcaccggggcccaaggugagacccugggcgagaaguggaaacgccagcugaaucaguugaguaagagcgaauuuaacacguacaagcgguccggaaucauggaggucgaccgcagcgaagcgaaagaaggacugaagcgcggggaaacuacgaaacacgcggugucccgaggcacugcaaagcugcgaugguucguggagcgcaaccucgucaagccggaggggaaggucauagaccugggaugcggccgcggcggguggagcuacuauugcgccgggcugaagaaggugaccgaggucaagggcuacacgaaaggcgggcccgggcaugaagagcccaucccgauggccacauacggguggaaucuaguuaagcuucauuccgggaaggauguuuucuucauaccuccugagaagugcgacacgcuccuaugugauaucggggagagcucccccaacccgacgauagaggagggccgcacccuucguguccugaaaaugguggaaccauggcugagggggaaccaguucugcaucaagauccucaauccguauaugccaagcgucgucgaaacuuuagagcaaaugcagcgcaaacauggcggcaugcucgugcgcaaccccuuaagucggaauagcacgcacgagauguauuggguauccugcgggaccggaaauaucgucagcgcugugaauaugaccucccgcaugcugcugaacagguuuaccauggcgcauaggaagccuaccuacgagcgagacguggaucuaggagccggcacccgacacgucgcuguggagcccgaaguagccaaccuggauauuaucggccagcgcauagagaacaucaagcacgaacacaagucuacguggcacuaugaugaggacaaccccuacaagaccugggccuaccauggcuccuacgagguaaaacccagcggcucagcgagcagcaugguaaacgguguagucaaacuccucaccaaaccaugggauguaauccccauggucacccagaucgccaugacggacaccaccccuuucggccagcaacgggucuucaaggagaagguggauacccggacuccaaaggccaagcggggcaccgcccagaucauggaggucacagccaaauggcucuggggcuucuuaagucgcaacaagaaaccucggaucugcacccgugaagaauucacaagaaaggugcgcuccaacgcggccaucggagccguauucgucgacgagaaucaguggaacuccgccaaggaggcuguggaggaugaacgcuucugggaccucgugcaucgcgagcgggaguugcacaagcaagggaagugcgcgaccugcguauacaacaugauggguaagcgcgagaagaaauuaggggaguucggcaaggccaaggguagcagggccaucugguacauguggcucggcgcucgauuccuggaauuugaggcacuaggauucaugaaugaggaccauugguucagccgugagaacagccucuccggggucgagggggaagggcugcacaagcugggcuacauccuccgcgauaucagcaagauuccgggcggcaacauguaugcggaugacaccgccggcugggauacgcggauuacggaagaugacuugcagaacgaggccaagauaacggacauaauggagcccgagcacgccuugcucgcgaagagcaucuucaagcugaccuaucagaacaagguugugcguguccagcggccggcaaaaaacggcaccgugauggacgugaucagccgaagagaucagcggggcucaggccaagucggaacguacggccucaacaccuucaccaacauggaggcgcagcucauccgccaaauggaaucugaggguauuuuuagcccuagcgaacucgagacucccaaccuggcggggcggguguuggacuggcucgagaagcacggaguagaacgccugaagcgcauggccaucuccggcgacgacugcguggucaagccgaucgacgaucguuucgcgacggcuuuaaccgcacugaacgacaugggaaagguacgcaaggacaucccgcagugggagcccucuaagggguggaaugacuggcagcaggucccauucugcagccaccacuuccaccagcucauaaugaaggauggucgagagaucguggugcccugccgcaaccaggacgagcugguuggacgcgcacggguaucccagggagccgguuggucgcugcgagagaccgcuugccugggcaaauccuacgcucaaauguggcagcucauguauuuccaccgccgcgacuugcgccuagcugcuaacgccaucugcucugcgguaccggucgacugggugcccacuuccaggacgaccuggagcauccacgcgcaucaccaguggaugaccaccgaggauaugcucuccgucuggaacaggguguggaucgaggagaacccauggauggaagacaagacgcacauuuccucuuggggcgacgugcccuaccucggaaagcgggaggaccagugguguggaagccugaucgggcuuaccgcuagggccacuugggcgaccaacauccagguggcaauuaaccaggugcgccgccugauaggcaaugagaacuaccuggacuauaugaccucuaugaagcgcuuuaagaaugaauccgacccggagggugcccugugguga

SEQ ID NO: 24359 - RNA, 9879 nt, Artificial Sequence
  derived and/or modified CDS sequence (opt11) from DENV-1__FJ898389__SS-prME
uccgucacgauguugcuaaugcuuaugccgacggcacuagccuuucaccucacgacacgcggaggggaaccacacaugaucgucacgaaacaggaaagaggaaaaucccuacuauucaaaaccuccgccggggugaacaugugcacccugauugcaauggaucucggcgaacuaugcgaagacacaaugaccuauaaaugcccgagaaucacugaggcggaaccagaugauguagauugcugguguaacgccacagacacauggguaacguacgggaccugcagccaaaccggagaacaccggagggacaaacgaagcgucgcucucgccccacauguaggccuagggcuagaaacgcguacggagacguggauguccuccgaaggcgcauggaagcagauccaaagggucgaaacgugggcgcuacgccacccagguuuuacaguaauugcacuauuccuagcacacgccaucggaaccucuaucacccaaaaaggcauaauuuuuauccuccucaugcuuguaacuccaaguauggcaaugcguugcgucggcaucggcagucgcgacuucgucgagggucugucuggggcuaccuggguugacguggugcuagagcacggaucaugcgucacgacgauggcgaaagauaaaccuacccuggacauagaacuacuaaagacugaagucacaaacccagcuguucuucgcaaacuaugcaucgaagcgaagauaucuaacacgacaacagacagccgaugcccaacccaaggcgaggcuacacucauggaagaacaagacgcgaacuucguaugccgcagaaccuucgucgaccgggguuggggcaauggcuguggacuauucggaaaggggagccugauaaccugcgccaaauucaaaugcguuacaaaacuugagggcaagauaguucaauacgaaaaucucaaauacucaguaaucgugaccguucacacgggcgaccaacaccaggugggcaacgaaagcacugaacacggcacgaccgcaaccaucacaccgcaagcccccacgucggaaauucaacuaacagacuacggcgcccucacccuagauugcucaccacggacgggucuggauuuuaacgagaugguacuccucacaaugaaagaaaaguccuggcuaguccauaaacaaugguuccuagaccuaccgcuacccuggacgagcggcgccuccacgagccaggaaacauggaaccgucaagaucuccuagugacauucaagaccgcacaugcuaagaaacaagaagucguaguacuaggcucccaagagggggcgaugcauacugcacucacaggagcgacagagauccaaacgucuggcaccacgacaauuuuugcagggcacuuaaagugcagacucaagauggacaaauugacuuuaaagggaaugaguuacguaaugugcaccgggagcuuuaaacuugaaaaagagguagcggaaacacaacacgggacgguccucguccagauaaaauaugaaggaaccgacgcgccaugcaaaauaccuuucaguacucaagacgaaaagggcguaacucaaaauggaaggcugaucacggcaaacccuaucgucacagacaaggagaagcccgugaacaucgaagcagagccaccuuucggagaaaguuacauaguuauaggggccggcgagaaggccuugaaacucucgugguucaagaaaggcucaucuauuggcaaaauguucgaagcuacagcacgaggagcaagacggauggccauccugggggacacggcgugggacuuugggagcauuggagggguguuuacaucagucgguaagcuaguacaucaaauauuuggaaccgcguacggcguccucuuuucaggagucucguggacgaugaagaucgggaucgguguucuguuaacguggcuaggguuaaacuccaggaguacuagccucucaaugacuuguauugcuguaggauuagugaccuuauaccuggguguuaugguucaggcggauagcggcuguguaaucaacuggaaaggccgagagcugaaguguggcagcggaaucuuuguaaccaacgaagugcacacguggaccgaacaauauaaguuucaagcagacucacccaagcggcuaagcgccgcgaucgggaaggccugggaagaggggguaugugggauucgcucggccacaagacuagaaaacaucauguggaaacaaauaaguaacgaacuaaaucacauauuacuggagaaugauaugaaguucaccgugguaguuggggacguagucgggauucuagcacaaggcaaaaagaugauaagaccucaaccgauggaacauaaauauucguggaaaagcuggggaaaagccaaaauaauaggggcugaugugcaaaacacgacauucaucauugacgguccgaacacuccagaaugccccgaugaccaaagagcuuggaauaucugggagguggaggacuacggcuucggcauauucacaacaaauaucuggcucaaacucagggacaguuacacccagguuugugaccaccgccucaugagcgccgccaucaaagauaguaaagccguccacgccgacaugggcuauuggauugagagcgagaagaacgaaaccuggaaacuugcacgugcaaguuuuaucgaagucaaaacaugcauauggcccaagagccacacacuguggucaaacggaguccuggaaucggaaaugauaauuccaaagauauacggaggcccaauaagucaacauaacuaucgaccaggauacuucacccagacggccggacccuggcaucugggaaaacuggagcuagauuucgaucuaugcgaaggaacaacagucgucguggaugaacacuguggcaaccgugguccaucacuccgcacaaccacagucacgggaaagaucauacacgaguggugcugccggucaugcacccucccgccccuucgguucaaaggcgaggacggaugcugguacggcauggagaucagaccgguaaaagaaaaagaagaaaaccucgugaaaaguauggucagcgcuggaucaggcgaagucgacaguuucagucucggccugcuguguaucuccaucaugauagaggaagucaugcggucacgcuggaguaggaaaaugcucaugaccggcacacucgcaguauuccuauuuuuaauuaugggccaguuaacauggaacgaccugauacgccuauguaucauggugggggcaaacgccagugacagaaugggcaugggaacaaccuaccuagccuuaauggcaacuuucaaaaugagaccaauguucgcgguaggauugcuauucagacggcugaccagucgagaaguccucuugcuaacaauuggacuaagccuaguagcaucagucgagcuaccaaauucgcuggaagaacugggggauggcuuagcaaugggaaucaugauacugaaacugcugacagacuuccaaucgcaccaguugugggccacccucuugucauuaacauucaucaaaacuaccuuaagccugcauuacgcauggaagaccauggcaauggugcuaagcauaguaagccucuucccacuaugccuuuccaccacaucgcaaaagaccaccuggcuuccaguacugcucgguucguucgggugcaaaccccucgcaauguuuuuaauagccgagaacaagauuuggggacgcaaauccuggccacuaaaugagggaaucauggcaguaggaguaguuaguauauugcugagcagcuugcucaaaaacgauguaccgcuggcuggcccacugauagcaggagguauguuaauagcgugcuacgucaucagcggcagcagcgcggaccuaucucuagagaaggcugccgaagucucgugggaagaggaagcugagcacucuggggccucacacaacauccuaguggaagugcaggacgacggaacgaugaagauaaaagacgaggaacgcgacgacaccuuaaccauccuccucaaggcuacgcuucuagcaguaaguggcguguacccacuaucgaucccggcgaccuuguuugugugguacuucuggcaaaagaagaaacaacguuccgggguauuaugggacacaccgucacccccggagguagaaagggcggugcuagacgacggcauauaccgaauaaugcaacggggccuguuaggacgcucccaaguaggggugggcgucuuccaagaaaacguguuccacacaauguggcacgucacacgcggggccguccuaauguaccaaggcaaacgacuagaaccaaguugggcuagugucaagaaagaccuuauuagcuacggcgggggcuggaggcuccagggcagcuggaauaccggggaggagguacagguuauagccguagaaccaggcaaaaaucccaaaaauguucaaaccgcgccgggaaccuucaaaacccccgaaggugaagugggggcgaucgcgcucgacuucaaaccgggcacuucagggucgccuaucguaaauagggaagggaaaaucguaggauuguacgguaacggaguuguaaccacaucaggcacuuacguuucugcaaucgcccaagcaaaggcuucucaagaaggaccacuuccggaaaucgaggacgaaguuuuccgaaagagaaaucuaacuaucauggaccuucacccgggcuccggcaagacacgccgauaccugccugcgaucguuagagaagccauaaagcgaaaacuacgcacacugauacucgccccuacgcgagugguagcaagugagauggcagaggcacugaaagguaugcccauacgcuaccaaaccacagccgucaaaagcgaacacacaggcaaagagaucgucgauuugaugugccacgcaaccuucacgaugcgccugcuuucaccggugagagugccaaauuacaacaugaucaucauggacgaagcacauuucacggacccauucaguauagccgcaagaggauacauaagcacacgggucggaaugggcgaggcugcagcgaucuucaugaccgccaccccaccuggaucaguagaggcuuucccucagucaaaugcggucauccaagacgaagaacgagauaucccugaaaggagcuggaacaguggcuacgaauggaucacugauuuccccggcaaaacagucugguucguaccguccaucaaaagcggcaaugacauugcgaacugccugcgcaagaacggaaaaagaguaauacaacugaguaggaagacguucgauacagaauaccaaaagacuaaaaauaacgacugggauuauguggugacaacugacauaagugaaaugggagcaaacuuucgcgcggaucgagugauagacccgcgcagaugucuuaaaccgguuauccuaaaagauggaccugaacggguaauacuggccgggccuaugcccgucacugucgcauccgccgcccaacgccgcggccgaaucggacgaaaccauaacaaggagggcgaccaauauauauacaugggccaaccgcuaaacaacgaugaggaccacgcacacuggacggaggcgaaaauguugcuggacaauaucaacaccccagaagggaucaucccagcacucuucgaaccagaacgcgagaaaagcgcagcuaucgacggcgaauacaggcugcggggagaggcaaggaagacauucguggagcucaugcgacgcggcgaucucccgguauggcuuagcuauaagguagcaucagaaggcuuccaauauagcgacagacgauggugcuucgacggagagcggaacaaccaggugcuagaggagaauauggacguggaaaucuggacgaaagagggagaacggaagaaacuccggcccagauggcuagacgcuaggaccuacuccgauccgcuagcguuacgcgaauuuaaggaauuugcagcaggacgcaggagcguaucgggagaucuaauucuugaaauaggcaaacucccccaacaccuuacucagcgggcccaaaaugcacuggauaaccucgugaugcugcacaacagcgaacagggaggcagggcguaccggcaugccauggaagaauuacccgacacgaucgaaacacuuaugcuucuugcacuuauugcaguacugacgggcggagucacauuguuuuuccuauccggcagggggcuggguaaaaccagcauaggguuacugugcgugauggcuagcaguguacuucuauggauggccucaguagagccucacuggauagccgccagcauaauccuugaguucuuucucaugguccuacuaauaccagaaccagacagacagcgaacaccucaagauaaccaacuagcguacgucgucauaggacuuuuauucaugauacuaacaguagcggccaaugaaaugggccuacuagaaacaaccaagaaggauuugggcauagggcacgucgcagucgaaaaccaccaccaugcaaccauguuagacguagaccuacacccagccucggcauggacacucuacgccguggccacaacuaucauaacaccaaugaugcgacacaccauagaaaacacgacagcgaacauuagccuaacagcuauagcgaaccaggccgcgauccucauggggcuggacaagggcuggccaauauccaagauggauauaggcguuccccuacuggcgcucggcugcuacagccaagucaauccccucacccuaacugcggccguguugaugcuaguggcgcauuacgccauaauaggaccaggccuccaagcuaaggcaacacgagaagcccagaaacgcaccgccgcaggaaucaugaagaauccaacaguggaugggauuguagcgaucgaccucgacccgguagucuacgacgcgaaguucgagaaacagcugggucaaauaaugcuucuaauucuaugcacgagccaaauccuccuaaugcguacgacaugggcgcucugcgaaaguauaacgcucgcuacgggaccccuaacaacgcucugggaagguagcccggguaaguucuggaauacaacaauagccgugagcauggccaacaucuucaggggcucauaccucgcaggcgcgggauuagccuucucguuaaugaagucgcucggaggcggacgccgcggaacaggggcacagggcgaaacacuaggcgaaaaguggaaaaggcagcucaaucaacuuagcaaguccgaguucaauauauauaaacgaucagggaucauggaagucgacagaagugaagccaaagaaggacuaaagcggggcgaaacaacuagacacgccguaucacgcggaacagccaaacuccgaugguucguggaacguaaccucgucaagcccgaaggcaagguaaucgaccuaggauguggccgaggaggguggagcuacuacugcgcgggucugaagaaggucacagaaguuaaaggcuauacgaaagggggccccggccaugaggagccuaucccuauggcuacauauggguggaaccucgucaagcuccacucaggcaaagacgucuucuucacacccccggaaaagugcgacaccuuacucugcgauaucggugagagcuccccaaaccccacgaucgaagagggccguacccuccggguacuaaaaauggucgagccauggcucaggggcaaccaguucugcauuaaaauauuaaauccauacaugccaagcgucgucgaaacccuggaacagaugcaaagaaagcauggcggaaugcucgugcgaaacccucuuucucguaacuccacccacgagauguacuggguaagcuguggaacagggaacauaguuuccgccgucaauaugacgucgagaaugcuccuuaacagauucacaauggcccaccguaaaccaaccuacgagcgggacguagaccuuggugcgggcacucgucacgucgcggucgagccggagguggcaaaccuggacaucauuggccaacgaauugaaaauaucaagcacgagcauaaaagcaccuggcacuacgacgaggacaacccauacaaaacgugggccuaccacggcaguuacgagguaaagccaagcggcucagcgaguagcaugguaaacggaguggugaagcuccuaacaaagccaugggacgucauuccgauggugacccaaauugcgaugacagacaccacaccguuuggccaacaacguguguuuaaagaaaagguagauacccgcaccccgaaagcgaagcgagggacagcucaaauaauggaagugacagcacguuggcucuggggauuccuuucgcgcaacaagaaaccacggauauguacaagagaggaauuuacacgcaaagugcgaucaaacgccgcaaucggcgccgucuucgucgacgaaaaccaauggaacagcgcaaaagaagccgucgaggacgagagauucugggaccucguacagaaggaaagagaacuacacaaacaggguaagugugcaaccugcguguauaacaugaugggcaagcgagagaagaaacucggagaguucggaaaagcuaaaggaagccgagccauaugguacauguggcucggcgcucgguuuuuagaguuugaagcccuaggguuuaugaacgaagaccacugguucagucgugaaaacucgcucuccggaguggagggagaaggacuacacaaacuaggauacauccuacgcgacauaagcaagaucccuggaggcaacauguacgcagacgauaccgcaggcugggacacaagaauaacugaggacgacuugcagaacgaagccaaaaucaccgauaucauggagccggagcacgcgcuucuggccaccucaaucuucaagcugacuuaccagaacaaaguaguccgaguacaacgaccggccaagaacggcacggugauggacgugauaagcaggcgugaccagcgaggaucgggccaggucgggacauauggccuuaauaccuuuacaaauauggaggcacagcugauuagacaaauggaaucagagggcaucuuccuacccagugaacuagaaaccccaaaccuugcugaacgcguacuagauuggcuagagaaguacggagucgagagauuaaaacgaauggcaauaagcggcgacgacugugucgucaaacccauugacgaucgauucgcaaccgcgcucacagcgcuaaaugacauggguaaaguacgcaaagacauaccccaaugggaacccaguaaaggauggaacgauuggcaacaaguacccuucuguagccaccauuuccaccaacuaauuaugaaagacggucgggagaucguugucccgugccggaaucaggacgagcugguggguagagccagggucucacaaggggccggauggagccuaagagagacagcaugccuaggcaagagcuacgcacaaauguggcagcuaauguauuuccacagacgggaucuccgcuuagccgcgaacgcaauauguucagccgugccaguugacuggguaccgaccagucgcacgacauggagcauacacgcacaccaucaguggaugaccacagaagacaugcucucaguguggaacaggguauggaucgaggagaauccuuggauggaagacaagacccacgucagcagcuggggagacgucccauaucucgguaaacgcgaagaccagugguguggguccuuaauaggauugacagcgcgggccaccugggcuagcaauauucaagucgcgaucaaccaagugaggagacucauaggcaacgaaaacuauuuggacuacaugacgucgaugaaacgguucaagaaugaaggagaccccgaaggagcccuaugguag

SEQ ID NO: 24360 - RNA, 9879 nt, Artificial Sequence
  derived and/or modified CDS sequence (opt11) from DENV-1__FJ898390__SS-prME
agcguaaccaugcugcucaugcucaugccuaccgcccuggccuuccaccucaccacacggggcggggaaccccauaugaucgugaccaagcaagagcgggggaaaucacugcuguuuaagacaucagcgggcgugaacaugugcacacucaucgccauggaccugggagagcugugcgaggacaccaugaccuacaaaugcccucggaucacugaggcagagccggacgacguggacugcuggugcaacgccacagacaccugggugaccuacgggacgugcucgcaaacgggagagcaccgacgcgauaagcgcagcguagcccuugcgccacauguaggccucgggcuugagaccaggaccgaaaccuggaugucuagcgagggcgccuggaagcaaauccaacgggucgagacgugggcccuccgucaccccggcuucaccguaauagcccuguuccuggcgcaugcuaucggcaccuccauaacccagaaaggcaucauauucauacuccugaugcuggugacccccagcauggccaugcggugugucggcaucggcagucgcgacuucguggaggggcucucgggcgccacguggguggacguagugcuggagcacgggucaugcgugaccaccauggccaaggacaagccaacgcuggacaucgagcuacuaaagaccgaggucacgaaccccgcgguacugcguaaacuuuguaucgaggccaagaucucaaauacgaccaccgauagucgcugccccacgcagggcgaggccacccuuauggaggagcaggaugccaauuucgugugccgacgcaccuuuguugacagggguugggguaacgggugcgggcuguucgguaaggggagccucaucacuugcgccaaauucaagugugugaccaagcuggaggggaagauaguucaguaugagaaccucaaguacuccgugaucguuaccguccacacuggcgaccagcaccaggucgggaacgagagcacugagcauggcacaacagccacuaucacgccccaggcacccaccuccgagauccagcucacagacuauggggcccugacccucgacugcagcccucgcacggggcucgacuucaacgagaugguacuccuaaccaugaaggaaaaguccuggcuuguccacaaacagugguuuuuggaccugccucucccguggaccagcggggccuccaccucgcaggagacguggaaccggcaggacuuauuagucaccuuuaaaacagcucacgcgaagaagcaagagguggucgugcucggaagccaggagggcgccaugcacaccgcgcucacgggagccaccgagauacagaccuccgggacgacgaccauauucgccgggcaccucaagugccgccucaagauggacaaacugacccuaaagggcauguccuaugugaugugcaccggguccuucaagcucgagaaggagguagcggagacgcagcauggcaccguucuggugcagauuaaguacgagggcacggacgcccccuguaagauccccuucucuacucaggacgaaaagggcgugacacaaaauggccggcugauaacggccaauccgaucgugacggacaaggagaagcccgugaacaucgaagccgagccgcccuucggcgaguccuacaucgucaucgggguaggagagaaggcauuaaagcucaguugguucaagaaaggguccagcaucggcaagauguuugaagccaccgcccgcggugcacggcgcauggccauucugggggacacugcgugggacuucggaucgauuggaggaguguuuacuagcgucgggaagcuggugcaccagaucuuugguaccgccuacgggguucuauucucaggaguaagcuggaccaugaagauagguaucggcgugcugcugacguggcucgggcucaacucccgcagcaccagucucucgaugacaugcaucgccguggggcucgugacccuguaucuggggguuaugguucaggcagacagugggugugucaucaacuggaaaggcagagagcucaagugcgggagcgguauauucgugacgaacgagguacacacauggaccgagcaguacaaguuccaggccgacagcccuaagcgccugucggcugccaucgggaaggccugggaggagggggucugcggcauccgauccgcuacccgccuugagaacauuauguggaaacagaucuccaaugagcucaaccacauccugcuggagaacgacaugaaguuuacagugguagugggggacgugguagggauucuagcccaggggaagaagaugauccggccccagccgauggagcacaaguacuccuggaaauccuggggcaaagccaagaucauaggugccgauguccagaauacgacuuucaucaucgacgggccuaacaccccggaaugcccggacgaccagcgggccuggaacaucugggaggucgaagacuacggauuugggaucuucaccacaaacaucuggcugaagcuuagagacaguuacacccagguaugcgaucaucgccuuauguccgcugcgauuaaggacaguaaggccguucacgccgacaugggcuauuggaucgaguccgagaagaacgagacguggaaguuagcccgggccagcuuuaucgaggugaagacuugcaucuggcccaaaucccacacacuguggagcaacggggugcucgaguccgagaugaucauucccaagaucuacgggggcccgaucagccagcacaacuacagacccggcuacuucacccagaccgcgggccccuggcaucuggggaaauuagagcuggacuuugaccuaugugaaggcaccacgguggugguggaugaacauugcggcaaucgagggccgucccuuaggaccaccaccgucacagguaagaucauccacgaguggugcugucggagcugcacccugccgccccuccgcuucaaaggcgaggacggcuguugguaugggauggagauccggcccguuaaggaaaaggaggagaaccucguuaaauccaugguuagcgccggcagcggcgaagucgacuccuucagccucggucugcuguguaucuccaucaugaucgaggaggugaugcgcagccgguggagucgcaagaugcucaugacuggcacacuggcugucuucuuacugcugauaaugggccaguuaacguggaacgaccuaauccgacugugcauaauggucggcgccaaugccagcgaccgcauggggaugggcaccacauaccuggcgcucauggccaccuucaagaugcgccccauguucgcuguagggcugcuguuucgccgccucacgucccgcgaaguguuacugcucaccauagggcugagcuuaguggcguccgucgagcugccgaauagccuggaggagcugggcgacgggcucgccaugggcaucaugauacuuaaacuguuaacggauuuccagagccaccagcugugggcgacccuucucucucugacuuuuaucaagaccacccugucgcuccacuaugccuggaagaccauggccauggugcuguccauagugucucuauucccccucugucugagcacgaccucccagaagaccaccuggcugccaguccuguuggguucgcuuggcugcaagccgcuuaccauguuccugaucgcggaaaauaaaaucuggggccgcaaguccuggccgcugaacgaagguaucauggcugugggugucgucagcaucuugcugagcucccugcucaaaaacgacgugccccuggccgggccguuaaucgccggcggcaugcucauugccugcuacgucauaagcggguccuccgcggaccucucccuggagaaggccgcugagguaucaugggaggaggaggcggagcacuccggagcaagucacaacaucuuaguggaggugcaggaugacgggaccaugaagauaaaggacgaggagcgggacgacaccuugaccaucuugcucaaggccacccuacucgcagucuccggcguguauccguugagcaucccggcgacgcuguucgugugguacuucuggcagaagaaaaagcaacgcuccgguguccugugggacacccccagcccgcccgaggucgaaagagcaguguuagaugacgggauauacaggaucaugcaacggggccuccuagggcgaucucaagucggagugggaguuuuccaggagaacguauuccacacaauguggcauguuacccggggcgccguguugauguaccagggaaagcguuuggagcccaguugggccuccguuaagaaggaucugaucagcuacggcggcggauggcgacuacagggcuccuggaauacgggggaggagguccagguaaucgcggucgagccagguaaaaacccgaagaacgugcagaccgcgccuggaaccuuuaagacccccgagggagaggugggcgccaucgcacucgacuucaagccugggaccagcgguucccccaucguuaaccgcgaaggcaagaucgugggccuguacggcaacggggugguuacgaccagcggcacauacgugagcgcuaucgcccaggcaaaggcgucccaagagggaccgcugcccgaaaucgaggacgagguguuccguaaacgcaaccucacgaucauggaucuucacccaggcagcgguaaaacccgccgcuaccugccggcuaucgugcgggaggccaucaagcgcaaacuccguacgcugauccuugcccccaccagaguuguggcaucugaaauggcagaggcccuaaagggcaugccgauccgguaccagacgaccgcugugaagagcgagcacaccggcaaggagaucguagaccugaugugccacgcaaccuucacgaugcguuuacucucccccgugagggucccgaacuacaacaugaucauuauggacgaggcccacuucaccgaccccagcuccaucgccgccagagguuacauaucgacacgaguuggcaugggggaagccgcugccaucuucaugacugccaccccucccggauccguggaggccuuuccgcagagcaaugcggucauucaggaugaagagagagacauucccgagcggucuuggaacagcggcuaugaguggaucaccgacuucccggggaagaccgugugguucgugccguccaucaagagcggcaaugacauagccaauugccugagaaaaaacgggaagcgagugauccagcuguccagaaagaccuuugacacggaguaccagaaaaccaaaaacaacgacugggacuacguggucaccaccgacaucagcgagaugggcgccaacuuucgcgccgaccgggucaucgauccucgccggugucucaagccggucauccugaaagacgggcccgagagggucauccuggcaggccccaugccggugacgguggccuccgccgcccagcgacgcgggcggaucggacgcaaccacaacaaggagggggaccaguacaucuauaugggucagccccucaacaacgacgaggaccacgcgcacuggaccgaggcgaagaugcuucuggauaacaucaauacccccgaagggaucauccccgcccuguucgaaccggagcgugagaaaucggcugccaucgacggggaguaccgcuuacgcggcgaggcacggaagaccuucgucgagcugaugcgccggggggaccuccccguguggcuguccuauaaaguggcgucugaaggcuuccaguauagcgaccgccguuggugcuucgauggcgaacgcaauaaccagguccucgaggagaacauggacgucgagaucuggacgaaggagggggagcggaagaaguuacgcccacgauggcuugaugcccgcaccuauagcgacccccuugcccucagggaguucaaggaguucgccgcuggccgccggagcguguccggagaccugauacuggagauaggaaagcucccgcaacaccugacccagcgcgcgcagaacgccuuggacaaccucgugaugcuucacaacucugagcagggcgggcgggccuaccgccacgccauggaagagcugcccgacacuaucgagacgcucaugcugcucgcguugaucgccguucuaaccggcgggguaacccuguucuuccucuccggucggggccugggcaaaaccagcaucggcuugcucugcgucauggcauccagcgugcugcuguggauggcguccguggagccccacuggaucgcagcgagcaucauccuugaguucuuccugaugguucugcucaucccugaaccagaccggcaacggacgccccaagacaaccagcuggccuacgucgucauagggcuacucuucaugauccugacggucgccgccaacgaaaugggccugcuugagaccaccaagaaggaucugggaaucggccacguagcuguagagaaccaccaccacgcaaccaugcuggaugucgaccuucaccccgccagcgccuggacgcuguacgccguagcuaccaccaucaucaccccgaugaugaggcacaccauagagaacacgaccgcgaacauaagccugaccgcuaucgcuaaccaggcagccauccucaugggccuggacaagggcuggcccauuuccaagauggacaucggcguccccuuacuggcguugggaugcuauucgcaggucaaucccuugacauuaaccgccgcuguguuaaugcugguggcccacuacgcgauuaucggccccggccuccaggccaaagccacacgggaagcgcaaaagaggaccgccgcaggcauaaugaagaaccccacgguugacgggaucguggccaucgaccuggaccccguagucuacgacgcgaaguucgagaagcaacugggccagaucauguuacugaucuuaugcaccagucaaauucucuuaaugcgcaccaccugggcccugugcgagaguaucacgcucgcuaccggcccccugaccacccugugggaggggaguccgggcaaguucuggaacacgaccauagcggugagcauggccaauauauucagagggucuuaccucgcuggugcagggcuggccuucagccugaugaagucccucgggggcgggaggaggggcacuggggcgcaaggagaaacccugggcgagaaauggaagcgccaacugaaccaacucuccaagagcgaguuuaacaucuacaagcguagcgggaucauggagguggacaggagugaagccaaggaaggccugaagcgcggagagacgaccagacacgccgucagccggggcacagcgaagcugcguugguucguggagcggaaucuggugaaacccgaggggaaagucaucgaucugggcugcggccgcggcggcuggagcuacuacugcgcggggcugaagaaaguaacagaggugaaaggcuacacgaaaggcgggcccggccaugaggagcccaucccgauggccaccuauggguggaaucugguaaagcugcacuccgggaaggacguguucuuuacuccaccagagaagugugacacccuacugugcgacaucggagagaguucccccaauccaacuauugaggaaggccggacccuccgagugcugaagaugguagagcccuggcugcgggggaaccaguucugcaucaagauccucaaccccuacaugccauccgucguggagacccucgagcagaugcagcgcaagcacggcggcaugcuggugcggaauccucucaguaggaacagcacacacgaaauguauuggguguccugcggaaccggcaacaucgugucagccgucaacaugacgucccggaugcuccugaaucgcuucacaauggcccaccgaaaacccaccuacgaacgggacgucgaccucggggccggcacccgccacguagcgguagaacccgagguggcgaaccuggacauaaucggccaacggaucgagaacaucaagcaugaacacaagagcacguggcacuacgacgaggacaacccguauaaaaccugggcauaccacggcucauacgaggucaagccgaguggcucggccagcagcaugguaaacgggguugucaaguugcucaccaagcccugggacgugauccccaugguaacccagauugcgaugacggacacaacgcccuucggacagcagcgcgucuuuaaggagaagguagacacccggaccccgaaagcgaagcgcgggacugcacagaucauggaaguuaccgcccgguggcucuggggauuccuuucccgcaauaagaagcccaggaucugcacccgcgaggaguucacccggaaaguccgaagcaacgcggcaaucggcgccguuuucgucgacgaaaaccaguggaacuccgcaaaggaggccguagaggacgagcgauucugggaccucguccagaaagagcgcgagcuucacaagcaggggaaaugcgccaccugcgucuauaacaugaugggcaagcgggagaagaagcuuggcgaguucggcaaggcuaagggcagcagagccaucugguauauguggcucggcgcccgguuccuggaguucgaggcgcugggcuuuaugaaugaggaccacugguucucccgcgagaacagcuuguccggggucgaaggcgaggggcuucacaagcucggcuacauccuccgugacaucagcaagauuccaggaggcaacauguaugccgacgacaccgccggcugggacacccggaucacggaggacgaccuucagaaugaggccaagauaaccgacaucauggagcccgagcacgcgcuacucgccacguccaucuucaaguuaacuuaccagaacaagguggugcggguccagcgacccgccaagaaugggacagugauggauguaauuucccgcagggaccagcgaggcagcgggcaagucggcaccuacggacugaacaccuuuaccaacauggaggcgcaacugauccggcaaauggagucggaggguaucuuccugccgucugagcuggagacgccgaaccucgccgagcgcgugcuggauuggcuggaaaagcacggaguagagcggcucaagcgcauggccaucagcggggaugauugcguggugaagccgaucgacgaccgguuugccaccgcacugaccgcgcugaacgacaugggaaaggugcgcaaggacaucccccagugggagccuuccaaaggauggaacgacuggcaacagguuccauucugcagccaucacuuccaccagcuaauuaugaaagacggccgggagaucguggugccuugcagaaaccaggacgagcuggucggucgggcuagaguaucccagggggccggcuggagucugcgggagaccgcaugccucgggaaguccuacgcgcagauguggcagcugauguacuuccacagacgggaccugcgccucgcagccaacgccaucugcagugccguccccgucgacugggugcccacgagccggacgaccugguccauccacgcacaucaccaauggaugaccacggaggacaugcugagcguguggaacagggucuggaucgaggagaaccccuggauggaggacaaaacccacguuaguagcuggggggacgugcccuaccuggggaagcgggaggaccaguggugugguucccucaucggccugaccgcccgagccaccugggcuagcaacauccaggucgcaaucaaccaagugcgacggcugaucggaaaugaaaauuaucuagacuacaugaccucgaugaaacgcuucaagaacgagggggacccugagggagcacugugguga

SEQ ID NO: 24361 - RNA, 9879 nt, Artificial Sequence
  derived and/or modified CDS sequence (opt11) from DENV-1__FJ898391__SS-prME
ucugucacgaugcuccucaugcuuaugccgaccgcgcuagcauuccaccuaaccacgagaggaggugaaccgcacaugaucguuagcaaacaagaacggggaaaaucccuauuauuuaaaaccagcgcgggaguaaacaugugcacacucauugcaauggaucugggagaguucugcgaagauacgaugaccuacaaaugcccgcgcaucacggaagcagaaccagacgaugucgacugcuggugcaacgcgacagauacaugggugacauacggaacgugcagccaaaccggagaacacagacgagacaaacgaagcguggcucuugcaccccacguuggcuugggccuggaaacacgcacagaaaccuggaugagcagcgaaggagcguggaaacaaauucaacguguggaaacgugggcacucagacacccgggauucaccgugaucgcccuguuccuugcgcaugcuauuggaaccucuauaacccaaaaaggcaucaucuucauacugcugaugcucguaacgcccagcauggccaugcgcugcgugggaauuggcagcagggauuucguagaaggccucucgggagccacaugggucgacguuguucuggaacauggaagcugcguaacaaccauggcaaaagacaaaccgacgcucgacaucgaacugcuaaaaaccgaagugacaaaccccgcgguacuacgcaaacuaugcaucgaagccaaaauuagcaauaccacaacggacucacgauguccuacacaaggcgaagcaacccucguggaggagcaagacgcaaacuucguuugcagacgcaccuucguggacagaggauggggaaacgguugcgggcuguucggaaaaggaucacuuaucacaugcgccaaauucaaauguguaaccaaacuagaggggaaaaccguacaguaugaaaaccucaaauacagugucaucguaaccguacacacaggagaccagcaccaaguaggcaacgaauccacggaacacggaacgacggccacaaucacaccccaagccccgagcacggagauacaguuaaccgacuacggcgcacuaacccucgacugcagcccaagaacgggacuagauuucaaugaaaugguacuucuaaccaugaaagagaaaagcuggcuagugcauaaacaaugguuccuagaccugccccugcccuggaccucaggcgcaucgaccagccaagaaacguggaaccguaaagaucuguuagucacauucaaaacugcccacgcgaagaaacaggaagucguagucuuagggucccaggagggggcaaugcacaccgcgcuuacaggcgcaacugaaauccagacaucuggcaccaccacaauuuucgccgggcaucugaaaugccgccuaaaaauggacaaacuaacacuaaaaggaauguccuaugucaugugcacgggcagcuucaaacucgagaaagagguagccgagacccaacacggcaccguccuuguacaaauaaaauaugaagguaccgaugcucccugcaaaauacccuuuucuacacaggacgagaaagggguuacacagaaugggcggcugauaacugcaaacccaauaguaaccgacaaagagaaacccgugaauauagaggcagagccgcccuucggcgagaguuauaucguaaucggcgcgggcgaaaaagcccugaaacucuccugguucaaaaagggaagcucaaucggcaaaauguucgaagcuacagcacgcggagcgcgcaggauggcaauacucggagacacugccugggacuuugggaguaucggaggcgucuucaccucagucggaaaacucguucaucaaaucuucgggacggcauacggagucuuguucucaggcgucucauggaccaugaaaauaggaaucgggguccuccucaccuggcugggacuaaacagcagaagcacuucacugagcaugacgugcauagcagucggccuuguaacccucuaccucggcguaaugguucaagcggacuccggaugcgucaucaacuggaagggaagggaacucaaaugcggauccggaaucuuugugacgaacgaaguacacaccuggaccgagcaauacaaguuccaagccgacucgccuaaaaggcugagcgcagcaauaggaaaagccugggaggaaggugugugcgggaucagaagcgccacacggcucgaaaacaucauguggaaacagauauccaaugaguuaaaccauauacuccucgaaaacgauaugaaguucacagugguaguuggcgauguggcggggauauuagcacaggguaagaaaaugaucagaccccagccaauggaguacaaguacuccuggaaaucauggggcaaggcuaaaauaauaggggccgacgugcagaauacuacguucauaauagaugggcccaacacccccgaaugcccggaugaccagcgagcguggaacauaugggaagucgaggacuacggauucggaauauucacaacaaacauuuggcucaaguugcgggacucauacacacagguuugcgaucaccgauugaugagcgcagccaucaaggacucgaaagccgugcacgccgacaugggauacuggaucgagucugagaaaaaugagacguggaaacuagccagagccuccuuuaucgaagugaaaacaugcaucuggcccaagucccacacccucuggucaaaugggguacuggaaagcgaaaugauaauuccaaaaauauacggcggaccuauaagccaacacaacuaccgacccggauauuucacgcagacggccgggccguggcacuugggaaaacucgaacuagacuucgaccuaugcgaaggaaccacagucguaguugacgaacauuguggaaaucguggucccagccuacggaccacuacggucacagggaagaucauccacgaauggugcuguagauccuguaccuugcccccucuaagauucaaaggugaagacggcugcugguacgggauggaaauaaggccagugaaagagaaggaggaaaaccucguuaagagcauggugagugccggaucuggcgaaguagacagcuucucgcuaggacuacuaugcaucucuaucaugauagaagagguaaugcgaagucgauggagccggaaaaugcuuaugaccggaacgcucgcaguguucuuccugcuaauaaugggccaacucaccuggaacgaccuaauccggcucugcauaaugguaggcgcgaacgcaagcgauaggauggguaugggaacaacauaccuggcacuaauggccacguucaaaaugcgcccaauguuugcugucggcuugcuauuccgacgacuaacgucgagggaagugcuacuacuuaccaucgggcucagcuuaguagcuucagucgaacugccgaacucccuggaagaacuaggugauggucuagcaauggggaucaugauucucaaacugcucacagacuuccaaucgcaccagcuuugggccacccuccugucacuaacauucauuaaaaccacauucagucuccacuaugccuggaaaaccauggcaaugguccucuccaucgugucccuauuuccauuaugccuaagcacgacgagccagaaaacgaccuggcuaccgguucuauugggaucccucggcuguaaaccguuaacgauguuccugaucgcagaaaauaaaauauggggaaggaagucauggccccucaaugaaggaaucauggcgguaggcauuguguccauucuucuaucuucacuccuuaaaaaugaugugcccuuagccgguccccugaucgcaggcgguaugcucauagcguguuacgugauuagcgguuccucggcagaucuaucuuuagagaaagcggcagaaguaagcugggaagaggaagccgagcauagcggugccagccauaacauacugguggagguccaagacgacggaacaaugaaaaucaaagaugaggagagggaugacacacuaaccauacugcugaaagccacccuccuggcgguauccggcgucuacccccuaucuauaccggcaacacucuucgucugguacuucuggcagaagaagaaacagagaagcggaguucugugggacacacccagcccaccggaagucgagagagcaguccuagacgacgguauuuaucgcauaaugcaacgagggcuauuaggcaggucccaagucggcgucggagucuuccaagaaaauguauuccacaccauguggcauguaacacgcggcgcgguccugauguaccaaggaaagcgccucgagccaagcugggccucaguaaagaaagaccuuaucagcuacggagguggauggagacuccaagggaguuggaacacgggagaggagguacaagugaucgccguagagcccgguaaaaaccccaaaaacguccagacagcccccggcacauucaaaacgagugaaggcgaggugggcgcgaucgcacuagacuucaaacccgguacaagcgggagcccgauaguaaaucgagaagguaagaucguagggcuuuauggaaacggagucguaacgacgucgggaaccuauguauccgccauagcccaggccaaagcaagccaggagggaccacugcccgaaaucgaggaugaggucuuccgcaaaagaaaccuaaccauuauggacuugcacccaggaagcggcaaaacucggagauaccuaccagccaucgugcgugaagccauaaagcggaaacuaaggacuuuaaucuuggcccccacacggguggucgccagcgaaauggccgaagcacugaagggcaugccaaucagguaccaaacaacugcggugaaauccgaacauacuggaaaagagauagucgaucucaugugccacgccaccuuuaccaugcgccucuugucgccugugcgagucccgaauuauaacaugaucauuauggacgaagcucacuucacagaccccuccagcaucgcggcgcgaggauauauauccacacgcgugggcaugggagaagcggccgccauuuucaugacagcaaccccacccggcagcguggaggcauucccgcagaguaacgccgucauacaggaugaagaaagagacauuccugaacgcagcuggaacuccgguuacgaauggaucacagacuuccccgggaagacagucugguuuguaccuagcauaaaaucaggcaacgacauagccaauugcuuacggaagaacggcaagcgcgugauucagcugagccgaaagaccuuugacacggaauaccaaaagacgaaaaacaaugacugggauuacguuguaacaaccgacaucucagaaaugggcgcaaacuucagggcggacagaguaaucgacccgcgacgaugccugaagcccgucaucuuaaaggacggccccgagagagucauauuagcgggcccgaugccugugacgguagcuucagcagcacagaggcgcgggcgcauuggaagaaaccacaacaaagagggggaucaauacaucuacaugggccagccgcugaauaacgacgaagaucacgcucacuggaccgaagcgaagaugcuacuggacaauauaaacacaccggagggcaucauuccugcccuauucgaacccgagcgggagaaaagcgcggcgaucgacggggaauaucgucugcgcggggaagcccgcaaaacauucguagaacuaaugcgccggggcgacuuaccaguauggcuaagcuacaaaguagcaagcgaaggguuccaauacucagaucgucgguggugcuucgauggugagagaaacaaccaagugcuagaggagaacauggacguagagauauggaccaaggagggagaacgaaagaaacugaggccccgcuggcuggacgcacgcacauacuccgauccccuugccuugcgagaguucaaagaguucgccgcgggcaggcguagcguaucuggagacuuaauccuagagauuggaaaacuaccccaacaccuaacacagagggcacaaaacgcauuggacaaccuaguaauguugcacaauagcgaacaaggggguagggcuuaccgucacgccauggaagaauugccggauacuauugagacccucaugcuccuagcacuaauugccguccugaccggaggggucacccuauucuuccuaucggggcguggucucggaaagacgucaauagggcuccugugcguaauggcgaguucuguacuacuauggauggccagcguggagccacauuggauagccgcgucgauaauccuagaguuuuuccugaugguucuccucauaccggaaccugacagacagagaacgccacaagacaaucaauuagcguauguagucauaggccuacucuucaugaucuugacuguggcagccaacgagaugggucuucucgagaccaccaagaaagaucuggggaucggacaugucgcaguggaaaaccaccaccaugccgcaaugcuggacguagaccuacauccagcuagugcauggacucuguacgcaguagcaaccaccaucaucacgccuaugaugcgacacaccauugagaacaccacagccaauauuucccuaacggcaaucgcaaaccaggccgcuauccuaaugggacucgacaaaggguggccaaucucuaagauggacauaggcguaccauuguuagcucuaggaugcuauagccaagucaacccuuugacuuuaaccgcggcuguccugaugcuaguggcccacuacgccauaaucgguccuggccugcaagcaaaggcuacccgcgaagcacagaaaagaaccgccgccggcaucaugaaaaacccaaccguggauggaauaguugccauagaccuagacccugucguauaugacgccaaauucgagaaacaauuaggacaaaucaugcuucuaauacugugcacaagccaaauucuccuaaugcgaacaacaugggcgcuuugugaauccaucacacuugcgaccgggccuuuaacgacucucugggaaggaagccccggcaaguucuggaauacaacaauugcagucucaauggccaacauuuucaggggaucauaccuagcaggcgccggacuggcauuuucauuaaugaaaagccuaggcggaggacguagagggacgggcgcucaaggagagacccugggugagaaauggaaacgccaacuaaaccaacuaagcaaguccgaguucaacacauacaagcgaaguggaaucauggaaguagaccgaucugaggcaaaagaaggcuugaaacguggggaaacuaccaagcacgcaguuucgcgcgguacugccaagcugcgcugguucgucgaacggaaccuagucaagccagaagggaaggucauagaccugggcugcggcagagggggauggucauacuauugcgccggccucaagaaagugacagaggugaaaggguacacuaaaggcggccccgggcacgaggaaccuauucccauggcaaccuauggauggaaucuugugaaacuacacagcggaaaagauguuuucuucauaccacccgagaaaugcgacacacugcugugugacauaggcgaaucgagcccaaacccuacaaucgaggaaggacguaccuugcgcguccucaagaugguggagcccuggcuacgggggaaccaauucuguauaaaaauacucaauccauacaugcccucugugguagaaacacuugaacaaaugcaacgcaagcacggaggaaugcucgucaggaacccucuaucucgaaacucuacacaugaaauguauuggguauccugcgggaccgguaacauugucagcgcggugaauaugacguccagaaugcuccucaaccgcuucaccauggcacacaggaagccuacguacgaaagagacgucgaccucggcgccggaaccaggcacguugccgucgaacccgagguagcgaacuuggacauaaucggacaacgaauugagaauauuaagcacgagcauaaaucaacauggcacuacgacgaagauaauccguauaagaccugggccuaccacggaagcuacgaaguaaaacccuccggcuccgcgaguuccauggucaauggggucguuaagcuccuuacaaaacccugggacguuaucccaaugguaacucaaauagccaugaccgacacaaccccuuucggacaacaaagaguauucaaagaaaaaguggacacccggacacccaaggccaagcgggggacugcucaaauaauggaggugaccgcuaaauggcuguggggauuucuaucaagaaacaagaaaccacggaucugcaccagggaagaguuuacaaggaaaguaagaaguaaugccgccauuggggccguauucgucgacgaaaaucaauggaacagcgccaaagaagcuguugaggacgaaagguuuugggaccuaguacaccgcgagagagagcugcacaagcagggcaaaugugcaacgugugucuauaacaugauggggaagagagagaagaaacucggugaguucggcaaagcaaaagggagccgggcaauaugguacauguggcuaggggcccgcuuccucgaguucgaagcccucggcuuuaugaaugaagaucacugguucuccagggaaaacucucuaagcggcguugaaggcgagggacuccacaaguuaggguacauccuucgggauaucagcaagaucccuggggguaacauguacgccgacgacacggcaggaugggauacaaggauaaccgaagacgauuuacagaacgaagcgaaaauaacagacaucauggaaccagaacacgcgcugcucgcgaaaucgaucuuuaaacuaaccuaucaaaauaagguaguaagaguucagcguccagccaaaaaugggaccgucauggacguaaucagucgccgagaccaaagaggcucgggccaagucggaacauacggccuuaauacuuucacaaacauggaagcucagcuaauccggcagauggaaagcgaagguauauuuuccccgagcgaacuugaaacccccaauuuagcagggagaguacuugacuggcuggagaaacacgggguagagcgacuaaaaaggauggcaauuucgggcgacgauugugucgugaaaccuaucgaugaucgguucgccacagccuugacugcgcucaaugacaugggcaaggucagaaaggauauaccccagugggaaccaucaaaaggauggaacgacuggcaacaaguuccauucuguucacaucacuuccaccaguuaauaaugaaagaugggcgugagaucgucgugccaugcagaaaccaagaugaacucguuggccgugccaggguuucccaaggagccggcuggagucuacgagaaacagcgugucuaggcaagucguaugcgcagauguggcagcucauguauuuccaccgucgagaccuaagacuggcagcaaacgccauauguagcgcgguccccguggacugggugcccacaucgcggaccaccuggucaauacacgcacaccaccaauggaugaccacggaagacaugcuuucaguauggaaucgcguauggauugaagaaaacccguggauggaagacaagacccacaucucgaguuggggcgacguaccguaucugggcaagcgagaagaccaauggugcggcagccucauaggucucaccgccagggcaacaugggcgacuaacauucagguagccauaaaccagguccgccgauuaaucgguaacgagaacuaucuagacuacaugaccucgaugaaacguuuuaagaacgaaucggaccccgaaggggcgcuaugguaa

SEQ ID NO: 24362 - RNA, 9879 nt, Artificial Sequence
  derived and/or modified CDS sequence (opt11) from DENV-1__FJ898392__SS-prME
agugugaccaugcuguugaugcugaugcccacagcccuggccuuccaccucacgacucggggcggcgaaccccauaugaucgugacaaagcaggagagggguaagagccugcuguucaagaccagcgcgggagugaacauguguacccucaucgccauggaccucggcgaacucugcgaggacacuaugaccuacaagugcccccgcaucacggaagccgagcccgacgacguggacuguuggugcaacgccaccgauacguggguuaccuacggcaccugcucacagacuggcgagcaccggcgcgacaagcgcucuguggcccucgcgccucacguaggccuggggcuggaaacuaggaccgagaccuggaugucauccgagggcgccuggaagcagauccagcguguggagacaugggcccuccgccaccccggguucacugugaucgcccuguuccuggcgcacgcgaucgggaccucuaucacccagaaggggaucauauucauccuccugaugcugguuacgcccucuauggccaugcggugcguuggcauuggaucuagggacuucguggagggccucucgggcgcgacgugggucgacgucgugcuggagcacggauccugcgugaccaccauggccaaagacaagccgacgcuggacaucgagcuccugaagaccgaggucaccaacccugcgguacuuaggaagcuaugcaucgaggccaagaucagcaacaccacgaccgacucccgcugccccacacagggcgaggccacucugauggaggagcaggacgccaacuucguuugcagacguacuuucgucgaccgaggcuggggaaacggcuguggucuguuugguaaggggucacucaucacaugcgcaaaguucaaaugcgugaccaagcuugagggcaagaucguccaguacgagaaucugaaguacucaguuaucgugacgguacacacaggcgaucagcaccaggucgggaaugagagcacggagcauggcaccaccgcaaccaucacgccccaggccccaaccuccgaaauccagcucaccgacuacggggcccugacacuggauugcaguccccgcacgggccucgacuuuaacgagauggugcugcugacaaugaaggagaagucuuggcucguccauaagcagugguuccuggaccucccgcuccccuggacaagcggggccagcaccucccaggaaacauggaaccggcaggaucugcuggugacauucaagaccgcccacgcgaagaagcaagagguggucgugcuuggcagccaggaaggcgccaugcauacagcacugacgggcgccaccgagauccagaccucuggcaccaccaccaucuucgcugggcacuuaaaaugcagguugaagauggauaaacugacccugaagggcaugagcuacgugaugugcacugggucauuuaagcuggaaaaggagguugcggagacgcagcacgguaccguccugguucagaucaaguacgagggcaccgacgcccccugcaagauucccuucagcacucaggacgagaagggggugacccagaacggccgguuaaucaccgccaacccgaucgugaccgauaaagaaaagcccgugaacaucgaggcugaaccgcccuucggugaguccuacaucgucaucggcgcgggggagaaggcacugaaauuaagcugguucaaaaagggcuccagcaucggaaagauguucgaggccaccgcccgcggggcccggcgcauggcgauuuuaggcgacacggccugggacuucggguccauuggcggcguauucaccagcgucgggaagcugguccaccagaucuucggcaccgccuacggcguccuguuuuccgggguaagcuggacaaugaaaaucggcauaggcguucugcugacguggcucggccugaacucccgcucaaccucccugucaaugacauguaucgccgugggacucgugacccuguaccugggagugauggugcaggccgacagcggaugcgugauuaacuggaagggacgggaacucaaaugcgggagcgguaucuucguuacgaaugaagugcacaccuggacggagcaguacaaguuucaggcugacucaccgaagcgccugagugccgccaucgggaaggccugggaggagggggugugcggcauccggagcgcuacacgacuagagaauauuauguggaagcagauaagcaaugagcugaaucacauccugcuggagaacgggaugaaguucaccgucguggugggagaugugguggggaucuuagcgcagggcaagaagaugauuaggccccagcccauggagcacaaauacucauggaagucuuggggcaaggccaagaucaucggcgccgaugugcagaacacgacuuucauuaucgacggccccaauacucccgaguguccagacgaccagcgggcauggaacaucugggaggucgaggacuacggguucggcauauuuaccacgaacaucuggcuaaagcugcgggacagcuacacccaaguaugcgaccaucgccuuauguccgccgccaucaaagacagcaaggccgugcacgccgacauggguuacuggaucgagucagagaagaacgagaccuggaagcuggcccgagcgucguucaucgaggucaaaacuugcaucuggcccaagucucacacacuguggucuaacggggugcuagagucagaaaugauuauacccaagauuuacggcggaccgaucagccagcacaacuaccgccccggcuacuucacccaaaccgcgggacccuggcaucuggguaagcuggagcucgacuucgaccugugcgagggcaccacgguugucguggacgagcauugcggaaaucggggcccgucccugcgcacaacaaccguuacggggaagauuauccacgagugguguugcagaagcugcacacugcccccacuccgcuucaagggcgaggacgggugcugguacggaauggagauacggcccgucaaagagaaggaggagaacuuggugaaguccauggugagcgccggcagcggggaagucgacagcuuuagccuuggcuugcuguguacaagcaucaugaucgaggaggugaugcgcagccgguggucccgcaaaaugcucaugacggggacgcuggcaguguuccuccuccugauuaugggccagcucaccuggaacgaccucauccgccuuuguaucauggucggggccaaugcgagcgaccguaugggaaugggcaccaccuaccuggcccucauggcgacguucaagaugcgaccgauguucgccguggggcugcuauuccggcgccugaccucuagggagguacugcuucucaccaucgggcuaagcuuagucgccuccguggaguuacccaacagccuggaggagcugggggacggccuugcgaugggcauaaugauucugaaacugcucaccgacuuucagagucaccagcugugggccacccugcuaucacugacuuucaucaagaccacacucucccuccacuacgccuggaagacgauggcgauggugcugucgaucgugucguuguuuccccucugucuaagcaccaccucccagaagacgacguggcugcccgugcuccuggggagccuaggcuguaagccgcucaccauguuucugaucgcggagaacaagaucugggggagaaagucuuggccgcuaaacgagggcaucauggccguggggguggugucgauucuccugagcucccuguuaaagaaugacguaccucuggccggcccccugaucgccggggggaugcucaucgccugcuacgugaucagcggcuccuccgcggaucugucgcuggagaaagccgccgaggugagcugggaggaggaggccgagcacuccggggccagccacaacauccucgucgaagugcaggaugacggcaccaugaagaucaaggaugaggagagagacgacacccugacaauacugcucaaggccacccugcucgcgguauccggggucuacccacugagcaucccggccacccuguucguaugguacuucuggcaaaagaagaagcagcgcuccggcgugcugugggacacccccaguccgcccgaggucgagcgggcggugcuggacgaugguaucuaccgcauuaugcagcgugggcuucugggccgcucccaggugggggucggcgucuuccaggaaaacguguuucauacaauguggcacgucacgcgcggugccgugcuaauguaccaaggcaagcgccucgaacccagcugggcuucugugaagaaggauuugaucucguauggugggggcuggcggcugcagggguccuggaacaccggagaggagguccaggugauagcaguggagcccgggaaaaacccgaaaaauguccaaaccgccccaggcaccuucaagacacccgagggcgaggugggggccaucgcccuagacuucaagccuggaaccagcgggucccccaucgugaaccgcgaagguaaaaucgucggccuauacgggaacgguguggugacaaccagcggcacguaugucagcgcgaucgcccaggcuaaggccucccaggagggaccgcugcccgagaucgaagaugaaguguuccggaagagaaaccucaccauaauggaccugcaucccgggagcgggaagacccgacgcuaccugccggcgaucguacgggaggcaaucaagcgcaagcuccggacccugauccuggcccccacgcgagucguggccuccgagauggccgaagcgcugaaaggcaugcccauacgcuaucaaaccacagccguuaaaucagagcauaccgggaaagaaauugucgaccuaaugugccaugcuacguucaccaugcggcugcucucccccgugcgcguuccaaacuacaacaugaucaucauggacgaagcccacuucaccgaccccaguuccauagcugcgcggggcuacaucucaacacgugugggcaugggggaagcggccgcuaucuucaugacggccacgccacccggguccguggaggcauucccgcagagcaacgcugugauccaggacgaggagcgggacauccccgagcgauccuggaacagcggcuacgaguggaucacugacuucccuggcaagacagucugguucgugcccuccaucaagagcgguaacgacaucgccaacugcuugcggaaaaauggcaaacgcgugauacagcugucccggaagacguucgauaccgaauaccagaaaaccaagaacaacgacugggauuacgugguuaccacggauaucuccgagaugggggccaacuuucgcgcggaccgggugauugacccgcgccggugccucaagcccgucauccugaaagacggccccgagcgcgugauccuggccgggcccaugccggugaccgucgccuccgcugcacaacgccgcggccgcauuggccgcaaccauaacaaggagggggaccaguauauauauaugggccagccccucaacaacgacgaggaccaugcgcacuggaccgaagccaagaugcuguuggacaacauaaacacucccgaggggaucauccccgcgcucuucgaaccugagcgggaaaagagugccgcaaucgacggggaguaccgccugagaggggaggcgcgcaagacguucguggagcugaugcgucggggcgaccuacccguguggcugucauacaaaguggcaagcgaaggcuuccaguauagcgaucgccggugguguuucgauggggagcgcaacaaccagguguuagaggagaacauggacgucgagaucuggaccaaggaaggcgagagaaagaagcuacgccccagguggcuggacgcgcgcaccuauuccgauccccuggcccuccgggaguucaaagaauuugccgcggggcgccggagcguguccggcgaccugauccuggagaucggcaaacuuccgcagcaccugacgcagcgggcccagaacgcccuggauaaccuugugaugcuccacaacucugagcagggcgggcgggccuaccgccacgcgauggaggagcugcccgacacgaucgagaccuugaugcugcuggcccucaucgcggugcugaccggcggcgugacccuguuuuuccucuccggacguggccugggcaagaccagcaucgggcuacucugcgugauggccuccaguguccugcuguggauggcuuccguggagccccauuggauagcggccuccaucauccuagaguucuuucugaugguacuccucauccccgagcccgaccgccagcggacgccccaggacaaucagcuggcuuacgucgugaucggacuccucuucaucauccuaaccguugccgccaacgagaugggucugcuagagaccacgaaaaaggaccuaggcaucggucaugucgcgguggagaaccaccaccacgcuacgaugcuggacguggaccuccaucccgcuuccgccuggacucuguacgccgucgcuaccaccaucaucacuccgaugaugcggcacaccaucgagaacaccaccgccaacaucagccugacggccaucgccaaccaggccgcgauccucaugggccuagacaagggcuggccgaucuccaagauggacauaggggugccccugcucgcacugggcugcuacagccaggugaacccccugacccucaccgccgcuguccugaugcugguugcgcauuacgccauaaucgguccgggccuccaggccaaggccacacgggaagcacagaagagaaccgcggccggaaucaugaagaaccccaccguugauggcaucgucgccaucgaccuggauccagugguuuacgacgccaaauucgagaagcagcugggccagaucaugcuccugauccuuugcaccucccagauccuccugaugcgcacaaccugggcccugugugagagcaucacucuagcaacagguccccugaccacgcuuugggagggcuccccggggaaguucuggaauaccacuauugccgucagcauggccaacauuuucagaggauccuaccucgcgggcgccgggcuggcauucagccucaugaaguccuuaggggggggucgccggggaaccggcgcccagggggagacguuaggggagaaauggaagcgccagcuuaaccaguugucgaagucggaguucaacaucuauaagagguccggcaucauggaaguggauagauccgaggccaaagagggccugaagcggggcgaaaccacccgccaugcaguguccaggggcaccgcgaagcugcgcugguucgucgagcguaaccuggugaagcccgaaggcaaggugauagacuuggggugcgggcgcggugguuggagcuacuacugcgcaggcuuaaagaaggucacggagguaaagggauauaccaagggcggcccuggccacgaggagcccaucccaauggcgacguauggcuggaaccugguaaagcuccacucagggaaggacgucuucuucacgccacccgaaaagugcgacacgcugcugugcgauauaggugagagcucccccaacccgacuauugaggaggggcggacccucagggugcugaagaugguggagcccuggcugcggggcaaucaguuuugcauuaagauccucaaucccuacaugccgaguguuguggagacccuggagcagaugcagaggaagcacggugguaugcucgugcggaacccacucucacgcaacagcacccaugaaauguacugggucucaugcggcaccgggaacauugugagcgccgugaacaugacgucccggaugcuacugaaccgcuuuacaauggcccaucguaagcccacuuacgagcgggaugucgaccucggcgccggcacgcgccacguggccguggagcccgagguugcgaacuuagacauuaucgggcagcggauagagaacaucaagcacgagcacaaaagcaccuggcacuacgacgaggacaacccauacaagacgugggccuaccacggcuccuacgagguaaagccgagcgggucugccagcagcauggucaacggaguggugaagcugcucaccaagcccugggacgucauccccauggugacgcaaaucgcgaugacugacaccacccccuuugggcagcagcgcgucuuuaaggagaaggucgacacgcggacuccgaaggccaagaggggcacagcccaaaucauggaaguaaccgcccgguggcuguggggcuuccugucccgcaacaagaaaccccggaucugcacgcgcgaagaguucacaaggaaggugcgcagcaaugccgcuaucggggccgucuucguggacgagaaucaguggaacuccgcaaaagaggccgucgaagaugaacgguucugggaucucgugcagaaggagcgcgaacugcacaagcagggcaagugcgcgaccugcguguacaacaugauggggaagcgugagaaaaagcugggcgaguucgggaaggccaagggcucacgugcgaucugguacauguggcucggugcucgguuucuagaguucgaggcccugggguucaugaacgaggaccauugguucucccgggagaacagccuaagcggaguggagggggaggggcugcacaagcugggguacauccuccgggacaucagcaagauccccgguggcaacauguacgcggacgacaccgccgggugggacacgcgcauaaccgaggacgauuuacagaacgaggccaagaucaccgacaucauggagccggaacaugcccuacucgccacaucgaucuucaagcugacguaccaaaauaaggucgugcgggugcagaggcccgcuaagaacggcaccguaauggacgugaucagccgccgggaccagcguggcuccggucaggugggaacuuauggucugaacacuuuuacgaacauggaggcccagcucauccggcaaauggagagcgagggcaucuuucuacccagugagcucgagacuccuaaccucgccgagcgcguacuugauuggcuggaaaaguauggcguggagcggcucaagcgcauggccaucagcggugacgauugcguggucaagccgaucgacgaccgguucgcuaccgcgcugaccgcccugaacgacauggggaaggugagaaaagacauuccccagugggagcccuccaagggcuggaacgacuggcagcagguccccuucugcagccaucacuuccaccaauugaucaugaaggacggccgggagaucguugugcccugccgcaaccaagaugaacugguagggcgggcccgaguuucccagggugccggguggaguuugcgagagacggccugccuaggcaagagcuacgcucagauguggcaacugauguacuuccaucgccgggaucugcgccucgccgcgaacgccaucugcuccgcggugccaguggacuggguuccaacaagccggaccaccugguccauucaugcccaccaccaauggaugacaaccgaggacaugcuuagcguauggaaccgcgucuggaucgaggagaaccccuggauggaggauaagacccacgucuccucauggggcgacgugccguaccugggcaagcgggaggaccaauggugcggcuccuugaucggguugaccgcccgcgccaccugggccucuaacauccagguggcaauaaaccagguccgcagacugaucggcaacgagaauuaccucgacuacaugacuuccaugaagagguuuaagaacgaaggcgaccccgagggggcccugugguga

SEQ ID NO: 24363 - RNA, 9879 nt, Artificial Sequence
  derived and/or modified CDS sequence (opt11) from DENV-1__FJ898393__SS-prME
aguguuaccaugcuucucaugcugaugcccaccgcccuggccuuccaccuaacgacccgcggcggggagccucacaugaucgugaccaagcaggagaggggcaagagccugcuauucaagaccagcgcgggggugaauaugugcacgcucaucgccauggaccuaggcgaguuaugcgaagauacgaugacuuacaaaugcccccggaucaccgaggcggagcccgacgacgucgacuguuggugcaacgccaccgacacgugggugaccuacgggacaugcagccagacgggcgagcaucggcgcgauaagcggucagucgcccucgcuccccacgucgggcugggguuggagacccgcaccgagaccuggauguccagcgagggcgcguggaagcaaauucagaggguagaaacuugggcccuucgucauccuggguucacagugauugcccuguucuuagcgcacgcgauaggcaccaguaucacucagaaggggaucaucuuuauccugcugaugcuggugacccccagcauggcuaugcggugcgucggcaucggcucccgcgacuucguagaggggcuaagcggcgccaccuggguggacgucgugcuggagcacgguuccugugugaccaccauggccaaggacaagcccacgcuugacaucgagcuccugaagacugagguaaccaaccccgcggugcuucggaaguuguguauagaggccaaaaucuccaauaccacgacggacucccgcugccccacccagggcgaagccacccugauggaggaacaggacgcuaacuucgugugccggcgcacguucgucgaccgcggcuggggcaacggcugcgggcuguucggcaaggggagucucauuaccugcgccaaguucaagugugugaccaagcuggagggcaagauaguacaauacgagaaccugaaguacagcgucaucgugaccguacacacgggcgaccagcaccaggucgggaacgagucuaccgagcacggcaccaccgcaaccaucacgccccaggcccccacguccgagauccagcucaccgacuacggagccuugacccuggacuguagcccccgcacgggacucgacuucaaugagauggucuuacugaccaugaaggagaaguccuggcucguccacaaacagugguuucuggacuugccgcuccccuggaccagcggggcgagcaccucccaggaaacguggaacaggcaggaucuacuggugaccuucaagacagcccacgcgaagaagcaagagguggucguccucggaagccaggagggggccaugcacaccgcccugacgggggccacggagauccagaccuccggcaccacgaccaucuucgccgggcaccugaagugccgccucaagauggauaagcugacccugaagggcaugagcuacgugaugugcaccggguccuucaagcuggagaaggagguggccgagacgcagcaugggacggugcugguacagaucaaguacgaggguaccgacgccccuugcaagauccccuucucgacccaagacgagaaaggugugacgcagaacggccggcuuaucaccgccaacccgaucgucacugacaaggagaagcccgucaacaucgaggccgagccgcccuucggagaguccuacaucguuaucggggccggcgagaaggcccugaagcucagcugguucaagaagggguccagcaucggcaaaauguucgaggccaccgcccgcggggcccggcgcauggcgauucugggugacacagccugggacuucggguccgugggugguguguuuaccagcgucgggaagcuggugcaucagaucuucggcacugccuacggaguccuguuuuccggggucagcuggaccaugaagaucgguaucggcgugcugcugacguggcucggccucaacuccaggagcaccucccugagcaugaccuguaucgccguggggcucgucacucuguaccugggugugauggugcaagccgacuccgggugcguaaucaacuggaagggccgggagcucaagugcggaagcggcaucuucgugaccaacgaggugcacaccuggaccgagcaguacaaguuccaagcggacagcccgaaacgccuuuccgccgccaucggccgggccugggaggaaggggucugcggcauccgcuccgccacccggcuggagaacaucauguggaagcagaucuccaacgagcucaaccacaucuugcuggaaaacgacaugaaguucaccguggucgucggggacguggugggcauuuuggcgcaggggaagaagaugauccgcccucagcccauggaacacaaguauucuuggaagagcugggguaaggccaagaucaucggugccgacguacagaauacgaccuucaucauagacgggccgaauaccccggaaugccccgacgaccagcgggccuggaacaucugggaaguggaggacuacggcuuuggaauuuucaccacgaacaucuggcugaaacugcgcgauagcuacacccaggugugugaccacagauugauguccgcggccaucaaggacagcaaggccguccacgccgacaugggguacuggauagaguccgagaagaacgaaaccuggaagcuagcccgcgcgagcuucauugaggugaagaccugcaucuggcccaagucccacacuuuauggagcaacggcgugcucgaguccgagaugaucauaccgaagaucuacggggggccgaucucgcagcacaauuaccgccccggguacuuuacccagaccgccggacccuggcacuugggaaagcuggagcucgacuucgaucugugcgaggggaccacggucgugguggacgaacacugcggcaaccgugggccgucuuuacggacgacuaccgucacuggcaagaucauccacgaguggugcugccgcagcuguacccuuccgcccuugcgauucaagggcgaggauggcugcugguacggaauggagauccgccccguuaaggaaaaggaggagaaucuggugaaguccauggucucggccggcagcggggagguugacuccuucagccucggccuacugugcaucucaaucaugauagaggaggugaugcggagccgcuggucccggaagaugcucaugacgggcacccuggcggucuuucugcugcugaucauggggcaacugacauggaacgaccucauucgccugugcaucauggucggcgccaacgcgagcgaccgcauggggaugggaaccaccuaccuggcacuuauggccaccuucaagaugcggccgauguucgccgucggccuuuuauuucgccgguuaacguccagggagguacugcugcucaccaucgggcugucgcuaguggccagugucgagcuuccaaacagccuggaggagcugggcgacgggcucgcgaugggcaucaugaucuugaagcugcucaccgauuuccagucucaccagcugugggcaacccugcucagccugacguucaucaagaccacccuaucccuccacuacgcuuggaagaccauggccaugguguuaagcaucgcgucucuuuucccucugugccuaucuacgaccucccaaaagacaaccuggcugcccguguuacugggcagcuuagggugcaagccgcugacgauguuccuuaucacagagaccaagaucuggggccguaaguccuggccccugaaugaggguaucauggccgucggcgugguguccauccuccugagcucccuucucaagaacgacgucccccucgcggggccccugaucgccggcggcaugcucaucgccugcuacgugaucagcgggagcagcgcggaccugucccuggagaaggccgccgaggugucaugggaggaggaggccgagcacucgggcgccagccacaacauccucgucgugguucaggacgacgggaccaugaagauaaaggacgaggagcgcgacgauaccuuaacgauacugcugaaggccacgcugcuggccgucuccggcguguacccgcucaguauccccgccacacuguucgugugguacuucuggcagaagaaaaagcagcgguccgggguccugugggacacccccagcccgcccgaaguugagcgcgcagugcuggacgacggcaucuaccguaucaugcagcgcggccuccuggggcggucccaggucggcguggggguguuucaggagaacgucuuccacacaauguggcacgugaccagaggggccgugcugauguaccaggguaaacggcucgagcccagcugggcguccgucaagaaggaccugaucagcuacggcggcgguuggcgccugcagggcuccuggaacacgggcgaggagguccaagugaucgccgucgaacccggaaagaaucccaaaaacgugcagaccgcuccggggacuuucaaaacccccgaaggggaggugggcgccaucgcccucgacuucaagcccggaaccuccggcucccccaucgucaaccgggaggggaagaucgugggucuguacggcaacgggguugucaccacgagcggcaccuacguuagcgcgaucgcccaggccaaggccucccaggaggggccgcugccagaaaucgaggacgagguauuccgcaagcggaaccuuaccauaauggaccugcaucccggcagcgggaagacgcgacgguaccugccagcgauuguccgcgaggccaucaaacggaagcuccgcacguugauccuggccccaacccgcguggucgcgagugagauggccgaggcgcucaagggcaugcccauccgguaccaaaccacggcggucaaguccgagcacacgggaaaggaaauaguggaccugaugugccacgccaccuucaccaugcgccugcucucccccgugcgcgucccgaacuauaacaugaucaucauggacgaggcccauuuuaccgacccgagcuccauugcugcuaggggguacaucagcacacgagugggaaugggggaggccgccgccaucuucaugaccgccacgccgccuggcuccguugaggcguucccgcagagcaaugccgucauacaggacgaggagagagauauucccgagagauccuggaacagcggguacgaguggaucaccgacuuccccggcaagacugugugguucgugcccuccaucaagagcggcaacgacauagccaacugccugcguaagaacgggaagcgggucauucagcugucccgcaagaccuucgacacugaguaccaaaagaccaagaacaacgauugggacuacguggucaccaccgacaucagcgagaugggcgccaacuuccgggcggaccgcguaauugacccgcggcgaugucucaagcccgugauccugaaggacgggcccgagcggguaauccuggccggcccaaugccagugacggucgcguccgcagcccagagacgggggcgcaucggccggaaccacaacaaagagggagaccaguacauuuacaugggucaaccccucaauaacgacgaggaccacgcgcacuggaccgaggccaagaugcugcuugacaauaucaauacgcccgagggcauaauccccgcccucuucgagccagagcgcgagaaguccgccgccaucgacggggaguaccgccugagaggugaggcgaggaagacguucguagagcugaugcgucgcggugaccuccccguguggcuguccuacaagguggccagugaaggcuuccaguacucggaccggcgcuggugcuucgacggcgagcggaacaaccagguccuggaggaaaacauggacguggaaaucuggaccaaagagggggaacgcaagaagcugcggccccgcuggcuggacgcucggacauacuccgacccccuggcacuccgcgaguucaaggaguucgccgcgggccgucgguccguguccggggaccuaauccuggagaucggcaagcucccgcagcaccugacgcagcgugcccagaacgcccuggacaaccucgugaugcugcacaacagcgaacaggggggcagagcuuaccggcacgcuauggaggagcugcccgacacuaucgagacccucaugcugcuggcccucaucgccgugcugaccggcggggugacccuguucuuccucuccggccgcgggcuuggcaagacgagcaucggccugcucugcgucauggccuccagcgugcugcuguggauggccuccguggagccccacuggauugcggcgagcaucaucuuagaguucuuccugaugguacugcucauccccgaaccggaccggcagcgcacgccccaggauaaccagcuggccuacguggucaucggguuacucuucaugauacugaccgucgccgccaacgaaaugggccuccucgagaccacuaagaaggaccuggggauaggccacguggcgguggagaaccaccaccacgcgaccaugcuggacgucgaccuccaccccgcauccgccuggacccuguacgccguggcuaccacgaucauuaccccgaugaugcggcacaccaucgagaacaccacggccaauaucagccugaccgcuauagccaaccaggccgcgauccugaugggucuggacaagggcuggcccaucuccaagauggacaucggugugcccuugcucgcccuggggugcuacagccaaguuaacccccugacacucaccgccgccguacugaugcuggucgcgcauuacgccauuauuggcccugggcugcaggccaaagccacaagagaggcucaaaagcgcaccgcggccggcaucaugaaaaaccccaccgucgaugggauagucgccauagaucuggaccccguggucuacgacgcuaaguucgaaaagcagcugggccaaaucaugcuccugauccugugcaccucccagauccuccugaugcgcacgaccugggcccucugugagagcaucacccucgcgaccggcccccugacgacccugugggagggguccccgggcaaguucuggaacaccaccauagccguaagcauggccaacaucuuccgcggauccuaccuagcuggcgccggccuggcguucagccugaugaaaucccucgggggcgggcggcgcggaacaggggcccaaggcgaaacccuuggcgagaaguggaagcggcagcugaaccagcucuccaaaagcgaguuuaacaucuacaagcgcuccgggaucauggagguggaccguagcgaggccaaagagggcuugaaacguggggagaccacacgucacgccgucucccgcggcacggcgaaacugcguugguuuguggagcgcaaccuggugaagcccgaagggaaagucaucgaccucggcugcggccgcggcggguggagcuacuauugcgccgggcugaagaaggucaccgaggucaagggguacacaaagggcgggcccggccacgaggagcccauccccauggcaaccuacggguggaaccuagucaagcuacacuccggcaaggacguuuuuuucacgccgcccgagaagugcgacacccugcugugcgacaucggggaguccucccccaauccgaccaucgaggagggccgcacccuccggguccucaagauggucgagccuuggcugcgcgggaaucaauuuugcaucaagauacucaaucccuauaugcccagcgugguagagacuuuagagcagaugcagcggaagcacggcggcaugcugguaaggaacccgcucucccggaacucgacgcacgagauguacuggguguccugcgggaccggcaacaucgucagcgccgucaacaugaccucgcgcaugcugcuaaaccgcuucaccauggcgcaucggaaacccacguacgaacgcgacguggaccucggugcaggcacgagacauguugccgucgaacccgagguugccaacuuagacaucaucggccagcggaucgagaacaucaagcacgagcauaagagcaccuggcacuaugacgaagacaaucccuauaaaaccugggccuaccacgggucuuacgagguuaagccgagcggcuccgccagcucaauggugaacgggguaguaaagcuccucacgaagcccugggacgugauucccauggugacccaaaucgcgaugaccgacacaacaccuuuuggccagcagcgggucuuuaaagaaaagguggacacccgaacaccgaaagccaaacgggggaccgcgcagauuauggaggugacggcgcgcuggcuguggggcuuccugucacguaacaaaaagccccgcaucugcacccgggaggaguucacccgcaagguccggagcaacgcggcgaucggcgccguguucgucgacgagaaucaguggaauuccgccaaggaggcuguagaggacgagcgcuucugggaccucgugcagaaggagcgggagcugcacaagcaggggaaaugcgcgaccugcguguacaacaugaugggcaagcgcgagaagaagcugggggaauucggcaaggccaaggggagccgcgcuaucugguacaugugguugggcgcccgcuuucuggaguucgaggcccucggguucaugaacgaagaccacugguucucccgggagaacagccucuccggggucgagggugaggggcugcacaagcugggcuacauccuccgcgauaucagcaagauuccuggcggcaacauguacgcggaugacacggccggcugggacacccggaucaccgaggacgaccugcaaaacgaggccaagauuaccgacaucauggaaccggagcacgcccugcuagcgacguccaucuucaaacugaccuaccaaaacaaaguggugcgcguccagcgccccgcgaagaacggaaccgugauggacguuaucagucggagggaccagcggggcucugggcaggucgggaccuacggccucaacacguucaccaacauggaggcacagcucauccgccagauggaguccgaggggaucuuccuaccaagugaguuggagaccccgaaccucgccgagcggguguuagacuggcuggagaaguacggcguggagcggcugaaacggauggccaucagcggagacgacugcgucgugaagccgaucgaugaccgcuucgcuaccgcgcugacggcacugaacgacaugggcaaggugcggaaggacaucccccagugggagcccuccaagggguggaaugauuggcagcagguccccuucugcucacaccauuuccaccaacucaucaugaaggauggccgcgagauuguggugccgugccggaaucaggacgaacuggucggcagagcaagaguaagccagggggccggcuggagccugcgugagacggccugccucggcaaaagcuacgcgcagauguggcaacugauguauuuccaccgacgcgaccugcggcucgccgccaaugccaucugcuccgcggugccggucgacugggugccuacuagccguaccacgugguccauccacgcccaucaccaguggaugaccacggaagacaugcugucgguguggaacagggucuggaucgaagaaaaccccuggauggaggacaagacccacguguccucuuggggcgacgugccuuaccuggggaagcgcgaggaccaguggugcggcucacucaucggccugacggcccgcgccacuugggccaguaauauccaggucgcuaucaaccaagugcggcgccugaucggaaacgagaacuaccucgacuacaugaccuccaugaagcgguucaagaacgagggcgaucccgagggggcccugugguga

SEQ ID NO: 24364 - RNA, 9879 nt, Artificial Sequence
  derived and/or modified CDS sequence (opt11) from DENV-1__FJ898394__SS-prME
agcgugaccaugcuguuaauguugaugcccacagcgcuggccuuucaccucaccacccgggggggugagccgcauaugaucgugaccaaacaggagagaggcaaguccuugcucuucaagacgagcgccgggguaaauaugugcacccucaucgccauggaucuaggcgaguugugugaggauaccaugaccuauaagugccccaggaucacugaggcagagcccgaugacguggacuguugguguaaugccaccgacacguggguaacuuacgguacauguagccagaccggcgaacauagacgcgacaagcggagcguggccuuggcgccccauguuggccuggggcuggagacgagaacagagaccuggaugaguuccgaaggugccuggaagcagauccagcggguggagaccugggcccuuaggcauccgggguucaccgugaucgccuuauuccuggcacacgcaaucggcacuuccaucacacagaaggggaucauauucauccuccugauguuagugacgcccagcauggcaaugagaugcguaggcaucggaucucgcgacuucguagaggggcucucgggcgcaaccuggguggaugucgugcuggaacauggcuccugcgugaccaccauggccaaggacaagccaacgcuggacauagaacuccugaagaccgagguaaccaaccccgcggugcugcggaagcuuugcaucgaggccaaaaucuccaacaccacaacagauucucgcugcccgacgcagggcgaggcuacucugauggaggaacaggacgccaacuucgugugucggcgcacguuugucgacagaggcugggggaacggaugugggcuguucggcaaagguucacucauuacgugcgccaaguucaagugcgugaccaaguuagagggcaaaaucgugcaguacgagaaccugaaguacucagucaucgugaccgugcacaccggcgaucagcaucaggucggaaacgagucuacggagcauggcaccacagcuacgauaacgccccaagcccccacauccgagauccaacucaccgauuacggcgcccugacccuggauugcagcccucgcacgggacucgacuucaacgagaugguccugcugaccaugaaggaaaaguccugguuaguccauaagcagugguuucuggaucugccauuacccuggacaagcggggcaucaacgccacaggaaacuuggaaccggcaggaucuuuugguaaccuuuaagaccgcccacgcgaagaagcaagagguggucguacuaggcucccaagagggcgcuaugcacacugcucugaccggugccacggagauccagaccucgggcaccacgaccauauucgcugggcaccugaagugccggcucaagauggacaaacuuacccuuaagggcaugucguacgucaugugcaccgguucauucaagcucgagaaggaggucgcggagacgcagcacggcaccguucuggugcagaucaaauacgagggcaccgacgcacccugcaagauuccauucaguacgcaagacgagaagggggugacccagaacggccggcugauaaccgcaaaccccaucguaacggacaaagagaagcccguaaacaucgaggccgagccucccuucggcgagucguauauagugaucggcgcgggggagaaagcccuaaaacucuccugguucaagaaagggagcuccauaggcaagauguucgaagcuacggcacgcggagcccggcgcauggcaaucuuaggcgacacggccugggacuuuggcagcauaggcggcguguucaccuccguggguaaauugguccaccagaucuuuggcaccgcuuacgggguucuguuuucgggcguauccuggaccaugaagaucggaauuggcgucuuauugacguggcucggccugaacucacgcucgaccagccugagcaugacuuguaucgccguggggcucguuacacuguaucugggcgucauggugcaggcggacucgggaugcgugaucaacuggaagggccgcgagcuuaaguguggaagcggcaucuucgucacgaacgagguccacaccuggacagagcaguacaaauuccaggccgauagcccuaagcggcucuccgcagcgaucggcaaggccugggaggagggggucugcggcauccgguccgcgacacgccuggagaacaucauguggaaacagaucagcaacgaauugaaccacauccugcuggagaacgacaugaaguucaccgucguggucggggacguggugggcauauuggcacaggggaagaagaugauaagaccucagccaauggagcacaaauauucauggaaguccuggggcaaggcgaaaaucaucggcgccgaugugcaaaauacgacauuuaucaucgaugggccaaacacccccgaaugcccggacgaucagcgagcauggaauaucugggagguggaggacuacggcuucgguauauucacuaccaacauuuggcugaagcugcgggauuccuacacacaagugugugaucaucgauuaaugagugcugcuaucaaagacagcaaggccgugcacgccgacaugggcuacuggaucgagagcgaaaagaacgagaccuggaaauuagcccgggcgucauucauugaggucaagaccugcaucuggccaaagucacacacgcugugguccaacgguguguuagagagcgagaugauuauaccgaagaucuacggcggacccauaucccagcauaauuaucgccccgguuacuucacacagaccgcaggaccauggcaccuggguaagcuagagcucgacuucgacuuaugugagggcaccacuguagucguggacgagcacuguggcaaucgggggcccucacugcgcacgaccaccguuacaggcaagauuauucaugaguggugcugucgguccuguacccugccuccuuuacgguuuaagggugaggacgggugcugguacggaauggagauacggccagucaaggagaaggaggagaaccuggucaagucaauggugagcgccgggagcggcgaggucgacagcuuuucccucgggcuacugugcaucucgauaaugauugaagaaguuaugagaagccgguggagccgcaagaugcucaugaccgggacucuggcgguguuucugcuccugauuauggggcagcugacguggaacgaccuaaucagauuaugcauaauggucggggccaacguuagcgaccgcauggggaugggcaccaccuaucuggcucucauggccacauucaaaaugaggcccauguucgcggugggacuguuguuccggcguuugaccagucgggagguccugcuucucaccaucgggcugucccugguggccagcgucgagcucccuaacucccuugaagagcuuggcgacgggcuugcgauggggaucaugauccugaaacugcucacugacuuucagagccaucaacugugggccacgcugcucuccuugacguuuaucaagaccacauugagccuccacuacgccuggaagaccauggcuaugguacuguccauagugucguuauucccacucugcuuauccacgacaagccagaagaccaccuggcuacccgugcuccuaggcucccucgggugcaagccauugacgauguuccuuaucgccgagaauaagaucuggggucgcaaguccuggccccugaacgaggggaucauggcugugggcgucgucuccauacugcucagcucauugcucaaaaacgacgugccccuggcggggccgcuaaucgcaggcgguaugcucaucgcaugcuacgugaucucggggagcucggccgaccugagcuuagagaaggcggccgaagucuccugggaggaggaagccgagcacagcggcgcgucccacaauauacuuguggaggugcaggacgacgguaccaugaagaucaaggacgaggagcgggaugacacccugacuauauuacuaaaggccacacuccuggcgguuagcggcgucuaucccuuauccauccccgcuacccucuucgugugguacuucuggcaaaagaagaagcaacgcagcggggucuugugggacacccccuccccacccgaaguggagcgugcaguacucgacgacgguaucuaccgcaucaugcaacggggccuucuggggcggagccaggucggcguagggguguuucaggagaauguguuccacacuauguggcacgugacccguggcgccguauugauguaccagggcaagcggcucgagcccucuugggcgagcgucaagaaggaucuaaucuccuacggcgguggguggcgguuacaaggcagcuggaacacgggugaggagguccaggucauagccgucgagcccggcaagaacccgaaaaacgugcagacagcuccagggaccuucaagacacccgagggcgagguuggcgcgaucgcacuggacuucaagcccgguacauccggcagcccgaucgucaaccgggaagggaaaauagugggccucuaugguaacgggguugucacuaccuccggcaccuacgugagcgccaucgcgcaggccaaagcgagccaggaagggccgcuucccgaaaucgaggacgagguuuuucggaagcgaaaccucacgaucauggaccugcacccgggcuccggaaagacacgccgcuaucuucccgccaucgucagagaggcgauaaagcgcaagcuccggacccugaucuuagccccaacccgcgugguggccagcgagauggccgaggcccucaagggcaugccaauccgauaccagacaacugccguuaaguccgagcacaccggcaaggagaucguagaccugaugugccacgccacauucaccaugcggcugcucagcccgguacguguccccaacuacaacaugauaauaauggacgaggcccacuucaccgaccccucgagcaucgcagcccggggguauaucucaacccgcgugggcaugggggaggcagcggccaucuucaugaccgcaacgcccccuggcuccguggaagccuucccccaauccaaugccgucauccaagacgaggaacgagacauuccugagagauccuggaacuccggcuacgaauggauuaccgacuuuccgggcaagacagugugguuugugccgagcaucaagagcggcaacgauaucgccaacugccugaggaagaacgguaagcgcgucauccagcuuucgcgcaagacauucgauaccgaguaccagaagaccaagaacaacgacugggauuauguggugaccaccgacaucagcgagaugggcgcuaacuuuagagcagaucggguaaucgauccuaggaggugccucaagcccgugaucuugaaggacgguccugagcgcgugauccuggcgggcccgaugccggugacgguggccucagccgcccagaggcgcgggcggaucggccggaaucacaacaaggagggcgaucaguacaucuauauggggcagccccucaacaacgacgaggaccacgcccacuggaccgaggcaaaaaugcugcuggauaauaucaauacccccgagggcauuauccccgcccucuuugagcccgagcgggagaagucugccgccaucgacggggaguaucgccugcgcggggaagcccggaaaaccuucgucgaacuuaugcgccgcggggaccuccccguguggcuuucauacaagguagcguccgagggguuccaguauagcgaccgccgcuggugcuucgacggcgagagaaacaaccagguccuggaagaaaacauggacguagaaauauggaccaaggagggggagcggaaaaaguuacgcccgcguuggcuagacgcucgcacuuacagcgauccucuggcacuccgggaauucaaagaguucgccgccggccgccgauccguaagcggggaccugauccuagagaucggcaaauugccacagcaccugacccaacgcgcgcagaacgccuuggacaaccucgucauguugcauaacuccgaacaaggggggcgggcuuaccgccacgccauggaggaauugccugacaccaucgagacucuaaugcuguuggcacucaucgcuguccugaccggcgggguaacccucuucuuucucagcgggcgggggcuugggaaaacgucaaucggucugcugugcgucauggccagcuccguucuccuguggauggcuagcguggagccgcacuggaucgccgcguccaucauccucgaauucuuccugauggugcugcugauaccugaacccgaucgucaacggacgccucaagacaaccagcuggccuacguaguuauagggcuccuguucaugauacugacagucgcagccaacgagaugggccuucucgagacaaccaagaaggaucugggaauugggcauguggcagucgaaaaccaucaccacgcgaccaugcuggacguggaccuccauccagccucagcuuggacgcucuacgccguggccaccaccaucaucaccccgaugaugaggcacacaauugagaacacgaccgcgaacaucucacugaccgcaauugccaaccaagccgccauacuaaugggguuggacaagggguggcccaucagcaaaauggacaucggcgugccccugcucgcgcucgggugcuacucccaggucaacccacuuacccucaccgccgccguguuaauguugguagcccacuaugcgaucauuggccccggccuccaggcuaaagccacacgggaagcucagaagagaacugcggcgggcaucaugaagaaccccacggucgaugggaucguagccauugaccuggaucccgugguguaugacgcgaaguucgagaagcagcuuggccagaucauguuguuaauucugugcaccagucaaauacuccugaugcgcaccaccugggcccugugcgaguccauuacacuggccacagggccgcugaccacauuaugggagggcuccccuggcaaauucuggaacacgaccauagcggugagcauggccaacaucuucagggggucauaccucgccggagccggcuuggccuucucguuaaugaagucacucgggggcgggcgccggggcacgggcgcgcagggggagacccugggugagaaauggaaaagacagcuaaaccaacugagcaaguccgaguucaacaucuacaagcggagcggcauaauggagguagauagguccgaggccaaggaaggucugaaacgcggggagacgacccgucacgcagugucucggggcacggccaagcugagaugguucguggagcggaaccugguaaaaccugagggaaaggucaucgaccucggguguggccgcgguggcuggaguuauuauugcgcgggacuaaagaaggugaccgagguuaaaggcuacacaaagggaggacccggccacgaagagccgauccccauggccaccuacggguggaaucuagucaaacugcauagcggcaaggacguguuuuucacgccgcccgaaaagugcgacacccugcugugugacauuggggaauccuccccgaaccccacuaucgaggagggccggacccugcgugugcugaaaauggucgaacccuggcuucgggggaaccaguucugcauaaaaauccucaaucccuauaugccguccgugguggagacccuggagcaaaugcagcgcaagcacggaggaaugcuaguccggaauccccuaagccgcaacucaacgcacgagauguacugggugagcugcggaaccggcaacaucguauccgccgucaacaugacgucucggaugcugcugaaccgauucacuaugacucaccgcaagcccacuuacgagcgagauguagaccugggggcagggacgaggcacgucgcugucgaacccgagguugcuaaccuagacaucaucggacaacggaucgagaacaucaagcaugagcacaaguccaccuggcacuacgacgaggacaauccauauaagaccugggcauaucauggaagcuacgaagucaagccguccggcagcgccagcagcaugguuaacgggguggucaaacugcuaacaaagcccugggacgugauccccauggugacgcagaucgccaugaccgacaccacuccguucggccaacaaagggucuucaaggagaagguggacacgcgcaccccgaaggcaaagcgcgggaccgcgcagaucauggaagucaccgcccgguggcuguggggcuuucugagcagaaauaagaaaccgcggauuugcacccgcgaagaguucacccggaagguucgcucuaacgcagccaucggcgcuguguucguggacgagaaccaguggaauucagcgaaggaagccgucgaggacgagcgguucugggacuuagugcagaaggagcgcgaauugcacaaacaggggaagugcgcgaccugcguguacaacaugaugggcaagcgggagaagaagcuaggggaguuuggcaaagcgaagggauccagagcgauuugguauauguggcucggggccagguuucuagaguucgaagcccugggcuucaugaacgaggaccauugguucagccgcgagaauucgcucagcggggucgagggggagggucugcacaagcuaggcuacauucuccgugacauauccaagauaccgggugggaacauguacgccgacgauaccgccgggugggauacacguauuacggaggacgaccuucagaacgaggccaaaaucaccgacauaauggagcccgagcacgcccugcuagcaaccagcaucuuuaaacuaacguaccagaacaaggucgugcgcguccaacgccccgcuaagaacgggacaguaauggacgugaucucucggcgggaccagcgcggcagcgggcaggucggcaccuauggcuuaaauaccuucacgaacauggaggcacagcucauacggcagauggaguccgaggguauuuuccugccuagcgagcuggaaaccccgaaucucgcugagcgcguucuugacugguuagagaagcauggcguggagcggcucaagcgcauggccauuuccggggacgacugcgucgugaagcccaucgacgaccgguucgccaccgcccugaccgcacuaaacgacaugggcaaggugcgcaaggacaucccccagugggagcccucaaaaggguggaacgauuggcagcaggucccguuuugcucgcaccacuuccaccagcucauuaugaaggacggccgggaaaucguggucccuugccgcaaccaggacgagcugguggggcgggcgcgaguuagccagggggccggcuggucucugcgggaaacggcuugccucggcaagagcuacgcccagauguggcagcugauguauuuucaccgccgggaccuacgauuagccgccaacgcgauaugcucagccgugccaguggacugggugccgacgucccgaaccaccuggagcauacacgcgcaccaccaguggaugacuaccgaagacaugcuaucuguauggaaccguguauggauagaggagaacccauggauggaagacaaaacgcacgugagcaguuggggggacgugcccuaccuggggaaacgggaggaucaauggugcggcucccucaucggccugaccgcgagggccaccugggcaucaaacauucaggucgccaucaaucagguuaggagacuuaucgggaaugagaauuaccucgacuacaugacuagcaugaagcgguucaagaacgagggcgacccagagggggcccugugguaa

SEQ ID NO: 24365 - RNA, 9879 nt, Artificial Sequence
  derived and/or modified CDS sequence (opt11) from DENV-1__GQ199838__SS-prME
agcgugaccaugcuguuaaugcugaugcccaccgcccuugccuuucaccucacgacccguggaggcgagccccacaugauagugaccaaacaggagcggggcaagagccugcuguuuaagaccucagcgggggugaacaugugcacccucaucgccauggaccuuggggaacugugcgaagacaccaugaccuauaagugcccccgaauaacugaagccgaacccgacgacguggacugcuggugcaaugccaccgacaccugggucaccuacgggaccugcucccagacuggggagcaccggcgagacaagcggagcguggcgcucgcaccccauguuggccugggucuggaaacucgcacggagacguggauguccagcgagggcgccuggaagcagauccagcgggucgagacgugggcacugcgccaccccggauucacgguuaucgcgcuguuccucgcacacgcuaucggcacgagcaucacccaaaaagggaucauauucauucuccugaugcuggugacgcccagcauggcaaugcggugcgugggcauaggcucacgcgacuucguggaaggguuaucaggcgccaccuggguggaugucgugcuggagcacgggucgugcgugaccaccauggccaaggacaagcccacgcuggacauagaacuccugaaaaccgaggucaccaaucccgcagugcugcguaagcucugcauagaggccaaaauaucgaacaccacgaccgacucccgcugccccacucagggagaggccacgcugauggaggaacaggacgccaacuucgugugccgacggacgcuggucgaccggggcugggguaauggcugcgggcuguucgggaaggggagccugaucacgugcgccaaauuuaaaugcgugaccaaguuggagggcaaaaucguucaauaugagaaccucaaauacagugucaucgugacaguacauacgggcgaccagcaucaaguggggaacgagagcaccgagcacgggaccaccgcuacuauuacaccccaagcgcccaccuccgagauccaguuaaccgacuauggggcucugacccucgacugcaguccccgaacgggccuggacuucaaugagauggugcuucugaccaugaaggagaaguccuggcugguccacaagcagugguuccuggaucucccacugccguggaccagcggggccagcaccagucaagaaacguggaacaggcaggacuuacuggugaccuucaaaaccgcucacgcaaagaagcaagagguggucguucugggcucacaagagggcgccaugcacacagcccugacgggugccacugaaauccagaccuccggcacgacgacgauauucgcaggccaucucaagugucgccugaagauggacaagcugacccuaaagggcaugagcuacgucauguguaccgggucuuucaagcuggagaaggagguggcggagacgcaacauggcaccguauuagugcagauuaaguacgagggcaccgacgccccgugcaagauccccuucagcacucaggaugagaaaggcguaacucaaaacggccggcugaucacggcaaauccaaucgugacagacaaggagaagcccguaaauauagaggccgagccgcccuuuggagaguccuacaucgucaucggcgcgggcgaaaaggcccucaagcuaaguugguucaagaaagggucaagcauaggaaagauguucgaggcgaccgcacgaggggcccgccgaauggcgauccugggcgacacagcaugggacuuugguagcaucggcggcguuuucacaagcguugggaagcucguccaucaaauauucggcacugcauauggggugcuguucagcggcgugagcuggaccaugaagaucgggauuggcguccugcucacguggcugggccuaaauucccgcaguacgucacucuccaugaccugcaucgcgguggggcuggugacccucuacuuaggcguuauggugcaggcggacuccgggugcguaaucaacuggaagggccgggagcuuaaaugugggagcggcaucuuugucacuaacgaggugcacaccuggacugaacaguacaaguuccaggcggacagcccgaagcgccuaucugccgcaaucggcaaagccugggaggagggggugugcgguauccggagugcgacccgacuugagaauaucauguggaaacagaucucgaaugaacugaaccacauccugcucgagaaugggaugaaguucacagucguggugggcgacguagugggaauccuggcucagggcaaaaagaugauccgaccccagcccauggagcacaaauacaguuggaagucguggggcaaggccaagaucaucggcgcagacguccaaaacacuacguucauaauagauggcccgaacacuccugagugccccgacgaccagcgcgccuggaacaucugggaggucgaggacuacggcuucggcaucuucaccacgaauaucuggcugaagcucagggacagcuacacacaggugugugaccaccgccuuaugucugcugcuaucaaggacaguaaggccgugcacgccgacaugggguacuggaucgaguccgagaagaacgagaccuggaagcuggcccgcgcgaguuucauugaagucaagaccugcaucuggcccaagucccacacgcucuggucgaacgggguacuggaguccgagaugaucauacccaagaucuacggcgggccgaucagccagcauaacuaccgccccgguuacuucacccagaccgccgggcccuggcaccugggcaaacuugaguuggauuucgaucugugugagggaaccaccgugguaguagacgagcacugcgggaacagaggaccgucccuccgcaccaccacagugacaggaaaaaucauccacgaguggugcuguagaucaugcacccugccaccccugcgcuucaagggcgaggacggcugcugguacgggauggagauccggcccguuaaagaaaaagaggagaacuuagugaaguccaugguguccgcgggcagcggggaggucgauucauucucccucggcuugcucugcaccucgauaaugauugaggaaguuaugcgcucccggugguccaggaagauguuaaugacugguacuuuggccguguucuuacuccucaucaugggccagcucaccuggaacgaucuaauccgucucugcaucauggucggggcaaaugcgucagaccgcaugggcauggguacaacguacuuagcccugauggccacuuucaagaugcgcccuauguucgccgugggccuauuauuccggcgccuuaccucaagggaaguuuuacuccugaccaucggccugucucucgucgccuccguggagcuccccaauucucuagaggaguuaggggacggacuggccaugggcaucaugauccugaaguugcugaccgauuuccagucgcaccaguuaugggccacgcuccucagccugaccuucaucaagaccacccuuucccugcauuacgcuuggaagacgauggccaugguccugagcaucgugucccucuuuccccugugccugagcaccaccagucagaaaaccacuuggcuccccguguuacuuggaagccucggcugcaagccucugaccauguucuugaucgcggagaauaagaucugggggcgcaaauccuggcccuugaacgaaggcaucauggccgugggggugguguccauccugcuaagcucauuacugaagaacgacgucccccuugccgggccgcucaucgcgggcgggaugcugaucgccugcuacgucaucucaggcuccucagcggaucucucccuugaaaaagccgcggaggugagcugggaggaagaggccgaacacucaggagccagccacaauauacucgucgagguacaggaugacggcacgaugaagaucaaggacgaggagcgggaugacaccuugaccauccuccugaaggcgacgcuacucgcgguguccgggguguacccucucucuauccccgccacccuguucgugugguauuuuuggcaaaagaagaaacagcgcuccggugugcugugggacaccccuaguccacccgaggucgagcgcgcgguacucgacgauggcaucuacagaaucaugcagcggggucugcugggcaggucccaggugggagucggcguuuuccaggagaacguguuccauacaauguggcacgucacgagaggggccgugcucauguaccaaggcaagcgccuggagcccagcugggcguccguuaagaaagaucugaucagcuauggcgggggcuggaggcuacagggcuccuggaacaccggcgaggagguccaaguuaucgccgucgagcccggcaagaaccccaaaaacguccagacggcgcccggcaccuucaagacgccagaaggcgagguaggggccaucgcccuggacuucaagccgggcaccagugggucccccaucgugaaccgcgagggcaagaucgucgggcuguacgggaacggcguggucaccaccagcgggacguacgucagcgcuaucgcccaggccaaggccagccaggagggaccguuacccgaaaucgaggacgagguguuccggaagcggaaucucacuaucauggauuugcacccgggcucgggcaagaccagacgcuaccugccggcuaucgugcgggaggccaucaagcgcaagcugcggacccugauccuggccccgacgagggucguugcuagcgagauggccgaagcgcuaaagggaaugcccauccgauaucagaccaccgccgucaaguccgagcauacggguaaggagaucgucgaccugaugugucaugcaacguucaccaugcgguuacugucaccagugcguguaccgaacuacaacaugaucaucauggacgaggcccacuucaccgaccccagcuccaucgccgcccggggcuacaucagcacccgcgucggaaugggcgaggccgcugccauauucaugaccgccacgccgccuggguccguggaggcguucccgcagagcaacgcaguaauccaggacgaggagcgggacaucccagaacgcuccuggaacucgggguaugaguggaucaccgacuuucccgguaagaccguuugguucgucccuuccaucaagagcggcaacgacaucgcaaacuguuugcguaaaaacggcaaacgagugauacaguuaucccggaagacguuugacacugaguaccaaaagacuaagaacaacgacugggauuacguaguuaccacggacauuagcgagaugggggccaacuuccgcgcggaccgggugaucgacccccgccggugccugaagcccgucaucuugaaggauggccccgaacgggugauacucgccgggccaaugcccguuaccguggccuccgccgcccagcggcgaggccggaucggacguaaucacaacaaagagggggaccaguacaucuacaugggccagccccugaacaacgacgaggaccacgcucauuggaccgaggccaagaugcugcucgacaacaucaacacgccggaaggaaucauccccgcccuuuucgagccggaacgggagaaguccgccgcaaucgauggcgaguaccgccugagaggggaagcgcggaagacauucguagaguuaaugcgccggggcgaccugcccgucuggcugaguuacaagguggcgagcgagggauuccaguacucugacaggcgcuggugcuucgacggagagcgcaacaaccaaguucucgaggagaacauggacguugaaauauggaccaaggagggcgaacggaagaaguuacgccccagguggcuggacgcccgcaccuacuccgacccccucgcccugcgggaguuuaaggaguucgccgcggggcgcaggagcgucuccggcgaccugauacucgagaucggcaaacuuccgcagcaccuuacccagcgcgcccagaacgcccucgacaaucuggugaugcugcacaacucugagcagggcggccgggcuuaccgccacgcuauggaagaguugcccgacacgaucgagacacugaugcugcucgcgcugaucgcgguccugaccggcggggugacccucuucuuccuguccgggagaggccugggcaaaacgucgauagggcuccugugcguuauggcuuccagcguccuguuauggauggccuccguggagccccacuggaucgcggccagcaucauccuagaguucuuucuuaugguucuccugaucccggagccugaucgacagcggacgccucaagacaaccaacuggccuacgucguuauuggccuccuguucaucauccugacuguugccgccaacgagaugggguugcuugagaccaccaagaaggaccuggggaucgggcacgucgccguagagaaccaccaccacgccacuaugcucgacguggaccugcaccccgccucagccuggacccuguacgccguugcgaccaccaucaucacgccgaugaugcgccauaccaucgagaacaccaccgccaauauuucucuuacagccaucgccaaccaggccgcuauccugauggggcuagauaagggcuggccuauauccaagauggauaucggagugccccuccuggcccuaggaugcuacagucaggugaacccgcucaccuuaaccgccgccgucuugaugcucgucgcccacuacgcaaucauagggcccggccugcaggccaaggccacccgggaggcacagaaacgcaccgccgccgggaucaugaagaaccccaccguggauggaauugucgccauugacuuggaucccgucguguacgacgccaaauuugagaagcagcuaggacaaaucaugcuucugauccucugcaccucccaaauccuguuaaugaggacuaccugggcccucugcgagagcaucacccuugcuaccgggccacuaaccacgcucugggagggguccccggggaaguucuggaacaccaccauagcugucagcauggccaacaucuuucggggcuccuaccuugccggugcagggcuugcguucagccucaugaagucccuaggaggagggagacgagggacaggcgcgcaaggcgagacgcugggcgaaaaguggaagcgccaacucaaucaguuguccaaaagcgaguucaacaucuacaaacgguccggaaucauggagguggaccggagcgaggccaaagaaggguuaaagcgcggcgagaccacccgccacgcagugucccgggguacagcgaagcugcguugguuuguugagcggaaccucguuaagcccgagggaaaaguaaucgacuugggcugcgggcgcggcggauggagcuauuacugcgcuggcuuaaagaaggucacugaggucaagggguacacuaagggcggccccgggcacgaggagcccauuccgauggccaccuacggcuggaaucucgugaaacuucauuccggcaaagacguauucuuuaccccgcccgagaaaugcgacacgcuccucugcgacaucggggaaagcucccccaauccgacaaucgaagaaggucgaaccuugcgcgugcugaagaugguggagcccuggcuacgggggaaccaauucugcauaaaaauacucaacccguacaugccgagcguggucgaaacccuggagcagaugcagagaaagcauggcggcauguuagugcggaacccgcugagccgcaauagcacccacgagauguacugggucucgugcgguacggggaacaucgugagcgcugugaacaugacgucccggaugcuguuaaaccgcuucacaauggcccaccgcaagcccacuuaugaacgggauguggaccugggcgcgggaacgcgccacguggccguggagccagaggucgccaaccuggacaucaucggucagcguaucgagaacaucaaacaugagcacaaaagcaccuggcacuacgacgaggacaaccccuacaagaccugggccuaccacgguucuuacgaggugaagccaucuggauccgccagcagcauggucaacggcguggugaagcuccugaccaagccaugggacguaauucccauggugacgcaaauagcgaugaccgauaccaccccauucgggcagcagagaguguuuaaggagaagguugacacgcggacaccgaaggcuaagcgaggcaccgcccagauuauggaggugaccgcucguuggcugugggguuuccucucccgcaacaaaaagccccggauaugcacgagggaagaguucacccgcaaggugcgcagcaacgcugcgaucggggccguguucguggaugaaaaccaguggaacuccgccaaggaggccguugaggacgagagauucugggaucugguucagaaggagcgcgagcuccacaagcagggcaagugcgcuaccugcgucuacaacaugauggggaagcgcgaaaagaaacucggcgaguucgggaaagccaaaggcagcagagccaucugguacauguggcucggagcacgguuccuggaguucgaagcccucggguucaugaacgaggaccacugguucucgcgugagaacagccuguccggcguugagggggagggacugcacaagcucggguacauccugcgggacaucagcaagauccccgggggcaacauguaugcggacgacacugccggcugggacacgcgcaucaccgaggacgaccuccaaaacgaggcuaagauuacggacauaauggagccggagcacgccuuguuggccacguccauauucaaguuaacuuaccagaauaaggucguacggguucagcgacccgcgaagaacggcaccgucauggacguuauaagucgucgugaccagcgcggcuccggacaaguuggcaccuacgggcucaacacguuuacgaacauggaagcccaguugauccggcaaauggagagcgagggcauauuccugcccucugaacucgagaccccgaaccuggccgagcguguccuggacuggcuggagaaguacgggguggagagauugaagcgcauggccaucagcggcgaugacugcgucgugaaaccgaucgacgaccgguucgccacagcgcugaccgcauuaaacgacauggggaaggugcgcaaagacaucccccagugggaacccucaaagggcuggaacgacuggcagcagguccccuucugcagccaccauuuucaucagcugauuaugaaagacggcagggagaucguugugcccugcagaaaccaggacgagcugguggggcgggcccgcguuagccagggcgccggguggagccucagagagacagcuugcuugggcaaaucguacgcgcagauguggcagcugauguacuuucaccgccgggauuugaggcuggcagccaacgccaucugcuccgcagugcccguugacugggucccaaccagccggaccaccuggucgauucacgcacaucaccaguggaugacgaccgaagacaugcugagcguguggaaccgcguuuggauagaggagaaccccuggauggaggacaagacucacgucuccucauggggugacgugccuuaccucggcaagcgggaggaucaguggugcggcagucugaucggguuaaccgcccgcgccaccugggccuccaacauccagguggcgaucaaccagguacgccggcugauaggcaacgaaaauuaucuggacuauaugacaagcaugaagagauucaaaaacgagggggaccccgagggcgcccuaugguga

SEQ ID NO: 24366 - RNA, 9879 nt, Artificial Sequence
  derived and/or modified CDS sequence (opt11) from DENV-1__FJ898396__SS-prME
ucgguaaccaugcuuuugauguugaugcccaccgcccuggccuuccauuugacaacgcggggcggggagccgcacaugaucguuacgaaacaggagcguggcaagagccugcuuuucaagaccagcgcggggguuaacauguguacccucauugccauggacuugggugaacugugcgaggacaccaugacuuacaagugcccgcggaucacagaggccgaacccgaugacguagacugcuggugcaacgccaccgacaccugggugacuuacgggaccugcagccaaacuggggagcacagacgcgacaaacggaguguggcccucgcaccccacguaggccuggggcuggagacccgcaccgagaccuggauguccagcgagggcgcguggaagcagauccagcgggucgagacgugggcgcuccgccaucccggguucacagucaucgcccuguuucuggcccacgccaucggcaccuccaucacccagaaggggaucaucuucauccuccugaugcuggucacucccagcauggccaugcggugugucgggaucggcucccgcgacuuuguggagggguuaagcggcgccacauggguggacgucgugcuggagcacggguccugcgugaccaccauggccaaggacaagcccacgcuggacaucgagcugcugaagaccgaggucacgaaccccgcgguccugaggaagcucugcaucgaggccaaaauuagcaacacaacuaccgacucccgcugccccacccagggcgaggccacccugauggaggaacaggacgcuaauuucguuugccggcguacguuugucgaucggggcugggggaacggcugcggucuguucggcaaggggagccucaucacgugcgcaaaguucaaaugcguuaccaagcuggagggcaaaaucgugcaguaugagaaccugaaguacucagucauugugaccgugcacacgggcgaucagcaccaagucgggaacgagaguaccgagcacgguaccaccgcgaccaucacgccccaggcccccacuagcgagauccagcuaaccgacuacggggcucugacccuggacugcagcccccgaacuggccuugauuucaacgagaugguccuguuaaccaugaaggagaagucuugguuggugcauaagcagugguuccuggaucugccgcucccguggaccagcggggcuagcacaucgcaagagacuuggaaccggcaggaccugcuggugaccuucaagaccgcccacgcgaagaagcaggagguggucguguugggcagccaggagggcgccaugcacacugcccugacuggggccaccgagauccagaccagugguaccacgacgauuuuugccggucaucugaagugccgcuuaaagauggacaagcugacucugaaggguaugucguacgugaugugcaccggguccuucaaguuggaaaaggaggucgcggagacgcagcacggaaccgugcuagugcaaauaaaguacgagggaaccgacgcccccugcaagauccccuucagcacccaggacgagaaaggcgucacacagaacgggagacugaucacggccaauccuaucgugaccgauaaagaaaagcccgugaacaucgaggccgagccgcccuucggggaauccuacaucgucaucggcgcgggcgagaaggcccuuaagcucagcugguuuaagaagggguccaguaucggcaagauguucgaggccaccgcccggggugcccgccgcauggcgauccugggcgacacggccugggacuucggguccgucggcgggguuuuuaccagcgucgggaagcugguccaccagaucuucggcacugccuacgggguccuguucuccggggucucguggacgaugaagauagggaucggcgugcugcugacuuggcucgggcugaacucccguagcaccucccugucgaugacaugcaucgccgucggacucguaacccuguaccugggcguuauggugcaggccgacuccgggugcguuaucaacuggaagggccgggaacugaagugcgggucaggcaucuucgugacgaacgaggugcauacuuggaccgagcaguacaaguuccaagcggacagcccgaagcgccuguccgccgccaucggcaaggccugggaggagggggucugcggcauucggagcgccacccgccuggagaacaucauguggaagcagaucagcaacgaacucaaucacauccuucuggagaaugacaugaaguucaccgugguggucggggacguggugggcauccucgcgcaggguaagaaaaugauuagaccccagcccauggagcacaaguacagcuggaaauccuggggaaaggcgaagaucauuggcgccgacguccagaacacuacguuuaucauugaugggccuaacaccccggaaugcccagacgaccagcgcgccuggaacaucugggagguggaggacuacggauuugguaucuucaccacgaacaucugguugaaguuacgggacagcuacacccagguuugcgaucaucgccucaugagcgcggccaucaaggacagcaaggccguccaugccgacaugggcuauuggaucgagucagaaaagaacgagaccuggaaacuggccagggcgagcuucaucgaggugaagaccugcaucuggccuaagucccacacgcuguggagcaauggcgugcucgagagugagaugauuauccccaaaaucuacgguggcccuaucagccagcacaacuaccgccccggguacuucacccagaccgcaggccccuggcaccugggaaaacuggagcucgacuucgaccugugugagggcaccacggucgugguggacgaacauugcggcaaucgggguccgagccuacggacaaccaccgucacgggcaagauaauccacgaguggugcugccggagcugcacccuuccgccucuccgcuucaagggggaggaugggugcugguacgggauggaaauucggcccgugaaggagaaggaggagaaccuggugaaaaguauggucucggccggcucaggcgaaguggacagcuucagccuugggcuguuaugcaucuccaucaugaucgaggaggugaugcgcagccguuggucccgcaagaugcucaugacuggcacccuggccguauuccuacuucuuaucaugggccaguugacguggaacgaccucauccgguugugcauuauggugggcgccaacgcgagcgaccgcauggggaugggcaccacuuaccuggcccucauggccaccuucaagaugagaccgauguucgccguggggcugcuguuccgacgccuaacuucccgagaggugcugcugcucacuaucgggcugagcuuaguggcuuccgucgagcuccccaacagccuggaggagcugggcgacgggcuugcgaugggcaucaugauccucaaguugcucacugacuuccagucccaucagcugugggcuacucugcucagccugacuuuuaucaagaccacccugucccuccacuacgccuggaagaccauggccaugguucugucuaucgcguccuuguucccgcucugucugagcacuaccucccagaaaaccaccuggcucccuguccuccugggcagcuuagggugcaagccgcucacaauguuccugaucacugagaccaagauauggggccgcaaguccuggccccugaaugaggggaucauggccgucggcguggugagcauccuccugagcucccugcucaagaacgauguuccccuggccgggccccugaucgccggcggcaugcucauugccugcuacgugaucucaggguccuccgcugaccugucccuggagaaggcagccgaggugagcugggaggaggaagccgagcacuccggcgccucgcacaauauccucgucguggugcaggacgacggaacaaugaagaucaaggacgaagagcgggacgauacccugacgauccugcucaaggcgacgcuguuagcaguuuccggcguguacccgcucucaauccccgccacccuguucgugugguacuucuggcagaagaagaagcaacguuccgggguucugugggacacccccaguccgcccgagguagagcgggcagugcuggacgacggcauauaccgcaucaugcaacggggcuugcuggggcgcucgcaggucggcguggggguguuccaggagaacguuuuccacaccauguggcaugugacccgaggcgcagugcuaauguaccaggggaagcgccuggaacccagcugggcgagcguaaagaaggaccugaucagcuacggcggcggguggcgguugcagggguccuggaacaccggggaggaaguccaggugaucgccgucgaacccggcaagaaucccaagaauguacaaaccgcacccgggacguucaagacccccgagggcgaggugggcgccaucgcccucgacuucaagccggggaccagcgggucccccaucgucaaucgcgaggggaaaaucgugggucuuuacggcaacggaguggucaccacgagcggcaccuaugugagcgcgaucgcgcaggccaaagccucccaggaagggccgcugcccgagaucgaggacgagguguuccggaagcgcaaccuuaccaucauggaccugcacccaggcagcgggaagacccggcgcuaccugccagcgaucguccgggaggcuaucaagagaaaacuccgaacgcugauccuggccccuacccgcguaguggccuccgagauggccgaggcgcugaaggguaugcccauccgcuaccaaaccacggccgucaaaagcgagcacacgggcaaggagaucguagaucugaugugccacgccaccuucaccaugcggcuguuaucccccgugcgcgucccgaacuacaacaugauaaucauggaugaggcccauuuuaccgaccccagcuccaucgcggcgcggggguacauuagcacgcgggugggcaugggggaggcagccgccaucuucaugaccgccacgccucccggguccguggaggcguucccgcagagcaacgccguaauccaagacgaagagcgggauauccccgagcgauccuggaacagcggauaugaguggauuaccgauuucccaggaaaaacugugugguucgugcccuccauaaagaguggaaaugacauugccaacugccugaggaagaacgggaagcgcgucauccagcugagucggaagaccuucgauacugaauaccagaagaccaagaacaacgacugggacuacguugucacgaccgacaucagcgagaugggcgcuaacuuccgcgccgaccgggucaucgauccgcgccggugccucaagcccgugauccugaaagaugggccggagcgcguaauacuggccggcccaaugccggugaccguggcuuccgccgcccagcggcgcgggcgcaucggacgcaaucacaacaaggaaggcgaucaguacaucuacaugggccagccccucaacaacgacgaggaccacgcccacuggaccgaggccaagaugcugcuggacaacaucaacacgcccgagggcaucauccccgcccucuucgagccugagagagagaagagcgccgccaucgacggggaauaccgccuacgcggcgaggcgcggaagaccuucguggaauugaugcgccgcggugaccucccggugugguuauccuacaagguagccagcgagggcuuccaguacagcgaccgcagguggugcuucgacggcgaacgcaacaaccaaguucuggaggagaacauggauguggagaucuggaccaaggagggugagcggaagaagcuccguccgcguuggcuggacgcccgcaccuacuccgacccccuggcccugcgggaguucaaagaauucgccgcgggccgccggagcguguccggggacuuaauucuggaaaucggcaaacucccgcagcaccugacgcagcgugcccagaacgcccuagacaaccuuguaaugcuacacaacagcgaacagggcgggcgggccuaccgccacgcaauggaggaacugccagacaccaucgagaccuugaugcugcuagcgcucaucgccguacucaccggcggggugacucuguucuuucugucgggccggggccugggaaagacgagcaucgggcugcucugcguaauggccuccagcgugcugcuguggauggccuccguggagccccauuggaucgcggccaguaucacccucgaguucuuccugaugguccuguuaauccccgagccggaccggcagaggacaccccaggacaaccaauuggccuauguuguuaucgggcucuuguucaugaucuuaaccguugcugccaacgagaugggccuucucgagacuacuaaaaaggaccuggggauaggccacguggcgguagagaaccaccaccaugcaaccaugcuagacgucgaccuccaucccgccuccgccuggacacuguacgccguggcgacgaccaucaucacaccgaugaugcgccacaccaucgagaacacaaccgccaacaucagccugaccgcuauagccaaucaggccgcgauccucaugggauuagacaagggcuggccgaucuccaaaauggauauuggcgugccguugcucgcccuggggugcuacagccaggucaacccccugacccucacggccgccgugcugaugcugguggcccacuacgccauaaucggcccggggcuccaagccaaggcaacucgggaggcccagaagcgcacugcggccggcaucaugaaaaaccccaccgucgacgggaucguugccaucgaccuggaucccguggucuaugacgcuaaauucgagaagcagcugggacaaaucaugcugcugauuuuaugcacaucccaaauccuccugaugcgcaccaccugggcccugugcgagucuauaacccucgcgacgggcccccugacuacucugugggaggggucccccggcaaauucuggaacacuacgauugccgugagcauggccaacaucuuccgagggucauaccucgcaggcgccggccuggcguuuagccugaugaagucccucgggggcggucggcggggcaccggggcccagggugaaacccugggagagaaguggaaacgccagcugaaccagcucuccaagagcgaguucaacaucuacaagagauccgggaucauggagguggaccgcagcgaggcgaaggagggccugaaacgaggagagaccacuaggcaugccguuucccgggguacugcgaaacuucgcugguucguggagcgcaaccuggugaagcccgaggggaaggugauugacuuagggugcggcagagggggcuggagcuacuacugcgccgggcugaagaaggugaccgaggugaaaggauacacaaagggcgggcccggccacgaggagcccaucccgauggcgaccuauggguggaaccuggucaagcuccacagcggcaaggauguguuuuuuacgccgccugagaagugcgacacccugcugugcgauauuggggagucgucccccaauccgaccaucgaggagggccggacgcuucgcgugcuaaagauggucgaacccuggcugcgggggaaucaguucugcauaaagauccucaaccccuacaugcccucagugguggagacacuggagcaaaugcaacgcaagcacggcggcaugcuggucagaaacccguuaucacgcaacagcacacaugaaauguacuggguguccugcgguacaggcaauaucgugagugccgucaacaugaccagucggaugcugcugaaccgcuuuacgauggcccaccgcaagcccaccuacgagcgggacguggaccucggggccgguacccgccacguggccgucgagcccgagguggccaaccuggacaucauaggccaacggaucgagaacaucaagcacgagcacaagagcaccuggcacuacgacgaagacaaccccuacaagacgugggccuaucacggguccuacgaggucaagccgagcggauccgccucaagcauggugaacgggguggucaaacuguuaaccaagcccugggacguaauccccaugguuacccagaucgcgaugacggacacgacccccuucggccagcagcgugucuucaaggagaagguugauacccgaaccccgaaggccaagcgcgggacggcucagaucauggaaguaaccgcccgguggcuguggggcuuucugucccgcaacaaaaagccccggaucuguacccgcgaagaguucacccggaagguccggagcaacgccgcgaucggcgccgucuucguggacgagaaccaguggaacuccgcgaaggaagcgguagaggacgagcgguucugggaccucguccagaaggagcgcgagcugcacaaacagggcaagugcgcgacgugcguguacaacaugaugggcaagcgggagaaaaagcugggggaauucggcaaggccaaggggagccgcgccauaugguacauguggcucggcgcccgguuccuggaguucgaggcccugggcuucaugaaugaagaccacugguucucccgcgagaacucccucucuggggucgagggcgaggggcugcauaagcucggcuacauccuccgggacaucagcaagauucccgggggcaacauguacgcggacgacaccgcuggcugggacacccgcaucaccgaggacgaccuucagaacgaagccaagaucacggauaucauggagccggagcacgcccugcucgccaccuccaucuucaagcugaccuaccagaacaaggucgugcggguccagcgcccagcgaagaacgggaccguuauggacgugauuagccgccgggaccagcgcggcuccggucaggucggcacauacgggcugaacaccuucacaaacauggaagcccagcucauucggcaaauggagagcgaggggaucuuccugcccuccgagcuagagacccccaacuuggccgagcgggugcuggacuggcuggagaaguacggcguugagcggcucaagcgcauggcuaucagcggggacgacugugucgugaagccaaucgacgaccgguucgccaccgcgcugaccgcccugaacgacauggguaagguccgcaaggacauaccucagugggagcccuccaagggauggaaugauuggcagcagguccccuucugcagucaccacuuccaccagcucauaaugaaggacggcagggagaucguggugccuugccgcaaccaggacgagcuggucggccgggcgcgcguaucccagggggccggcuggagccugcgggagaccgccugccucggcaagagcuacgcgcagauguggcagcugauguacuuccaccgccgggaccuacgccucgcugccaaugccaucugcuccgcggugcccgucgacugggugcccaccagccggaccacgugguccauucacgcucaccaccaguggaugaccaccgaggacaugcucaguguguggaaccgcguauggaucgaggaaaacccauggauggaggacaagacccacgugucgagcuggggcgacgugccguaucugggaaagcgggaagaccaguggugcggcuccuugaucggccugacggcucgcgcgaccugggccagcaacauccaggucgcgaucaaccagguuagacgccugaucgggaacgagaauuaccucgacuacaugaccucuaugaagcgcuucaagaaugagggggacccggagggggcucugugguga

SEQ ID NO: 24367 - RNA, 9879 nt, Artificial Sequence
  derived and/or modified CDS sequence (opt11) from DENV-1__GQ199839__SS-prME
agcgugaccaugcugcucaugcugaugccaaccgcccuggccuuucaucuuaccacccggggcggugagccgcacaugauugucaccaagcaggagcggggcaagucacugcuguuuaaaaccagcgcgggggugaacaugugcacccucauugcgauggaccugggcgaacugugugaggacaccaugacauacaaauguccucggaucaccgaggccgagcccgacgauguggacugcugguguaacgcuaccgacacuuggguuaccuacggaacuugcagccggacgggcgagcaccgccgggacaaacgcucuguggcccucgcaccccaugugggccuggggcuggagacccggaccgagaccuggaugucgagcgagggcgccuggaagcagauccaacgcguugaaacgugggccuuacgacauccaggguucaccguuaucgcccuguuccuggcgcacgccaucggcaccuccaucacccaaaaggggauaauuuucauccuccuaaugcuaguaacucccucaauggccaugcgcuguguaggcauuggcucccgggacuucguggaggggcucagcggcgcgaccuggguggacgucgugcucgagcacggguccugugugaccaccauggccaaggauaagcccacucuggacaucgagcugcuaaagacagaggucacuaaccccgcgguguuacgcaagcucugcauugaggccaagauaaguaacacaacgaccgacagcagaugccccacccagggcgaggcgacgcugauggaggagcaggacgcgaacuuuguaugccgccgcacauucguggaccgcggcuggggcaacggcugcgggcuguucggcaaggggagucucauuacgugugcuaaguucaagugcguuaccaagcuggaggguaagaucgugcaguacgagaacuugaaguacucggucaucgugacgguucauacgggcgaccagcaccaagucgguaacgagagcaccgagcacggcaccacggcgaccaucaccccacaggcccccaccagcgagauucaacuuaccgacuacggggcccugacccuggacugcucuccccggacgggacucgacuucaacgagaugguacugcugaccaugaaggaaaaguccugguuaguccacaagcaaugguuccuggacuugccgcuccccuggacgagcggggcaagcacuagccaggagacguggaaccgccaggaccugcuggucaccuucaagaccgcucaugcgaagaagcaggaagugguaguguuggguucccaggagggggccaugcacacugcccugaccggggccaccgagauacagaccucaggcacaacgacaauauucgcagggcaccuaaagugccggcucaaaauggacaaguugacgcugaaaggcaugagcuacgugaugugcaccgguuccuuuaagcucgagaaagaagucgcagagacccagcacggcaccgugcuggugcagaucaaguacgaggggaccgacgccccgugcaagauccccuucucaacccaggacgagaagggggucacgcaaaacggcaggcugaucaccgccaacccgaucguuacggacaaagagaagcccguaaacauugaggcagagccgccuuucggggagagcuauaucgucauaggcgcaggcgagaaggcccugaaguuaucuugguucaagaagggcaguagcauaggcaagauguucgaagccaccgcccgcggagcgcgccgcauggcgauacugggcgauacggccugggacuucggguccaucggcggcguguucaccucugucgggaaacugguccaccagauuuuuggcacagccuacggagucuuauucuccggcgugagcuggaccaugaagauaggaaucggcguccugcucacguggcuaggccugaacucgcggagcaccagccugucgaugaccuguaucgcugugggguuggugacccuguaccugggcgucauggugcaggccgacuccggcugcguuaucaacuggaaggggcgcgagcucaagugcgggagcggcaucuucgucacgaacgaggugcauaccuggaccgagcaguauaaguuccaggcggacagcccgaagcgguugucggccgccauuggcaaagccugggaggagggggugugcggcauccggagcgccacccggcuggagaacaucauguggaaacagaucuccaacgaacucaaccauauccuucuggagaacgggcucaaguuuaccgucguggugggagacgucguggggauccuugcccaaggcaagaaaaugauucgaccacagcccauggagcacaaguacagcuggaaguccuggggcaaggccaaaaucaucggggccgacgugcagaacacaaccuucaucaucgacggucccaacacuccggaauguccggaugaccagcgugcguggaacaucugggaaguggaggauuacggauucggcaucuucacgacgaacaucuggcugaagcuacgcgauagcuacacccagguuugcgaccaccggcugauguccgccgccaucaaggacagcaaagccguucacgccgacaugggcuacuggauugaauccgagaagaacgagacuuggaaacuagcccgugcgucuuucaucgaggucaaaaccugcauauggccuaagucccacacgcucuggagcaacgguguauuagaguccgagaugaucaucccuaagauuuacggcgggccgaucagccagcacaacuaccggccuggcuacuucacccagacagcugggcccuggcaccugggcaagcucgagcuggacuuugaccugugugaaggcaccacggugguuguggacgagcauugcgguaaccgcggcccgucccucaggacgacuaccguaaccggcaaaauaauccacgaguggugcugccgcagcugcacccugccgccguugcgguucaagggcgaggacgggugcugguacggcauggagaucaggcccgucaaggagaaggaagagaaccucgucaagucgaugguuagcgccggcagcggagagguugacuccuucucccugggcuuacucugcaccuccaucaugauagaagaagugaugcggagccgcuggucccggaagaugcugaugacuggaacccuagccguuuuccuucuguugaucaugggacagcucaccuggaacgaccugauccgucucugcaucauggucggggcuaacgcgagcgauagaaugggcaugggcaccaccuaccuagcccugauggccacguucaagaugcggccgauguucgccguagggcuccuguuccgccgccugaccagucgcgagguucuguuacugaccaucgggcugucccucgucgccuccguggagcugcccaacagccuggaggagcucggggacggccuggcaaugggcauuaugauccugaagcuccugaccgacuuucagucccaccagcugugggccacgcuccugagccuuacguucaucaagaccacacucucccuacacuacgcuuggaagacgauggccaugguccugagcauagugucguuguucccccugugccugucgaccaccucccagaaaaccacuuggcuccccguacugcuugggagccucggcuguaaaccgcugaccauguucuuaaucgcggagaacaagaucuggggucggaagucuuggccccucaacgagggcaucauggcagucgggguugugagcauccuacugagcucgcuccugaaaaacgacguaccccuggccgggccccucauagccggcgggaugcucauugccugcuacgugauuagcgggagcagcgcggaccugucccucgagaaggccgccgaagugagcugggaggaggaggccgagcacucaggggccagucacaacaucuucgucgaggugcaggaugacggcaccaugaaaauuaaggacgaagagcgcgacgacacccugaccaucuugcucaaggcgacacugcuggcugugucggggguuuauccucugagcauucccgccacgcuguucgugugguacuucuggcagaagaagaaacagcgguccggcgugcugugggacacccccagcccgccugaagucgaaagagccgcccuggaugacggcaucuaccggauuaugcagcgcggguuacucggccggucccagguggggguuggugucuuccaggagaacguguuccacaccauguggcacgugacgcguggggccguucugauguaccagggcaagcggcucgagcccagcugggccuccgucaagaaggaccuaaucagcuacggcgggggcuggcgccugcagggguccuggaauaccggcgaagaggugcaagucauagccguugagcccgggaagaaccccaagaaugugcagaccgcccccggcaccuucaagacgcccgaaggugaggucggcgccaucgcccucgacuucaagccgggcaccagcggcucucccaucgugaaccgagaggguaaaaucgugggccuguacgggaaugguguugugaccaccucggggaccuacgugucugcuauugcacagaccaaggccucccaggagggcccgcuucccgagaucgaggacgaaguuuuucgcaagcggaaucucaccaucauggaccugcaccccggcagcgggaagacacgucgguaccugccggcaaucgugagagaggccaucaaaaggaagcuccgcacgcucauccuggcgcccacccgcguagucgcauccgagauggcugaggcgcugaagggcaugccuauucgguaccagaccacggccgucaagagugagcacacgggaaaggagaucguggaccugaugugccacgccaccuucacaaugcgccugcuaucccccguccggguuccaaacuacaauaugauuaucauggacgaggcccacuucaccgaccccuccuccaucgcagcgagaggcuacauuagcacgcggguggggaugggcgaggccgccgccauuuuuaugacggccacgccucccgguuccgucgaggcuuuuccgcaaagcaacgccgugauccaagacgaggagcgagacauccccgagcggucguggaacuccggcuacgaguggaucaccgacuuccccggcaagacggucugguuuguccccuccaucaagagugggaacgauaucgcuaauugccuccguaagaacgguaagcgggucauccagcuauccaggaagaccuucgacaccgaguaccaaaagaccaagaacaacgacugggacuacguggucacgacagacaucagcgagaugggggccaacuuucgggcggaccgcguuauagacccgagacgcugccucaagcccgucauccucaaggacggacccgagcgggucauccuggccgggcccaugccgguaaccgucgccuccgccgcucagcgccgcggccgcauuggccggaaccacaacaaagagggggaccaguacaucuauaugggccagccccucaacaaugacgaggaccacgcacacuggaccgaggccaagaugcugcuagauaacaucaacacgccggagggcaucaucccugcccuuuucgagcccgagcgugagaagucugcagccaucgacggcgaguaccgccugcgcggggaggcgcggaagaccuucguggagcuuaugcggcgcggcgaccucccuguuuggcuguccuauaaggucgccagcgaaggcuuccaguauagcgacagacgcuggugcuucgacggggagcgcaacaaucaggugcuggaggaaaacauggacguggagauuuggaccaaggagggugagcgcaagaaacuccggccccgguggcuggacgcacgcacuuacuccgacccccucgcccuacgcgaguucaaggaauucgccgcuggucggcgcagcguguccggcgaccugauccuggaaaucgguaagcuuccgcaacaccugacgcaacgggcccagaacgcguuagacaaccucguuauguuacauaauagcgagcagggcgggcgcgccuaccggcacgcgauggaggagcugccagacaccaucgagacccucaugcugcuggcccucaucgcaguguugaccgggggggucaccuuguucuuucucuccgggcgcggccugggcaaaacgagcauugggcugcugugcguaauggccuccagcgugcugcuguggauggccucugucgagccacacuggauugcggccagcaucauucucgaguucuuccugaugguauugcucaucccagaaccggaccgccaacgcacgccccaggacaaccagcuugccuacgugguuaucggccuacucuucaucauccuaaccguggccgccaacgagauggggcugcucgagacgacgaagaaggacuuagguaucgggcacguagcgguugagaaccaccaucacgcgaccaugcuggauguggaccuccaccccgccuccgccuggacccuguacgcggucgcgaccacgaucaucacccccaugaugcgccacaccauugagaacacgacggcuaauaucucccugaccgccaucgcaaaccaagccgcgauccugaugggguuggacaaaggcuggccgaucucgaaaauggacauugggguccccuugcucgcuuuaggcugcuauagccaagugaaccccuugacccucaccgccgccgugcugaugcuggucgcucauuaugcuaucaucgggccggggcuccaggccaaagccacgagagaagcgcagaagcgcacugcggccgggauaaugaaaaauccaaccguggacggcauuguggccaucgauuuagaccccguuguguacgacgcgaaguucgagaagcagcugggccagaucaugcugcugauccuaugcaccucccaaauccucuuaaugcggacgacuugggcccugugcgagucuaucacgcuagcuacggggccccucacgacacucugggagggcucccccgggaaguucuggaacaccaccaucgccgugagcauggccaauaucuuccgcgguucguaccucgccggcgcagggcuggcguucucacuaaugaagucccucggcgguggucggcgcgggacgggcgcccaaggcgagacccuaggagagaaguggaagcgccaguugaaccagcucuccaagagcgaguuuaacaucuauaagcgcuccggcaucauggaggucgaucggagcgaagccaaggaggggcugaagcgcggcgagaccacccgacacgcugugucccgcggaacugcaaagcugcggugguucguugagcgcaaccuggucaagccggaggguaagguaauagaccucggcugcgggcgggguggguggucauacuacugcgcaggacugaaaaaagugaccgaggucaagggguacacaaaagguggccccgggcacgaggagcccaucccgauggccacauacggcuggaaccuggugaagcuccauuccgggaaggacguguucuucacgccgcccgaaaagugcgacacccugcugugcgacaucggcgagagcucccccaacccaacaaucgaggaggggcggacccuccgggucuuaaagaugguggagccuuggcuccgcggcaaucaguuuugcauaaagauucucaaucccuacaugcccagcgugguagagacacucgagcagaugcagcggaagcacggcgggaugcucgugcguaauccacucucgcggaacagcacccacgagauguacuggguguccugcggcaccgggaacauugucagcgccgugaauaugaccucccggaugcugcuuaaccgcuucaccauggcccaccggaagcccacguacgagcgcgacguggaccucggcgccggcacccggcacguggcuguggagcccgaaguggccaaccuggauaucaucggucaacguaucgagaacaucaagcacgagcauaagagcaccuggcacuacgacgaagacaaccccuacaagacaugggcuuaccauggcuccuacgaggucaaaccauccgggagugcgagcuccauggucaacggcgucgugaagcugcuuacgaaacccugggaugugauucccauggucacgcagaucgcgaugaccgauaccacgcccuucgggcagcaacggguguucaaggagaagguugacacccgcacccccaaagccaagcggggaaccgcccagauaauggaagucacggcccgcuggcuguggggguuuuugucccggaacaagaagccccgcauaugcacccgggaggaauuuacucgcaaagugcggagcaacgcggcgaucggggcuguguucgucgacgagaaccaguggaacuccgccaaggaggccguagaagacgagcgcuucugggaccucgugcagaaggagcgggagcugcacaagcagggaaagugcgcgacuugugucuacaacaugauggggaagcgcgaaaaaaagcugggcgaauucggaaaagccaagggcagccgagccaucugguacauguggcuaggcgcccgguuccuggaguucgaggcccugggguucaugaacgaggaucacugguucucacgggagaacagcuuguccggcgucgaaggagaagggcugcacaagcugggguacaucuuacgcgauauuaguaagauacccgguggcaacauguacgcggacgacacggcagggugggacacccggaucaccgaagacgaucuccagaacgaggcgaagaucacugacaucauggagccugaacaugcccugcuugcaacauccauuuucaaacugaccuaccagaauaaggugguccgcguacagaggcccgcgaaaaacggcaccgugauggacgucauuagccggcgagaccagcgggguucuggccagguuggaacguacgggcugaauacguucaccaacauggaggcccaguugauccgccaaauggaaagcgagggaauauuucugccuucagagcuggagacccccaaccucgcagagcgcgugcuggauuggcuggaaaaguacggggucgagcgccucaaacggauggccaucagcggagacgacugcguggugaagccuaucgaugaucgauucgccaccgcguugacugcauuaaacgacauggggaaggucaggaaagacaucccgcagugggagcccuccaaagguuggaaugauuggcagcagguaccguucuguagccaccacuuccaucagcucaucaugaaagauggccgcgagaucgucgucccgugccggaaucaggacgaacugguggggcgcgcccgggugucccagggggcuggguggagccugagagagaccgcgugucucggcaagagcuacgcgcagauguggcagcugauguacuuccaucggagagaccugcggcucgccgccaacgcgaucugcuccgcggucccgguggauugggugcccaccagccgcaccacgugguccauucaugcucaccaccaguggaugacuaccgaggacaugcucagcguguggaauagaguguggaucgaggaaaaucccuggauggaggauaaaacucacguguccagcuggggggacgucccguaccugggaaagcgcgaggaccaguggugcggcucccucaucggccuaacggccagagccacgugggccagcaacauucagguggccaucaaucagguacggcggcugaucggcaacgagaacuaccucgacuacaugaccuccaugaagcgguuuaagaacgaaggggaccccgagggcgcacugugguga

SEQ ID NO: 24368 - RNA, 9879 nt, Artificial Sequence
  derived and/or modified CDS sequence (opt11) from DENV-1__FJ898397__SS-prME
agcgugacgaugcugcucaugcucaugcccaccgcccuggccuuccaccucaccauccggggcggggagccccauaugauugugagcaagcaggagcggggcaagagccugcuauucaaaaccucugccggggugaauaugugcacccucaucgccauggaccuuggggaguucugcgaagauacuaugaccuacaagugcccccgcaucaccgaggccgagcccgacgacguggacugcuggugcaacgccaccgauacauggguaaccuacggaaccugcagccagaccggcgagcaccggagggauaagcggaguguggcucuggcuccucacgugggccuugggcuggagacaaggacggagaccuggaugagcucggagggcgccuggaagcaaauccagagaguggagaccugggcccugaggcacccgggguucaccgugaucgcccucuuccuggcgcacgccaucggaacuagcaucacccagaaggggaucaucuuuauccugcuuaugcuggugacucccuccauggccaugcgcugcgucggcaucggcagccgcgacuucguggagggacugaguggcgccacguggguagacgucgugcucgagcacgggaguugcgugacgaccauggcuaaagacaagcccacccuggacauugaacugcucaaaaccgaggucacgaaucccgcggugcugcggaaacuuugcaucgaggcaaagaucuccaacaccaccacugacagccgcugccccacgcagggggaggccacacucgucgaggagcaggacgccaauuucgucugccggcgcacguucguggaucggggcugggggaacggcuguggguuauuuggcaaggggucccuuauuacgugcgccaaguucaagugcgugacgaagcucgagggcaagaucguccaguaugagaaccugaaguauagcgugaucgugaccguccacaccggcgaucagcaccagguggguaaugaaagcacugagcacgggacgaccgcgaccaucacuccccaggcccccucgaccgaaauccagcugacggacuacggggcccucacccuggauugcagcccgcggacaggcuuagacuucaacgagaugguccuccugacuaugaaagagaaguccuggcuggugcacaagcagugguuccucgaccugccucugcccuggacguccggugccuccacaagccaagagacuuggaaucggaaggaccucuuggugaccuucaagacggcccaugcgaaaaagcaggaggucgucgugcuggguucccaggagggcgccaugcauacagcccuuacaggggccaccgaaauccagacgagcggcaccacgaccaucuucgccgggcaccuuaagugccgccuaaagauggacaagcucacgcucaagggcauguccuaugucaugugcaccggcagcuucaaauuagagaaggaaguggcggagacccagcauggcacaguucuuguucagaucaaguacgaagguacggacgcccccugcaagaucccguucuccacucaggacgagaaaggagugacacagaauggucgucucaucaccgcgaacccuaucgugacggacaaagagaagcccgugaacaucgaggccgagccgccguucggagagagcuacaucgugauuggcgcgggcgagaaagcacugaaacuauccugguucaagaagggcagcucgauagguaagauguucgaggccacugcccgcggggcccggcgcauggcuauacucggcgacaccgcgugggacuucgggagcauuggcggcguguucaccuccgucggaaagcuggugcaccagaucuuuggcacagccuacgggguacuguucucuggcgucucuuggacgaugaaaauagggaucggggugcuccugacauggcugggcuuaaacucgcgcucuacuagccuguccaugacguguauugcuguagggcuaguaacauuauaucugggcgugaugguucaggccgauagcgguugcgucaucaauuggaagggccgggagcugaagugcggaucaggcaucuucgugaccaaugaggugcacacuuggacggagcaguauaaguuucaggccgacuccccgaaacgccucucugccgccaucgggaaggccugggaggagggggucugcgguauccgguccgcgaccagacuggagaauaucauguggaaacagaucagcaacgagcuaaaccacauccucuuagaaaaugacaugaaguucaccgugguggucggggacguggccggcaucuuggcccaggggaagaagaugauccggccccaacccauggaguacaaguauuccuggaaaucguggggcaaagccaagaucauuggugccgacgugcagaacaccaccuucaucaucgacgggcccaauacgccggagugccccgacgaccaacgugcguggaacaucugggagguagaagacuauggguucgggaucuucacuaccaacauauggcucaaacugcgggauucauacacccagguuugcgaucaccgccugaugagcgcagccauuaaagacucaaaagccguucacgcggacaugggcuacuggauagagagcgagaagaacgaaacguggaagcucgcgcgggcgucuuucaucgaggucaagaccugcauauggcccaagagccauacccuaugguccaacggagugcuggaaucugagaugauuauccccaaaaucuacggugggccgaucucccagcacaacuaccgucccggguacuucacccagacggccggucccuggcaccucggaaaacuagagcuagacuucgaccucugugagggcacgaccgugguaguggacgagcacuguggcaaccgggggccgucucugcguaccacaaccguuaccggcaaaauaauccaugaguggugcugucgguccugcacucugccgccccugcgcuucaagggggaggacggcugcugguacggcauggagauccggcccguaaaggaaaaggaggaaaaccuugucaagagcauggugagcgcuggcuccggugagguagacuccuucucccuggggcuucugugcaucagcauaaugauugaggaaguuaugcgaucccgguggagccgcaagaugcugaugacgggcacccucgcgguguucuuccuacugauaaugggucagcucaccuggaacgaucugauacggcugugcauaauggucggcgcgaacgccuccgaccgcauggguauggguaccacguaucuugcacugauggccacuuucaagaugcgcccgauguucgccguggggcuccuguuccggcgccugacgagcagggagguacugcuacuaaccaucgggcugucgcucgucgcgagcguggagcugccgaacucacuggaggaacucggcgauggucuggccaugggaauaaugauucugaagcuacugacggauuuccagucacaccaguugugggccacccuccugucccucaccuucaucaagacuacguucagucuacacuacgccuggaagaccauggcgaugguccuguccaucguaagccucuuuccccucugccuguccacuacuucgcagaaaacgaccuggcugcccgugcuccugggcucccugggguguaagccgcucaccauguuccugauugccgagaacaagaucuggggccggaaaucguggccccuuaaugagggaaucauggccgucggcaucgugucgauccuccugaguucauuacucaagaacgacgugccauuagccgggccccugaucgcuggcggcaugcucaucgcgugcuacguuaucuccgggaguuccgccgaccuuagccuggagaaggcugcagagguuuccugggaggaggaagccgagcacucgggcgccucccacaacaucuuagucgagguccaagaugacgguaccaugaagaucaaggacgaggagcgcgacgacacucugaccaucuugcucaaggccaccuuacuggccguuagcggcguguacccauuguccauccccgccacucuguuugucugguacuucuggcagaagaaaaagcagcgaagcggggugcugugggacacgcccagcccgcccgagguggagcgggcaguccucgacgaugggaucuaccgaaucaugcaacggggccugcuggggcgcagccaggugggcgugggagucuuccaggagaacguguuccacaccauguggcacgugacacggggcgcgguccugauguaccaggggaagcgccuagagccauccugggccagcgugaagaaagaccugaucuccuauggcgguggguggcggcugcaggguagcuggaacaccggcgaggaagugcaaguaauagccgucgaacccggcaagaaccccaaaaacgugcagaccgccccggggaccuucaagacuuccgagggagaggucggggccaucgcgcucgauuucaagcccggcaccagcggcagccccaucguuaaccgcgaaggaaagaucgugggccuguacggaaacggggucgugaccacguccggcacuuacgugucugccaucgcccaggccaaggcgucccaggaaggaccccuaccggagauagaggacgaggucuuucggaagcgcaaucucaccauuauggaccugcaucccggcucugggaagacucggcgcuaccuccccgccauagugcgggaagcuaucaagcgcaagcuacggacgcugaucuuggcuccgaccaggguagucgcaucggagauggcugaggcccucaaggguaugcccauccgcuaccaaacuacugccgucaagagcgagcacacgggcaaggagaucguagaccugaugugucacgccaccuucaccaugcggcugcucucccccguccgugugcccaauuauaacaugaucauuauggacgaagcccacuucaccgacccuagcuccaucgcagcaaggggguacaucagcacccgcgugggcaugggggaggccgccgccaucuucaugaccgcgacgccacccgguuccgucgaggcguucccccaaagcaacgccgugauccaggacgaggagcgggacaucccggaaagauccuggaacagcgguuacgaguggaucaccgacuuccccggcaaaacggugugguucgucccguccauuaaguccggcaacgauauagccaacugcuuaaggaagaacgggaagagagugauucaacugucacggaagaccuuugacaccgaguaccagaagaccaagaauaaugacugggauuacgucgucacgaccgacaucagcgagaugggggcgaacuuucgcgcagaccgcgucaucgauccccgccggugcuugaagccagugauccugaaagacggaccagagagggucauccuggcgggccccaugcccgugaccgucgcguccgccgcccaacggcgcggucgcaucggaagaaaccauaacaaggaaggcgaccaauacaucuacauggggcagccucucaacaaugacgaggaccacgcccacuggaccgaagccaagaugcugcuggacaacaucaacacgcccgagggcaucauucccgcccuguucgagccagagagagagaaguccgcugcgauugacggggaguaucgacugcgcggagaggcgcgaaagaccuucguggagcugaugcgccggggcgaucuaccggugugguuaagcuacaaggucgccagugaaggcuuccaguacagcgaccgccgguggugcuucgacggcgaacgcaacaaucaggugcucgaagagaacauggacguggagaucuggacaaaggagggugagcggaagaagcuccgcccccgguggcuggacgcgcgcaccuacuccgacccgcuugcacuccgggaguucaaagaguucgcggccggccgcaggagcgucuccggugaccugauccucgagaucgguaagcucccccaacaccugacccagcgcgcccaaaacgcauuagacaaccucguaaugcugcacaacagcgagcagggcggccgggcguaccgccacgccauggaggagcugccugacaccauugagacccucauguuacuggcccucaucgccgugcugaccgguggggucacccuguucuuccuuucuggcaggggccucggcaagaccagcaucggccuguugugcguaauggccuccagcguccugcuauggauggcguccgucgagccccacuggaucgcugccagcaucauccucgaguucuuccugauggugcuccuuauaccagaaccggaccgccaacgaacgccgcaggacaaccagcuggccuacguggucaucgggcucuuguucaugauccugaccguggccgcgaacgagaugggccugcucgagaccacaaagaaggaccuggggaucggccacguggcagucgagaaccaccaccacgccgcuaugcuggacguggaccuacaccccgcauccgcuuggaccuuauacgccguggccacuaccauuaucacuccaaugaugcgccacaccaucgaaaacaccaccgccaacaucagccucacggccaucgccaaccaggcggccauacucauggggcuagacaaagguuggccaaucuccaaaauggacaucggcgucccccugcuagcccucgggugcuacagucaagugaaccccuuaacccucaccgccgcuguuuuaaugcuggucgcccacuacgccaucaucggccccggacuccaggccaaggccacgcgggaggcccagaagaggacggccgccggaaucaugaagaaccccaccguggacgggauuguggccauugaucuagaucccgucguguacgacgcaaaguuugagaagcaacugggucagaucaugcuccugauccugugcaccagccagauccucuugaugcguaccacaugggcccugugcgaaucaaucacccucgccaccggcccccugaccacgcugugggaggggucccccgggaaguucuggaacacaaccaucgccguaagcauggccaacaucuuucgagggucauaccuagcaggcgccggccuugcguucucgcugaugaaaucccucgggggcgggcgucggggcaccggggcucaaggcgaaacgcugggcgagaaguggaagcgacaacugaaccagcucucaaagagcgaguucaacacuuacaagcgguccgguaucauggaagucgaccgcagcgaggcaaaggagggccugaagcgaggggaaaccacuaagcacgcgguaagcaggggcacggcaaagcuccggugguucgucgagcguaauuuagugaagccggaagggaaggugauagaccugggcugcggccgcggcggguggagcuacuacugugccggucucaagaaagugacagaggucaaaggguacaccaagggcgggcccggccacgaggagccaaucccuauggccacguacggguggaaccuggugaaguugcacuccggcaaggauguguucuucauaccacccgagaagugcgacacgcugcugugcgacaucggggaaagcagcccuaaccccaccaucgaggagggccgaacccuccggguucugaagaugguggagccauggcugcgagggaaccaguuuugcaucaagauccucaacccguauaugcccucgguagucgagacgcucgagcagaugcaacgaaagcacggcggcaugcugguccgcaacccccucucccggaacucuacgcacgagauguacugggugaguugcgggaccgguaacaucgucucagccguaaacaugaccucccgcaugcugcucaaccgguuuaccauggcacaccgaaagcccaccuacgaacgcgacguggauuugggcgccggcacgcgccacgucgccguagagcccgagguugccaacuuggacauuaucggccagcgcaucgagaauaucaagcacgagcacaagagcaccuggcacuacgacgaggauaacccauauaaaacuugggcguaccacgggagcuacgaggucaaacccagcggcagcgcuuccaguauggugaacggggucgugaagcucuugaccaagccgugggauguuauccccauggucacacagaucgccaugaccgacaccaccccauucggccaacagcgcguauucaaggagaagguagauacgagaacgcccaaggcgaagcgggggacagcucagauaauggaagugaccgcgaaauggcuaugggguuuccugagucgcaacaagaagccaagaaucugcacgcgcgaggaguucacuaggaagguccgcagcaacgccgccaucggcgccguguucgucgacgagaaccaguggaacucugcuaaagaggccguagaggacgagcgguucugggaccuagugcaucgcgagcgggagcugcacaagcaggggaaaugcgcgaccugcgucuauaacaugaugggcaagcgcgagaagaagcugggugaguucgggaaagccaaggguagccgggccaucugguacauguggcuaggcgcgcgcuuccucgaguucgaggcccugggcuucaugaacgaggaucauugguucucccgggaaaacagccucucugggguggagggugagggacugcacaagcugggguacauccuucgagacaucucaaagauccccggcggcaauauguacgcggacgacaccgccggcugggacacuagaaucaccgaggacgaccuacagaaugaggccaaaaucaccgacaucauggagcccgagcaugcccugcuggccaccuccaucuucaagcugacuuaccagaauaagguggucagagugcagcggccggccaagaacgggaccguaauggacgugaucagccgccgcgaccaaagggguucuggccaagugggcacauacggccuuaauacauucacgaacauggaagcccaacucauuagacagauggagagcgaggggaucuucucccccagugagcuggagacccccaaccuggccggcagaguccucgauuggcuggaaaaacauggggucgaacgcuugaaacggauggccaucaguggcgacgacugcguggucaaacccauagacgaccgcuucgccaccgcccuuacugccuugaaugacauggggaaaguacggaaggacauuccccagugggaacccagcaagggcuggaacgacuggcagcaggucccguuuugcucccaccacuuccaccaacuuaucaugaaggacggccgcgagauaguggucccuugccguaaccaggacgaacucgucgggcgcgcccgggugucccagggcgcgggguggagucuacgcgagacugcuugcuuaggcaaguccuacgcccaaauguggcaauuaauguacuuccaccgacgggaucugcgccuggccgcuaacgcuaucuguagcgccgugccgguagacugggugcccaccucccgcaccacauggagcauccacgcccaccaccaguggaugacgaccgaagacaugcucagcgucuggaaccggguguggauugaggagaaccccuggauggaggacaagacccacauuuccuccuggggcgauguacccuaccuuggaaaacgcgaggaccaguggugcggcagcuugaucgggcucacggcccgggcgacgugggccaccaacauacagguagcuauuaaucagguacgccgccugaucggaaacgagaacuacuuagacuauaugaccucgaugaagcgguucaagaacgagagcgaucccgagggggcacucugguga

SEQ ID NO: 24369 - RNA, 9879 nt, Artificial Sequence
  derived and/or modified CDS sequence (opt11) from DENV-1__FJ898398__SS-prME
agcgucaccaugcugcugaugcugaugcccaccgcucuggcauuccaccucacgacgcggggcggggaaccccauaugaucgugucuaagcaggaacgagggaagucacugcuguucaagaccuccgccggcgugaacaugugcacgcucaucgcuauggaccugggcgaguucugugaagacacgaugaccuacaagugccccaggaucaccgaagccgagcccgaugacguggacugcuggugcaaugcaacggauaccugggucacguacggaaccugcagccagaccggcgagcacaggcgggacaagcggagcguggcccuggcgccccacgucggccucgggcuggagacgcgcaccgagaccuggaugaguucggagggcgcauggaagcagauccaacggguggaaacaugggcccugcgccaccccggauucacggugaucgcucucuuccuggcucacgcaaucggcaccucuaucacucagaaggggaucaucuucauccugcucaugcuggugacccccuccauggccaugcggugugucggaauaggcucacgcgacuucguggagggacuuucgggagccacguggguggaugucgugcuugagcacgggagcugcgugaccaccauggcuaaggacaagccaacccuggacauugagcugcucaagacggagguaacuaaucccgcgguccuacggaagcugugcaucgaggccaagaucucgaacaccaccacggacagccgcugcccuacccagggugaagcgacacucguggaggaacaggacgccaacuucgugugccggcgaaccuucgucgaccggggcugggggaacggcuguggacuguucggcaaggggucgcugaucacgugcgccaaguucaagugcgugaccaagcucgagggcaaaaucgugcaguacgagaaccugaaauacagcgugauagucaccguccauaccggcgaucagcaccagguggggaacgagagcacggagcacggcaccaccgcgaccaucacgccccaagcccccagcacggagauucaacugaccgacuacggugcccuuacccuggacuguagcccgcggaccggccuggacuucaacgagaugguccuccugacgaugaaagagaaguccugguuggugcacaagcagugguuccuagaccucccccugccauggaccagcggggcgagcaccagccaggagaccuggaaccggcaggaccuccuuguuacguucaaaaccgcccaugcgaagaagcaggaggucguggugcuuggcucccaggagggcgccaugcauaccgcucucaccggggcaacugagauccagaccagcgggacaaccacgaucuucgccgggcaucugaagugcaggcugaagauggacaaguuaacccucaaagggauguccuacgucaugugcaccgguuccuucaagcuggagaaagagguggcggaaacccagcacggcacggugcucguacagaucaaguacgagggcaccgacgcccccugcaagauccccuucuccacccaggacgagaaaggcgugacccagaacggccggcugaucacggccaacccaaucgucacagacaaagagaagccgguuaacaucgaggcugagccgccauucggagagagcuacaucgugaucggagcgggcgagaaggcccugaaacuuuccugguucaagaaagggagcuccaucggcaagauguucgaggccaccgcccgcggagcccgucgcauggcgauacucggcgacaccgccugggacuucgggagcaucggaggcguguucacaucggucgggaaacuugugcaccagaucuucggcacugccuacggggugcucuuuagcggcgucuccuggaccaugaagauagggauuggcgugcucuugaccuggcugggccugaacagccgcucaacuagccugaguaugacgugcaucgccguggggcuggucacccucuaccugggcgucauggugcaggccgauagcggaugcgucaucaacuggaagggccgggagcugaaaugcggcagcgguauauucgugacgaaugaggugcacacguggaccgagcaguacaaauuccaagcggacucuccgaagcgccucagcgccgcaaucggcaaggccugggaggaaggggucuguggcauucggucugccacacgccuggagaacauaauguggaagcagauuucgaacgagcugaaccacaucuugcuggagaacgacaugaagcugaccgugguggucggagacguggcgggcauccucgcccaagggaagaagaugauacggccccaacccauggaguacaaguacuccuggaagaucuggggcaaggccaagaucauaggagccgacgugcagaacaccacguucaucaucgacggacccaacaccccggagugucccgacgaccagcgcgcguggaauaucugggaggucgaggacuacggauuugggaucuucaccacuaacaucuggcuaaaguuacgugacucuuauacucaggugugcgaucaccgccucauguccgcggcaaucaaggacagcaaggccgugcacgccgacaugggcuacuggaucgaauccgaaaagaaugagacuuggaaacuggcgcgggccagcuucaucgaggucaagaccugcaucuggccuaagucccacacccucuggagcaacggcgugcucgaguccgagaugauaauucccaagaucuauggagggccgaucagccagcacaacuaccgcccaggauacuucacgcagaccgccggccccuggcaccuggggaagcuggagcucgacuucgaccugugcgaaggcaccaccguggucguggaugaacacugcggcaaccgggggccgucccugcgcacaacuaccgugacgggcaagaucauccaugaguggugcugucggagcugcacgcugccgccccuccgcuucaagggggaggacggcuguugguacggcauggagauucggccggucaaggaaaaggaggagaaccuggugaaguccauggugagcgccggcagcggcgaagucgacucguuuagccucgggcuacugugcaucuccaucaugaucgaggaggugaugcgcagccgcuggucccgcaagauguugaugacuggcacccuggcuguguuuuuccugcucaucauggggcaacucaccuggaaugaucugauccgccucuguaucauggucggcgcgaacgccagcgaccguaugggcaugggcaccaccuaccuggcccugauggccaccuuuaagaugcgcccgauguucgccgucggccuccuguuccggcgccugaccucccgggagguucuccugcugacgaucgggcucucacucguugcgucuguugaacugccgaacagccucgaggagcugggggacggucuggcuaugggcauaaugauucucaaacugcugacugacuuccagucccaccagcucugggcuacccugcugagccuaaccuucauccgcacgaccuucucccugcacuacgcauggaaaacuauggcgaugguccugagcaucguaucccuauucccccuaugccugagcaccacgucccagaagaccaccuggcucccgguccugcugggaagccucgggugcaagccucugaccauguuucuaaucgccgagaacaagauuuggggucggaaguccuggcccuugaacgaggggaucauggccgucggcauaguuagcauccuucugaguuccuuacugaagaacgaugugccccuggccggcccuuuaaucgccggcggaaugcuuaucgcgugcuacgucaucagcggguccagcgccgaccuguccuuagagaaggccgccgaagucuccugggaggaggaggcugagcacuccggggcgucccacaacauccugguggagguccaggacgaugggacgaugaagaucaaagacgaggagcgcgacgacacccugaccaucuugcugaaggccacccugcucgcuguguccggcguguacccccugagcauccccgcuacccuguucgugugguacuucuggcaaaagaagaagcagcgguccggggugcuuugggacacccccaguccgcccgaaguggagcgcgccguccuggaugacggaaucuaccguauuaugcagcgcggccugcuggggagaagucagguggguguuggggucuuccaggagaacguguuccacacuauguggcacgugacccgcggcgcgguucucauguaccaggggaaacggcuggaacccagcugggcuucggugaagaaggaccugaucucguacggcggcggguggagacuccagggcuccuggaacaccggggaggaaguccaggucaucgccguggagcccggcaagaaucccaagaacguacagacggcgcccgggaccuuuaagaccucugagggcgaggucggcgccaucgcccuggauuuuaagcccgggaccagcggaagccccaucgugaaccgggaggggaagaucgucggucuguacggcaacgggguggugacgaccagcggcacauacguguccgccaucgcccaggccaaggcaagccaggaggggccccucccggagaucgaggacgaggucuuccguaaacggaaccuaaccaucauggaccugcaucccggcuccgggaaaacgcgccgguacuuacccgccaucgugcgagaggccaucaagcggcgccugcgcacccugauacucgcuccgacccggguggucgcgagcgagauggcggaggcccugaagggcaugccaauccgcuaccagacaacggccgugaaguccgagcacaccggcaaagagaucguggacuugaugugccacgccaccuucaccaugcggcucuuaagccccguccgcgugcccaacuacaacaugaucaucauggacgaggcccacuucacagacccguccagcauagcggccaggggguacaucucuacccgcgucggcaugggggaggccgccgccauauucaugaccgcgacgccgcccggaagcgucgaggccuucccccaauccaaugccgugauccaggaugaggagcgggacaucccggagcgcagcuggaacuccggguacgaguggauaacggacuuccccgguaagaccgugugguucguccccagcaucaagucaggcaacgacauagccaacugcuugcggaagaacgggaagcgcgugauccagcucagccgcaagaccuucgacacggaguaccagaagacgaagaauaacgacugggacuacguggugaccaccgacaucuccgagaugggcgcgaauuuccgcgcggaccgggugaucgaccccagaaggugccugaaaccggucauacuuaaagacgggcccgagcgcgucauccucgccggccccaugcccgugacugucgccuccgccgcgcaaaggcgcgggcgcaucggucgcaaccacaacaaagagggcgaccaauacaucuacauggggcagccucugaacaaugacgaggaccaugcucacuggacggaagccaagaugcuacucgacaacaucaacacccccgagggcaucaucccggcccuguucgagcccgaacgcgagaagucugccgcgaucgauggagaguaccgccugcgcggcgaggcccgcaagaccuucgucgagcucaugcgucgcggggaccugccgguguggcugagcuauaaggucgccagcgagggauuccaguauuccgaccgccgguggugcuuugacggcgagcgcaacaaccaggugcuugaggagucuauggacguggagaucuggaccaaggagggggagcggaagaagcucaggccccgguggcuagacgcccgcaccuacuccgauccccucgcccugcgggaguucaaggaguucgcggccggccgccggucagucagcggggaccugauccuagaaaucggcaagcugccacaacaccugacccagcgcgcccagaacgcccucgacaauuugguuaugcugcacaacucagagcagggcggaagggcguaccgccaugcuauggaggagcuuccggacaccaucgagacccugaugcugcucgcccucaucgccgugcugacgggaggggucacauuguuuuuccuguccggccgggggcucggcaagaccaguaucggccuucugugugugauggccaguagcgugcugcucuggauggcguccgucgagccccacuggauagccgccucgaucauucuggaguucuuucugauggugcuccuuauccccgagccugaccgccagcggaccccgcaggacaaccagcuggccuaugugguaaucgggcuccucuucaugauccugaccguggccgcgaaugagauggguuuguuggagacgaccaagaaggaccucgguaucggccacguggccgucgagaaccaucaccacgccgccaugcucgacguagacuuacaccccgccuccgcauggacgcuguaugccguggccacaacgaucauaacacccaugaugagacacaccaucgagaauaccacugcgaacaucagccucaccgccaucgcaaaccaagccgccauccugauggggcuggacaaaggcuggccuaucuccaagauggacaucggcgugccccuucuugcccuggggugcuacucucaggugaauccucuaacccugacugcggcugugcugaugcugguggcccacuacgccaucaucggccccgggcuccaagccaaggcgacgcgcgaggcccagaagcggaccgccgccggaaucaugaagaacccgaccguggacggaauugucgccaucgauuuagaccccgucgucuacgaugcaaaguucgagaaacagcucggccagauaaugcugcuaauccucugcacaucccagauccugcugaugcgaacgaccugggcccucugcgagucaauuacccuggcaacaggcccccugaccacauuaugggaggguucccccggcaaguucuggaauaccaccaucgccgugagcauggccaacaucuuccgcgggagcuaucuggcgggggccgggcuggccuucucccucaugaagucccucgggggcggacgccgagggacgggggcccagggcgagacccugggagagaaguggaagaggcagcucaaccagcuauccaagucugaguucaauaccuacaagcgguccgggaucauggagguugaccguagcgaggccaaggagggccugaagcgaggggagacgacaaagcacgccguguccaggggcaccgccaagcuacggugguucguggaacgcaaccuugucaagccggaggguaaggugaucgaccugggcugcggccgcggcggguggagcuacuacugcgccgggcugaagaaggugacggaagucaaaggguacaccaagggcgggcccggucaugaggagcccauacccauggccacguacggguggaaccucgugaagcugcacuccggcaaggacguguucuucaucccgccugagaagugcgauacccugcuaugcgacauaggggagagcucgcccaaccccaccaucgaggagggccgcacccugcgcguucugaagaugguggagccguggcuacgcgggaaucaguuuugcaucaagauccugaaccccuauaugccuagcguaguagagacuuuagagcaaaugcagagaaaacacggcggcaugcucgugcgcaacccacugucccggaacagcacccaugagauguauuggguuuccugcgggacuggcaacaucgucucggcggugaacaugaccucccgcaugcuucuaaaccgcuucaccauggcccaccggaagcccacuuacgagagagacguggaucugggagccggcacucggcacgucgccgucgaacccgagguggccaaucuggauaucaucggccagcgaaucgagaauaucaagcacgagcacaaaagcaccuggcauuacgacgaggacaaccccuauaagaccugggcguaccacgggucguacgaggucaagcccagcggcagugccuccucuauggugaauggagucguaaaacuucugacuaaaccuugggacgugauaccaaugguuacucaaaucgccaugaccgacaccacacccuucgggcagcagcggguuuucaaggagaagguggacacacgcacccccaaggcgaagcggggcaccgcccagaucauggaggucacagcuaaguggcuuuggggcuuucugucccgcaacaagaagccacggaucugcacccgcgaggaguucacccggaaggugcgcagcaacgccgccaucggugccguguucgucgacgagaaccaguggaacagcgcgaaggaggcgguggaggacgagcgguuuugggaucuggugcaccgcgagcgggagcugcauaagcaggggaagugcgcgaccugcgucuauaacaugauggggaagcgcgagaagaagcugggggaguucggcaaggccaagggaagccgcgccaucugguacauguggcucggagcucgcuuccuggaguucgaggcccucggauucaugaaugaggaccacugguucuccagagagaacucacugucugggguggagggcgagggguuacacaagcucggcuauauccugcgcgacaucucgaaaauccccggggguaacauguacgccgacgacacggccggcugggauacccggauaacugaggaugaccugcagaacgaggccaagaucaccgacauaauggaacccgaacaugcgcucuuggccaaaucgaucuucaaguugacguaccagaacaaggugguccgcgugcagcgcccggccaagaacggcaccgugauggacgucaucagcagacgcgaucagcgggguuccggccaggugggcaccuacggccugaacaccuucacaaauauggaggcccagcugaucaggcagauggagagcgaggggaucuuuucccccagcgagcuggagacccccaaccuggccggccgggugcuaaauugguuggagaagcacgggguagagcgucucaagcggauggcgauauccggcgaugacugcguggugaagcccauugacgaccgcuucgcuaccgcucucacggcccugaacgacauggggaagguccgaaaagacaucccgcagugggagccauccaagggcuggaacgacuggcaacaggugcccuucugcagccaccacuuccaucagcucaucaugaaggacggccgcgaaauuguggugcccugucggaaccaggacgagcugguggggcgcgcgcgagugucccagggggcggguuggagccugcgcgagacggccugucucggcaaguccuacgcccagauguggcaguugauguacuuccaccggcgcgacuuacgacuggccgcgaacgccaucugcucggccgucccgguggacugggugccuaccagccguaccaccuggaguauucacgcccaccaucaguggaugacuacagaggauaugcuguccguauggaaccggguguggaucgaggaaaacccuuggauggaggacaagacucacgugagcuccuggggcgacgugcccuaccugggcaagcgagaggaccaguggugcggcagccucauugggcugaccgcccgcgcgaccugggccacgaacauccagguggcuaucaaccaggugcgacgccuacucggcaacgagaauuaucuggacuacaugaccuccaugaagcgguucaagaacgaaagcgacccggagggggcucugugguga

SEQ ID NO: 24370 - RNA, 9879 nt, Artificial Sequence
  derived and/or modified CDS sequence (opt11) from DENV-1__FJ898399__SS-prME
agcgugaccaugcugcucaugcugaugcccaccgcucuggccuuccaccuaaccacccgagguggggaaccccacaugaucgugagcaagcaggagcggggcaagagccuacuguucaagaccagcgcgggggugaacaugugcacccugaucgcuauggaccugggcgaguucugcgaggacaccaugaccuauaagugcccccgcaucaccgaagccgaacccgacgacguggauugcugguguaacgccacagacacguggguuacguacggaaccugcagccagacuggagagcauagacgggacaaacgguccguggcccuggccccgcauguuggccucggccuugagacaaggacugagaccuggaugagcagugaaggggccuggaagcagauccaaagggucgagaccugggcauugaggcaccccggguucaccgugauagccuuguuucuugcgcacgccauuggaaccagcauaacccagaaggggaucaucuuuauucugcucaugcuggugacccccuccauggccaugagaugcgucggcaucgguucucgcgacuucguagaggggcugucaggcgcuacuuggguggacgucguucucgagcacgggagcugcgucaccaccauggcaaaggacaagccuacccuggacaucgagcuacucaagacggagguaaccaaucccgcggugcugcggaagcugugcaucgaggccaagaucagcaacaccacaacggacagcagauguccgacacaaggcgaggcgacuuuaguugaggagcaggacgccaauuuugucugucgucgcaccuucguagacagaggcuggggcaacggcugcgggcuguucgggaaggggagccugaucacgugcgccaaguucaagugcgugaccaagcucgagggcaagaucguccaguacgagaaccucaaguacucugugauugugaccguccacacgggcgaccaacaucaaguggggaacgaguccacagaacacggcacgaccgccaccaucacgccccaagcccccucgacggagauacagcugaccgacuacggggcucuuacccuggacuguagcccccggaccgggcuggacuucaacgaaaugguccucuugacuaugaaagaaaaguccuggcuggugcacaagcagugguuccucgaccugcccuugccguggaccagcggggccuccacaagucaggagacguggaaccggaaagacuuacuggugacauucaagaccgcccacgcgaagaagcaggaggucgugguucuaggcucccaagagggcgccaugcacaccgcccucacaggggccaccgagauccagaccagcggcaccaccacgaucuucgcagggcaccugaagugccgccugaagauggauaaguuaacccuaaaggguauguccuacguuaugugcaccgguaguuucaagcuggagaaggagguggcggagacucagcacggcacggugcucguccagauuaaguaugagggcaccgacgccccauguaagaucccguuuuccacccaggacgagaagggggucacccagaauggccggcugaucacggccaaccccaucguuacggacaaagagaagcccgucaacaucgaagccgagccgcccuucggugagagcuacaucgucauuggcgcgggcgagaaggcccugaagcuguccugguucaagaagggaagcuccauuggcaaaauguuugaggcgacugcuagaggagcccggcgcauggcgauucuaggcgacaccgccugggacuuuggguccaucggcggcgucuucacguccgucgggaagcugguucaccaaauauucggaaccgcauacggcgugcuuuucucgggcgucucuuggacgaugaagaucgggaucgguguccuccugaccuggcugggccuaaauagccgcucuacgucgcugucaaugaccugcauagccguuggacugguuacccucuaucucggcguuauggugcaggccgacagcgguugcguuaucaauuggaagggcagggaacugaagugcggguccggcaucuucgugacaaaugaagugcacacguggaccgagcaguacaaauuccaggcagacuccccgaagcggcucuccgccgccaucggcaaagccugggaggagggggucuguggcauccguuccgcuacacggcuggagaacaucauguggaagcaaaucagcaacgagcugaaccacaucuugcuggagaacgacaugaaacugaccguugugguuggggacguagcggggauccuaggccagggcaagaagaugauucggccccagccuauggaguacaaguauuccuggaaguccuggggaaaggccaagaucaucggagccgacgcacagaacaccaccuucaucaucgauggccccaauaccccggagugccccgaugaccaacgcgcguggaacaucugggagguggaggacuacggguucggcaucuucaccaccaacaucugguugaagcuucgggacuccuacacgcagguuugcgaccaucgcuuaaugucggccgccauaaaggauuccaaggccguacacgccgacaugggcuacuggaucgagagcgagaagaaugagaccuggaagcuggcgcgcgcuuccuucauugaggugaagaccugcaucuggcccaaaagccauacccuguggucaaacgggguccucgagagcgagaugaucauccccaagaucuauggcggcccgaucucacaacauaacuaccgccccggcuacuucacgcagacagcugggcccuggcaccugggcaagcuggagcuugauuucgaccugugugaaggcaccacggugguggucgacgaacacugcgguaauagaggcccaagccuccgcacgacgaccgugacaggcaaaauuauucaugaguggugcuguaggucaugcacgcugccgccccuccgguucaagggggaggacgggugcugguacggcauggagaucagacccgugaaggagaaggaagagaaccuggucaagagcaugguuucggccggcuccggggaaguggacagcuucucccuaggccugcugugcaucagcaucaugaucgaggaggucaugcgcucccgguggucucgcaagaugcucaugacggggacccuagcaguguucuuccugcucaucaugggccaacugaccuggaacgaccuaauacgccucugcaucauggugggggcaaacgccuccgacagaaugggcauggguacgacauaccuggcccugauggccaccuucaaaaugcgcccgauguucgccgucgggcuccuguuccggcgucuuacuucgcgggagguucuccugcugacgauaggucucuccuuaguugcaagcgucgaauugcccaacucacuggaagagcuuggggacggccuggccaugggcaucaugauucucaagcugcugaccgacuuccagagccaccagcucugggccaccuuacucucccucaccuucaucaagacgacguucagucugcacuacgccuggaagaccauggcgauggugcucuccaucgugucacuguucccccuuugccuguccaccacgucucagaagaccaccuggcucccgguucuucuagggucucucggcugcaagccgcugaccauguuccugaucgcggagaacaagauaugggggaggaagagcuggccccuuaacgagggcaucauggccguuggaauugugagcauucugcuauccagccuccugaagaacgacgugccccuggccggaccccucaucgcgggcggcaugcugaucgcuugcuacgucaucuccggcagcuccgcggaccugagccucgagaaagccgcugaggucucgugggaggaagaggccgagcacagcggcgcgucccacaacauucucgucgaggugcaggacgacgguacgaugaagaucaaggacgaggagcgggaugacacguugacuauccuccugaaagcgacccugcuggcaguuagcgggguguacccgcuguccaucccugccacucucuucgugugguacuuuuggcagaagaagaagcagcgcagcggugugcucugggacacgcccagcccgccagagguggaacgugcagugcuggacgacgguauuuaccgcaucaugcaacgggggcugcugggccgcagccagguuggcguuggcguauuccaagagaaugucuuucacaccauguggcacgugacccgcggggccgugcucauguaccagggcaagcgccuggaaccauccugggcuucgguaaaaaaagaccugaucuccuacggcggagguuggcggcuccaggggagcuggaacacuggagaggagguccaagugauugccguugaacccgggaagaaccccaagaacgugcagacggcccccggcacuuucaagaccagcgagggugagguaggggccaucgcccuggacuucaaacccggcaccucggggagccccaucguuaaucgcgagggaaagaucgugggccuuuacgggaacggcguggucacuaccuccgggacauauguuagcgccauagcccaggccaaggccucccaggaagggccccucccggagaucgaggacgaaguguuccgcaaacgcaaccugaccaucauggaccuucaccccggaagcggcaagacacgccgcuaccuacccgcuauuguccgugaggccaucaagagaaaguugcggacccuuauccucgcaccgaccagagugguggccuccgagauggcagaggcccugaaggguaugcccauccgauaccagaccacggcagucaaaagcgagcacaccgggaaggagaucguagaccugaugugccacgcaaccuucaccaugcggcuccugucgcccgugcgcguccccaacuacaacaugaucaucauggacgaggcccacuucacggauccgucuuccaucgcggcucggggcuacauaaguacacgcguggggaugggcgaggccgccgccaucuucaugaccgcgacgccucccggguccguggaggccuucccccagagcaacgccgugauccaggacgaggagcgggacaucccggagcgcucuuggaacucaggcuaugaguggaucaccgacuucccaggcaagaccgugugguuugugccauccaucaagagcgguaaugacaucgccaacugccugcgaaagaacggcaagcgcgugauccagcuaucucggaagaccuucgauacggaauaccagaaaacgaagaacaacgauugggauuacguggugaccacggacaucucugagaugggggcaaacuuccgcgcagaccgggucaucgauccccgccggugucugaaaccugugauccugaaggacggcccagagagggucauccucgcggggcccaugcccgugacaguggccucugccgcucagcggcgcggccggaucggcagaaaucacaacaaggagggggaccaguacauauacaugggucagccccucaacaaugacgaagaccacgcccacuggacggaggccaagauguugcucgacaacauuaacacucccgaggguaucauccccgcccuguucgagccggaacgggagaaguccgcugccaucgacggcgaguaucgccugcgcggggaagcgcggaagacauucgucgagcucaugcggcggggugauuugccgguguggcugagcuacaagguggccuccgaaggcuuccaguacagcgacagacgguggugcuucgacggugagcggaacaaccagguacucgaggagaauauggacguagagaucuggaccaaggagggugagcggaagaaguugcgcccucgguggcuggacgcccggacguacuccgauccccuggcccugcgggaguucaaagaguucgcggccgggcgccggagcgugucgggugaucugauccucgagauaggcaaacugccccagcaccugacucaacgggcccagaacgcgcucgauaaccuggugaugcuacacaacagcgagcaaggagggcgggcauaucgccacgccauggaggaacucccagacaccaucgagacucugaugcugcucgcccucaucgcggugcuaacggggggcgucacccucuucuuccuguccggucgaggccugggcaagacuagcauagggcuccugugcgucauggccuccagcgugcuguuauggauggcguccguggaaccccauuggaucgcugcgucaauaaucuuggaguucuuccugaugguuuuacugaucccggagcccgaccgccaacggaccccgcaggacaaccagcuggccuacguagugaucggccuccuguucaugauccugaccgucgccgcgaacgagauggggcugcuagagacgacaaaaaaggaccuaggcaucggacacguugccguggaaaaccaccaccacgcggccaugcucgacguugacuuacaccccgccucugcauggacgcuguacgccguugccaccacgauaaucacccccaugaugcgccacaccaucgagaacaccacggccaauaucagccugaccgccaucgcgaaccaagccgcaauccugaugggccuugauaagggcuggccgaucucgaagauggacaucgggguuccgcuccuggccuuagguugcuacagccaggucaacccucuuacccugaccgcggcggugcucaugcucguggcccacuacgcuaucaucggucccggccuccaggcaaaggcgacgagggaggcucagaaacggacugccgccgggauaaugaagaacccgacaguugacggaauaguggccauagaccuggaccccgucgucuacgaugcgaaguucgagaagcagcucggccagaucaugcugcugauucucugcaccucccagauccugcugaugcgcacgaccugggcccucugcgagagcauaacccuggccaccggaccacugacgacccuuugggaaggcuccccugguaaguucuggaacaccaccaucgccguuuccauggccaacaucuuccgcggcagcuaccuggcgggcgccgggcuugccuucuccuugaugaagagccugggcgggggccgccgggggacaggagcacagggcgagacccugggggaaaaguggaagcggcaauuaaaccagcugucgaagucagaguucaacaccuacaagaggucuggaaucauggaaguggaccgcagcgaggcaaaggagggacugaaacggggggaaaccacgaagcacgccgucucgcgcggaaccgccaagcuacggugguucguggagaggaaccuggugaaaccagagggcaaggucaucgaccugggcugcgggcgggggggguggagcuauuacugcgcaggccuaaaaaaagugaccgaggugaagggguacaccaagggaggccccgggcacgaggagcccauccccauggcgacauauggcuggaaucugguuaaacuacacuccggaaaggacguguucuucaucccgccugagaagugcgacacccugcucugcgacaucggcgaaagcaguccuaaccccaccaucgaggagggacgcacccugcguguguugaaaauggucgagccguggcucagaggcaaucaauucuguauaaagauacugaauccauacaugcccucugugguggagacacuggagcagaugcaacggcgccauggcggaaugcucgucaggaacccucugagccgcaacagcacgcacgagauguacuggguguccugcggcaccggcaacauugugagcgcggucaauaugacgucccggaugcugcugaaccgcuucaccauggcgcaucgcaagccgacguacgaacgggacguugaccugggcgcgggcacccgccauguugccgucgagcccgagguggccaacuuggacauaaucggccagcgcaucgaaaacaucaagcacgaacauaagucgaccuggcacuaugacgaggauaaucccuacaaaaccugggcguaccacggcuccuacgaggugaaaccgucagggagcgccuccucgauggucaacggcguugugaagcucuugacgaagccgugggaugugauccccauggugacucaaaucgccaugaccgacaccacgcccuucgggcagcagagagucuucaaggagaagguggacacccggacccccaaggcaaagagaggaaccgcgcagauaauggaaguuaccgcgaaguggcuguggggauuccucucccggaacaaaaagccgcgcaucugcacccgcgaggaguucacccgcaaaguccggagcaacgcagcuaucggggccguguucguugacgaaaaccaguggaacuccgcgaaggaggcagucgaggaugaacguuucugggaccuggugcaccgugagcgugagcugcauaagcagggcaagugcgcuacuugcguguauaacaugauggggaaaagagagaagaagcucggcgaguucgggaaggccaagggcagccgcgcuaucugguacauguggcugggcgcacgguuccuggaauuugaggcucucggguucaugaacgaggaccacugguucucccgagagaacagccuguccggcguagagggggagggccugcacaagcucggguacauucuccgggauaucagcaagauucccggugggaacauguacgcagaugauacagcugguugggacacccgcaucacggaggacgaucuccagaacgaggccaagaucacggacaucauggagccggagcacgcgcuccuggcuaaguccaucuucaagcugaccuaccaaaauaagguggugcggguccagcgcccggccaagaauggaaccgugauggacgugaucucacgccgggaccagcgcgguuccggccaaguuggcacuuacggguuaaacaccuucacuaacauggaggcccaguugauccggcagauggagucggagggcaucuuuucgcccagcgagcuggagacccccaaccucgccggacggguguuagacuggcuggagaaacacggcguggagcggcuaaagcgaauggcgaucuccggggacgacugcgucgucaagcccaucgacgaccgcuucgccaccgcccugacagcccugaacgacaugggcaaaguccgcaaggacaucccgcagugggagccuagcaagggcuggaacgacuggcaacagguccccuucugcucccaucauuuccaccagcuuaucaugaaggacgggagagaaaucguugucccaugccgcaaucaggacgaacuggucgggcgggcccggguuucccagggggcgggcuggagccuccgggagaccgcgugccucgggaaguccuacgcccaaauguggcagcuuauguacuuccacaggcgggaccugcgccucgccgcaaaugccaucugcagugcggugccagucgacugggugcccaccucccggaccaccuggagcauccacgcacaucaccaguggaugacaacugaggacauguugagcguguggaaccgugucuggaucgaggagaacccauggauggaggacaagacccacaucaguucauggggcgaugugcccuaucucggcaagcgggaggaucaguggugcgggagcuugaucggccugaccgccagagcgacgugggccacgaacauccagguagcaauuaaccaggugaggcggcugaucgggaacgagaacuaucucgacuacaugaccuccaugaagcgcuucaagaacgagagcgaucccgagggugcccugugguga

SEQ ID NO: 24371 - RNA, 9879 nt, Artificial Sequence
  derived and/or modified CDS sequence (opt11) from DENV-1__FJ898401__SS-prME
agcguuacgaugcugcucaugcuuaugcccaccgcccuagccuuccaccucacgacccggggcggggagccccacaugaucgugagcaaacaagagcggggcaaaagccugcuauuuaagacuuccgccgggguaaacaugugcacccucaucgccauggaccugggcgaguucugcgaagauacgaugaccuacaagugcccgcgcaucaccgaagcagaaccagacgacguggacuguuggugcaacgccaccgacacgugggugacauaugggacaugcucccagaccggggaacacaggagggacaagcggaguguggcccuggccccccacgugggcuuggggcuggagacgcggaccgagacuuggaugucuagcgagggcgccuggaaacagauccagcggguggagaccugggcgcuucgacaucccggguucacggugaucgcccucuuucuggcacacgcuaucggcaccagcaucacccagaaggggauaauuuucauucuucucauguuaguaacccccagcauggccaugcggugcgugggcaucgggagccgcgauuucgucgagggucuguccggcgccacguggguggacgugguucuagagcacgggagcugcgugacaaccauggccaaggacaagcccacgcuagauauagaacugcuuaagacggagguuaccaacccggcuguacugaggaagcugugcaucgaggcuaagaucuccaacacgaccacugauagccgcugcccgacgcagggcgaggccacccucguggaggagcaggacgccaacuucgucugccggcggaccuucguggaccgcgggugggguaauggaugcggacuguucggaaaggggucccugaucacgugcgccaaauucaagugcgugaccaaauuagaggguaagaucguccaguaugagaaccugaaguacagcgugaucgugaccgugcacaccggcgaucaacaccagguagggaaugaguccacugagcauggcaccaccgcgaccaucacgccccaggccccgucaaccgagauccagcugacagacuacggcgcccucaccuuggacugcagcccccggaccggccuggacuuuaacgaaaugguccuccuuacgaugaaggaaaaguccuggcugguccacaagcagugguucuuggaccuuccgcuccccuggaccagcggggcguccaccagccaggagaccuggaacagaaaggaccucuuggugacauucaaaaccgcccacgcgaaaaagcaggaggugguggugcuggguucccaggaaggcgccaugcacaccgcacucacaggggccaccgagauccagacaucuggcaccacuacgaucuucgccgggcaucuaaagugccgccugaaaauggacaaacucacccugaagggcauguccuacgucaugugcaccgguucuuuuaagcucgagaaggagguggcggaaacccaacauggcacgguccucgugcagaucaaguacgaaggcacugacgcccccugcaagauacccuucagcacccaggaugaaaaggggguuacccagaacggccggcugaucacggccaacccgaucgucaccgauaaggagaagccggucaacauugaggccgaaccucccuucggggagagcuacauugugaucggcgcaggcgaaaaggcccugaaguugucaugguuuaagaaggggaguagcaucgguaagauguucgaggcuaccgcgcgcggggcuagacgcauggcgauacucggggacaccgccugggauuucgggagcaucggcggcguguucacguccguggggaaauuagugcaccagauauucggcaccgccuaugggguccuguucucgggcguauccuggaccaugaagaucgggaucgguguacucuuaacauggcugggucucaacucgcgcuccaccucacugucuaugaccuguaucgcuguugggcuagucacguuauaucugggcguuauggugcaggccgauagcgguugcguuaucaacuggaaagggcgggagcugaagugcggauccggcaucuuugugaccaacgaggugcacacguggaccgagcaauacaaguuccaagcggacuccccuaagcgccugagcgccgcgaucgguaaagcuugggaggagggggucugcggaauccggucugccacccggcuggagaacaucauguggaaacaaaucagcaacgagcugaaccacauccuccuggagaacgacaugaaguucaccguggucgucggggacguagccgguaucuuggcgcaggggaagaaaaugauccggccacaaccaauggaguacaaguacuccuggaagucuuggggcaaggccaagaucaucggcgcggacgugcagaacaccacuuucauaauagacgggcccaacacaccggagugucccgacgaccagcgcgcauggaacaucugggaggucgaagacuacggcuuugggaucuucacuaccaacaucuggcuaaaauugcgggauagcuacacccagguaugugaccaccggcugaugagcgccgccauuaaggacuccaaagccgugcaugccgacaugggauacuggaucgagagcgagaaaaacgaaaccuggaagcuggcgcgugccucuuucaucgaggucaagaccugcauuuggccuaaaagccacacgcugugguccaacggcguucuggaauccgagaugaucauccccaagaucuaugggggccccaucucccagcacaauuaucgcccaggauacuucacgcagaccgcgggucccuggcaucucgggaaacuugagcuggacuucgaccucugugaggggaccaccguggucguagacgggcauugugguaauagaggcccuucguuacggacgacaaccguuacugggaagaucauccacgaguggugcugucgauccugcacgcugccgccccugcgcuucaaaggggaggacggguguugguacggcauggagauccggccuguaaaggagaaggaggagaaccuggucaaguccaugguaagcgccggguccggggaggucgacagcuucucucugggucuccuuugcauuagcaucaugaucgaggagguaaugcgcucacgguggagccgcaagaugcugaugaccgggacccucgccguguucuucuugcugaucaugggccaacucaccuggaacgaccugauccgccugugcaucauggucggagcgaacgcaucugaccgcaugggcaugggcacaacauauuuagcccugauggccacguucaaaaugcgcccuauguucgccguagggcuccuguucaggcguuuaacgagccgugaaguccugcuccucacgaucggcuuguccuuaguagccucuguagagcugcccaacagucuggaagagcucggggacggccuggccaugggcaucaugauauuaaagcuacugaccgacuuccaaagccaccaacuuugggcuacccuacuaucgcugacuuucaucaagacaacuuucagccuccacuacgccuggaagaccauggcgaugguccuguccaucgugagccuguucccccucugccuguccacaacgucacagaagaccaccuggcugcccgugcuccuaggguccuuaggcuguaagccgcucaccauguuucugauugccgagaauaagaucugggguaggaagagcuggccccugaacgagggcaucauggccguggggauaguaagcauacuccugucaagucugcucaagaacgacgugccccuggccggcccgcugaucgcgggaggaaugcucaucgcgugcuacgucaucuccggcagcucggcugaccugagccuggaaaaggcugccgagguguccugggagaaagaggcggagcacagcggggccucacauaacaucuuaguggagguccaggacgacgggacuaugaaaaucaaggacgaggagcgggacgacacccugacaauauugcucaaggcaacccuccuugcuguguccgggguauauccgcucuccauuccggccacacuguucguguggcauuucuggcagaagaagaagcagcgcuccggcguguugugggauacacccagcccgcccgagguggaacgggcagucuuagacgacgggaucuaucgcauuaugcagcgggggcugcugggccgcagccaggugggggugggcguauuucaggagaacguuuuccauaccauguggcaugucacaaggggggccguacugauguaccagggcaagcgccucgaaccguccugggccuccgugaagaaagaccugaucuccuacggggggggcuggcggcugcaagguuccuggaacaccggcgaggaggugcagguaaucgcuguggaaccugggaagaacccuaagaacguucagacggcccccggcaccuucaagacguccgagggagaagucggugccaucgcucucgacuucaagcccggaaccucaggaagcccuaucguuaaucgggagggcaagauagucggccuauacgggaauggcguggugacgaccuccggcaccuacgugagcgccaucgcccaagccaaggcaucccaggagggcccacugccggaaaucgaagaugaggucuuuagaaagcgcaaccugacaaucauggaucuacacccagggagcggcaagacgcgccgcuaccugccagccauuguucgcgaggccauuaagcggaagcuucguacccugauccuggccccuacccgggugguggcuagcgaaauggcggaggcccuaaaaggcaugcccauccgcuaccagaccacugcugucaagagcgaacacaccggcaaggagauuguagaccucaugugccacgccaccuuuacaaugcgccugcugucgcccguccgcguacccaacuacaacaugaucaucauggacgaggcccacuucacugacccgagcaguaucgccgcccgaggcuacaucagcacccgaguggguaugggcgaagcugcggccaucuucaugacugcgacgccgcccgggagcgucgaggcauuuccccagagcaaugccgugauccaagacgaagagcgggauaucccggaacgcucauggaauagcggcuaugaguggaucacggauuuccccggcaagacggugugguucguccccuccaucaagucggggaacgacauagcaaauugccugcguaagaacggcaagcgcgugauccagcugucccggaaaacguucgacaccgaguaccaaaagacgaagaacaacgacugggauuacguggucaccacugacaucagcgaaaugggggcaaauuuccgugccgacaggguaauagauccuaggagaugcuuaaagccuguuauccucaaggacggccccgagcgagucauccuggcggguccuaugccagugaccguugccuccgcagcccagcgucguggcaggaucggccguaaccauaauaaggagggggaccaguauaucuacauggggcagccgcucaacaacgacgaggaccacgcccacuggacggaggccaagauguuacuggauaacauaaacacccccgaggggaucauccccgcccuauucgagccggagcgggagaaaagugcugcaaucgacggcgaguacaggcugaggggcgaggcacggaagacguucguggagcuuaugcgacggggcgaccucccgguuuggcugucauacaaggucgccuccgagggcuuccaauacagcgaccgccgcuggugcuucgacggugagcggaacaaucagguucuggaagagaacauggauguggagaucuggaccaaggagggcgagcggaagaaacuccgcccucgguggcuugacgcccguaccuacagugacccccuggcacucagggaguucaaggaguuugcggcgggccgccggagcgucuccggcgaccugauccucgagaucggcaaacucccacagcaccugacccagcgcgcccagaacgcccuggauaaccucgugaugcuacacaacagcgagcagggcgggcgggcguaccgccaugcgauggaggagcucccggauaccaucgagacacucaugcuguuagcccucauagcuguucugaccggcggagucacguuauucuuccucuccgggcggggccugggcaagaccuccaucggguuacucugcgugauggcguccagcgugcugcuguggauggcaagcgucgaaccccacuggaucgccgcuagcaucauccucgaguucuuucugauggugcugcugauucccgagcccgaccgccagcggaccccucaggauaaccagcuggccuacguggucaucggccuccuauucaugauccugaccguggcagcgaacgagaugggguugcucgagacgacuaagaaggaccuaggcaucgggcacguggcagucgaaaaccaccaccaugccgcgaugcuggacguggaccuccaccccgccuccgccuggacccuguacgccguagcgaccacgauaauaacccccaugaugcggcacaccaucgagaacacuacugcgaacaucucccugaccgcaaucgcuaaccaagccgcgauccucaugggccuggacaagggcuggccgaucucgaagauggauaucggggucccccugcucgcccugggcuguuacagccaggugaacccacugaccuugaccgcggccguacugaugcuggucgcccauuacgccaucauagggcccggccuccaagccaaggcgacgcgggaggcccagaagcgcacagccgcagggaucaugaagaacccgaccguggacggcaucgucgcgaucgacuuagaucccgugguguacgacgcuaaguucgagaagcagcuggggcagauuaugcuucugauccugugcacaucccaaauccuccugaugcgcacgaccugggcccugugcgagagcaucacacucgcuacuggcccccucacgacccuaugggaaggcucgcccggcaaguucuggaacaccaccaucgccgugucgauggcuaacauauuccggggcagcuaccucgcgggcgccgggcuggccuuuuccuuaaugaagucccucggaggaggccgccggggcacgggcgcgcauggagagacgcuaggagagaaguggaagcgccaguuaaaccaguuguccaaguccgaguucaacaccuacaagcguucugggaucauggaggucgaccgcagcgaggcuaaggaggggcugaagcgcggcgagaccacgaagcacgccgugucccgcgggaccgcgaagcugcgaugguucguagagcgcaaccuggugaagccggagggcaaggugaucgaccugggcugcgggcggggcggguggagcuacuacugcgccggacugaagaaagucacagaggucaagggguacaccaagggaggcccagggcacgaagagccuauucccauggcaacguacggauggaaccuggugaaacuccacuccgggaaagacguguucuucaucccgccugagaagugugacaccuugcugugcgacaucggggagucaucccccaaucccaccauugaggaggggcgcacccuccggguccuuaagaugguggagccguggcugcgcggcaaccaguucugcauuaagauucucaaccccuacaugccuagcguggucgaaacgcuugagcagaugcaacguaagcacgguggcaugcugguacgcaacccccucucuagaaacagcacccaugagauguauuggguaaguuguggcaccgggaacauugucagugcggugaauaugacaucccgcaugcugcugaaccgguuuacaauggcgcaucgcaagccaacguacgagcgcgauguugaccuuggggcuggcacgcggcacguggccguggaacccgagguggcgaaucuggacaucaucgggcagcgcauugaaaacaucaagcacgagcacaaaucaacuuggcauuacgacgaagacaaccccuacaagacaugggcguaccauggcuccuacgaagucaagcccagcgggucggccucaagcaugguaaacggcgucgucaagcuguugaccaagccuugggacgugauucccauggucacccagauugccaugaccgauaccacucccuucgggcagcagcgaguguucaaggagaagguggauacccggaccccaaaggccaaacggggcaccgcccagauuauggaggucacggcgaagugguuauggggcuuccugucccgcaacaagaagccgcggaucuguaccagagaggaguucacgcggaaagugagaucaaaugccgccauaggugccgucuuugucgacgagaaucaguggaacuccgcgaaagaagcuguagaagacgagcgguucugggacuuagugcaucgugagcgggagcugcacaagcagggcaagugcgcgaccugcguguacaacaugauggggaagcgcgagaagaagcuaggagaguuugggaaagccaagggcagccgcgccaucugguacauguggcucggagcgcgcuuccuggaguuugaggcccuaggguucaugaacgaggaucacugguucagccgggaaaauucccugaguggcgucgaaggagagggccugcacaagcugggguacauacuacgcgacauaaguaagauccccggaggcaauauguacgccgaugauaccgccgggugggacaccagaaucacugaggacgaccugcagaaugaagcuaagauaaccgacaucauggaaccggagcacgcguuacucgcuaagucuaucuucaagcugacguaccagaacaaggugguccgcguccagaggccagcuaaaaacggcaccguuauggacgucauuucccggcgcgaucagcggggcuccggacagguggguaccuaugggcucaacacuuucacgaauauggaggcccaguugauucgucaaauggagagcgagggcaucuucuccccaagcgagcuugaaacgcccaacuuagccggcagagugcucgacuggcuggaaaagcauggcgucgaacggcugaagcggauggcgaucuccggggacgacuguguggugaagcccaucgacgaccgcuucgccacggcccucaccgcccugaacgacaugggcaaaguccggaaagacaucccgcagugggagcccagcaagggauggaaugacuggcagcaaguccccuucugcagccaccacuuccaucagcugauuaugaaggacggacgcgagauuguggucccuugccgcaaccaggacgagcuuguuggucgcgcccgggugucgcaaggcgcgggcuggagccugcgcgagacggcgugccuggggaagucauacgcacaaauguggcagcucauguauuuccaccggcgcgaccuccggcuggccgccaacgccauuugcucugcgguaccuguggauuggguccccaccucacgcaccaccuggagcauucaugcccaccaccaguggaugaccaccgaagauaugcucucggucuggaaccggguguggaucgaggagaaucccuggauggaggacaaaacccacaucagcuccuggggggacgucccauaucugggcaagcgcgaagaccaguggugcgggagccuuaucggcuuaacugcccgcgcgacgugggccacgaauauccaagucgcuaucaaccaggugcgacgccugaucgguaacgagaacuaccuggacuacaugaccuccaugaagcgguucaagaacgagucugacccggaaggcgccuugugguga

SEQ ID NO: 24372 - RNA, 9879 nt, Artificial Sequence
  derived and/or modified CDS sequence (opt11) from DENV-1__FJ898402__SS-prME
agcgugaccaugcugcugaugcugaugcccaccgcccuggccuuccaucucacgacccggggcggggaaccccacaugaucgugagcaagcaggagcggggcaagagccugcuguucaagaccucugcgggggugaacaugugcacgcucaucgccauggaccucggggaguuuugcgaggacacgaugaccuauaagugcccucgcaucaccgaggccgagcccgaugacgucgacugcuggugcaacgcuacagauaccuggguaacauacgggaccugcagccaaacaggcgagcaccgccgggacaagagauccguggcccuggcgccucacguaggccucgggcuggagacgcgcaccgaaacauggaugagcuccgagggcgccuggaagcagauacagcgaguggagaccugggcccugcgccaccccggguucacggugauugcccucuuucuggcccacgccaucggcaccagcaucacccagaaagggaucaucuucauucugcucaugcugguaacacccuccauggccaugcggugugucggaaucggcagccgcgauuucguggagggucuauccggcgccacguggguggacgucgugcuugagcacgggagcugcgugaccaccauggccaaggacaagcccacccuggacaucgagcuucucaagacggaggucaccaaccccgccgugcugcggaagcugugcaucgaagccaagaucuccaauaccaccacggacagccguugcccgacccagggggaggccacccugguggaggaacaggacgcuaacuucgucugccggcgcaccuuuguggaucgggggugggggaacggaugugggcuguucggcaaggggucccugaucacaugcgccaaguuuaaaugcgugaccaagcuagagggcaagauaguccaguacgagaaccugaaauacagcgugaucgugaccguccacacgggcgaccagcaccagguggggaaugaguccacggagcacggcaccaccgcgaccaucacgccacaggccccauccacggagauccagcugaccgacuacggggcccugacccuggacugcagcccccggaccggcuuggacuucaacgagaugguacugcuaacgaugaaagagaaguccuggcuggugcacaagcagugguuccuggaccuaccgcuuccuuggacgagcggggccuccaccagccaggagaccuggaaccggaaggaucuccuugugaccuuuaagaccgcacacgcgaagaagcaggagguuguggugcuaggcucccaagagggggccaugcacacugcccucaccggagccacggagauccagaccagcggcaccaccacgaucuucgccgggcaucugaagugccgccucaagauggacaagcucacacugaagggaauguccuacgucaugugcacuggcagcuucaagcuggaaaaggaggucgcagagacccagcauggcacgguucucguccaaaucaaguacgagggcaccgacgccccaugcaagauccccuucuccacccaggacgagaagggggugacccagaauggcaggcugauuaccgccaacccgaucguaacagacaaggagaagcccgucaacaucgaggccgagccgcccuucggggagaguuauaucgugaucggagcgggcgagaaggcccugaagcuguccugguucaagaaggggagcuccaucgguaagauguucgaggccaccgcccgcggggcccgacgcauggcgauccucggcgacaccgcuugggacuucgggagcauugguggcguuuucacgucagucgguaagcucgugcaccaaauauucggcaccgccuacggggugcuguucuccggcgucuccuggaccaugaagauugguaucggcgucuugcuuaccuggcugggccucaacagccgcuccacgagucuguccaugaccugcaucgccguggggcuggucacccucuaccugggcgugauggugcaggccgacagcgggugugucaucaacuggaagggccgggaauuaaagugcgguagcggcauauucgugaccaacgaggugcacacauggaccgagcaguacaaguuucaggcggacucaccgaagaggcucagcgcugccaucgggaaggccugggaagagggggucugcggcauccgguccgcaacccgacuugagaacaucauguggaagcagauaagcaacgagcugaauuacaucuuauuggagaacgacaugaaguucaccgugguggucggagauguggccggcauccuggcccaagggaagaagaugauccggccccaacccauggaguacaaauacuccuggaaguccuggggcaaggccaagaucaucggcgccgacgugcagaacaccacguucaucaucgacgggcccaacaccccggagugccccgaugaccaacgcgcuuggaacaucugggaaguagaggacuaugguuuugggauuuucaccaccaacaucuggcucaagcugcgagacuccuacacacaggugugcgaccaccgccucaugagcgccgccaucaaggauagcaaggccgugcacgccgauaugggcuacuggaucgaaucggagaagaaugagaccuggaagcucgcgcgugccuccuuuauugaggucaagaccugcaucuggcccaaaagccacacccugugguccaacggcguccuggagagcgagaugaucauccccaagaucuacgggggcccgaucucccagcacaacuaccgccccggguacuuuacccagaccgcaggucccuggcaccucggcaagcuggagcuggacuucgaccucugcgaggguaccaccgugguagucgacgaacacugcggcaaccggggcccgagcuuacgcacgaccaccguaacagggaagaucauacacgaauggugcugccgguccuguacccuuccgccccugcgcuucaagggggaagacggcuguugguacggaauggagauccggcccgugaaagagaaggaggagaaccuagucaagagcauggugagcgccggcuccggcgaggucgauucguucucccuggggcuccugugcaucuccaucaugauugaagaggugaugcgcuccagguggagccgcaagaugcugaugacgggaacgcucgcgguguucuuccugcugaucaugggccaacucaccuggaacgaccugaucaggcugugcaucaugguuggcgcgaacgccuccgaccggauggguaugggcacgaccuaccucgcccugauggccacuuucaagaugcgccccauguucgccguggggcuccucuuccggcgccugaccagccgggaggugcuacuccuaacgaucggcuugucccucgucgcgagcguggagcugccgaacucccuggaagaacucggcgaugggcuggccaugggcauuaugauccuuaagcuccugacagacuuucagucgcaccaacugugggcaacucuccuuucgcugaccuucaucaaaacgaccuuuucccuccacuacgccuggaagaccauggcgaugguccuguccaucgugucuuuauuuccccucugccugagcacaacgagccagaagaccaccuggcugccagugcuccuaggcucccuggggugcaagccacucacgauguuucugaucgccgaaaacaagaucuggggacgcaagaguuggccacuaaacgaagggaucauggccgucgguaucguuagcauccuccuuagcagccugcuaaagaacgacgugccccuggcggggccccugaucgccggcggcaugcucaucgccugcuaugucauauccgggagcagcgccgaucugagccuggaaaaagccgccgaaguguccugggaagaggaggccgagcauagcggcgcgucacacaauauccucguggagguccaggacgacgggacgaugaagaucaaggacgaggagcgggacgacacccugaccauccuguugaaggccacccugcuggcggugagcggcguguacccguuauccauccccgccacacucuucguuugguacuucuggcagaaaaagaagcagcgcagcgggguccucugggacacgcccagcccacccgagguggagcgggccguccucgacgacggcauuuaccgcaucaugcagcggggccugcuggggaggagccaagugggcgugggggucuuccaggagaacgucuuccacaccauguggcaugugaccaggggcgccguccugauguaccaggggaagcgccucgagcccuccugggcuagcgugaagaaagaccugaucuccuacggcggcggguggcggcugcagggcucuuggaauaccggggaggaagugcaggucaucgcaguggagccgggcaagaaccccaagaacgugcaaacggccccggggaccuucaagaccagugagggcgaggucggggccaucgcgcucgacuucaagcccgggaccucgggcagccccauagugaaucgcgagggcaagaucguaggucuguaugggaauggggucgugacgaccuccggcaccuacguaucggccaucgcccaggccaaggcgucccaagaagggccccugccggaaaucgaggacgagguauucagaaagcggaaccucaccaucauggaccugcaccccggcucggggaagacgcggcgcuaccugcccgccaucgugcgggaggcaauuaaacgcaagcucagaaccuuaauccuggcgccgaccaggguggucgccuccgagauggcggaggcauuaaaggggaugcccauucgcuaccagacgacagccgucaagagugagcacaccggcaaggagauaguggaccugaugugccacgccaccuucacgaugagacuacucucccccguacgggugccgaacuacaacaugaucauuauggacgaggcccacuuuacagauccgagcuccauugcggcgcgugguuacaucucgaccagagugggcaugggggaggcggccgccaucuucaugaccgcgacuccacccggguccgucgaggccuucccccagucuaacgccgugauacaggacgaggagagagacauaccggagcgcuccuggaacuccggguaugaguggaucacagacuuccccggcaagaccgugugguuuguccccuccaucaagagcggcaaugauaucgccaacugucugcggaagaacgggaagagagugauccagcugucucggaagacguuugacaccgaguaucagaagacgaagaacaacgacugggacuacgucguuaccaccgacaucagcgagaugggagcgaacuuccgagccgaccgggugauugacccccgcagaugccucaagccggugauccugaaggacggucccgagcgcguaauccuggccggucccaugcccgugacggucgccuccgccgcgcagaggcgcgggcguaucggccgcaaccacaacaaggagggcgaccaguacaucuacauggggcagccgcucaacaacgacgaggaccacgcccacuggacggaggccaagauguugcuggauaauaucaacaccccggagggcaucauacccgcccucuucgagcccgagagggagaaauccgcggcgaucgacggggaauaucgcuugcgcggcgaggcccggaaaacauucguggagcugaugcgccguggggaccucccgguguggcucagcuauaagguggcauccgagggauuccaguacagcgacagacggugguguuucgacggcgagcgcaacaaucaggugcuggaggagaacauggauguggagaucuggaccaaggaaggggagcggaagaaacucagaccgcgguggcuggacgccagaacguacuccgacccccuggcccuuagagaguucaaggaguucgccgccggucgccgauccgucaguggggaucugauccuggagaucggaaagcucccucagcaccuuacccaaagagcucaaaacgcucuggacaaucucgugaugcuucacaauucagaacagggcgggcgggcguaccgccacgcuauggaggagcugccggacacaaucgagacccucaugcugcuggcccucaucgcgguuuugacggguggggucacccuguucuuccucuccggccgggggcugggcaaaaccagcaucggccugcuuugcgugauggcuuccagcgugcugcuguggaccgcuucggucgagccccacuggaucgccgccagcaucaucuuggaguucuuccugauggugcuuuugauccccgaaccugaucgccagcggaccccgcaggauaaccagcuagcguacguggucaucgggcuccucuucaugauacugacgguggccgcgaacgagaugggccugcucgagaccacgaagaaagacuuggggaucggccacguggccgucgagaaccaccaccacgccgcaaugcuagauguggaccugcaccccgccuccgcuuggacucuuuacgccguggccacaaccaucauuacccccaugaugcgacacaccauagagaauacgacggccaacaucagcuugaccgccaucgcuaaccaggccgccauacucaugggucuggauaagggauggccgaucuccaaaauggauauuggcguccccuuacucgcccuggggugcuacagccaggugaacccccugacccucacugccgcggugcugaugcuggucgcccacuacgcaaucaucgguccagggcuccaggccaaggcgacccgggaggcccagaagcgcacagccgccgguaucaugaagaacccgaccguggauggcaucguagccauagaccuggacccaguggucuacgacgcgaaguucgagaagcagcugggucagaucaugcugcuaauccugugcacgucucagauccuucuuaugcgcaccaccugggcccugugcgagagcaucacauuagccacgggcccgcugaccacucugugggaggggucccccggcaaguucuggaacaccacgaucgccgugagcauggccaacauauuucggggaucuuaucuugcgggcgcgggccuggccuucucacugaugaagucccuggguggcggccggcggggcaccggagcccaaggcgagacccuaggcgagaaauggaagcgccaacugaaccaguuaucaaaaagcgaguucaacacauacaagcgguccgggaucauggaggucgaccgcagcgaggcgaaggagggccugaagcguggggagacgacgaagcacgccguguccagaggcaccgcuaaacugcggugguucguggagcgcaaccucguuaagccggaagggaaagugaucgaccugggcugcggccgcggaggguggagcuauuacugcgccgggcugaagaagguuacugaggucaaaggguacaccaaaggaggccccggccacgaggagcccauucccauggccaccuacggguggaaccuggugaagcugcauuccggcaaagacguguucuuuauuccgcccgagaagugcgacacccugcuaugcgacauuggggaauccucccccaaccccacaaucgaagagggccgcacgcuccggguccugaagaugguggagccguggcuccgcgggaaccaguuuugcaucaagauccucaaccccuacaugccuagcguggucgagacccuggaacaaaugcagcggaaacauggcggcaugcuggugcgcaacccccucucccgcaauagcacccacgagauguacugggugucaugcgggaccgguaacaucgucagcgccgugaacaugaccucgcgaaugcuccuuaaucgguucacgauggcccaccgcaagccgacuuacgagcgcgacguggaucucggggccggcaccaggcaugucgccguggagcccgaaguggccaacuuagacaucaucggccagcgcaucgagaauaucaagcacgagcacaagagcaccuggcacuacgacgaagauaacccguacaaaacgugggcauaccacggguccuacgaggucaaacccagcggcagcgccuccagcauggugaacgguguugucaagcuccucaccaaaccgugggacgugauucccauggucacccagaucgcuaugaccgacacgacacccuuuggucaacagcggguguucaaggagaagguggacacccgaacucccaaggcuaaacgggggacggcucaaaucauggaggucaccgcgaaguggcuguggggcuuccugucccgaaacaagaagccgcggaucugcacccgagaggaguucacgcggaagguucgcagcaacgccgccaucggcgccguguucgucgacgagaaccaguggaacuccgcgaaagaggccguugaggacgagcgguuuugggaccucgugcaccgcgaacgggagcugcauaagcaggggaaaugcgcaacgugcgucuacaacaugaugggcaagcgggagaagaagcugggagaguucggcaaggcaaagggcagccgggccauaugguacauguggcucggggcgcgguuccucgaguucgaggcccugggcuucaugaacgaggaccauugguucucccgggagaacucuuuauccgggguugagggcgagggcuuacacaaacuugguuacauccuccgcgacaucucgaaaauccccggggguaacauguacgccgacgacaccgcgggcugggacacccggauaacggaggacgaccugcagaacgaagccaaaaucaccgacaucauggagcccgaacacgcccugcucgccaaguccaucuucaaauugaccuaccaaaauaaggugguccgcgugcagcggccugcuaagaacgggaccgugauggacguuauuagccgccgcgaccagcggggcuccggccaggugggaaccuacggccugaacacuuucacaaacauggaggcccagcucauccgccagauggagagcgaagggaucuucuccccgagcgagcuggagacccccaaccuggccggacgggugcuggacuggcuggagaagcacggggucgaacgccugaagcggauggcgaucucgggcgacgauuguguuguaaaacccauagacgaucgguucgccacugcgcuaacugcccugaacgacauggggaagguaaggaaggacaucccgcagugggagccuagcaagggcuggaacgacuggcagcagguacccuucuguagccaccacuuucaccagcugaucaugaaagacggcagggagaucguugugcccugccggaaccaggacgagcucguggggcgggcacgggugucccagggcgcgggguggagcuugcgcgagacugcaugccugggcaaguccuaugcgcagauguggcagcucauguacuuucaccggcgcgacuuacggcuggccgcgaacgccaucugcagcgccguaccgguggauugggugcccaccucccgcacgacguggagcauccacgcccaccaccaguggaugaccacggaagacaugcucagugucuggaaccggguguggaucgaggagaauccuuggauggaggauaagacccacaucagcucguggggcgacgugcccuaucugggcaaacgcgaggaccaauggugcggcagccugaucgggcucaccgcacgggcgacuugggcuacgaacauccaggucgccauuaaccagguucgccgccugaucggaaacgagaacuaccuagacuacaugaccuccaugaagcgguucaagaacgagucugaccccgagggggcccucugguga

SEQ ID NO: 24373 - RNA, 9879 nt, Artificial Sequence
  derived and/or modified CDS sequence (opt11) from DENV-1__FJ898403__SS-prME
agcgucaccaugcuacucaugcugaugcccaccgcucuugccuuccaccucacgaccagaggcggggagccucacaugaucgugagcaagcaggagaggggcaagagcuuacuguucaagacgagugccggggugaacauguguacccucaucgccauggaccugggcgaguucugcgaggauacaaugaccuacaagugcccccgcaucaccgaggccgagcccgacgacguagacugcuggugcaacgccaccgacacguggguuaccuacggaaccugcagccagaccggugagcaccggcgggacaagcgguccguggcccuggcuccccacgugggccuaggguuagagacgcgcaccgaaacauggaugagcuccgagggcgcauggaagcagauacagcggguggagaccugggcccugcgccaccccggguucacgguuaucgcccucuucuuagcgcacgcuaucggcaccagcaucacccaaaagggcaucaucuucauccugcucaugcuggugacgccauccauggcuaugcggugcgucggcauagguagccgcgacuucguggaggggcuguccggggccacauggguggacgucgugcucgagcacggaucaugcgugaccaccauggccaaggacaagcccacucuggacaucgagcugcugaagaccgaggucaccaaccccgcgguacugcggaagcugugcaucgaggccaagaucuccaacaccaccacggacagccgcuguccgacccagggcgaggcuacccuuguggaggagcaggacgccaacuuugucugccgccgcaccuucguagaccggggcuggggcaacggcugcggcuuguuuggcaaggggucccugaucacaugcgccaaguucaagugcgugaccaagcucgagggcaagaucguccaguaugagaaccuaaaguauagcgugaucgugaccguccacaccggcgaucagcaccaggucgggaacgaguccacggagcacggcacaaccgcgacaaucaccccucaggcucccaguacggagauccagcugaccgacuauggagcccucacccuagacugcagcccucggaccggcuuagacuucaacgagaugguccuccucacgaugaaggaaaaauccuggcugguccacaagcagugguuccucgaucugccgcugcccuggaccagcggggcguccaccucccaggagaccuggaacaggaaggaccuccuggugacguucaagaccgcccacgcgaagaagcaggaggucguggugcugggcucccaggagggcgcgaugcacaccgcccucaccggcgccaccgagauccagaccucgggcaccaccacaaucuuugccgggcaccugaagugucgccugaaaauggacaagcucaccuuaaagggcauguccuacgucaugugcaccgggagcuucaagcuagagaaggagguggcggagacccagcacggcacgguguuaguccagaucaaguacgagggcaccgaugcccccuguaagauccccuucuccacccaggacgagaagggggugacccagaauggccggcugaucacggcaaacccgaucgugaccgacaaggagaagcccgucaacaucgaggccgagccgccuuucggggagucauauauagugaucggcgcgggcgagaaggcccugaagcuguccugguucaagaaaggaagcuccaucggcaagauguucgaggccaccgcacgcggcgcucggcggauggcgauccucggcgacaccgccugggacuucgggagcaucggaggcguguucacuuccgucgggaaguuagugcaccagaucuuuggcaccgccuacgggguucuuuucagcggcgucuccuggacgaugaaaaucgggaucggagugcugcugaccuggcuuggacucaacagccggagcacgagccugucaaugacaugcaucgccgugggguuggucacucucuacuugggaguuauggugcaggcagacagcgggugugucaucaauuggaaaggccgggagcugaagugcgggagcggaauauucgugacgaacgaggugcacacauggacugagcaauauaaguuucaagcggacucgccuaagcgucucagcgccgccaucgguaaggcuugggaggagggggucugcggcaucagauccgccacccgacuggagaacaucauguggaaacagaucagcaaugagcugaaccacauccugcuggagaaugacaugaaguucaccguagucgucggggauguggcgggcauccuggcccaagggaaaaagaugaucaggccgcagcccauggaguacaaguacuccuggaaguccuggggcaaggcuaagaucauaggcgccgacgugcagaauaccaccuucaucaucgacgggccaaacacccccgagugccccgacgaccagcgcgcauggaacauuugggagguggaggacuacggcuucgguaucuucaccaccaacaucuggcuuaagcugcgcgacuccuacacccaagugugugaccaccgccugaugagcgcagccauaaaggacuccaaggccgugcacgccgacauggguuacuggaucgaguccgagaagaacgagaccuggaaacucgcgcgggcauccuucaucgaaguuaagaccugcauauggcccaagagccacaccuugugguccaacggcgugcuggaguccgaaaugaucauccccaaaauuuacgggggaccgaucucacaacacaacuaucgcccuggguacuucacgcagaccgccgguccuuggcaccucgggaagcuggaacuggauuucgaccucugugagggcaccaccguggucgucgacgagcacugcggcaaccgugggccgagccuccgcacgaccaccgugacgggcaagauuauccacgaauggugcugucggucaugcacgcugccuccccugcgcuucaagggggaggauggcugcugguacgggauggagauccggccaguaaaggagaaggaggagaaccuggucaagucuauggugucugccggcuccggugaggucgacaguuucucccuggggcucuuguguaucuccaucaugauugaggaggugaugcgcucccgcuggucgcgcaagaugcugaugaccggcacacucgccgucuucuuccugcugaucauggggcagcucaccuggaacgaucucauacgacuguguauaauggucggugcgaacgccuccgaccggaugggcaugggcacgaccuaccuagcccugauggccaccuucaaaaugcgcccgauguucgccguggggcuccuguuccggcgccuaaccagcagagaggugcugcuccugacgaucgggcuaucccucguugcgucgguggagcugcccaacucacuggaggaguugggcgacgggcuggccaugggcaucaugauccugaaguugcugacggacuuccagucgcaccagcugugggccacccuccugucguuaacguucaucaagacgaccuucagccuccacuacgccuggaagaccauggcgaugguccugucaaucgucagccuguucccuuugugccuuuccaccacgucgcagaagaccaccuggcugcccgugcuucugggcucacucgggugcaaaccgcugaccauguuccucaucgccgagaacaagaucuggggccgcaaaagcuggccccuuaacgaggggaucauggccgucggcaucgugagcauucuccuuagcagccugcucaagaacgacgugccccuggccgggccccugaucgccggcggcaugcuuauugccugcuacgucauauccggguccuccgccgaucugagccuggagaaagccgcggaggucucgugggaggaagaggcggagcacagcggcgcgucccacaacauccuaguggagguccaggacgacgggacgaugaagaucaaggacgaggagcgggaugacacucucaccauccugcucaaggccacccugcuggccgugagcggcguguacccucucuccauccccgcuacccucuucgucugguacuucuggcagaagaagaaacagcgcagcggggugcugugggacacgcccagcccgccugagguggaacgggcaguccucgaugauggcaucuaccgcaucaugcagcggggccugcuggggcgcagccagguuggcgugggugucuuccaagagaacguguuccacacgauguggcaugugacccggggcgcgguccugauguaccaggguaagcgccuugaacccuccugggcaagcgugaagaaggaccugaucuccuacgggggaggguggcggcugcagggcagcuggaacaccggggaggagguccaggucauugcuguggagcccggcaagaaccccaagaacgugcagacggcccccgggaccuucaagaccuccgagggcgagguuggggccaucgcucucgacuucaaacccgggaccagcggaucucccauugugaaccgcgaaggaaagauagucggacuguacgguaacggggucgugacgaccucgggcaccuacgugagcgcaaucgcucaagccaaggcuucccaggaggggccccugccggagaucgaggaugaggucuucagaaagcgcaaccucaccaucauggaccuacaccccggcagcgggaagacgcgccgcuaccugccugccauugugcgggaagccaucaagcgaaagcucagaaccuuaauucuggcccccacccgcgugguggccuccgagauggcggaggcguugaagggcaugcccaucagguaccagaccacggccgucaagagcgagcacaccggaaaggagaucguggaccugaugugccacgccaccuucaccaugcggcugcucucccccguucgcguacccaauuacaacaugaucauuauggaugaagcucacuucacggacccgaguaguaucgcggcucggggguacauuagcacccgugugggaaugggggaggccgccgccauauucaugaccgcgacgccacccgguuccgucgaagccuucccucagagcaacgccgugauccaggacgaagagcgugacauaccggagcgcuccuggaacucuggguacgaguggaucacugacuucccaggcaagaccgugugguucguccccuccaucaagaguggcaacgacaucgccaacugccugcgaaagaacgggaagagagugauccagcugucccgcaagacuuuugacaccgaauaccagaagacgaaaaacaacgacugggauuacguugucaccacggauaucagcgagaugggggcgaauuuccgcgccgaccgggucauugacccccgccggugccuuaagccggugauccuaaaggacgggcccgagcgcgucauccuagccggccccaugcccgugaccgucgccuccgccgcgcaacggcgcgggcggauaggccgcaaccacaacaaggaaggcgaccaguacaucuauauggggcagccgcucaauaacgaugaggaccacgcccacuggacggaagcaaagaugcuguuagacaacauaaauacccccgagggcaucauccccgcuuuguucgagcccgagcgggaaaaauccgccgcgauugacggggaauaccgccugcgaggcgaggcccggaagaccuuuguggagcugaugcgcaggggcgaucuccccguguggcugagcuauaagguagccuccgagggcuuccaguacucagaccgccgguggugcuucgacggagagcgcaacaaccaagugcuggaggaaaauauggacguggagaucuggaccaaggagggcgagcggaagaaguuacgcccccgguggcuggacgcccgcacguauuccgacccacucgcucuccgggaguuuaaggaguucgcggccggccgccggagcgucuccggggauuuaauccuggaaaucggcaaguugccacagcaccugacccagcgcgcucagaacgcacuggauaaucucgugaugcugcacaauagugagcagggcggccgggcguaccgccacgccauggaggaauuaccggauaccauugagaccuuaauguuacuggcccucaucgccguacuaacgggcggugucacccuguucuuucucuccggccgggggcucggcaaaaccagcauuggccugcucugcgugauggccuccagcgugcugcuuuggauggcguccgucgagccccacuggaucgccgccaguauaauucucgaguucuuccugauggugcugcucauucccgaacccgacagacagcggaccccacaggacaaccagcuggccuacguggucaucggguuacuuuucaugauccugaccguggccgcgaacgagaugggacugcucgaaacgaccaagaaggaucuggggaucggccacguggccgucgagaaccaccaccacgcagcgaugcuggacguggaccuccaccccgcguccgcguggacccucuacgccguggccaccacgaucaucacccccaugaugcgccacaccaucgagaacaccacagcaaacaucucucugacugccaucgcgaaccaggccgccauccucauggggcuggacaagggcuggccaaucuccaagauggacaucggcguuccgcugcucgcccuggggugcuacagccaggugaacccccugacccugaccgcggcaguguuaaugcuggucgcacacuacgccaucaucggucccgggcuccaggccaaggcgacgcgggaggcccagaagcgcaccgccgcggguaucaugaagaacccgaccgucgacgguaucguggcgaucgaccuggaccccgucguguacgacgcgaaauuugagaagcaacugggccagauuauguuguuaauccucugcacuucccagauccugcugaugcgcacuacgugggcccugugcgagagcaucacccuagccaccggccccuuaacgaccuugugggagggaucaccuggaaaguucuggaauaccaccaucgccgugagcauggccaauaucuuucgugggagcuaccucgcgggcgccggccuggccuucucccugaugaagucccucggaggcggacgacggggcacgggggcccagggggagacacugggcgagaaguggaagcgccaguugaaccagcuguccaagagcgaguucaacacauacaagcgcuccgggaucauggaaguagaccgcucagaggccaaggagggccugaagcgcggggagacaacgaagcaugcggugucccggggcacggccaaguugcggugguucguggagcguaaccucgugaagcccgaggggaaagugaucgaccuggggugcgggcguggaggguggucuuacuacugcgccgggcugaagaaggugaccgaggucaagggguacacaaagggcgggccgggccacgaggagcccauccccauggccacuuacggguggaaccuggucaagcuccacaguggcaaggacguguucuucaucccgccugagaagugcgacacccuccucugcgauauuggggagaguucccccaaccccaccaucgaggagggccgcacccuccggguccugaagaugguggagccguggcugcgcgggaaccaguucuguaucaagauccucaacccauacaugccaagcguggucgagacgcuggaacagaugcagcggaagcacggcggcaugcucgugcgcaacccccucucacggaacagcacccacgagauguacugggugucaugcggcaccggcaacaucgucuccgcagugaacaugaccucccgcaugcuucugaaccgguucacgauggcccaccgaaagccgaccuacgagcgcgauguagaccucggggccggcacccggcacgucgccguggagccagagguggccaaccuggacaucaucggccagcguaucgaaaacaucaagcacgagcauaagagcacauggcacuacgacgaggauaacccuuacaagaccugggcauaccacggguccuacgaggucaagccuagcggcagcgcuuccagcaugguaaacggggucgugaagcugcucacgaagccgugggacguuauucccaugguuacgcagaucgccaugaccgacaccacgccuuuuggacaacagcggguguucaaggaaaaaguagacacccguaccccaaaggccaagcgggggaccgcccagauuauggaagucacggcgaaguggcucuggggauuucuguccaggaacaagaaaccgaggaucugcacgcgcgaggaguucacacggaaggugcggagcaacgcugccaucggcgccguguucgucgacgagaaccaguggaacucggcgaaggaggccguggaggacgagcgguuuugggaccuuguucaccgggaacgggagcugcacaagcaagggaagugcgcgaccugcgucuacaacaugaugggaaagcgcgagaagaagcugggagaguuuggcaaggccaaggggagcagagcuaucugguauauguggcucggagcgcguuuccuggaauuugaggcucugggcuucaugaacgaggaccacugguuuucacgggagaacagccucagugggguggagggcgagggauugcacaaacugggcuacauacugagagacaucagcaagaucccgggggguaacauguacgccgaugacacggccggcugggacacccggaucaccgaggacgaccuccagaacgaagcgaagaucacggacauuauggagcccgagcacgcgcugcuugcgaaguccauuuuuaagcugacguaccagaacaaggugguccgcgugcagcggccggcgaagaacgggacugugauggacgucaucagccgccgcgaccagagaggcuccggccaggugggcacuuauggccugaauaccuucacgaacauggaggcccaacucauccgccaaauggaaagcgaagggaucuucucgcccagcgagcuggagacccccaaccuggcaggccggguguuagacuggcucgagaagcauggggucgagcgccugaagaggauggcgauaucuggugacgacugcguggugaagccgaucgacgaccgguucgccacagcccucaccgcccugaacgacaugggcaagguccggaaggacgugccgcagugggaacccaguaaaggauggaacgacuggcagcaaguccccuucuguagccaccacuuccaucagcuaauuaugaaggacggacgcgagaucgucgugccaugucggaaccaagaugaacugguggggcgcgcgcgggucucccagggcgcgggguggucacugcgcgagacagccugucugggcaaaucuuacgcccagauguggcagcucauguauuuccaccggcgcgaccugcggcuggccgcgaacgcgaucugcagcgccgugccgguagacuggguccccacuuccagaaccaccuggagcauccacgcccaucaccaguggaugacaacugaggacauguuguccguguggaaccguguauggaucgaggagaacccguggauggaggacaagacccacaucagcuccuggggagauguccccuaccugggcaagcgggaggaccaguggugcggcagccugaucgggcucaccgcccgggcuacgugggccaccaauauccagguggccaucaaccagguucgccgccugaucggcaacgagaacuaccuggacuacaugacgaguaugaaaagguucaagaacgagucggaccccgagggggcccucugguaa

SEQ ID NO: 24374 - RNA, 9879 nt, Artificial Sequence
  derived and/or modified CDS sequence (opt11) from DENV-1__FJ898404__SS-prME
uccgucacgaugcugcucaugcugaugcccaccgcucuggccuuccaccugaccacccggggcggggaaccacacaugaucguuacaaaacaagaacggggcaaaagccuccuguucaagacgagcgccggggugaauaugugcacccucaucgccauggaccugggcgagcugugcgaggauaccaugacuuacaaauguccgcggauuacugaggccgagccugaugacgucgacugcuggugcaacgccaccgauaccugggugacguacgggaccugcagccagacgggcgagcaccgucgagauaagagaagcguugcccuggcgccccacguagggcugggacuugaaacgcgcaccgagaccuggauguccagcgaaggcgccuggaagcagauacagcgggucgagacgugggcgcuccgccaucccggauucaccgugaucgcacuguucuuggcgcacgcgaucggcacuuccauaacccagaaggggauuaucuucauccucuuaaugcuggugacgccaagcauggcaaugcgguguguaggcaucggcucccgagauuucguugagggguuaagcggggccaccuggguggacgucgugcuggagcacgguuccugcgugaccaccauggccaaggacaaacccacgcuggacaucgagcuucugaagacggaagucaccaaccccgcggugcuucggaagcucugcauugaggcuaaaaucucaaacacuacaaccgacuccagaugcccuacccagggcgaggccacccugauggaagaacaggacgccaauuuuguuugucgucgcaccuucgucgaccggggauggggaaacggcugcggacuguuuggcaaaggaagccucaucacgugugccaaguuuaagugugugaccaagcuggagggcaagaucguacaguacgagaaccuuaaguauucagucaucguuaccgugcacaccggcgaccagcaucagguagggaacgagucuaccgagcacggcaccacagcuacgaucacuccccaagccccgaccuccgaaauucaacuaaccgacuacggugcgcugacccuggauugcucgccccgaacgggccuggauuucaacgaaaugguccugcugaccaugaaggagaaaucuugguuaguacacaagcagugguuccuggacuugccucucccauggaccucaggggccagcacaucccaagaaaccuggaaccggcaggaucugcuggugaccuucaagacggcucaugcgaagaagcaggaagugguagugcucgggucccaagagggcgcaaugcauaccgcccugacgggggcgaccgagauccagaccucgggcaccacgaccauuuucgccggacacuuaaagugucgguuaaaaauggauaaacugacccugaaaggcaugaguuaugugaugugcaccggcaguuucaaacucgagaaggaggucgccgagacgcagcacggcaccguccugguccaaauaaaguacgaaggcaccgacgcccccugcaagauccccuucuccacccaagaugagaaggggguaacgcagaauggacggcugaucaccgccaauccgaucguaaccgacaaagagaaacccguaaacaucgaagcagaaccgcccuucggggagaguuacaucguaaucggcgcgggggagaaggcccucaaacugagcugguucaagaaaggcucaagcaucggcaagauguucgaggccacugcgcguggggcacggagaauggcgauuuuaggggacacagcuugggacuucgguuccgucgguggcguguuuacgagcguugggaagcuggugcaccagaucuucgggacggcguacggggucuuauuuuccggugugagcuggacuaugaagaucggcaucggcgugcugcugacguggcucggucuuaacucccgcucgaccucucucagcaugaccugcaucgccgucggguugguaacacuuuaccugggagugauggugcaagcugacagcgggugcgucaucaacuggaagggacgagagcucaaaugugggucuggaauauucgugaccaaugaggugcacaccuggaccgagcaguacaaauuucaggcggacaguccgaagcggcugagugcggcaaucggcaaagccugggaagagggggucugcgguauacgaucagccacucggcuugagaacaucauguggaagcagaucuccaacgagcucaaccacauccugcuggagaaugacaugaaguucaccgucgucgucggggacguggugggcauccuagcgcaggguaagaaaaugauccggccccagccgauggaacacaaguacucguggaaguccuggggcaaagcuaagaucaucggcgccgacguccaaaauaccacauucaucaucgacgggcccaacaccccggaauguccagacgaccaaagagccuggaacaucugggagguggaggacuacggcuuuggcaucuucaccaccaauauaugguuaaaauuacgcgacaguuacacucaggugugcgaccaucgccucauguccgcggccaucaaggacaguaaggcuguccacgcagacaugggcuauuggauagagucggagaaaaacgagacuuggaagcuagcccgggcgucuuucauagaggucaagaccugcaucuggccgaagagucacacgcugugguccaauggagugcucgaguccgagaugauuauccccaagaucuacgguggcccgaucagccagcacaauuaucgccccggcuauuucacucagaccgccggccccuggcaccuuggcaagcuggagcuugauuucgacuuaugcgagggcacuacggucgugguggacgagcacugcgguaaccggggacccagucugcgaaccacgacgguuacggggaagaucauccacgagugguguugcaggagcugcacccugccgccccuccgcuuuaagggcgaggacggcuguugguacgggauggagauccggcccgugaaggagaaggaggagaaccuggugaaauccaugguaagcgcgggcagcggagaaguggacagcuucagccucgggcucuuguguaucuccaucaugaucgaggaagugaugcgcagccggugguccagaaagaugcuuaugaccgggacccuggccgucuuccugcuccugaucauggggcagcugacguggaacgaccucauccggcuuugcaucauggugggcgcgaacgcguccgaccgaauggguaugggcaccacuuaccuugcacucauggccacauuuaagaugcgaccgauguucgccgugggacuucuguuccgacgcuuaacgagcagagagguacuacugcucaccaucgggcugagucugguugccuccgucgagcuccccaacucucuggaggagcucggggacgggcuugccaugggcauuaugauccugaagcugcucacagacuuccagagccaccaguugugggccacccuauugucguugacauucaucaagaccacucuaucccuccacuaugcuuggaagaccauggcgauggugcuuagcauagcgucguuguucccccucugccugagcacaaccucucagaagaccaccugguugcccguccuauuagguagccuggggugcaagccacucacgauguuccugaucaccgagaccaagaucuggggacgcaagagcuggccgcucaacgaggggauuauggccguuggcguggugucuauacuccugucuagucuguuaaagaacgauguucccuuagccgggccucugauugccggcggcauguugauugccugcuacgugaucucaggcagcagcgcggaccugucccuggaaaaggccgcugaggugagcugggaggaggaggccgagcacaguggggcuucgcacaacauccuagucguugugcaggacgacgggacgaugaagaucaaagacgaggagcgggacgacacccuuacgauccugcucaaagcgaccuuacuggccgucuccgguguguauccccuuagcauaccggcuacccuguuugugugguauuuuuggcagaagaaaaagcaaaggucuggcguccuuugggacacgcccucgccgccagagguagagcgggcugugcuggacgacggcaucuaccgcaucaugcagaggggccuccuggggcgcagucaggucggcguuggggucuuccaggagaacgucuuucauacgauguggcacgugacccggggcgcagugcugauguaccagggcaagcgacucgagcccagcugggcguccgugaagaaggaccugauuagcuacgggggcggauggcgguugcagggcaguuggaacaccggagaggagguccaagugaucgcggucgaaccagguaaaaauccgaaaaacgugcaaaccgcucccgggacauucaagacgcccgagggcgaagugggcgcuauugcccucgacuucaagcccggcacauccggcucccccauugucaaccgugaaggaaagaucgugggccuuuacggcaauggaguagucacgacguccggcaccuacguuuccgcgauagcccaggcuaaggccucccaggaggggccgcugcccgagauugaggacgaaguuuucagaaagcgcaaucucaccaucauggaccugcaccccggcucugggaagacacgucgcuaccugccggcgauuguccgggaggcaaucaagcgcaaguugcggacuuuaauccuggcgcccacccgcguaguagccagcgagauggccgaggcacucaagggcaugccaauccgcuaucagacuaccgccgucaaaucggagcacacgggcaaggagaucguagaccuuaugugccacgccaccuucacaaugagacugcuuucucccgugcggguuccgaacuacaacaugauuauuauggacgaggcccacuucacugaucccagcuccaucgcugcucgcggcuauaucagcacgcgcguuggcaugggggaggcugcggccaucuucaugaccgccaccccucccggauccgucgaagcguucccgcaaagcaacgccguaauccaggacgaggagcgggacauccccgagagguccuggaacagcggguacgaguggaucaccgauuuccccgguaagacggugugguucguucccaguauuaaguccggcaacgacaucgcaaacugccugcggaagaacgguaagagagucauccagcucucccguaagaccuucgauaccgaguaucagaagaccaagaacaaugacugggacuacgugguuacgacggacaucagcgagaugggcgccaacuuucgcgcggaccgcgucauagauccgcgucguugucucaagccuguuauccugaaagacgggcccgagcgcgucauccucgcaggccccaugccggugacgguggccuccgccgcccaacgcagagggagaaucggccgcaaccacaauaaggagggggaccaguacaucuauaugggacagccccucaauaacgacgaggaccacgcgcacuggaccgaggccaagaugcugcuggacaacaucaacacgcccgagggcaucauccccgcccucuucgagccagaacgggagaagagugccgccaucgacggugaguaccgccuccgaggugaggcgcgcaagacguucgucgagcuaaugcggcgcggugaccuccccguuuggcugucguacaagguggccagcgaaggcuuccaguacagcgaccgcagauggugcuuugacggugagcgcaauaaccaaguccuggaggagaacauggauguagagaucuggaccaaggagggggagaggaagaagcuccgcccccguuggcuggacgcacgcacuuacuccgacccccucgcacuccgggaguucaaagaguucgcagcgggccgucggagcgugucaggugaccugauccuggaaaucgguaaacuuccucagcaucugacgcaacgcgcgcagaaugcccuggacaaucucgucaugcuucacaacagcgagcagggcgguagagccuaccgccacgcgauggaggagcuucccgacaccaucgagacacucaugcuccuggcacucauugccgugcugacgggcggggugacccuguucuuucuuagcggccggggacucggcaagacguccaucggccugcuuugcgucauggcaagcagcguacugcuguggauggccagcguugagccccacuggaucgcggccaguaucauucuugaguucuuccucaugguccugcucaucccggaaccggaccgccagcggacgccccaggacaaccagcucgcauacguggugauaggucuccuauuuaugauucuuacggucgcugccaaugagaugggccugcuagagacuacgaagaaggaccuggggaucggacauguggcgguggagaaccaccaccacgccaccaugcuugacguggacuuacaccccgccuccgcuuggacccuauacgccguggcaaccacaaucaucaccccgaugaugcgccacaccaucgagaacaccacggccaacaucagccugacagccauagcuaaccaggccgcgauucucaugggguuagacaagggcuggcccauuucgaagauggauaucggcgugccacuacucgcacuugggugcuacagccagguuaacccccugacccugacagccgcaguguuaaugcugguggcgcacuacgccaucaucggcccggggcuccaggccaaggcgacgcgggaagcccagaagcgcacggccgccggcauuaugaagaacccuaccgucgaugggauaguugcuaucgaccuggacccgguagucuaugaugccaaguuugagaagcagcugggacagaucauguuacugauccugugcaccucccagauacucuuaaugagaacgaccugggcuuuaugcgaaucgaucacccucgcgaccggaccccugacgacacugugggagggcucgcccggcaaguucuggaauacuaccauagcaguuucuauggccaacaucuuucgggggagcuaccucgccggcgccggccuggcuuucucucugaugaaaucccuagggggcgggcggcggggcacgggugcccagggcgaaacccucggcgagaaguggaagcgccaacucaaccaacucuccaagagcgaauuuaacaucuauaaacgguccggcauaauggaagucgaccgcagugaggccaaggagggccuuaagcgcggcgaaaccacccgccacgccguuucacggggcacggcuaagcugcgcugguucguggaaagaaaccuggugaagcccgagggaaaggucaucgaccucggcugcggucguggaggcuggagcuacuacugcgccgggcugaagaaggugacggagguuaaaggcuacacaaagggcgggcccggccaugaggaacccauccccauggccaccuacgguuggaaucuuguuaaacugcacagcggcaaagacguuuucuucacgccgcccgagaaaugcgacacccuucuaugcgacaucggggagagcuccccuaauccgaccaucgaagaaggucggacccugcgugugcugaagauggucgagcccuggcuccgggguaaccaauucugcauuaagauccucaacccauacaugcccagcguggucgagacgcuggagcagaugcagcgcaaacacggcgguaugcuugucaggaauccgcucucccgcaacagcacgcacgaaauguacugggugagcugcgggaccggcaacauagugucugcagucaacaugaccuccaggaugcugcugaaucgcuucacgauggcccaccgcaaacccacguacgagagggauguggaucucggggcgggcacccgccacguggccgucgaaccagagguagccaaccuggacaucauaggccagcguaucgaaaacaucaagcacgagcacaagagcaccuggcacuacgaugaggacaaccccuauaagacgugggcguaccaugggucuuacgaggugaaaccuagcgguucugccucuagcauggugaacggggucgucaagcugcucaccaagcccugggacgugaucccaauggugacccagaucgccaugacagacaccacaccguucggccagcagcgcgucuucaaggaaaaaguagacaccagaaccccgaaggccaagcgcggaaccgcccaaaucauggagguaacggcucggugguuguggggcuuccuguccaggaauaagaagccccggauaugcacuagagaggaguucacccgaaaggugcgcucgaacgccgcgaucggagccguguucguggacgagaaccaauggaacuccgccaaggaagccguugaggacgagcgguucugggaccugguacagaaggagcgugagcuucacaaacaagggaaaugcgcuaccuguguguacaacaugaugggcaagcgggaaaagaaacugggcgaguuuggaaaggcuaaagggagccgcgccauaugguacaugugguugggcgcccgguuucuggaguucgaggcccugggcuucaugaacgaagaucacugguuuagucgcgaaaauucuuuguccggggucgagggugagggacugcauaagcugggcuacauccuucgugacauuagcaaaauccccgggggcaacauguacgcugaugauacggccgguugggacacgcguaucaccgaggaugaucugcagaaugaggccaagauaacugacauaauggagccggaacacgccuugcucgcuacgagcaucuucaagcugaccuaccaaaacaagguggugcgaguccagcgcccagcgaagaacgggacuguuauggacgugauaagccgacgcgaccaacguggcuccgggcaggucggcacguacggccugaacacguucaccaacauggaagcccagcucauacggcagauggaguccgagggaaucuuccuccccucagagcuggagacucccaauuuggccgagcgcguucuggauugguuggagaaauacgggguggagcgccuaaagagaauggccaucagcggggacgacugugucgugaaaccgaucgacgaccgcuucgcaacggcgcuaaccgcccugaaugauaugggcaaaguccggaaggauauuccacagugggagcccuccaaaggguggaaugacuggcaacagguccccuuuugcagccaucacuuccaucagcucauaaugaaggacgguagggaaaucguggucccaugccgcaaccaagacgagcuggucggccgcgcacgcgugucucagggagccgguuggucguuacgggagaccgcuugccucggaaaaucguacgcgcagauguggcagcucauguacuuccaccgacgggaucugcgccucgccgccaacgccaucugcuccgccguccccguagacugggugcccaccucccggaccacguggucuauccacgcacaccaccaguggaugaccaccgaggauaugcuuagcgucuggaaccgugucuggauagaagagaauccuuggauggaagacaagacccacgucuccagcuggggcgacgugccguacuuagggaagcgggaagaccaaugguguggcucucuaaucggccuuacugcacgugccaccugggcgucuaacauccagguagcaauaaaccagguacgccggcugaucgggaacgagaauuaccuugacuauaugaccuccaugaagcgcuucaaaaacgagggcgaccccgaaggggcccuuugguaa

SEQ ID NO: 24375 - RNA, 9879 nt, Artificial Sequence
  derived and/or modified CDS sequence (opt11) from DENV-1__GQ199840__SS-prME
agcgugaccaugcugcucauguugaugcccaccgcccuagccuuccaccucacgacccggggcggggagccccauaugauugugagcaaacaggagcgggggaagagccugcuguucaaaaccagugccggggugaacaugugcacccucaucgccauggaccugggcgaguuuugcgaggacaccaugaccuacaagugccccaggaucacagaggcggagcccgacgacguugacugcuggugcaacgcgacugacacgugggucaccuaugggaccugcagccagaccggcgagcaccggcgggacaagcgcuccguggcccuggcgccccacgugggccuugggcuagagacacgcacugagacauggaugucauccgagggcgccuggaagcagauccagcgggucgagaccugggcccugcgccauccgggcuucacggugaucgcccucuuccuggcgcacgcgaucggcaccuccaucacccaaaagggaaucaucuucauccugcucaugcuggugacgcccuccauggcaaugcggugcgucggcaucggaucccgcgacuucgucgaggggcucagcggcgccacauggguggacguugugcucgagcacggguccugcgugacaaccauggccaaagacaagccaacccuggacaucgagcugcucaaaacggaagucaccaacccagcuguacuacggaagcuuugcauagaagccaagauaagcaauaccacaacagacucgcgcuguccgacccagggagaagccacccucguagaagagcaggacgccaauuucgucugccggcgcaccuucguagaccgcggcugggggaacgguugugggcuguucgguaaggggucccugauaacgugcgccaaguucaagugcguuaccaaacucgagggcaagaucguccaguacgagaaccugaaguacagcgugaucgugaccguccacaccggcgaccagcaccagguggggaacgaauccacggagcauggcacgaccgcgaccaucacgccccaggcccccagcacagagauccaguugaccgacuacggggcccucacccuggacugcucgccccggacggggcuggacuucaacgagaugguccuccugacgaugaaggagaagaguuggcugguucacaagcagugguuccucgaccugccgcugcccuggacaagcggcgccuccaccagccaggagacguggaaccggcaggaccuccuggugacauucaagacugcccacgcaaagaagcaggaggugguuguguuaggcucccaggagggcgccaugcacaccgcgcucaccggcgccacggagauccagacaagcggaaccaccacgauuuucgccgggcacuuaaagugucgccugaagauggacaagcuuacccugaagggcauguccuacgucaugugcaccgggagcuucaagcuggagaaggagguggcggagacccagcacggcacgguccucguccagaucaaauaugagggcacagacgcuccaugcaagauccccuucuccacccaggacgagaagggggugacccaaaacggccgguugaucacugccaacccgaucguaaccgacaaggagaagcccgucaauaucgaggccgagccgcccuucggugagucguacaucgugaucggcgcgggcgaaaaggcccuuaagcuguccugguucaagaaggggagcuccaucggcaagauguuugaggccaccgcgagaggggcccggcgcauggcgauccucggcgauaccgcgugggacuucggaagcaucggcggcguguucacguccguagguaaacugguucaccaaaucuucggcaccgccuacggugugcuguucucaggcgucagcuggaccaugaaaaucgggaucggcgugcuccugaccuggcuuggcuuaaacagccgcucgacgagccuguccaugacguguaucgcugugggccuggucacguuauaccugggcgugaugguacaggccgacagcgggugcgucaucaacuggaaaggccgggagcucaagugcgggagcggcauauucgugaccaacgaagugcacacauggaccgagcaguacaaguuccaggcggacucgccaaaacgccucucggccgccauuggcaaggccugggaggagggugucugcggcauccggagugccacccgccuggagaacaucauguggaaacaaaucagcaacgagcugaaccacaucuuacuggagaacgacaugaaguucaccguaguggucggugacguggccggcaucuuggcccaggggaagaagaugauccggccucaaccuauggaauauaaguacuccuggaagucguggggcaaggccaagaucaucggcgccgacguccagaacaccacguucaucaucgaugggccgaacacaccggaaugccccgacgaccagcgcgcguggaauaucugggaggucgaggacuacggcuucgguaucuucacgaccaacaucuggcuaaagcugcgggacuccuauacccaggugugcgaccaccgcuuaaugucugccgccaucaaggacuccaaggccgugcacgccgacaugggauacuggaucgagucggagaagaacgagaccuggaagcucgcgcgggcauccuucaucgaggucaagaccugcaucuggcccaagagccacacccugugguccaacggcgugcuggagagcgagaugaucauccccaagaucuacgguggcccgaucucccagcacaauuaccggcccggauacuuuacacagaccgccgggcccuggcaccucgggaagcuggagcuggauuucgaccucugcgagggaaccacaguggucguggacgagcacugcggcaaccggggaccaucccugcgcacaaccaccgugacuggcaagaucauucaugaguggugcugucggucaugcacgcugccuccccuucgcuuuaagggggaggacggcugcugguacgggauggagauccgucccgucaaggagaaggaagagaaccuagucaagagcauggugagugccggcuccggugaggucgacagcuuuucccuggggcuccugugcaucagcaucaugauugaggagguaaugcgcucccgguggagccggaaaaugcugaugacaggcacccucgccguguucuuccugcugaucaccgggcagcucacguggaacgaccugauccgccugugcaucauggucggcgcgaacgccuccgaccgcauggggaugggcaccaccuaccucgcccugauggcgacguucaagaugcgcccuauguucgccgugggacuucuuuuucggcgcuuaacgucucgagagguacugcuccugaccauagggcugucccucgucgcuagcguggagcugccaaacagucuggaggagcucggcgaugggcuggccaugggcauuaugauccugaaacuccugacugacuuccagucccaccagcuaugggcgacccuccugucccugacguuuaucaagaccaccuuuagccuccacuacgccuggaagaccauggcgaugguccugucgaucgucagccuauucccacucugucuuucuacgacaagccagaagaccaccuggcugcccgugcuccugggauccuuaggaugcaagccgcuaaccauguuccuaauagcagagaacaagaucuggggccgcaagagcuggccucucaacgaggggaucauggccgucggcauuguguccauauugcugucgucacugcucaagaacgaugucccccuggcggguccccugaucgccggcggcaugcucaucgcgugcuacguaaucuccggcagcuccgccgaccugagccuggagaaggcagccgaaguguccugggaggaggaggcagaacacagcggcgcgagccacaacauccucguggagguccaggacgacgggaccaugaagaucaaggacgaggagcgggacgauacgcugacgauccugcucaaggccacccugcuggccgugagcggcguuuacccgcucuccauccccgccacucuguucgucugguacuucuggcagaagaagaagcagcgcagcggggugcugugggacauccccagcccacccgaaguggagcgggccguccucgacgacggcauuuaccgcaucaugcagcggggucuucuggggcgcagccagguaggcguaggcguguuccaggagaacguguuccacaccauguggcaugugacacggggagcgguccugauguaccaggggaagcgccucgagccuucgugggcgagcgugaaaaaggaccuuaucagcuacgggggaggcuggcggcugcagggcagcuggaacaccggagaggaagugcaggucaucgccguggagcccggcaagaaucccaagaacgugcagacggccccagggacguucaagacuucggagggcgaggucggcgccauugcgcucgacuuuaaacccgggaccagcgguagccccauagugaaccgcgagggaaagaucgugggccuguacggaaacggggucgugacuaccuccgguaccuacgugagcgccauagcccaggccaaggcgucccaggagggaccacugccggagaucgaggacgaaguuuuccggaagcgcaaccucaccaucauggacuugcaccccggcagcgggaaaacgcggcguuaccugcccgccauugugcgagaggccaucaagcgcaagcuccggacccugauccuggcccccaccaggguggucgccuccgagauggcggaggcccucaaaggcaugcccaucagauaccagaccacggccgucaagagcgagcacacuggcaaggagaucguggaccugaugugccacgccaccuucacaaugcggcuccucucccccgugcgcgugcccaacuacaacaugaucaucauggaugaagcucauuucacggacccgagcagcaucgcggcgcggggguacaucagcacccgcguggggaugggggaggcugccgcuauuuucaugaccgcgacgccgccaggcucaguugaagccuucccccagagcaacgccgugauccaagacgaggagcgcgacaucccggagcgguccuggaacuccggguacgaguggauuacggauuuccccggcaagaccgugugguucguccccuccaucaagagcggcaaugacaucgccaacugccugcggaagaaugggaaacgcgugauccagcugucacggaaaaccuucgacaccgaguaccagaagacgaagaacaaugacugggacuacguagucaccaccgacaucagcgagaugggcgcgaacuuccgagcugaccgcgucauugacccgcgccguugccucaaacccgucaucuugaaagacggacccgaacgcgucauccuggccggucccaugcccgucacagucgccagugccgcgcagcgucgcgggcggaucggccgcaaccacaacaaggaaggcgaccaguacaucuacauggggcagccgcucaacaacgacgaagaucacgcccacuggacagaagccaagaugcugcuagacaacaucaauacccccgagggcaucauccccgcccucuucgagcccgagcgggagaaguccgccgcgauagauggggaauaccgccuucgcggcgaggcccgaaagaccuucgucgagcugaugcgccgcggggaccucccggucuggcugagcuacaaggucgccucagagggcuuccaguacuccgaccgccgcugguguuucgacggugagcgcaacaaccaggugcuggaggagaacauggauguggagaucuggaccaaggagggggagcgaaagaagcucagaccccguuggcuggacgcccgcacguacuccgacccgcuggcucuccgggaguuuaaggaguucgcggccggccgccggagcgucuccggagaccucauccuggagaucggcaaacucccccagcaccugacccagcgugcccaaaacgcucuagacaacuuagugaugcugcacaauagcgagcagggcgggcgggcguaccgccacgccauggaggagcugcccgacaccauagagacccucaugcugcuggcccucaucgccguucugacgggcggggucacacuguucuucuugagcggccgggggcugggcaaaaccagcaucggcuugcucugcguaauggcaucaucagugcugcuguggauggcguccguugagccacacuggaucgcggccagcaucauccucgaguucuuucuuauggugcugcucauccccgagccagaccgccagcggaccccacaggacaaccaauuagcguacguugucaucggguugcucuucaugauccugaccguggcagcgaacgagaugggccugcucgagacgacgaagaaggaccuggggauaggucacguugccgccgagaaucaccaccacgccgccaugcucgacguagaccuccaucccgcguccgccuggacccuauacgccguggccaccacaaucaucacuccgaugaugcgccacaccaucgagaacaccacagccaacaucagccugaccgcgaucgccaaccaggccgccauccucauggggcuggacaagggcuggccaauaucaaaaauggacauuggcgugccacugcucgcacuggggugcuacucacaggucaaccccuuaacccucacagcggccgugcugaugcugguggcccacuacgccauuaucggccccgggcuccaggcgaaggcuacaagggaggcucagaagcgcaccgccgccgggauuaugaagaacccgaccgucgaugggaucguggcgaucgaccuggacccugugguauaugacgccaaguucgagaagcaguuaggucagauaaugcuccugauccucugcaccucgcagauccuccugaugcgcacgaccugggcguugugcgagagcaucacccucgccaccggcccucucacaacccugugggagggcucucccggcaaguuuuggaacaccaccauugccguaagcauggcgaauaucuuccgggggagcuaccucgccggcgcgggccuggccuucucccucaugaagucucuagguggggggcgccggggaacgggggcgcagggggaaacucugggcgagaaauggaagaggcaacugaaccagcucucuaagagcgaauucaacaccuacaagcgguccgguaucauggagguggaccgcagcgaagccaaagagggacuaaagcguggggagaccacgaaacacgccgucucccgcggaaccgccaagcugaggugguucguggagcguaaccucguaaagccugaagggaaggucauagaccugggcugcggccgcggcggguggagcuauuacugcgcugggcugaaaaaggugaccgaggucaagggguacaccaaggggggccccggacaugaggagcccauccccauggcaacguacggguggaaccuggucaagcuccacuccgguaaggacguguucuucaucccuccugaaaagugugacacccugcugugcgacaucggggagagcagucccaaccccaccaucgaggagggucggacccuccggguguugaaaaugguugagccguggcuccgggggaaccaguucugcaucaagauauugaaccccuacaugcccagcgugguugagacgcuggagcagaugcagcggaagcacggcgggaugcuaguccgcaacccccucucccggaacucgacccaugagauguauuggguguccugcgggacaggaaacaucguaagcgcggucaacaugacgucccgcaugcugcugaaccgguucaccauggcacaucgcaagccgacauacgagcgcgacguugaccucggggcugguacccggcaugucgcagucgagcccgagguugcuaaucuggacauuaucggccagcgcaucgaaaacaucaaacacgagcacaagagcacuuggcacuacgacgaggacaaucccuacaagacgugggccuaccacgggaguuacgaggugaagcccagcggcagcgccuccagcauggucaacgggguggucaagcugcucacgaagccaugggacgugaucccuauggucacccaaaucgccaugaccgacaccacgcccuucggccagcagcgggucuucaaggagaagguugacacccgcacccccaaggccaagcgugggacugcgcagauuauggaggugacggccaaguggcuuuggggcuuccugucccgaaacaagaagccgcggauauguacccgcgaggaguucacccggaagguccgcagcaacgccgccaucggcgcgguguucguggacgagaaccaguggaacuccgccaaagaggccgucgaggacgaacgguucugggaccucguacaucgcgagagggagcuucauaagcaaggcaagugcgcaaccugcguguacaauaugaugggaaagcgcgagaagaaguugggggaguucggcaaggccaaggggagccgugcuauaugguacauguggcucggugcccgcuuccuggaguuugaggcccugggcuucaugaacgaagaccacugguuuucccgagagaacagccuuuccggggucgagggcgaaggguuacacaaacucggcuacauccuccgcgacaucucaaagauucccggagggaacauguacgccgacgacacggccggcugggacacccggaucacggaggacgaccugcagaacgaagcgaagauuacggacauaauggagcccgagcacgcccugcucgcaaaguccaucuucaaacugaccuaccagaacaaggugguacgcguccaacguccggcgaagaacggaacggugauggacgugauaagccgccgcgaccaacggggauccgggcaggucggcaccuauggccugaacaccuucacgaauauggaggcccaacucauccgccagauggagucugaaggcaucuucucgcccagcgagcuugagacccccaaccuggcgggccgagugcucgacuggcuggagaaauacgggguggaacgccugaagcggauggccauuuccggcgacgacugcguugugaagcccaucgacgaccgcuuugccaccgcccucacugcccugaacgacauggguaaggugagaaaggacaucccccaaugggagcccaguaagggcuggaacgacuggcagcaagucccguucuguagccaccacuuccaccaguugaucaugaaggacggccgcgaaaucguggugccuugccggaaccaggacgaacucgucgggcgcgcucgggugucccagggcgccggguggagccugcgugagacugcaugucugggcaaguccuaugcccagauguggcagcucauguacuuccaccggcgcgaccugcggcuggcggcuaacgccaucugcagcgcugugccgguagacugggugcccaccucccgcaccaccuggagcauccacgcccaccaucaguggaugacgaccgaggacaugcucuccguguggaaccgaguuuggauagaagagaaccccuggauggaggacaagacccacauuagcuccuggggcgacgugcccuaucugggcaagcgcgaggaccaguggugcggcagccugaucgggcucaccgcgcgggccacgugggccacuaacauccagguggcgaucaaccaggugcgucgccugauaggcaaugagaacuaucuagacuauaugaccuccaugaagcgguucaagaaugagagcgacccggagggggcgcucugguga

SEQ ID NO: 24376 - RNA, 9879 nt, Artificial Sequence
  derived and/or modified CDS sequence (opt11) from DENV-1__FJ898405__SS-prME
uccgugaccaugcuacuaauguuaaugcccaccgcccuggccuuccaccucaccaccaggggaggggaaccccacaugauagugaccaagcaagagcgcggcaagagccugcucuucaagaccagugcgggggugaauaugugcacauuaaucgcaauggaccugggggaguuaugugaggacaccaugaccuacaaaugcccccggaucaccgaggccgagcccgacgacguagacugcuggugcaacgccaccgauaccugggugaccuacgggaccugcucccagacgggagagcacagacgcgacaagaggagcguggcccuugcaccccacguagggcucgggcuugagacccggaccgagacguggauguccagcgaaggcgcguggaagcagauccagcggguugagaccugggcuuugcgccaccccggguucaccgugaucgcccuguuccucgcgcaugccaucgggaccucgauuacgcagaaggggaucaucuucauccuucuaauguuggugacccccagcauggccaugcguugcguuggcaucggcucccgcgacuucgucgagggacucucuggggccaccuggguggacgucgugcuggaacacggguccugcguaaccaccauggccaaagauaagccuacgcuggacauugagcuccugaagaccgaggucacgaaccccgcgguccugcggaaguuaugcaucgaggccaaaaucagcaacaccacuaccgacucccggugcccaacucaaggcgaggccacccugauggaggagcaggacgcaaacuucgugugccggcgcaccuuuguagaucgggguugggggaacggcugcggcuuguucggcaaggggagccucaucacaugcgccaaauucaaguguguuacgaagcuggaaggcaagaucguacaguaugagaacuuaaaguacuccguaaucgugaccgugcacacgggcgaccagcaccaggucgggaaugagagcaccgagcacgggaccacagcgaccauaacgccccaagcacccacauccgagauccagcucaccgacuacggcgcuuugacccuggacugcagccccagaacgggucucgacuucaacgaaauggugcuacuaacgaugaaggagaaguccuggcugguucacaagcagugguucuuggaccugccgcucccuuggaccucgggggccaguaccucgcaggagaccuggaaccggcaggaucuccugguuacguuuaaaacugcccaugcgaagaagcaggaaguuguagugcuaggcagccaggagggcgccaugcauaccgcacugacaggagcgaccgaaauccaaaccuccgguacuacuaccaucuucgccgggcaccugaagugcagacuaaagauggacaagcugacccugaagggcaugagcuacgugaugugcaccggcuccuucaagcuugaaaaagagguugcagagacgcaacacgguaccguuuuggugcagaucaaguacgaaggaaccgacgcccccugcaagaucccuuuuagcacccaagacgaaaagggagucacacaaaacggccggcuaaucaccgccaacccaaucgugacugacaaggagaaacccgugaacaucgaggccgaaccgcccuucggggaguccuacauagugaucggcgcgggcgagaaggcccugaaacucuccugguucaaaaagggaagcaacauaggcaagauguuugaggcaaccgcacgcggggcccggcguauggcaauccugggcgacacggccugggacuucgguagcaucggcggaguguucaccucgguggggaaguugguccaccaaauauuuggcacagccuacggagugcuguucagcggaguguccuggaccaugaagaucgggaucgguguacuucugacguggcucggccugaauagccgcagcaccucacuauccaugaccugcaucgcgguggggcuggucacccuguaucugggcgucaugguacaggccgacucugggugcguaaucaacuggaaaggcagagagcuuaaaugcggcuccggcauauucgugacgaaugaggugcacaccuggaccgaacaguacaaguuccaggcggauagcccgaagcgacugagcgccgcgauuggcaaggccugggaggaaggcgugugcggaauccggucagccacucgauuagagaacaucauguggaagcaaauuagcaacgagcucaaccacauccuacuggagaaugacaugaaguucaccguugugguaggcgacgucgugggcauccucgcacaggggaaaaagaugauucggccucagcccauggagcacaaguacuccuggaaguccuggggcaaggcaaaaaucauuggcgccgacgugcagaacacgacguucaucaucgacgggcccaacaccccugagugccccgaugaccagcgggccuggaauaucugggagguagaggacuacggcuuuggcauauucaccacgaacauauggcugaagcugcgggacuccuauacacaggugugcgaccaccgccucaugagcgcggccauaaaggacucgaaggcgguccacgccgacaugggcuauuggaucgagagcgagaagaacgaaacuuggaagcuggcccgggcguccuucaucgaagugaagaccugcaucuggcccaagucucacacccuuuggucuaauggagugcucgagagcgagaugaucauccccaaaauuuaugggggcccgauuucccagcacaacuaucggcccggguacuucacccagaccgcagggcccuggcaccuaggcaaguuggagcucgauuuugaccugugcgagggcacgacggucgugguugaugaacacugcggaaacagggguccgagccuacgaacaaccaccgucacgggcaagaucauacaugaguggugcugccguagcugcacccuuccaccucuccgcuucaagggcgaggacggcuguugguauggaauggagauccgaccuguuaaagagaaggaggagaaccuggucaaguccaugguauccgccggcucgggcgagguugacagcuucucccucgggcugcugugcauaagcauuaugaucgaggaaguuaugcgaucccgguggagccgcaaaaugcucaugaccggcaccuuggccguguuccugcuucugaucauggggcaacugacguggaacgaucucauaaggcucugcauuaugguuggcgcaaacgcgucugaccggaugggcaugggcaccaccuaccuggccuugauggccacguuuaagaugcguccgauguucgccgugggauuacuguuccggaggcuaacgagccgugaagugcugcuacucacgaucgggcugucucugguugccagcguggagcuccccaacucccuugaggaguugggcgacggacucgcgaugggaaucaugauacugaagcugcucaccgacuuccagagccaccagcugugggccacccugcucucacugacguucaucaagaccaccuuaucacugcauuacgcguggaagacuauggccaugguacuuuccaucgugagucuguuccccuugugcuuauccacgaccagccagaaaaccaccuggcuccccguacuccugggcagucugggguguaagccucucacgauguuucuaaucgcugagaacaagauauggggccgaaagagcuggccccuuaacgaggggaucauggccguaggcgugguuuccauccuccugucaagccugcucaaaaacgacgugccccuugcagggccccugaucgccggcggcaugcucaucgccugcuacgugaucucgggcagcuccgccgacuugagccuggaaaaggccgccgaagugucgugggaggaggaggccgagcacagcggcgcgucccacaacauccucgucgagguccaagacgacgguaccaugaaaaucaaagaugaggagcgggacgacacccugaccauucugcucaaggcgacacuguuagcuguuucuggcgucuauccccuuuccaucccggcgacucuguucguaugguauuuuuggcagaagaagaagcagcgcagcggggugcucugggauaccccauccccgcccgaagucgagcgggccgugcuggacgacggcaucuaccgcaucaugcagcggggccuccugggccgcagccaggugggcgucggggucuuccaagagaaugucuuccauaccauguggcacgucacccggggagcggugcugauguaucaaggaaagcgucucgagcccucgugggcgagcgucaagaaggaccugaucaguuacggcggaggguggcggcugcagggaagcuggaacacuggggaggagguucaggugaucgccguggagcccgguaaaaaccccaagaacgugcagaccgcgccggggacguuuaagacgccggagggggaggugggcgcaaucgcccucgacuucaagccugggacguccggcagcccaaucgugaaucgcgaggggaagauagucggccuguauggcaacgguguggucacuaccuccggcaccuacguuagcgcgaucgcccaggcuaaagcgagccaggaggguccgcugcccgagaucgaggacgagguuuuucggaagcgcaacuugacaaucauggaccugcaucccggcuccgggaagacccggcgcuaccugccggcuaucgugagggaagcgaucaagcgaaagcuccggacccugauccuugccccgacacgcgucguggccagcgagauggccgaggcgcucaagggaaugcccauccgauaccagacaacagccgugaaguccgagcacacaggcaaggagauugucgaccugaugugccacgcgacuuucacgaugcggcuucucagccccgugcgcguuccgaauuacaacaugaucaucauggaugaggcccauuucaccgaucccaguucuaucgccgcgcggggauacaucucgacccgugucgggaugggggaggccgcggcaauuuucaugacugcgacgccgcccggcagcguggaggcguucccgcaguccaacgcuguuauccaggacgaggagcgcgacauacccgaacgcagcuggaacagcggguaugaguggaucaccgacuucccugguaagacggucugguucgugcccagcauaaagucgggaaacgacauugccaacugccuacggaagaacgguaagcgcgugauccaacugucacggaagaccuucgacacagaguaccagaagaccaagaauaaugacugggacuacgucguuaccaccgacaucuccgagaugggcgcgaauuuccgcgcggaccgugucaucgacccgcgccgcugucucaagcccgucauccuuaaggaugggccugagcgcgugauccucgccggcccaaugccggucacuguggccagcgccgcccaacggcgcggcaggaucggccgcaaccacaacaaagagggagaccaguauauuuauaugggacaaccauugaacaacgacgaggaccacgcgcacuggaccgaagcaaagaugcuccuggacaauauaaacacccccgaggggaucaucccugccuuguucgagccggagagggagaagagugccgccaucgauggggaguaucgcuugcgcggcgaagcgaggaaaaccuucguggagcugaugcgucgcggggaucuuccugucuggcugagcuacaagguggccagcgagggcuuccaauacagcgaucgcagguggugcuucgacggcgagcgcaacaaccaggugcuggaggagaacauggacguagagaucuggacaaaagaaggggagcggaaaaagcuacgcccgcgguggcuggaugcccguacuuacucggacccacuggcccucagggaguucaaggaguucgccgcgggccgccgguccgugucaggggaccugauccucgagaucgguaagcucccgcagcaccugacgcaacgcgcgcagaacgcucuggacaacuuggucaugcugcacaauuccgagcaaggcgggcgggccuaccggcacgcaauggaggaacugcccgacacaaucgagacguuaaugcuacuggcccugauugccguccugaccggcggaguuacccucuucuuucucagcggccggggacuaggcaagaccuccaucggcuugcucugcgugauggccagcucaguccuccuguggauggccagcguugagccucacuggauugcggcuuccaucauucucgaguuuuuucuuauggucuuacucauucccgagccggaucgacagcggacuccccaggacaaccagcuggcauacgucguaaucgggcucuuauucaugauccugacgguagccgcaaacgagaugggccuucuagagaccacuaagaaggaccugggcaucggccacgucgcgguggagaaccaccaucacgccaccaugcuggacguggaccuccacccugcuagcgccuggaccuuauacgccgucgcgacaaccaucaucaccccgaugaugcgacauacaaucgagaacaccacggcaaacauuucacugaccgccauugccaaccaggcugcuauauuaauggggcuggauaagggauggcccauuaguaagauggauaucggagugcccuugcucgcccuugggugcuacucccaggugaacccccucacgcucaccgccgccguccugaugcuuguagcgcauuacgccauuaucggaccggggcuacaagccaaagccacgcgggaagcccagaagcgcacggcggcaggcauuaugaagaaucccacaguagacgggauuguugccaucgaccuggaccccgugguguacgacgcuaaguucgagaaacagcugggccagaucaugcucuugauacuuugcacuucacagauccuccugaugcguacaacgugggcccucugcgaguccaucacuuuagcgaccggcccucugaccacacucugggaagggagccccggcaaguucuggaacaccaccauagccgucuccauggccaacauuuuccgggggagcuaucucgcuggagccggccuggcguucucccugaugaaaagccucggcggcgggcgccgcggcaccggagcccagggggagacccugggcgagaaguggaagcgccagcugaaccagcucuccaaguccgaguucaacaucuacaagcggagcgguauuauggaggucgaccggagcgaggccaaagagggccugaagcgcggggaaacuaccagacacgcugucucgcgggggaccgccaagcugcgcugguucgucgaacguaaccugguuaagcccgaggggaaggugauagaccucggcugcggccgcgggggcugguccuacuauugcgcgggucucaagaaaguaaccgaggucaagggcuacacuaagggcgggcccggacacgaggagcccauccccauggcgaccuacggcuggaaccuggugaagcuccauaguggcaaggacgucuucuucacaccgcccgagaagugugacacccuucucugcgacaucggggaauccucaccgaacccgacgauugaggagggccggacccuccgcgugcucaagaugguggagcccuggcugcguggaaaccaguucugcaucaagauccucaaccccuacaugcccuccgugguggagacuuuagaacagaugcagcgcaagcauggcggcaugcuggugcggaacccccucucacgaaacuccacccacgaaauguacuggguuucaugcgguacugguaacauaguguccgccgugaacaugacuagccgaaugcugcucaacagguucaccauggcccaccgcaagcccaccuacgagcgcgacgucgaccucggggcgggcacccgccacgucgcgguggaacccgagguagccaacuuggacaucaucggccagcggaucgagaacaucaaacaugagcacaaguccacuuggcauuacgaugaggacaaucccuacaaaacaugggcuuaccacgggagcuacgaggugaagccgagcggcagcgccagcagcauggucaacggaguggugaaacugcuuacuaagccuugggauguuauccccauggugacucagauugcgaugacggacaccacccccuucggccagcagaggguguucaaggaaaaggucgacacgcggacgcccaaagccaagcgcgggacggcccagaucauggaaguuaccgcaagauggcuguggggcuucuugucacgcaacaagaagccccguaucuguaccagagaggaguucacgcguaaggugagguccaacgcugcgaucggcgccgucuucgucgacgagaaccaguggaacagcgccaaggaagccguggaggacgagcgguucugggaccucguucaaaaggagcgcgagcugcauaaacaaggcaagugugcgaccuguguguacaacaugaugggcaagagagagaagaagcuuggggaauucggcaaggcaaagggaucccgcgccaucugguauauguggcuaggcgcccgcuuccuggaguucgaggcccugggcuuuaugaacgaggaccauugguucagccgcgagaauucccucagcggcguagagggcgaaggguugcacaaguugggguauauccuccgggacauauccaagauccccggugguaauauguacgcggacgacaccgccggcugggacacaagaaucacggaggacgacuugcagaacgaagcuaaaaucacagauaucauggagccggagcaugccuuauuagccaccagcaucuucaagcugaccuaccagaauaaggucgugcggguacagcgacccgcgaaaaacggaaccgucauggacgugaucucccggcgggaccagcgcggcagcggccagguaggcacguacggccugaacacauuuaccaacauggaggcacagcuuauccggcagauggaguccgaggggaucuucagccccuccgagcuggagauucccaaccuggccgagcgcguucucgacuggcuugagaaguacggcguggagcggcugaagcgcauggccaucucgggggaugacugcguagucaagccuaucgacgaccgcuuugccacggcucucaccgcccugaaugauauggguaaggugcgcaaggacguaccccaaugggagccaaguaagggcuggaacgauuggcagcagguccccuucugcagucaccauuuccaccaacugaucaugaaggaugggcgggaaaucgucgucccuugccgcaaccaagacgagcuagucggccgggcccgcguaagccagggggccggcuggagcuugcgggagaccgcuugccugggcaaaagcuacgcucagauguggcagcuuauguauuuccaccgccgggaccugcgacuggcagccaacgccaucuguagugcgguucccgucgacuggguccccacaucccggacgaccugguccauucacgcacaccaucaguggaugaccacugaggacaugcuaagcguauggaaccgcgucuggaucgaggagaaucccuggauggaggacaagacucacguguccagcuggggcgacgugccguaccuggggaagcgggaagaccaguggugugguucccugauaggucuuaccgcacgcgcuaccugggcaagcaacauccagguugcgaucaaucaagugcgccggcugaucgggaacgagaacuaccuagacuauaugaccuccaugaagcgauucaagaaugagggcgaccccgagggcgcucucugguga

SEQ ID NO: 24377 - RNA, 9879 nt, Artificial Sequence
  derived and/or modified CDS sequence (opt11) from DENV-1__FJ898406__SS-prME
agcgugaccaugcugcucaugcugaugcccaccgcccuggccuuccaccucaccacccggggcggggagccccauaugaucgugaccaagcaggaacggggaaagagccugcuguucaagaccagugccggggugaacaugugcacccucauagccauggaucucggagaacugugcgaggacaccaugaccuacaaaugcccccggaucaccgaggccgagcccgacgauguggacugcugguguaacgccaccgacacaugggugaccuacgggacgugcucccagaccggggagcaccggcgcgauaagcggucgguugcccucgcgccucacguaggucuggguuuggaaacccgcaccgagaccuggauguccagcgagggcgccuggaaacagauccagcgggucgaaacgugggcccuccggcacccagguuucacugugaucgcccuguuccuugcccacgccaucggcaccuccaucacccagaaggggaucaucuucauccuccugaugcuggugacgcccucgauggccaugcggugcgucggcaucggaucccgcgacuuuguggaggggcucucgggcgccacuuggguggacguagugcuggagcacgggucgugcgucaccaccauggccaaggauaagcccacgcuagacaucgagcuccugaagacagagguaaccaacccggcggugcugcgcaagcucugcauugaagccaagauaagcaacaccacgaccgacucccgcugccccacccagggcgaggccacacucauggaggagcaagacgccaacuucgugugccgacgcacguucgucgaccggggcugggggaacggcugcggucuguuuggcaagggaucgcugauaacgugugcuaaguuuaagugcgugaccaagcuggagggcaagaucguucaguacgagaacuugaaauacucagugaucgugaccguccacacgggcgaccaacaccaggucgggaacgagaguaccgagcacggcaccaccgcgaccaucacaccccaggcccccaccuccgagauccagcuuaccgacuacggggcccugacacuggacugcagcccccgaacuggccucgacuucaacgagauggugcugcuaaccaugaaagagaaguccugguuaguucacaagcagugguuccuggaccugccccuccccuggaccagcggggccagcaccucccaggagacuuggaaccgacaagaccugcuggugacuuucaagaccgcccacgcgaagaagcaggagguggucguguugggcagccaggagggugccaugcauaccgcacugacgggggccacggagauccagaccucuggcaccacgaccaucuucgccgggcaccugaagugccgccucaagauggacaagcugacccugaagggcaugagcuacguaauguguacgggguccuucaagcucgaaaaggaggucgcggagacgcagcauggcaccguucugguucagaucaaauacgagggaaccgacgcucccugcaagauucccuuuagcacucaggacgaaaaaggugucacgcagaacggccggcugaucaccgcaaacccgaucgugaccgacaaggagaagcccgugaacaucgaggcagagccgcccuucggggagucguacauugucaucggcgccggcgagaaagcacucaagcucagcugguucaaaaagggauccaacaucggcaagauguucgaggccaccgcccgcggggcccggcgcauggcgauacugggcgacacggccugggacuucgguagcaucggcgguguguucacauccguggggaagcugguccaccagaucuucggcaccgccuacggggucuuauucagcggggugagcuggaccaugaaaaucgggaucggcguccugcuaacauggcucggcuuaaauagccgcuccaccucacuuucuaugacguguaucgccguagggcucgugacccuguaucugggcgucauggugcaggcagauagcggcugcgugaucaauuggaagggccgcgagcucaagugcggcuccggcaucuucgucacgaacgaagugcacaccuggaccgagcaguacaaguuccaggcggacuccccgaagcgcuuaucugccgcgaucggcaaggccugggaggagggggucugcggaauucgguccgccacccgccuggagaauauaauguggaagcagaucucuaaugagcucaaccacaucuuacuugagaacgacaugaaguucaccguggugguaggggacgucgugggcauucucgcgcaggggaagaagaugauccggccccagcccauggagcacaaguacuccuggaaguccugggggaaggcuaagaucaucggcgccgacgugcagaacacgaccuuuaucaucgacgggccaaacacccccgagugccccgacgaccagcgcgccuggaacaucugggaggucgaggacuacggauucgggaucuucaccacgaauaucuggcugaaguugcgggacucauacacccaagugugugaccacaggcucaugagcgcggcuaucaaagauuccaaagccgugcacgcggauaugggcuacuggauagagagcgagaagaacgagacguggaaacuggcccgggcauccuucaucgaggucaagaccugcaucuggccgaagagccacacgcugugguccaauggcgugcucgagucggagaugaucauccccaagaucuaugggggcccgauuucccagcacaacuaccgcccaggauacuuuacgcagacagccggccccuggcaccuggguaagcuggaacucgauuucgaccugugcgaagggaccacgguggugguggacgagcauugcggcaacagggggccgagccugcgcaccaccaccgugacgggcaagauuauccacgaguggugcugccgguccugcaccuuaccgccccuccgcuucaaaggggaggauggcuguugguauggaauggagauccggcccgucaaagagaaggaggagaaccuggucaagaguaugguauccgccggcagcggggagguagacagcuucagcuuggggcuguuguguaucuccaucaugauagaggaggugaugcguucgcgguggagccgcaagaugcucaugacaggcaccuuagcgguguuccugcuucugaucaugggucagcugaccuggaacgaccucauccgguugugcaucaugguuggcgccaacgcaucagacaggauggggaugggcaccacuuaucuggcccucauggcuacuuucaagaugcgcccgauguucgccgugggccugcuguuccggcgccuaacgagccgggaaguucugcugcucacgaucggguugagccuggucgccucaguggagcuccccaauucccuggaggagcugggggacgggcucgcgaugggcaucaugauccugaagcugcucacggacuuccagagccaccagcugugggccacccugcugucccugaccuucaucaagaccacacugucgcuccacuacgccuggaagaccauggccaugguccugucgaucgugagccuguucccccucugccugagcacgaccagccagaagaccaccuggcuacccgugcuccugggcucacuggggugcaagccgcucacgauguuccugaucgcggagaauaagaucuggggccgcaagagcuggccccugaacgaggggaucauggccgugggcgugguguccauacuccugucgagccugcucaagaacgacguuccccuggcagggccccugaucgccggcggcaugcucaucgccugcuacgugaucuccgggaguuccgcggaccuaagccucgagaaggccgcugaagucuccugggaagaggaggccgaacauaguggcgccucccacaacauccucguugaggugcaggaugacgggaccaugaagaucaaagaugaggagcgggacgauacccugaccauccugcucaaggcuacccuacucgccgugaguggugucuacccgcucucuauccccgccacgcuguucgugugguacuucuggcaaaagaagaagcagcgcagcggggugcugugggacaccccgagcccucccgaaguggagcgggccgugcuugacgacgggaucuaccgaaucaugcagcggggacuccucgggcgcagccaggugggcgucgggguguuccaggagaacguguuucacacgauguggcacgugacucggggcgccguguuaauguaccaggggaagcgccucgagcccuccugggcgagcguaaagaaggaccugauauccuacggcgguggguggcgccuucagggcucguggaacacgggagaggagguccaggugaucgccguggagcccggcaagaacccaaagaacguacagaccgcccccgggaccuucaaaacccccgagggcgagguuggggccaucgcacucgacuucaagcccgggacgaguggcagccccauugugaaccgcgaggggaagaucgucggccuauauggcaacggugugguuaccaccucugggaccuacguaagcgcgaucgcccaggccaaggccagccaggaggggccgcugcccgagauagaagacgagguuuucaggaagcggaaccucacgaucauggaccugcaccccggcuccgggaagacgcggcgcuaucugccagcgaucgugcgggaggcuauaaagcggaagcuccggacccugauccuggcucccacccgcgucgucgccucggagauggccgaggcuuuaaaggggaugccuauacgauaccagacgaccgcugugaaguccgagcacaccggcaaggagauaguugaccuaaugugccaugccaccuucacaaugcggcuguugagcccuguacgagugccuaacuacaacaugaucaucauggacgaggcccacuucaccgaccccuccagcauagcagcgcggggguacaucuccacccgcgucggcaugggggaggccgccgccaucuucaugaccgcaacaccgcccggcagcguugaggcguucccgcaguccaacgccgugauucaggacgaagagcgggacauucccgaacgcagcuggaacuccggguacgaguggaucaccgacuuccccggaaagaccgucugguuugugcccagcaucaaguccggcaacgacaucgccaacugccugcgcaaaaacgggaaacgcgugauccagcugagccggaagaccuucgacacggaauaccagaagaccaaaaacaacgacugggacuacguugugaccaccgacaucuccgagaugggcgccaacuuccgcgcggaccgggugaucgacccacgccggugccuuaagccagucauccugaaggacggacccgagcggguuauccuggccggccccaugcccgucacuguggccagcgccgcgcagcggcgcgggcggaucggcaggaaccacaauaaggagggugaccaguacaucuacaugggucagcccuuaaacaacgacgaggaccacgcucauuggaccgaggccaagauguugcuggacaacaucaacacgcccgagggcaucauccccgcacucuucgagcccgagagggaaaagucugccgccaucgacggggaguaccgccugcgaggggaggcgcgaaagaccuucguggagcugaugcgacgcggggaccuccccgucuggcuaagcuacaaaguggcguccgagggguuccaguacagcgaccgccguuggugcuucgauggcgagcgcaacaaccaggugcuggaagagaacauggacgucgagauuuggacgaaggaaggugagcgaaagaagcuccgcccccgguggcucgaugcccgcacguacagcgaccccuuagcuuugcgggaguucaaggaguucgccgcgggucgcagguccgugagcggggaccugauccuggaaaucggcaagcucccgcagcaccugacccagcgcgcccagaaugccuuagacaaccucgugaugcugcacaacucugagcagggggggcgggccuaccgccacgcgauggaggaacugccagacaccaucgagacgcucaugcugcuggcccucaucgccguacugacuggcggggugacgcuguucuuccucucgggccggggucugggcaagacaucaauuggcuuguuaugcgugauggccagcuccguccugcuuuggauggccucaguggagccccacuggauagcggcuuccaucauccucgaguucuuucugauggugcugcuuauccccgagccggaucgccaacggacgccccaggacaaccagcuggccuacguagugaucgggcuucucuucaugauccugacgguagccgccaacgagaugggucugcuagagaccaccaagaaagaccugggcaucggccaugucgccguggagaaccaccaccacgccaccaugcuggacguagaccuucacccugccagugccuggacgcuguacgccgucgcaaccaccaucauaaccccgaugaugcgccacacaaucgagaacaccaccgcgaacaucucccugaccgcuaucgccaaccaagccgcgauccucauggggcuggacaagggguggcccaucagcaagauggacaucgggguuccacugcucgccuuggggugcuacucccaggugaacccccuaacguugacugcagccguccugaugcuuguggcgcacuaugcaauuaucggaccggggcuccaagccaaggccacccgggaagcccagaaacguaccgcggccgguaucaugaaaaacccgacgguggacgggaucgucgccaucgaccucgaccccgugguguacgacgcgaaguucgagaagcagcugggccagaucauguugcugauccuauguaccucccagaucuugcugaugcgcacgaccugggcccugugcgaauccauuacgcuugcgaccggcccccugaccacucugugggaggggucgccgggcaaguuuuggaacacgaccaucgccguuuccauggccaauaucuuccgcgggagcuaccuggccggcgccggccuggcguucucccugaugaaaucccucgggggcggccgccggggcaccggcgcccagggcgagacgcugggcgagaaguggaagagacagcugaaccaguugaguaaguccgaguucaacaucuacaagcggagcgggaucauggagguggaccgcuccgaggccaaagagggccugaagcgcggggagacgacccggcacgccgugagcagaggcacggcgaagcugagaugguucguugagagaaaccuggucaagcccgaggggaaggugauagaccucgggugcggccgagggggcugguccuacuacugcgccgggcuaaagaaggucacggaggugaagggguacacgaaaggcggacccggccacgaggaacccaucccgauggccaccuacggguggaaccugguaaagcuacacagcggaaaagauguguucuucaccccccccgagaagugcgacacgcugcugugugacaucggggagagcagccccaauccgacgaucgaggaaggccggacccuccgcguacugaagaugguggaacccuggcugcgggguaaucaguucugcauaaagauccucaaccccuacaugccauccguaguggagaccuuggagcagaugcagcgcaagcacggcggcaugcuugugcgaaacccgcucagccgcaacucgacccacgagauguacugggugagcugcgguaccggcaacaucguguccgccgugaacaugacuagccggauguuacugaaccgcuuuaccauggcccaucgcaagcccaccuacgagcgggacgucgaccugggcgcaggcacccgacacguggcuguggagcccgaggucgccaaccuggacaucaucggccagcggaucgagaacaucaagcacgagcacaaguccacguggcauuacgaugaggacaaccccuauaagaccugggcauaccacgggagcuacgaggugaagccguccggcuccgccuccucaauggucaacggggugguaaagcugcucaccaagcccugggacguaauucccauggucacgcagaucgcgaugacggacaccacucccuucggccaacagagggucuucaaggaaaagguugacacccguacgccgaaggccaagagagggaccgcccagaucauggaggugaccgcccgguggcugugggguuucuuaaguaggaacaaaaagccacgaaucugcacccgcgaggaguucacgcggaaggugcgcuccaacgcagcgaucggcgccgucuucguggacgagaaucaguggaauagcgccaaggaggcaguagaggacgagcgguuuugggaccucgugcagaaggagcgagagcugcacaagcagggaaaaugcgcgaccuguguguacaacaugaugggcaagcgggaaaagaagcugggcgaguucggcaaggccaaaggguccagggccaucugguauaugugguuaggcgcucgcuuccuagaguucgaggcgcugggguuuaugaacgaagaucacugguucagccgcgagaauuccuuaagcgggguggaaggggaggggcugcacaagcugggcuacauccuccgggauaucuccaagauccccggaggcaauauguacgcggacgauaccgccggcugggacacacggauuacggaggacgaccugcagaacgaagcuaagaucaccgauaucauggagccggaacacgcccugcucgccaccagcaucuucaagcugaccuaucagaacaaggucgugcgggugcagcgccccgcgaagaacgguacagucauggacgugauaucccgccgagaccagcgcggcagcggccaggugggcaccuacggacugaacaccuucaccaacauggaggcccagcucauccggcagauggagagugaggggaucuucagccccuccgagcuggagaucccgaaccuugcagagcgcguccuggacuggcuggagaaauacggaguggagagacugaagcgcauggccaucagcggggacgauuguguggucaagccgaucgacgaccgguuugcaacagcgcucaccgcucucaacgacaugggcaaggugcguaaggacgugccccagugggagcccuccaaaggguggaaugacuggcagcagguccccuucugcagccaccacuuccaccagcugaucaugaaggacggccgggagaucgucguuccaugccgcaaccaggacgagcucgucggccgggcacgcguuucccaaggggcuggcuggagucugagagaaaccgccugccuuggcaagucauacgcgcaaauguggcagcucauguacuuccaccgucgggaccugcgccuggccgccaaugccauaugcuccgcggugcccgucgacuggguucccacaagucggacgacuugguccauucacgcccaccaccaauggaugacaaccgaggacaugcucagcguguggaaccgcgucuggaucgaggagaaccccuggauggaggacaaaacacaugugucuagcuggggcgacgugccauaccuggggaagcgagaggaucagugguguggcucccugauaggccucaccgcccgcgcgacuugggccagcaacauccagguugcuaucaaccaggugcgccggcugaucggcaacgaaaauuaccuggacuacauggcaaguaugaaacgcuucaagaacgaaggcgacccugagggggccuuaugguga

SEQ ID NO: 24378 - RNA, 9879 nt, Artificial Sequence
  derived and/or modified CDS sequence (opt11) from DENV-1__GQ199841__SS-prME
agcguaaccaugcugcucaugcugaugcccaccgccuuagccuuccaccugacuacccggggcggugagccccacaugaucguaagcaagcaggagagagggaagagccugcuguucaagaccagcgcgggugugaacaugugcacccucaucgccauggaccugggcgaguucugcgaggauaccaugacguacaagugcccccgcauaaccgaggccgaacccgaugacguggacugcuggugcaacgccaccgacacgugggugaccuacggaaccugcagccagacuggugagcaccggcgcgacaagcgguccguggcucuggcaccccacgugggccucgggcuggagacgcgcaccgagaccuggaugucgucugagggugccuggaagcagauccagcgggucgagaccugggcccugaggcaccccggauucacggugauugcccucuuccuggcccaugccaucggcaccagcaucacccagaaggggauaaucuucauccugcucauguuagugacacccucuauggccaugcggugcgucgggauaggcagccgcgacuucguggagggccuguccggugccaccuggguggacgucgugcucgagcacgggagcugcgugaccaccauggccaaggacaagccgacacuggacauagaacugcucaagacggaggucaccaaccccgcggugcugcggaagcugugcaucgaggccaagauauccaacaccaccacggacagccguugcccgacccagggcgaggccacgcucguggaggaacaggaugccaacuucgucugccgucgcacguucguggaccgaggcugggggaacggcugcggccuguucggcaaggggucccugaucacgugcgcgaaauucaagugcguuacgaagcucgagggcaagaccguccaguacgagaaccugaaguacagcgugaucgugacgguccacaccggcgaccagcaccagguggggaaugaauccaccgagcacgggaccacggcaaccaucacgccccaggcccccagcaccgagauccagcugaccgacuacggugcccucaccuuggacuguuccccccggaccggucuggacuuuaacgagaugguccuccugacuaugaaggaaaaguccuggcuggugcacaagcagugguuccucgaccugccgcuccccuggaccagcggggccucuaccagccaagagacguggaaccggaaggaccuccuggugaccuucaaaacggcccacgcgaagaagcaggaagucgugguacugggcucccaggagggcgccaugcacacggcacucaccggggcaaccgagauccagaccagcgggaccacgaccaucuucgccgggcaccugaagugccgccugaagauggacaagcucacccugaaaggcauguccuacgucaugugcaccgggucauucaagcuggagaaggagguggcggaaacgcagcacggcaccgugcucguccagaucaaguacgagggcaccgacgcccccugcaagauccccuucuccacccaagacgagaagggggugacgcagaacggccggcuuauuaccgccaauccgaucgugaccgauaaggagaagcccgucaauauugaggcagagccgcccuucggggagagcuacauaguaaucggggcgggcgaaaaggcacugaagcuguccugguucaaaaaggggucuuccaucgguaagauguucgaggccaccgcccgcggggcccggcgcauggcgauccucggcgacacggccugggacuucgggagcaucggaggcguguucaccuccgucgggaagcuggugcaccagaucuucggcaccgccuacggggugcuguucagcggcgucuccuggaccaugaagauugggaucggggugcuccugacguggcugggccucaacagccgcuccaccagcuuauccaugaccugcaucgcgguggggcuggucacucucuacuuaggcgugauggugcaggccgacucgggcugcgucauuaacuggaagggccgugaacugaaaugcgggagcgggaucuucguaacgaacgaggugcacaccuggaccgagcaauacaaguuccaggcggacuccccgaagcgucucagcgccgccaucggcaaggcuugggaggagggggucugcggcauccgguccgcgacccgccuagaaaacaucauguggaagcagaucucgaacgaacugaaucacauucuccuggagaacgacaugaaguucaccgugguggugggggacguggcaggaauccuggcgcagggcaagaagaugauccgcccucagcccauggaguacaaguacuccuggaaguccuggggcaaggccaagaucauaggcgcugacgugcaaaacacgaccuucaucaucgacgggcccaacaccccggagugucccgaugaucagagagcguggaauauuugggaggucgaggacuacggcuucggaauuuuuacgacgaacauauggcucaaacuacgggacaguuacacucaagugugcgaucaccgccugaugagcgccgccaucaaggacuccaaggcgguacacgcggacaugggcuacuggaucgagucggagaagaacgagacauggaaacuggcucgugccuccuucauagaggucaagaccugcaucuggcccaagagccauacgcuauggaguaacggcgugcuugagagcgagaugaucauacccaagaucuacgguggcccgaucucccaacacaacuaccgacccggguacuucacccagaccgccggccccuggcaccuggggaaguuagagcuggauuucgaccugugcgagggaaccacaguggucguggacgaacauugcggcaaccgggggccgagccugcgcaccaccacugugacggguaagaucauccacgaguggugcugccgguccugcacccuuccgccccugcgcuucaagggggaggacggcugcugguacgggauggagauccggcccgucaaggagaaggaagagaaccugguuaagagcauggugagcgccggcuccggcgaggucgacagcuucuccuuggggcuccucugcaucagcaucaugaucgaggaggugaugcgcucucgguggucgcgcaagauguuaaugaccggcacgcucgccguauucuuccugcugaucauggggcagcucacguggaacgaccugauccggcugugcaucauggucggugcgaacgccucugacaggauggggaugggcaccaccuaucucgcgcugauggccaccuucaagaugcgcccgauguucgcuguaggccuccuguuccggcgucugacgagccgggagguguuacuacugaccaucgggcuuucccucgucgcgagcgucgagcuccccaacucccuggaggaguuaggcgacgggcuggccaugggcaucaugauacugaagcuccugaccgauuuccagagccaccagcugugggccacccuccugucccugacauuuauuaagaccaccuucagccuccacuacgcuuggaagacgauggcgaugguccuguccaucgugagccuguucccgcucugccuguccacuacuagccaaaagaccaccuggcugcccgugcuucugggcucccuggggugcaagccgcuuacgauguuccugaucgccgagaacaagauauggggccgcaagucguggccccugaaugaagggaucauggccgucggcaucgugagcauccuccuguccucgcugcucaagaacgacgugccccuggccgggccccugauugccggcggaaugcucaucgcgugcuaugucaucuccgguagcuccgccgaccugagccuggagaaagccgccgagguguccugggaggaagaggcugagcacucgggggcgucccacaacauccucguggaaguccaggacgacgggaccaugaagaucaaggacgaggagcgggacgacacccugaccauccugcuuaaggccacccugcuggcugugucgggaguguacccccucagcauccccgccacgcuguuugucugguacuucuggcagaagaaaaagcagcgcucaggggugcugugggacacccccagcccgccagagguggagcgggcuguccucgacgacggaaucuaccgcauaaugcagcggggcuugcuggggcgcagccaggugggagugggggucuuccaggagaacguguuccacacaauguggcacgugacccggggcgcgguccugauguaccaggggaagcgccucgagccuucuugggcgucggugaagaaggaccugaucuccuacggcggcggguggcgucugcagggcagcuggaacacgggggaggaggugcaggucaucgccguggagcccgguaagaaccccaagaacgugcagaccgcccccgggaccuucaaaaccuccgagggcgaggucggcgccaucgcgcucgauuucaagcccgggacgucaggaagccccaucgugaaccgcgaggggaagaucgugggccuguacggcaauggagucgucaccaccuccggcacuuacgugucugccaucgcccaggccaaggcgucccaagaggggccgcucccggagaucgaggacgaggucuuccggaagcgcaaccucacgaucauggaccugcaccccgggagcgggaagacccggcgcuaccugcccgccaucgugcgggaggcaaucaagcgcaagcuccggaccuuaauccuggccccgacccgcguggucgccuccgaaauggcggaggccuuaaagggcaugcccaucagguaccagacaaccgcagucaagagcgagcacaccggcaaagagauaguggaccugaugugccacgccaccuucacgaugcggcuucucuccccgguccgagugcccaacuacaacaugaucaucauggacgaggcccacuucaccgacccgagcucuaucgcggcccggggguacaucagcacccgcgugggcaugggggaggccgccgccaucuucaugaccgcuacgccgcccggcagcgucgaggccuucccccagagcaacgccgugauccaggacgaggagcgggacauuccggagcgcuccuggaacagcggguacgaguggaucaccgacuuccccgggaagaccgugugguucguccccuccaucaagagcggcaacgacaucgccaacugccugcggaagaacgggaagagagucauccagcucucccguaagaccuucgacacggaguaccagaagaccaagaacaacgacugggauuacguggucaccaccgacauuagcgagaugggcgcgaacuuucgcgccgaccgggugaucgacccccgccggugccugaagccggugauccuuaaggacggacccgagcgcguaauccuggcaggcccaaugcccgugacggucgcauccgccgcgcagcggcgcggucggaucggccgcaaccacaacaaggagggcgaccaguauaucuacauggggcagccauugaacaacgacgaggaccaugcccacuggaccgaggccaagaugcugcuggacaacaucaacacacccgagggcaucauccccgcccucuucgagcccgagcgggagaaguccgcggcgaucgacggggaguaccgucugcgcggcgaggcccggaagaccuucguggaacuuaugaggcgcggggaccugccugucuggcugagcuacaaggucgccucugagggcuuucaguauagcgaccgccgguggugcuuugacggagagcgcaacaaccaggugcuggaggagaacauggacguugagaucuggaccaaggagggugagaggaagaagcuccgcccccgguggcuggacgcccgcaccuacuccgacccccuggcccuccgggaguucaaggaguucgcggccggccgccggucagucuccggggaccugauccucgaaaucggcaaguuaccacaacaccugacccaaagagcccaaaacgcccuggacaaccucgugaugcugcacaacagcgagcagggcgggcgggcguaccgccacgccauggaggagcugccggacacaaucgagacacucaugcuucuggcucucaucgcggugcugaccggcggagucacccuguuuuuccucuccggucgggggcugggcaagaccagcaucggccugcucugcgugauggccaguuccgcgcuguuguggauggccuccguagagccccacuggaucgccgcgagcaucauccucgaguucuuccugaugguacugcuaauucccgaacccgaucgucagcggaccccgcaggacaaccaacuugccuacguggucaucgggcuccucuucaugauccugacugucgcggccaacgaaaugggguuacucgagaccacaaaaaaggaccuggggaucggccacguggccguggagaaccaccaccacgccgccaugcuggaugucgaccuccacccagcgagcgccuggacacuguacgcaguggccaccaccaucaucacccccaugaugagacacaccaucgaaaacacgaccgccaacauaagccuaaccgcgaucgccaaccaggccgccauccucaugggguuagacaagggauggccaaucuccaagauggacaucggcguaccccugcucgcccuggggugcuacagccaggucaacccccugacccucacggcagccgugcugaugcugguggcccacuacgccauuauaggccccgggcuccaggcgaaggccacccgugaggcucagaagcgcaccgccgcgggcaucaugaagaacccgacggucgacgggaucguggcgaucgaccuggacccuguggucuacgacgcuaaguucgagaagcagcugggccagauuaugcucuugauccugugcaccucccagauucuccucaugcgcaccaccugggcucugugcgagagcauuaccuuggccacgggcccccugacgacccugugggaggggucccccggcaaguucuggaacaccacgaucgccgugagcauggcgaacaucuuccgggggagcuacuuggccggcgccgggcuggccuucucccucaugaagucccucgggggcgggcgccggggcaccggggcacaaggcgagacacugggcgagaaguggaaacgccagcugaaccaguuaaguaagagcgaguucaacaccuacaagcgguccgggaucauggaaguggaccgcagcgaggccaaggagggccugaagcgcggagaaacaaccaagcaugccgucucccgcggcaccgccaagcuaagaugguucguugagcgcaaccucgugaagccggaggggaaggucaucgaccugggcugcggucgcgggggguggucauacuacugcgccgggcugaagaaggugacugaggugaagggguauacuaagggcgggcccggccaugaggagcccaucccuauggcgaccuacggguggaaccuggucaaacuccacuccggcaaggacguguucuucauuccacccgagaagugugacacucugcucugcgauaucggggagucaucccccaaucccaccaucgaggagggucgcacguuacgagugcugaagauggucgagccguggcugcgcgggaaccaguucugcaucaagauccucaaccccuacaugcccagcgugguggagacccuggagcagaugcagcggaagcacggcgggaugcugguccggaacccccucucccggaacagcacccacgagauguacuggguguccugcgggaccgguaacaucguuagcgccgucaacaugaccucccgcaugcugcugaaccgguucaccauggcccaccgcaaaccuaccuacgagcgcgacguggaccucggggccgggacacggcacguggccguggaacccgagguggcgaaccuggacaucaucggccagcgcaucgagaacaucaaacaugagcacaagagcaccuggcacuaugaugaagacaaccccuacaagacgugggcuuaccacggguccuacgaggugaagcccaguggcagcgccuccagcauggucaacggggucgucaagcugcucaccaagccgugggacgugauccccauggucacccagaucgccaugaccgacacgaccccguucggccagcagcgggucuuuaaggagaagguagacacccgcacccccaaagcgaagcggggaacggcgcagaucauggaggugaccgccaaguggcuguggggauuucugucccgcaauaaaaaaccgcggauauguaccagggaggaauucacccggaagguccgcucaaacgccgccaucggcgcgguguucguggacgaaaaccaguggaauuccgcaaaagaggccgucgaggacgaacgguucugggaccucgugcaccgcgagcgggaauugcacaaacaggggaagugcgcaacgugcguguacaacaugaugggcaagcgcgagaagaagcugggggaguucggcaaggccaaggggucucgggcgaucugguacauguggcucggcgcccgcuuccuggaguuugaggcccugggcuucaugaacgaggaccacugguucucccgggaaaacucgcucucgggggucgagggcgaggggcugcacaagcugggcuacauucuccgcgauauaagcaagauccccggggguaacauguacgccgaugacaccgccggcugggacacccggaucaccgaggacgaccugcagaacgaggcgaagaucacggacaucauggagcccgagcacgcacugcucgccaaguccaucuucaagcugaccuaccaaaacaaaguagugcgcguccagcgaccggccaagaacgggaccgugauggacgugaucagccgcagggaccaaaggggcuccgggcaggucggcacguacggccugaacacauucacuaacauggaggcccagcucauccgccagauggagagcgaggggaucuucuccccgagugaauuagagacccccaaccuggcgggucgggugcucgacuggcuggagaagcacgggguggagcgccugaagcguauggccaucuccggcgacgacugcgucguuaagcccaucgaugaccgcuucgccaccgcccucacggcccuaaacgacauggggaaggugcggaaggacaucccgcagugggagcccagcaagggcuggaacgacuggcagcaggucccuuucugcagccaccacuuucaccagcugaucaugaaggacgggcgcgaaauugugguccccugccggaaccaggacgagcucguugggcgggcgcggguuucccagggagccggguggucccugcgagagaccgccugccugggcaaguccuacgcccagauguggcagcucauguacuuccaccgucgagaccugcggcuggcggcaaacgccauuugcagcgccgugccggucgacuggguuccuaccucucgcaccacguggucaauccaugcccaccaucaguggaugacaaccgaagauaugcucuccguguggaaccgagucuggaucgaggagaaccccuggauggaggacaaaacccacaucagcuccuggggcgacgugccguaccugggcaagcgcgaggaccaguggugcggcagccugaucgggcucacggcgcgggccaccugggccaccaacauccagguggcuaucaaccagguccgcagacugauuggcaacgagaauuaccuggauuacaugaccaguaugaagcgguucaaaaacgagagcgacccggagggggcccucugguga

SEQ ID NO: 24379 - RNA, 9879 nt, Artificial Sequence
  derived and/or modified CDS sequence (opt11) from DENV-1__FJ898407__SS-prME
agcgugaccaugcuucucaugcugaugccaaccgcccuugccuuucaccucaccacccggggcggggaaccccacaugaucgugaguaagcaggagcgaggcaaaucccugcuguucaagaccuccgcaggggugaacaugugcacgcucaucgccauggaccuuggcgaacugugugaggacaccaugacuuacaagugcccccggauuaccgagguggagccugacgacguggacugcuggugcaacacuacggacaccugggugaccuacgggaccugcagccagacgggcgagcaccggcgcgacaagcggagcguggcccucgcaccccacgucggccuggggcuggagacccgggccgagaccuggaugagcucugaaggcgcguggaagcaaauucagaaaguggagaccugggcccuccggcacccgggguucacggugauagcccucuuccuggcccaugcgaucggcaccagcaucacccagaaggggaucaucuucauacugcugaugcuggucacccccuccauggccaugcgcugcgugggcaucgggagccgggacuucguagaggggcucuccggcgccacgugggucgacguggugcuggagcaugggaguugcgucaccaccauggccaaggauaagcccacgcuggacaucgagcuccugaagacggaggugaccaaucccgccgugcugcguaagcucugcauugaggccaagaucucaaacaccaccacggacagccguugucccacccagggcgaagccacccuggucgaggagcaggacgccaacuucgugugccgccguaccuucguggaccgcggcugggggaacgggugcgggcuguucggcaaggggucccuuaucacuugugccaaguucaagugcguaacuaagcuggaaggcaagaucguacaguaugagaaccugaaguacagugugaucgucaccguccacaccggcgaccagcaucagguggggaaugaauccacggagcacggcaccaccgcuaccaucacgccucaggcgcccacgagcgagauccagcucaccgacuacggugcccugacccuggacugcagcccgcggaccggccucgacuucaacgagaugguacugcugacgaugaaggagaaguccuggcucgugcacaagcagugguuucuggacuuaccccuccccuggaccagcggggcguccaccagccaggagaccuggaaccgccaggaccuguuagucacguucaagaccgcccacgccaaaaagcaggaggugguggugcucggcucgcaggagggcgcgaugcacaccgcccugaccggggccacggaaauacagaccagcggcaccaccaccaucuuugccgggcaccugaagugccggcucaagauggacaagcugacccucaagggcauguccuacgugaugugcaccgggucguucaagcucgagaaggagguggccgagacccaacacggcacgguccuggugcagauuaaauaugaaggcaccgacgcgccgugcaagauccccuucagcacccaggacgagaagggagugacccagaacggccgccugaucacggccaacccgaucgucaccgauaaggagaagcccguaaacaucgaggccgagccgcccuucggggagagcuacaucgugaucggcgccggcgagaaggcacugaagcucuccugguuuaagaaggggagcuccaucggcaagauguucgaggccaccgcccgcggggcccgccggauggccauccugggugacacugcuugggacuuugggagcaucggcggcgucuucacguccguggggaagcuaguacaccagauuuuuggcaccgccuacgggguccucuucagcggcguauccuggaccaugaagaucgggaucgggguucuacugaccuggcucggccugaauuccagguccacgagccuguccaugaccugcaucgccgucgggcucgugacccuguaccugggcgugaugguccaggccgacagcgggugugugaucaacuggaagggacgcgagcucaagugcgggagcggcaucuucgugaccaacgagguccacaccuggaccgagcaguacaaguuccaggccgacuccccgaagcggcugagcgccgccaucggaaaggccugggaggagggcguuugcggcauccgcagugccacccggcuggagaacaucauguggcgccagaucucuaacgagcucaaucacauccugcuggagaacgauaugaaguucaccguggucgugggggacguggucggcauccucgcccaggggaaaaagaugauccggccccagccuauggaacauaaguacuccuggaagucaugggggaaggcgaagaucaucggagccgacgugcagaacaccacguucaucaucgacgggcccaacaccccugagugccccgacgaccaacgcgccuggaacaucugggagguggaggacuacgguuucgggaucuucaccaccaacaucuggcuaaagcugcgggauuccuacacucaggucugcgaccacaggcuuaugagcgccgcgaucaaggacuccaaggccguacacgccgacaugggcuacuggaucgagagcgagaaaaacgagaccuggaagcuggcccgagccuccuucauugaggucaagaccugcaucuggcccaagagccauacccugugguccaacggcguccucgagagcgagaugaucauccccaagaucuacgggggcccgaucucucagcacaacuacagacccggguacuucacgcagaccgcgggccccuggcaccuggggaaacuggagcucgacuuugacuuaugcgagggcaccaccgucguggucgacgagcacugcggcaaccgggggccgagccugcgaacgacuaccguaaccggcaagauuauccacgagugguguugccgguccugcacgcugccuccccuccgcuuuaagggggaggacggcugcugguacgggauggagaucaggccugugaaggaaaaggaagagaaccuggucaagagcauggucagcgccggcuccggugagguggacaguuucucccucgggcuccugugcaucagcaucaugaucgaggaggucaugcgcucccgguggagccgcaagauguugaugaccgguacccuggccguguucuuucuucucaucaugggucagcugaccuggaacgaccugauacgguccugcaucauggugggcgccaacgccagcgaccgcauggggaugggcaccaccuaccucgcgcugauggccaccuucaagaugcgcccgauguucgccgucggccugcuuuuccggcgccuuaccucacgggagguguuacuccugacgaucggucugagccucgucgcguccguggagcugccaaacagcuuggaggaacucggcgacggacuggccaugggcaucaugauccugaagcuccugaccgacuuccaguccuaccagcugugggcgacccuccugagucugaccuucaucaagacgaccuucucccuccacuacgccuggaagaccauggccauggugcugagcaucgucucccugcucccacugugccugagcaccacgucccagaagaccaccugguugccggugcugcugggcagccucggcugcaagccgcugaccauguuucugauugcugagaacaagaucugggggaggaaaaguuggccccucaacgaggggauaauggcggugggcauugucuccauccugcugagcagucuccugaagaacgacgucccgcuagccgggccucucaucgcaggcgggaugcugaucgccugcuacguaaucagcggguccagcgccgaccugucccucgagaaggcggccgaagucagcugggaggaggaagccgagcacaguggggcaagccacaacaucuuaguggaggugcaggacgacgggacgaugaagaucaaggacgaggagcgggacgacacccugaccauccugcuaaaggccacccugcucgcgguuuccggcguguacccgcucagcauccccgccacccuauucgugugguacuuuuggcagaagaagaagcagcgcaguggugugcucugggacacgccaucuccgccagagguggagagggccgugcuggacgacggcaucuaccgcaucaugcagcggggcuuacuggggcgcucccaggugggcguggggguuuuccaggagaauguguuccauaccauguggcacgugacacggggagccgugcucauguaccaagggaagcgacuggagcccagcugggccuccguuaaaaaagacuugauuagcuacggcggcggguggcggcuccagggcucguggaacaccggggaggagguccaggugaucgccgucgagcccggcaagaaccccaagaacgugcagacggcccccggcaccuucaagacccccgagggcgaggugggcgcaaucgcccuggacuucaagcccgggaccucuggcucgcccaucgucaaucgcgaggggaagaucgugggccuguacggcaacgggguggucacgaccuccgguaccuacgugagcgccaucgcgcagacaaaggccucccaggagggcccgcucccggagaucgaggacgaggucuuccguaaacgcaaccugacgaucauggaccuacaucccggcagcggaaagacacggcgcuacuuaccggccaucguccgggaggccaucaagaggaaguuacggacccugauccucgcucccacccgcgugguagccuccgagauggccgaggcccugaagggcaugcccauccgcuaccagacgaccgccgucaaaagcgagcacaccggccgggaaaucgucgacuuaaugugccaugcgaccuucacgaugcgccuccuguccccugugcgggucccgaacuacaauaugaucauuauggacgaggcccacuucaccgaccccagcuccaucgccgcccgcggguacaucagcacccgggugggcaugggggaggccgcggccaucuucaugaccgccacgccgcccggcuccguggaggcuuuuccgcagagcaacgccgucauccaggacgaggagcgagacauccccgagcgguccuggaacagcggguacgaguggauuaccgacuuccccggcaagaccgugugguucgugcccuccaucaagaguggcaacgacauugccaacugccugcgcaagaacgggaagcggguaauacagcucucccgcaagaccuucgacacggaguaccagaagaccaaaaacaacgacugggacuacguggugaccacggacaucagcgagaugggcgcgaacuuccgggccgaccgcgugaucgauccgcggcguugucugaagcccgugauccugaaagacgggcccgagcgggucauccucgccggcccuaugccgguuacgguggcgucggccgcccagcgccgugggcgcaucgggcggaaccacaacaaggagggcgaucaguacaucuacauggggcagccccugaacaacgacgaagaccacgcgcacuggaccgaggccaagaugcugcucgauaacaucaacacucccgaggguaucauccccgcgcuguuugagccagagagggagaaguccgcggccauagacggggaguauaggcugcggggcgaggcccggaagaccuuugucgagcucaugcggcgcggugaccugcccguguggcugucauacaagguggccucugagggcuuccaguacucagaccggcgcuggugcuucgacggggagcggaauaaccagguccucgaggaaaacauggacguggagaucuggacgaaggagggugagagaaagaagcugcguccgcgcuggcuugacgcgcggacuuacuccgacccccucgcccuucgcgaguucaaggaguuugcggcaggacggcgcucaguguccggggaccugauccucgagaucggcaaguugccacagcaccugacacagcgggcccagaacgcgcucgauaaccugguaaugcugcacaacagcgagcagggcgggcgcgccuaccggcacgcgauggaggaguugcccgacaccauagaaacgcugaugcugcucgcccugaucgcggugcugaccggcggggucacccucuucuuucuguccggccgcgggcugggcaagaccaguaucggccuccugugcgucauggccucaagcgcccugcucuggauggccuccguugagccccacuggaucgccgccagcaucaucuuggaguucuuccugauggugcuccugauccccgagccggaccggcagcggacgccucaggacaaccagcuggccuacgucgugaucgggcuccuguucaugauccugacgguagccgcaaacgagaugggccuccuagagaccacuaagaaggaccuggggaucggccacguugccguggagaaccaccaccacgcuacgauguuagacgucgaccugcaccccgcuuccgccuggacguuguaugccgucgccacaaccaucaucacgccgaugaugaggcacacgauugagaacaccaccgcgaacaucuccuugaccgcuaucgccaaccaggccgcgauuuugaugggucuggacaaggguuggccaaucuccaagauggauaucggcgugccccuccuagcgcuggggugcuacagccaagugaacccccugacgcugaccgccgccgugcugaugcucguggcccacuacgcgaucaucggcccggggcugcaggcgaaggccacccgcgaggcccagaagcgcacagccgcgggcaucaugaaaaaccccacgguggacgggaucgucgccaucgaucuggacccaguggucuaugacgccaaguucgagaagcagcucggccagauaaugcuacugauccucugcaccucccaaauccuacugaugcggaccaccugggcccucugcgagucaaucacucuggccaccggcccgcugaccaccuuaugggagggguccccgggcaaguucuggaauacgaccaucgcggucagcauggccaauaucuuccgcgggagcuaccuggccggcgcaggccuggccuuuucccucaugaagucccucgggggcgggcggcgcgggaccggugcgcagggcgagacacugggcgagaaguggaagcggcagcucaaucagcuguccaagagcgaguucaacacauacaagcgcuccgggaucauggagguggaccgcagcgaggccaaggagggccugcgccgcggggagaccaccaagcacgccgucucccgcggcacggcgaaacuccggugguucgucgaacgcaacuuagugaagcccgaggggaaggugaucgaccugggcugcggccggggcgguuggagcuauuacugcgcugggcugaagaaggucacggaggugaagggguacaccaagggcgggcccggacacgaggagccgaucccgauggccaccuacggcuggaaccucgugaagcugcacuccggcaaggacgucuuuuucauaccaccggagaagugcgacacccugcucugugacaucggggagagcucccccaaccccacgauugaagaaggccgcacccugcggguucugaagaugguggagcccuggcuccgcgggaaccaauucugcaucaagaucuuaaaccccuacaugccaagcgucguggaaacccuggagcagaugcagcggaagcacggcggcaugcucgugcgcaacccgcugucccggaacaguacccacgagauguacugggucuccugugggaccggcaacauagugagcgccgugaacaugacgucccgcauguuauuaaaccgcuucaccauggcccaccggaagcccaccuacgagcgcgacguggaucucggggccggcacacgucacguugcgguggagcccgaggucgccaaccuggacauaaucggccaacgcaucgagaauaucaagcacgagcacaagucgacguggcacuacgacgaggacaaucccuacaagacaugggccuaccacggguccuacgaggugaagccgaguggcuccgcaagcagcauggucaacgggguggugaagcuccuuaccaaacccugggacgucauccccauggugacccagauagccaugacagauacaaccccauucggccagcaacggguguuuaaggagaaggucgauacccgcacgccgaaggcgaagcgggggaccgcacagauuauggaggugaccgcccgcuggcucuggggcuuccucucccggaacaagaagccccgcaucugcacccgggaggaguucacccgcaaagugcggagcaaugccgccauuggcgcggucuucguggaugagaaccaguggaauuccgccaaggaggccguugaagacgagcgcuucugggaccuuguccaccgggagagagagcugcacaagcaggggaagugcgcgaccugcguguacaacaugaugggcaagcgggagaagaagcucggagaguucggcaaggcgaaaggcagccgcgcgaucugguacaugugguuaggcgcccgguuccuggaguucgaggcccucgguuucaugaacgaggaccacugguucucccgcgagaacagccuuuccgggguggagggcgaggggcugcacaagcucggcuacauccuacgggacaucagcaagauccccgggggcaacauguaugccgacgacaccgcgggcugggauacccgcaucacggaggacgaccugcagaacgaggccaagaucaccgauaucauggagccggagcacgcccuccuggccaccuccaucuucaagcugaccuaccagaauaaggucgugcgagugcagcggccugcccgcaaugggacggucauggacguaauuucacggcgcgaccaacggggcuccggccagguaggcaccuacggccucaacaccuucaccaacauggaggcgcagcugauccgucaaauggagucggagggaaucuucucccccagcgagcuagagacgcccaaccucgcggagcguguacuggacuggcuggagaagcacggcguggagcgacucaagcggauggccaucagcggggaugacugcguggugaagccgaucgacgaccgcuucgccaccgcccugagcgcgcugaaugacaugggcaaggugcggaaggacaucccccagugggagcccagcaaaggguggaacgacuggcagcagguccccuucugcucccaucacuuccaccagcucaucaugaaggauggccgcgagaucgucguaccgugccggaaccaggacgagcuggugggccgcgcccgggucagucagggggccggcuggucccugcgcgagaccgccugccucggcaaguccuacgcccagauguggcagcugauguacuuccaccgucgagaucugcgccucgccgccaacgcgaucugcuccgccguccccguggacuggguccccaccagcaggacaacaugguccauccacgcgcaucaccaguggaugaccacugaggacaugcugagcguguggaaccgcguguggaucgaggagaaccccuggauggaagauaagacgcacaucuccagcuggggugacgucccguacuuagggaagcgggaggaccaguggugcggcagucucauaggccugacggcccgcgccaccugggccaccaacauccagguggccaucaaccaggugcggcgccugaucgggaacgagaacuaccucgacuacaugaccagcaugaagcgguuuaagaacgagagcgaccccgagggcgcgcugugguga

SEQ ID NO: 24380 - RNA, 9879 nt, Artificial Sequence
  derived and/or modified CDS sequence (opt11) from DENV-1__FJ898408__SS-prME
ucggugaccaugcugcucaugcucaugcccacggcccuggccuuucaccucacuacccgaggaggggaaccccauaugaucgugacgaagcaggagcgggggaaaagccuacucuucaaaaccagcgcuggggugaauaugugcacccucaucgccauggaccugggcgagcugugcgaggacaccaugaccuacaagugcccccgcaucaccgaggccgagcccgacgacguagacugcuggugcaacgcaaccgacaccuggguaaccuacgguaccugcagccagaccggagagcaccgucgcgacaagcggagcguggcccucgcgccccacgugggccuggggcuugagaccaggaccgaaaccuggauguccagcgagggcgccuggaaacagauccagcguguagagacuugggcccuuagacaccccggcuucaccgugaucgcccucuuccuggcgcacgccaucggcacauccaucacacagaaggggaucaucuucauccuccugaugcugguaacgcccagcauggccaugcggugcgucggcaucggcucccgcgacuucguggaggggcucagcggcgccacuuggguggacgucgugcuggaacacggcuccugcgucaccacgauggcgaaggacaagcccacgcuggacaucgagcucuuaaagaccgagguuaccaaccccgcugugcugcguaagcucugcaucgaggccaaaaucagcaacaccacgaccgacucccguugccccacccagggcgaggccacccugauggaggagcaggacgccaacuucgucugccggcguacguucgucgaccggggaugggguaacggcugugggcuguucggaaaggggagccucauaacgugugcaaaguucaagugcgugaccaagcuggagggaaagaucgugcaguacgaaaaccugaaguacuccguaaucgucaccgugcauacuggugaccagcaccaggucgggaacgagagcaccgaacacggcacaaccgcgaccauaacgccccaggccccuaccuccgagauccagcucaccgauuacggggcccugaccuuagacuguagcccccgcaccggccucgacuucaacgaaauggugcugcugaccaugaaggagaaauccuggcucguccacaagcagugguuccuggaucugccgcuccccuggaccagcggggcuagcaccucccaggagacguggaaccggcaggaccugcuggucaccuucaagaccgcccacgcgaagaagcaggagguggugguccugggcagccaagaaggggccaugcacaccgcccucacgggagccaccgagauccagaccucaggcaccacuacgauuuuugccgggcaucugaaaugccgccucaagauggacaagcugacccugaagggcaugagcuacgugaugugcacaggguccuucaaacucgagaaggagguagcggagacacagcacggcaccguauugguacagaucaaguacgagggcaccgacgcccccugcaagauccccuucagcacccaggacgagaagggggucacgcagaacggccggcugaucaccgccaacccgaucgugaccgacaaggagaagccggugaacaucgaggccgagccgcccuuuggggaguccuauaucgucauaggcgcuggcgagaaggcccugaaacucagcugguucaagaagggguccagcaucggcaaaauguucgaggccaccgcccgcggugcccggcgcauggcgaucuuaggcgauacggccugggacuuuggguccaucggcgggguguucacaagcguugggaagcugguccaucagaucuucggcaccgcauaugggguacuguucuccggcgugucguggaccaugaagauuggaaucggcguccugcuuacguggcucggccugaacucacgcuccaccagucugagcaugaccugcaucgccguggggcucgugacucuuuaucugggcguaauggugcaggcggacuccgggugcgugaucaacuggaagggucgggagcuaaaaugcgggagcggcaucuucgugacaaacgaagugcacacauggaccgagcaguacaaguuccaggcggacagcccgaagcgccuguccgccgcgaucggcaaggcgugggaggagggcgucugcggcauccggagcgccacucgccuggaaaacaucauguggaagcagauauccaacgagcucaaccacauacugcuggaaaaugggaugaaguucaccguaguggugggcgacgucguggggaucuuggcgcagggcaagaaaaugauucggccacagcccauggagcacaaguacagcuggaagaguuggggcaaggccaagaucaucggggcugaugugcagaacacgaccuuuauuauugacggacccaacacuccggagugucccgacgaucagcgcgccuggaacaucugggaggucgaggacuacggguucgguauauucaccacgaacauuuggcugaaguugcgggacagcuacacccaagugugcgaccaccggcuaauguccgcggcaaucaaggacaguaaggccguccaugcagauaugggcuacuggaucgaguccgagaagaacgagaccuggaagcuggcccgcgcgagcuucaucgaggucaaaaccugcaucuggcccaagucccacacgcuguggucaaacggcgugcucgaguccgagaugaucauacccaagaucuacggcgggccuaucagccagcauaauuaccgccccggcuacuucacccaaaccgcugggcccuggcaccugggcaagcuagagcucgacuucgaccugugcgagggcaccaccguggucguagaugagcacugcgggaaccggggcccgucccuccgcaccaccaccgugacggggaagaucauccacgaguggugcugccgcagcugcacucugccgccccuacguuucaagggcgaggacgggugcugguacggcauggagauccggcccgucaaggagaaggaagagaaccugguuaaguccauggugagcgccggcaguggggaggucgauaguuucagccucgggcugcugugcaccuccaucaugaucgaggaggucaugcgaagucgguggucccgcaagaugcucaugacugggacgcuggcuguauuccugcuccugaucaugggccagcugaccuggaacgaccucauccggcugugcaucauggucggagccaaugcgagcgaccgcaugggcaugggaacuaccuaccuggcccuaauggccacguucaagaugcgcccgauguuugcugugggacugcuguuccggcgccucaccagccgggaggugcugcuucucaccaucggucugagccugguugccagcguagagcuccccaacagcuuagaggagcuuggggacggccucgcgaugggcaucaugauccugaagcuccucacagacuuccagucccaccagcugugggccacucuguuaagccugaccuucaucaagacuaccuuaucccuccacuacgccuggaagacgauggcaaugguccuuagcaucgugagccuguucccccucugucugagcacaaccucccagaagacgacaugguugcccgugcuccucggaagccucggcugcaagccgcuuaccauguuccugaucgcggaaaacaagaucugggggcgcaaaucuuggccccugaaugagggcaucauggccgucgggguggugucgauauuacugagcagccugcucaagaacgacgucccccuggccggcccucugaucgccggcggcaugcucaucgcgugcuacgugauaagcggcuccuccgcggaccugucccuggagaaagcagccgaggugucuugggaggaggaggccgagcauuccggcgccagccacaacauucucgucgaagugcaagacgacggcacaaugaaaaucaaggacgaggagagagacgauacccugaccauccugcucaaggccacgcugcuggcugugaguggggucuacccgcucucgauccccgccacccuuuucgugugguauuucuggcagaagaagaagcagagaucuggcgugcugugggacacgcccagcccgccagaggucgaacgggccgugcuggacgauggcaucuacaggaucaugcaacggggacuucuaggccgcucccagguggggguuggcguguuccaggagaacguauuccacaccauguggcaugucacgcgcggggccgugcugauguaccaaggcaagcgccuggagcccucuugggcgucugucaagaaagaccugaucagcuacggcgggggcuggcggcugcaggggucauggaacaccggugaggagguccaggugaucgccguggagcccgggaagaaucccaagaacguccagaccgcccccggcacguucaagacgcccgagggcgaagucggggccaucgcgcuagacuucaagccggggaccucaggaucccccaucgugaacagggagggcaagaucguuggccuguacgggaacggcguggugaccaccagcgguacauaugucagcgcgaucgcccaggccaaggccucucaggaagggccgcugcccgagaucgaggacgagguguuucggaagcgcaaccucaccaucauggaccugcaccccgggagcggcaagacccggcgcuaccugcccgcgaucgugcgggaggccaucaagcgcaagcugcggacgcugauccuggcccccacgcgcgucguggcuuccgagauggcugaggcacucaagggcaugcccauccgcuaccagaccaccgcuguuaagagcgagcauaccgggaaggagaucgucgaccugaugugccaugccacguuuacaaugcggcuauuaucccccgugcguguaccgaauuacaacaugaucaucauggacgaggcccacuucacugaucccagcuccaucgccgcgcguggcuacaucagcacgcgcguagggaugggcgaagccgccgccaucuuuaugacggccacgccgcccggcagugucgaggcguucccgcagagcaacgcagugauccaggacgaggagagagacaucccagagcgcucauggaacagcggcuacgaauggaucacugacuucccuggcaagaccguaugguucgugcccuccaucaagagcgggaacgacaucgccaacugccugcggaagaacggcaagcgcgugauacaacugucccggaaaacguucgacaccgaguaccagaagacuaagaacaacgacugggacuaugucgugaccacggacaucagcgagaugggggcgaacuuuagggcggaccgggugaucgacccgcggcggugccucaaacccgucauccugaaggauggccccgaacgcguuauccuugccgggcccaugccgguuaccguggccuccgcugcccagcggcgcggccggaucggccgcaaccacaacaaggagggggaccaauacauauacaugggccagccacucaacaacgaugaggaccacgcgcacuggacagaggccaagaugcuucuggacaauauuaacacccccgaagguaucauccccgcccucuucgagccggagcgggagaaguccgcugcaaucgacggcgaguaccgccugcgcggggaggcgcggaagacguuuguggagcuuaugcgccggggcgaccucccagucuggcuguccuauaagguggccagcgagggauuccaguacagcgacagacgguggugcuucgauggggagcgcaauaaucaggugcuggaggagaacauggacgucgagauuuggacgaaggagggcgagcggaagaagcucagaccccgguggcuggacgcccgcacguacuccgacccccuggcacuaagagaauuuaaggaguuugccgcggggcgccggagcguguccggcgaccuaauccuggagaucggcaaacuuccgcagcaccugacccagcgcgcccagaacgcccuggauaaccucgugaugcugcacaacagcgagcagggagggcgggccuaccgccacgcgauggaggaacugccggacacgaucgagacccucaugcugcuggcgcucaucgccguccugacagggggcgugacccuguucuuccucaguggacggggccugggcaagaccagcauaggacuguuaugcgucauggccuccagcgucuuacuguggauggccucaguggagccccacuggaucgcggccucgaucauccucgaguucuuccugauggugcugcucauacccgagccggacaggcagcggacgccgcaggauaaccaguuggccuacgucgucaucggucuccucuucaucaucuugaccguggccgccaaugagaugggucugcucgaaacaaccaagaaggaccugggcaucgggcacgucgcgguggagaaccaccaccacgccacgaugcuggacguagaccugcaccccgccuccgccuggacccuguacgccgucgcgaccaccaucaucacgccgaugaugaggcauacuaucgaaaacaccacugccaacaucagccuuacugccaucgccaaccaagccgcgauacuaaugggucuggauaaaggcuggcccauuucaaagauggauaucggggugccauuauuagcccugggcugcuacagccagguaaauccccugaccuugacagcggccgucuuaaugcugguugcacacuacgccaucaucgggccuggccuucaggccaaggccacucgggaggcccagaagcgcacugcggccgggaucaugaagaaccccaccguggacggcaucgucgccauugaccuggaccccgugguguacgacgccaaguucgagaagcagcucggccagaucaugcuccugauccugugcacaucgcagauccuccugaugcgcaccacgugggcccugugcgaauccauaacccucgcgacaggcccacugaccacgcugugggaaggcuccccggggaaguucuggaauaccaccaucgccgucagcauggcuaauaucuuccggggcuccuaccucgcgggcgccggccuggcguucucucugaugaagucccucggcgguggccgcagggguaccggcgcacagggcgagacgcugggggagaaguggaagcgccagcugaaccagcucuccaagucugaguucaauaucuacaagcgcuccggcaucauggagguggacagaagcgaggccaaggaagggcucaagcggggcgagaccacccgccacgcugucucucggggaacggcuaagcuccgcugguuugucgagcggaaucuggugaagccagagggcaaggugaucgaccucggcugcggacgcggcggcuggagcuacuauugcgccggucugaagaaggucaccgaagugaagggcuacaccaaaggcggcccgggacacgaggaacccaucccgauggccaccuacggcuggaaccuggugaagcuccacuccgguaaggacgucuucuucaccccgcccgagaagugcgauacgcugcucugugacaucggcgagagcucccccaacccgacuaucgaggaggggcggacuuugcgcgucuuaaagaugguggaacccuggcugagaggaaaccaguuuugcaucaagauccucaaccccuacaugccgagcgugguagagacccuagagcagaugcagcgcaagcacggcgggaugcuggugaggaauccuuugucccgcaacagcacccacgagauguacugggucuccugcggcacggggaacaucgugagcgccgugaacaugaccuccagaaugcuacugaaccgcuucaccauggcccaccgcaagcccaccuacgaacgggacgucgaccucggcgcgggcacgaggcacguggccgucgagcccgagguggccaaccuggacaucaucggccagcgaaucgagaacaucaaacacgagcacaagagcaccuggcacuacgacgaagauaacccuuacaagaccugggcauaccacgguuccuacgaggugaaacccagcggaagcgccagcagcauggucaacggggugguuaagcuguuaaccaagcccugggacgucauucccauggugacgcagauagcgaugacagacacuacccccuucgggcagcagcgaguguucaaggagaagguggacacgcgaacuccgaaggcuaagcgcggcaccgcccaaaucauggaggugaccgcccguuggcucugggguuuccugucccgcaacaagaagccccggaucugcacgcgcgaggaguucaccagaaaggugcgcucgaacgccgcgauuggggcggucuucguagacgagaaccaguggaacuccgccaaagaggccguggaggacgagcgguucugggaucucguccagaaggagcgcgagcugcacaaacaaggcaagugugcgacgugcguguacaacaugauggggaaacgggagaagaaacuuggcgaguuugggaaggccaaaggcagccgagccaucugguacauguggcucggggcccgguuccuggaguucgaagcucugggguucaugaacgaagaucacugguucucgcgcgagaacagccuuuccggcgucgagggggaaggccugcacaaguuagguuacauccuccgggacaucaguaagauccccggcggaaacauguaugcggacgauaccgccggaugggacacgcgcaucacagaggacgaccugcagaacgaagcaaaaaucaccgauaucauggagccugagcacgcgcugcuugccaccuccaucuucaaacugacguaccagaacaaggucguucggguccaacgcccagcgaagaacggcaccgucauggacgugaucucgcgccgggaccagcgggggaguggacagguggguaccuacgggcugaacaccuucacgaacauggaggcccagcucauccggcagauggaaagugagggcaucuuccuucccuccgagcuggagacccccaaccucgcugagcgcguccuugacuggcucgaaaaguaugguguggagcggcucaagcgcauggccaucucuggugaugacugcgugguuaaaccaauugacgaccgguucgcuaccgcucugaccgcccugaacgauauggggaagguacgcaaggacaucccccagugggagcccaguaagggcuggaacgacuggcagcagguccccuucugcagccaccacuuccaucagcucaucaugaaggacggcagagagaucgucgugccgugccgaaaccaggacgagcugguggggagagcccgcgucucccagggcgccgggugguccuuacgggaaacggccugccucggcaagucguacgcgcagauguggcaacugauguacuuccaccgccgggacuugcgccucgccgccaacgccaucuguuccgcagaccccggagauugggugcccacaagcagaaccaccugguccauccacgcccaccaccaguggaugacgaccgaagauaugcugagcguguggaaccgaguauggaucgaggagaaccccuggauggaggacaagacccacguguccagcuggggcgacgugccguaucuggguaagcgagaggaccaauggugcgggucacuaaucggcuuaaccgcccgcgccaccugggccagcaacauccagguagcaaucaaccaggugcgucggcugaucgggaacgaaaacuaccucgacuacaugacguccaugaaacgcuucaaaaacgaaggcgacccggagggggccuugugguga

SEQ ID NO: 24381 - RNA, 9879 nt, Artificial Sequence
  derived and/or modified CDS sequence (opt11) from DENV-1__GQ199843__SS-prME
agcgucaccaugcugcucaugcuuaugccgaccgcccuggccuuccacuuaacaaccagaggcggggagccccacaugaucguaaguaagcaggagagaggcaagagccugcuguucaaaaccagcgcagggguuaauaugugcacacuaaucgccauggaccugggggagcuuugugaggacaccaugaccuacaagugcccacggaucacggagguggaacccgacgacguggauugcuggugcaacacaaccgauaccuggguuaccuacgggaccuguagccagacgggggaacaucggcgcgacaaacggagcgucgcccucgcuccacacgucggccuggggcuugagacccgggccgagacuuggaugucguccgagggcgcguggaagcaaauccaaaagguugaaaccugggcacuccggcaccccggguucacggugauugcccuguuccuggcccacgcgaucggcacuagcauaacccagaaggggaucaucuuuaucuuguuaaugcuggucacacccuccauggccaugcggugcguggggaucgguagccgggauuucguggaggggcucuccggcgcaacguggguugacguugugcuggagcacgggagcugcgugaccacuauggccaaagacaaacccacgcuggacaucgagcuccugaagacggaggugacaaaccccgccgucuugcgcaagcucugcauagaagcgaagauauccaauaccaccacggacagccggugcccgacgcagggcgaggccacccucguugaggagcaggacgccaacuucgugugccgucggaccuucguggaccgcggcuggggaaacggcuguggacucuucggaaagggguccuuaaucacgugcgcgaaguuuaagugcgucaccaaguuggaggguaagauugugcaguaugagaaucugaaguacucuguaaucgucacugugcacaccggcgaccagcaccaagucgggaacgaauccacggagcacgguaccacggcuacaauuacaccccaagcccccacgucugagauccagcucaccgacuacggagcccugacccuggacugcagcccccggaccggccucgacuucaacgagauggugcugcugacgaugaaggagaaguccugguuggugcacaagcagugguuccuagaccugccccucccauggaccaguggggccuccaccagccaggagaccuggaaccgccaggacuugcuugucacuuucaagaccgcgcacgccaagaagcaggaaguagugguccucggcucacaggagggcgcgaugcacaccgcccugaccggagcgacggagauccaaaccagcggcaccacgacgaucuucgccgggcaccugaagugccggcucaaaauggacaagcugacccugaaggggauguccuacguaaugugcaccgggagcuucaagcuagagaaggaggucgcggagacucagcacggcacaguccuggugcaaauaaaguacgagggcacugacgcgcccugcaagauccccuuuucuacucaggacgagaagggcguaacccagaauggcaggcugaucacggccaauccgauuguaaccgacaaggagaagccuguuaacauugaggccgagccgcccuucggggagaguuacaucgugaucggcgccggcgaaaaagcgcugaagcucagcugguucaagaagggaagcuccaucgguaagauguucgaagcuaccgcccgcggggcucgacguauggccauacuaggugacaccgcuugggacuucgguagcaucggcggcgucuucacguccguggggaaacuugugcaccagaucuucggcaccgcguacggcguccucuucagcggcgucuccuggacgaugaagaucggaaucggcguccuguugaccuggcugggccugaauagccgcuccacgagccuauccaugacaugcaucgccgucgggcucgugacccuguaucugggggugauggugcaggccgauagcgggugcgugaucaacuggaagggccgagagcucaaaugcggcagcggaauauucgugaccaaugagguccacacguggaccgagcaauacaaguuccaggccgauuccccgaagcggcugagcgcugccauagguaaggccugggaggagggggugugcggcauucgcucugccacccggcuagagaauaucauguggcgccaaaucagcaacgaguuaaaucacauacuucuagagaacgacaugaaauucaccgucgucgucggggaugugguaggcauacucgcccaggggaagaagaugauccggccgcaacccauggagcacaaauacuccuggaaaagcuggggcaaggcaaagauaaucggcgccgacgugcagaacaccacauucaucauugaugggccuaacacgccggagugccccgacgaccagcgugccuggaacaucugggagguggaggacuacggauucgguauuuuuacgacgaacaucuggcugaaguuacgggacaguuacacgcaggucugcgaccacagacucaugagcgccgcgaucaaggacuccaaggccgugcacgcggacaugggguauuggaucgaaucggagaagaacgaaaccuggaagcucgcccgggcguccuucaucgaagugaaaaccuguaucuggcccaagagccauacccugugguccaauggcguccucgagagcgagaugaucauccccaagaucuaugggggcccgaucucccagcacaacuaccgcccggguuacuuuacacagacagcgggcccauggcaccuggggaaguuggagcucgacuucgaccuaugcgaaggaaccaccguggugguugaugagcacugcggaaaccgggggccgagccugcgaacaaccacagugaccggcaagaucauacacgagugguguugucggucuugcacucugccgccccuccgauucaaaggggaggacgguuguugguacggaauggagauacggcccgugaaagagaaggaggagaaccuggucaaaagcauggucuccgccggcucaggcgagguggacagcuucucccucgggcugcuaugcaucaguauuaugaucgaggaggucaugcgaucccgguggagccgcaaaaugcugaugaccgguacgcuggcuguguucuuccuguuaaucauggggcagcugaccuggaacgaucugauccgguccuguauaauggugggcgccaacgccagcgaucgcauggggaugggcacgaccuaccucgcguugauggccaccuuuaagaugcgcccgauguucgcggucggccuguuguucagaaggcugaccucccgcgagguccugcuccugacgaucggguugagccucgucgcaucgguggagcugcccaauucccuggaagaguuaggugacgggcucgccaugggcaucaugauucugaagcuccugaccgacuuccaguccuaccagcugugggcgacccugcugagccugaccuucaucaaaacgacuuucucccuccacuacgcguggaaaaccauggccauggugcugagcaucgucucccuccucccccugugccugagcaccacgucucagaagaccacguggcuccccguguugcuggguagccucgggugcaaaccccugaccauguuucuuauagccgaaaacaagaucuggggccgcaagagcuggccccucaacgaggggauaauggcagugggcauagucaguauauuacuaucuuccuuacugaagaacgacgugccccuggccgggccgcucaucgccggcggcaugcugaucgccugcuacguaaucucuggguccagcgcagaccugucccucgaaaaggcggcggagguuucgugggaggaggaggcagaacacuccggcgccagccacaacauucuaguggaggugcaggacgacgggacgaugaagaucaaggaugaggagcgagacgacacccugacuauacuccugaaggccacucuacucgcggucuccggcgucuacccacucagcauccccgcgacccuguucgugugguacuuuuggcagaaaaagaaacagcgcuccgggguccucugggacacgcccagcccgccggagguugagcgugccguacuggaugacggcaucuaccguaucaugcagcggggccugcuaggucgcucccagguaggcguugggguguuccaggagaaugucuuucacaccauguggcacgugacccggggagccguguugauguaccaggggaagcgacuggagcccagcugggccagugucaaaaaggaccugaucagcuacgguggaggguggcggcuccagggcucauggaacacgggcgaggagguccaggucaucgcggucgaaccggggaagaauccuaagaaugugcagacggcccccgguaccuucaagaccccagaaggcgagguuggcgccaucgcgcuggacuucaagcccgggacuagcggcagccccaucgucaaucgcgaggggaagaucgugggccucuacggaaacgggguggucaccaccucgggcaccuacgugagcgcaauugcgcaggcaaaggccucccaggagggcccucuccccgagauagaggacgaggucuuccggaagcgcaaccugaccauuauggaccugcaccccggcucggggaagacgcggcgcuacuuacccgccaucgugcgggaggcaaucaagcgcaaguuaagaacacugauccucgccccuacccgcgugguggccuccgagauggccgaggcccugaagggcaugcccauccgcuaccagaccacugcgguaaaaagcgagcacaccggccgggagaucguggaucugaugugucacgccaccuucaccaugagauuacucucccccgugcggguuccgaacuauaacaugaucauuauggacgaagcacacuucacggaccccucguccaucgccgcccgggguuacauaucuacccgaguugguaugggagaggcggccgccauauucaugaccgcuacgccucccggcuccguggaagccuucccgcagagcaacgccgucauacaggaugaagaacgcgacauccccgagcgguccuggaauagcgguuacgaguggauuacagacuuccccggcaagaccgugugguucgugcccuccauuaaguccgggaacgacaucgcuaacugccugcgcaaaaacgggaagcggguaauccagcucagccgcaaaaccuucgauaccgaguaccaaaagacgaagaacaacgacugggacuauguugugaccacagacaucagcgaaaugggugccaacuuccgggcugaccgaguuaucgacccgaggcggugccugaagcccgugauccuuaaggacgggcccgaacgugucauccucgcgggacccaugccgguuacaguagccuccgccgcccagcgccgggggaggaucggccggaaucacaacaaggagggcgaccaguacaucuacauggggcagccucuaaacaacgacgaggaccacgcccacuggacggaggcgaaaaugcuucuggacaauaucaauacccccgaaggcauuauacccgcgcuguucgagccggagcgcgaaaaauccgccgccaucgacggugaauaccgcuugcggggcgaggcccgcaagaccuucgucgaguugaugcgacgcggggaccugcccguguggcugagcuacaaaguggcgucagaaggauuccaauacucagaccggcgcugguguuuugacggcgagcguaacaaccaggugcucgaggaaaacauggacguggagauauggaccaaagagggcgagcgcaagaagcugcggccccgcuggcuggacgcccggacguacuccgacccacucgcgcuaagggaguucaaggaguucgccgccggccggcgcagcgugagcggggaccuaauccucgagaucggcaagcugccccagcacuuaacacagcgggcgcagaacgcccucgauaaccuggucaugcugcacaacagcgaacagggcgggcgcgcguaucggcacgccauggaggaacucccugauaccaucgagacccugaugcugcuagcgcugaucgccgugcuuacaggagggguuacccucuucuuccuguccggccgcggcuugggaaagaccagcauaggucuccugugugugauggccucgucggcccuccucuggauggccuccguggagccccacuggaucgcggccucaaucaucuuggaguucuuccucauggugcuccugauccccgagccggaccggcaacgcacuccgcaagacaaccaguuggccuacguuguuaucgggcuccuguucaugauacugaccguggccgccaacgagaugggccucuuggagacgacgaagaaagaccucgggauuggccacgcggccgucgaaaaccaccaccacgccaccaugcucgauguggaucugcaccccgccuccgcauggacccuuuacgcgguggccacgacgaucaucacgccgaugaugcggcacaccauagaaaacacgaccgcuaacaucagccucacagccaucgccaaucaagcugccauccugaugggucuggacaaaggcuggccaaucuccaagauggacaucggcguaccccuacuggcccuggguugcuacagccaggugaaccccuuaacucugacggccgcuguucugaugcuugucgcccacuacgcaaucaucgggccugggcugcaagccaaggccacucgcgaggcgcagaagcgcacagcggcgggaauuaugaaaaaccccaccguggacggaauuguagccaucgaccuggaucccgugguguacgaugcaaaguucgaaaagcagcucggccagauaaugcuccucauacucuguacgucccagauccugcuaaugcgaaccaccugggcguugugcgagucaaucacccucgccacgggcccccugaccacucucugggagggguccccuggcaaguucuggaacaccacgauugcggugagcauggccaacaucuuccgcgggagcuaccuggcaggcgcuggucuugccuucuccuugaugaagucgcucggcggagggcgucgcgggacgggggcgcagggugagaccuugggcgagaaguggaaacggcagcucaaccagcugucgaagucggaguucaacaccuacaaacgcagcgggauuauggaggucgaccguucugaagcgaaggagggccugcgccgcggggagacgaccaagcacgcagugucccgaggcaccgccaaguugcggugguucguagagcggaacuuggucaagccggaggggaaggugaucgaccucggcugcggccgcggaggguggucuuacuacugcgccgggcugaagaaggugacugaggucaagggguacaccaaaggcgggcccggacacgaggagccgaucccgauggccaccuacggcuggaaucucgugaagcuccauagcggcaaggacguauucuuuaucccgccggagaaaugcgacacccugcugugcgacaucggggagagcucccccaacccgacaaucgaggagggcagaacgcugcggguccugaagaugguagagcccuggcuccgcgggaaccaauucugcaucaagauucucaaccccuacaugcccagcguagucgagacccuggaacagaugcagcgcaagcacggcggaaugcucgugcgcaacccgcugucucguaauagcacccaugagauguacuggguguccugcgggacaggcaauauagucagcgccgugaacaugacaucccgcauguuacucaaucgcuucacgauggcgcaccggaagcccacguacgagcgcgacguggacuuaggggccggcacccggcaugucgcgguggaacccgagguugccaaccuggacaucaucggccagaggaucgagaacaucaaacacgagcacaagucgaccuggcacuacgacgaggacaacccauacaagacgugggccuaccacgggucauacgaggucaagccgagcggcucggcguccagcauggugaaugggguagugaagcuccugaccaagcccugggaugugauccccaugguaacccagaucgccaugaccgacacgaccccauucggccagcaacgcguguuuaaggaaaaaguggauacgcgcacuccgaaggccaagcggggaacggcgcaaauuauggaagugaccgcgcgaugguuguggggcuuccuuucccggaacaagaagccacguaucuguaccagggaggaguucacccgcaaggugcggagcaacgcggccaucggugccguguucgucgacgagaaccaguggaacagcgccaaggaggcgguggaggacgagagauuuugggaccuugugcaccgugagagggagcugcacaagcaagggaagugcgcaacgugcgucuacaacaugaugggcaaacgagagaagaagcucggagaguucggcaaggccaaggggagccgugccauuugguacauguggcuaggugcccgguuccuggaguucgaggcgcucggguucaugaacgaggaccacugguuuucccgagagaacagccuuuccgggguagagggcgaggggcugcacaagcucggguacauccugcgggauaucagcaagauccccggcgguaacauguaugccgacgacacggccggaugggacacaaggaucacggaggacgaccugcagaacgaggccaagaucaccgacauaauggaaccggagcacgcccuccuggcgaccuccaucuucaagcugaccuaccaaaacaaggugguccgcgugcagcgccccgcacgcaacgggacagugauggacgucaucucgcggcgcgaccaacgggggucuggccaggugggcacguacggccucaacaccuucaccaacauggaggcccagcugauacgacagauggagagcgagggcaucuucucucccagcgagcuggagacccccaaccucgccgagcgggugcuugacuggcuggagaaacacggcgucgaacgccucaagcggauggcaaucuccggugacgauugcguggugaagccaaucgacgaccgcuucgcaaccgcccugagcgcccuuaacgacaugggcaagguccggaaggacauaccacagugggagccaaguaagggcuggaacgacuggcagcaaguuccguuuugcucucaucacuuccaccaguuaauaaugaaggacggccgcgagauaguggucccgugccggaaccaagacgagcuggucggccgcgcccgggugagccagggggcaggcuggucccugagagagaccgccugccucgggaagaguuacgcccagauguggcagcugauguacuuccaucggcgcgaccugcggcuugccgccaacgcgaucuguuccgccgucccuguggacugggugcccaccagccgcaccacguggucgauacaugcucaucaccaauggaugacaacggaagacaugcugagcguguggaaccggguguggaucgaagagaaucccuggauggaggacaaaacccacaucuccagcuggggcgacgugccuuacuuggggaagagggaggaccaguggugcggcucccucaucggccugacagcucgggcgaccugggcgaccaauauucaggucgccaucaaccaggugcggcgccugaucgggaacgagaauuaccucgacuacaugaccucgaugaagcgguuuaagaacgagucugaccccgagggcgcccugugguag

SEQ ID NO: 24382 - RNA, 9879 nt, Artificial Sequence
  derived and/or modified CDS sequence (opt11) from DENV-1__GQ199844__SS-prME
uccgugacaaugcuccucaugcugaugcccaccgccuuggcguuucaucucaccaccagaggaggggaaccccacaugaucgugaccaaacaggagaggggcaaaagucuacucuucaagacauccgcgggggugaacaugugcacacucaucgccauggauuuaggcgagcuuugcgaggacaccaugacuuacaagugcccccggaucacugaggccgaaccugaugacguugacugcuggugcaacgccaccgacaccugggugaccuacgggaccuguagccaaacgggcgagcacaggcgcgauaagcggagcguggcccuggcgccccaugugggccuggggcuugagaccaggaccgagaccuggauguccagcgagggcgccuggaagcaaauacagcgggucgagacaugggcacuucgccaccccggguucaccgugauagcccuuuuccuggcgcacgcaauuggcacuuccaucacacagaaggggaucauauucauacuccugaugcuggugacgcccagcauggccaugcgcugcgucgggauaggcucccgagauuucguggagggccugagcggcgccacuuggguggacgucgugcuggagcacggguccugcgugacgacuauggccaaagacaagccaacgcuggacaucgagcuccugaagaccgaggucacaaaccccgccgugcuacggaagcucugcauagaggccaagaucucaaacacgacgaccgacucaaggugccccacccagggcgaagcgacccugauggaggaacaagacgccaacuucgugugccgucgcaccuuuguugaccgaggcugggggaacgguugcgggcuguucggcaaggggagccuaaucacgugcgccaaauucaagugcguaaccaaguuagagggcaagaucgugcaguacgagaaccugaaguauucagucaucgucaccgugcacacgggcgaccagcaccaagucgggaacgagagcaccgagcacggcaccaucgcgaccaucacgccccaggcccccacguccgagauccagcuuaccgacuacggugcccugacccuggacuguagcccccgcaccggcuuggacuucaacgaaaugguccugcuuacuaugaaggaaaagucguggcuaguacacaagcagugguucuuagacuugccgcucccguggaccucgggggccucuacuucccaagagacauggaaccggcaggaccuacuggugacguucaagaccgcccacgcuaagaagcaggaggucgucgugcucgggucacaggagggcgccaugcacaccgccuuaaccggggccacugagauucagaccucuggcaccaccacgauauuugcugggcaucugaagugucgccucaagauggacaagcugacccugaagggcaugucguaugucaugugcacuggguccuucaagcucgagaaggaggucgcggagacccagcacgguaccgugcugguacagaucaaguacgagggcaccgacgcccccuguaagaucccauucuccacccaggaugaaaagggggucacucagaauggccgguugauaaccgccaaccccaucgugaccgauaaggagaagccgguuaacauagaggccgagccucccuuuggggaguccuacaucguuaucggcgcgggcgagaaggccuugaaacuuagcugguucaagaagggguccucgaucggcaagauguucgaggcgaccgcccgcggagcccgucgcauggcaauccugggggacaccgccugggacuucgggagugucggcggagucuucacgagcgucgggaaacugguucaccaaaucuucggcaccgccuaugggguccuguucuccggcguguccuggaccaugaagaucgguaucggcguguuguugaccuggcucggccugaacucccgcagcacgucccuguccaugacaugcaucgccgugggacucgucacccuguaccuaggcgugaugguccaggcggacuccgguuguguuaucaacuggaagggccgggagcucaagugcgggucgggcauuuucgucacuaacgaggugcauacauggacggagcaauacaaguuccaggccgauagcccgaagcgccuguccgcagcuaucggcaaggcgugggaggaaggggucugcggcauccgcagcgcaacccgccuggagaacaucauguggaagcagaucagcaacgagcucaaccacauccuacuggagaacgacaugaaauucaccguugucgucggagacguggucgggauccucgcucaggggaagaagaugaucaggccccagcccauggagcacaaguacagcuggaaguccuggggcaaggccaagaucauuggcgccgacguacagaacacuacguucaucaucgacgggcccaauaccccugagugcccugacgaccagcgugccuggaacaucugggagguggaggacuacggcuucgggauauuuacgaccaacaucuggcuaaaacugcgggacagcuacacccaagugugcgaccaucgccuuaugagcgcggccaucaaggacuccaaggcuguccacgccgacaugggauauuggaucgaguccgagaagaacgagaccuggaagcuggcccgggcgagcuucauugagguuaaaacgugcauuuggccuaagucccacacccuguggucuaacggcgugcucgaguccgagaugaucauuccgaagaucuauggcggcccaaucagccaacacaauuaccgccccggguacuucacgcagaccgcuggccccuggcaccuggggaagcuggagcucgacuuugaucugugcgagggcaccaccgucgugguagacgagcauuguggcaaccggggcccgucccugcgcacuaccacugucacgggcaaaaucauccaugaguggugcugcaggagcugcacccugccgccccugcgcuucaagggagaagacggcugcugguacgggauggagauccggcccgugaaggagaaggaggagaaucuggugaaguccauggucuccgcugggagcggcgagguagauuccuucucccucgggcuucugugcaucuccaucaugaucgaggagguuaugcgcagucgguggucacgcaagaugcucaugaccgggacauuagccgucuuucugcuccugaucauggggcagcugacauggaacgaccucauccggcugugcaucauggugggugccaacgccagcgaccgcaugggaaugggcacgaccuaucuggcccucauggccacuuucaagaugcgcccgauguucgccguagggcugcuauuccggcgccuaacguccagagaaguccugcugcucacgauagggcugagucugguggcuuccguugagcuccccaauagccucgaggagcugggcgacgggcucgcgaugggaaucaugauccuuaaacugcucaccgauuuccagucacaccagcugugggccacccuucucagccugaccuuuaucaagacgacgcuuucccugcacuacgcuuggaagacaauggcuauggugcugucuauugcgucgcuguucccccucugcuuaagcaccacgagccagaaaacgaccuggcugccugugcuccugggcagccugggguguaagccgcucacuauguucuugaucacggagacuaagaucuggggccgcaaaucguggccccugaaugaggggaucauggcagugggcguggugucuauccuacuguccucucugcucaaaaaugacgucccauuggcuggcccgcugaucgcgggcgggaugcucaucgccugcuacguuaucagcggguccagcgcagaccugucccuggagaaggccgccgaagugagcugggaagaagaggccgagcacuccggcgccagccacaacauccucgucguggugcaggaugacgggaccaugaaaauaaaggacgaagaacgggacgacacacugaccauccuucucaaagcuacacuacuggcuguauccggcguauacccccucagcaucccugccacccuguuugugugguacuucuggcagaagaagaagcagcgcuccgggguauugugggauacccccagcccuccugaaguggaacgggcugugcucgaugacgggaucuaccguaucaugcagcgcggccuccuagggcgcucacagguagggguggggguuuuccaggagaacgucuuccacaccauguggcacgugacgcguggcgcaguacugauguaccaggggaagcgccucgagccuagcugggcguccgucaagaaagaucugauuagcuacggcgguggguggcggcugcagggcuccuggaacacgggggaagaaguacaggugauagccguagagcccggcaagaacccuaagaacgugcagacagcacccgggaccuuuaagacgcccgagggcgaggucggcgccaucgcccucgacuuuaagcccggaaccucgggcucgcccaucgucaaccgcgaggggaagaucgugggguuguacggcaacgggguggucacgaccagcggcacguacgucagcgccaucgcccaggccaaagcaagucaggaggguccguuacccgagaucgaagacgagguguuucggaagcgcaaccucaccauaauggacuuacauccugguagcgggaagacccggcgcuaccugccggcaaucguccgggaggccaucaaacgcaaacuccggacccugauccuggccccgacgcgcgucguggcuuccgaaauggccgaggcgcucaaagggaugcccauccgcuaccagacuaccgccgucaagagcgagcacaccggcaaggagaucguugacuugaugugucacgccacguuuaccaugcggcugcucuccccugugcgcgugccgaacuacaauaugaucauuauggacgaggcccacuucacugaccccagcuccaucgcagcgcgaggguacaucagcaccagggugggcaugggggaagccgcggcgauuuucaugacggccacgccacccggguccguggaggcuuucccgcagucaaacgcggucauccaggaugaggagcgggacauaccggagcgcucguggaacagcggguacgaauggaucaccgacuucccaggcaagaccgugugguucgugcccuccaucaagagcgggaacgacaucgccaacugucuccgcaaaaauggcaagagagucauccaacuuucccggaaaacguucgacacugaguaccagaagacaaagaacaacgacugggacuacgugguuaccaccgacaucagcgaaaugggcgcaaacuucagggcggauagaguuaucgauccgagaaggugccucaagcccguuauucugaaggacggaccagagcgcguuauccuggccggucccaugccugugacuguggccuccgccgcccagcggcgcgggcgcaucggccguaaccacaacaaggaaggcgaccaguacaucuacauggggcaaccccucaauaacgacgaggaccacgcucacuggaccgaggccaagaugcugcuugacaacaucaacacccccgagggaaucaucccggcccucuuugaaccagagcgggagaaguccgccgccaucgacggagaguaccgcuuacgaggugaagccagaaagacguucgucgagcuuaugcgccgcggggaucuccccguguggcuguccuacaagguggccagcgagggauuccaguacagcgacagaagguggugcuucgacggcgagcgcaacaaccagguucuggaggagaauauggacguggagaucuggacaaaggagggcgagcgaaagaaacucagaccccguuggcuugaugcccgcacguacuccgauccacuggcucuccgggaauuuaaggaguucgccgcugggcgccggagcguguccggggaccugauccuggagauagguaaacucccccagcaccuaacccaacgcgcgcagaacgcgcuggacaaccuggucaugcugcacaacucagagcagggcggucgggccuaucgccacgcaauggaggagcuacccgacacgaucgagacccucaugcugcuugcucuuaucgccguccucacaggcggggugacgcuguucuuccucaguggccgggggcuggggaagaccucuauuggccuccugugugucauggccuccuccgugcugcuguggauggccuccguugagccucacuggaucgcggcaucgauaauccuagaguucuuccugaugguccuguuaauccccgaaccggaccgccagcggacgccgcaggacaaccagcuggcuuaugucguaaucgggcuacucuucaugauccugaccgucgccgcuaacgagaugggcuugcucgagaccacuaagaaggaccuggggaucggccauguggcuguggagaaccaucaccacgccaccaugcuugaugucgaccuccaccccgccucagccuggacccuguaugccgucgcgaccaccauaaucacgccgaugaugcgccacaccaucgagaacaccaccgccaauaucagccugaccgcgaucgccaaccaggccgcgauccucaugggacuggacaaaggguggcccaucuccaagauggacaucgguguaccccugcuugcccucgggugcuacagccaggucaauccacugacccuaaccgccgcggugcugaugcugguggcgcacuacgcaaucaucggcccggggcuacaagcgaaggcuacacgggaggcccagaagcgcacagcugccggcauaaugaagaaccccaccgucgacgggaucguugccauugauuuagacccuguuguauacgacgccaaguuugagaagcagcuuggccagaucaugcucuuaauccuguguaccucgcagauucuccuuaugcgcaccacgugggcccugugcgagagcaucacccucgcgaccggcccucugacuacgcugugggagggauccccgggcaaguucuggaacaccaccaucgccguaagcauggcuaacauauuccgggggagcuaccucgcaggagccggacuggcguucucacugaugaagucccucggcggagggcgcagaggcacgggggcacaaggcgagacgcucggcgagaaguggaagcgccaacugaaccaacuuuccaaaagcgaguucaacaucuacaagcggagcgggaucauggaaguggaccgcagcgaggccaaggaggggcugaagcguggugagaccaccaggcacgccgucucccgggggaccgcaaagcuccgcugguucguggagcggaaccugguuaagccagagggcaaaguuaucgaccucgguugcgggcgcggaggcuggagcuacuacugcgccgggcugaagaaagugacggaagugaagggcuacaccaagggcgggcccggccaugaggagcccaucccgauggccacguacggguggaaccuggucaagcuccauuccggaaaggacguuuucuucacgccgcccgagaagugcgacacguuacugugcgacaucggagagucaucccccaacccuaccaucgaggagggccggacccuccggguucugaagauggucgaacccuggcuccgugggaaccaguucugcaucaaaauccucaacccuuacaugccaucaguuguggagacacuggaacagaugcagcgcaagcacggugguaugcugguucggaacccgcuuucccggaacagcacgcaugagauguacuggguguccugcgggacggguaacaucgucagcgccgucaacaugacuucccggaugcugcucaaccgcuucacuauggcccaccgcaaacccacauacgaacgggacguggaccucggggcgggcacucgccacgucgccguugaacccgaaguggccaaccuugacaucaucggccagcggauagagaacaucaagcacgaacacaaguccaccuggcacuacgacgaggacaaccccuacaagacgugggccuaccacggguccuacgagguuaagccaagcggcagcgccagcagcauggugaacgggguggugaagcugcucaccaagcccugggacgugauccccaugguuacgcagaucgcgaugacggauaccacccccuucggccagcagcgcgucuucaaggaaaagguggacacgcggaccccgaaggccaagcgagguaccgcccaaaucauggaggugaccgcgcgauggcuguggggcuuccugagucgcaauaagaaaccccguaucuguacgcgcgaggaguucacccguaagguccgcagcaacgcagcgaucggcgcaguguucguggacgagaaccaguggaacuccgcaaaagaggcaguugaagacgagcgcuucugggaccucgugcaaaaggagcgcgagcuucacaagcaggggaagugcgcgaccuguguguacaacaugaugggcaagcgggagaagaagcugggagaguuuggcaaagccaaggggagucgagcuauaugguacauguggcucggcgcgcgguuucuggaguucgaggcgcuaggcuuuaugaacgaagaccacugguucucccgcgagaauagccucuccggcgucgaaggagaggggcugcauaagcugggcuacauacuccgggacaucagcaaaauccccgggggcaacauguacgcggacgacaccgccggcugggacacgcgcauuaccgaggacgaucugcagaaugaggccaagaucacggacaucauggagccggagcacgcccuguuagccaccuccaucuucaagcugacguaccagaacaagguggugcgaguccagcgcccugcgaagaacgggaccgugauggacgugauuagccgucgagaccagcgcggauccgggcaggucggcaccuacggccugaacacauucacgaacauggaggcucagcuaauacggcagauggagagcgaggggauuuuccuccccucggagcuggagaccccgaaccucgccgaacgugugcuggacuggcuggagaaguacggcguggagcgucucaagcguauggcuaucagcggcgacgacugcgucgugaagccgaucgacgacagguucgccaccgccuuaaccgcgcugaacgacaugggcaaggugagaaaggacauaccccaaugggagcccuccaagggguggaacgacuggcagcaggucccguucugcagccaccacuuccaccagcucaucaugaaggauggucgggagaucguggugcccugccgcaaccaggaugagcugguggggcgggcacggguuucacagggagcuggcuggagccugcgggagacggccugccucggcaaaagcuaugcccagauguggcagcugauguacuuccacaggcgggacuugcgccucgcugccaacgccaucuguuccgcugugcccgucgauugggugcccaccagccggacuaccugguccauccacgcucaccaccaauggaugaccaccgaggacaugcugagcguguggaaccgcguauggaucgaagagaauccguggauggaggacaagacccacguguccagcuggggagacguuccguaccuggggaagagagaggaucaguggugcggcucucucauuggccugaccgcuagagccacgugggccaguaauauccaggucgcgauaaaucagguacgccggcugauaggaaaugagaauuaccucgacuacaugacguccaugaagcgcuuuaagaacgagggagaccccgagggggcucugugguga

SEQ ID NO: 24383 - RNA, 9879 nt, Artificial Sequence
  derived and/or modified CDS sequence (opt11) from DENV-1__GQ199845__SS-prME
ucugucacgaugcuacugaugcugaugcccacggcccuggcuuuucaucucacgacacggggaggggaaccccacaugaucgucucgaaacaggaacgagggaaaagccuccuauucaaaacauccgccggggugaacaugugcacacucaucgcaauggacuugggggaguucugcgaggauaccaugacauacaagugcccacggauaaccgaggccgaaccugaugacgucgacugcuggugcaacgcaacagacacaugggucaccuacggcacuuguucgcagacaggcgaacaucgacgagacaaacgcagcgucgcccuagcaccccauguaggccucgggcucgagacccgaaccgagaccuggaugagcucagaaggcgcauggaaacagauucagcgugucgaaacaugggcacuuaggcacccgggcuucaccgucauagcucucuuccuugcccaugcaauaggaacuagcauaacccagaaaggcaucaucuucauacugcuuaugcucgucacuccauccauggcuaugagaugcguagguaucgguucucgugacuucgucgaaggucuaagcggcgcgaccuggguagacguaguccuagaacacgggucgugcguuacaacaauggccaaagacaaacccacccucgacauagagcuguugaaaacggaagucacgaacccagcaguguugcgaaaacucuguaucgaagcuaaaauuucgaacacgaccacugacaguaggugccccacccagggagaagccacccuaguagaagaacaggacgcuaacuuuguguguaggaggacguucguggauagagggugggguaacgggugcggccucuucgggaaagggagccuaauaaccugcgcgaaauucaaaugcgugacgaaacucgaaggaaaaaucguccaauacgaaaaccuaaaauauagcgugaucguaacggugcauacaggggaucagcaccaggucggcaacgagaguacagagcacggcaccacagccacaauuacuccccaagccccaucgaccgagauacaauugaccgacuacggagcccuaacgcucgacuguagcccgaggacuggacuggacuucaacgagaugguccuccuaacaaugaaagaaaaaucuuggcuuguacacaaacaaugguuccuugaucuacccuuaccguggaccaguggggcgaguacaagucaggaaacauggaacagacaggaccugcuaguuacguuuaaaacagcacacgcaaagaaacaggaagucgucguucucggaagccaagaaggagcuaugcauacggcacugacaggagcaaccgaaauacaaaccucaggaacuacgaccauuuucgcaggacacuuaaagugccggcuaaaaauggacaaacucaccuugaagggcaugucauacgugaugugcaccggaucuuucaaacucgaaaaagagguugcagaaacgcaacacgggacagucuuaguucagauuaaauacgaggguacagacgcacccugcaaaauuccuuuuagcacgcaagacgagaaaggggucacacagaacggacgauugaucaccgcaaacccgauugugacagacaaagaaaagccggucaacaucgaagccgaaccgccguucggagaaagcuacauaguaaucggagccggggaaaaagcccuuaaacuuuccugguucaagaaaggaagcagcauagggaaaauguucgaggcgacagcacgcggagcaagaaggauggccauacuaggcgauacagcaugggacuuuggaaguaucggugggauguuuacuagcguggggaaacucguucaccagauauucggcacugcguacgguguauuauuuuccggaguuucguggaccaugaagauaggaauaggaguucuccucacauggcugggccuaaauagcagauccacaucccuuagcaugacaugcauagcugucggccuugucacguuauaucuuggggugaugguacaagcggacaguggcugugugauaaacuggaaaggaagggaauuaaaaugcggauccggcaucuucguuacaaaugagguacacacauggaccgaacaguacaaauuccaggccgacagcccaaagcggcuaucggcagcaauuggaaaagcaugggaggagggagucugcggaauuagaagcgccacccgccucgaaaacauaauguggaaacagauauccaaugaacuaaaccacauucugcuugaaaaugacaugaaauuaaccguagucguuggagacgucgcagggauacuagcgcaagggaagaaaaugaucaggccccaaccaauggaauauaaguauagcuggaagauauggggaaaagcaaagaucauaggggcagauguacagaacaccacauucaucauagacggcccuaacaccccagagugucccgaugaccaacgugcauggaacauaugggaaguagaggauuacggcuucggcaucuucacaacuaacaucuggcugaaacuucgcgacucuuacacccaggucugugaucaccgacuuaugagcgcagcaaucaaagacuccaaggccguacaugcagauaugggauacuggauugagucggagaaaaacgagaccuggaaacucgccagggcgucauucauagaagucaaaacguguauauggcccaagucgcacacacuguggagcaacgggguccuggaaucugagaugauaauuccaaagaucuacggugggcccauuucgcagcauaacuaucgccccgguuacuuuacccaaacagcaggccccuggcaucuaggaaaauuagaauuagacuuugaccugugcgaagggaccacaguaguugucgacgaacacugcggaaaccggggcccgagucugcgaacgacaaccguaacagggaaaaucauacacgaauggugcugucgcagcuguacgcuaccaccccuucgguucaaaggggaagacggguguugguauggcauggagauacgcccaguaaaggaaaaagaggagaaccuggucaaguccaugguaagcgcaggcaguggggagguagacagcuucucccuaggacugcuuugcaucucgaucaugaucgaagaagucaugcgcagcagauggucgcguaaaaugcucaugacagggacacuagccgucuuuuuccugcuuauaauggggcaauugacguggaaugaccugaucagacucugcaucaugguaggagcgaacgccagugaucgaaugggaaugggcaccacauaccucgcacuuauggcaaccuucaagaugcgcccaauguucgcaguuggccugcuuuuucgacgccugacgagccgggaaguucuucuacucacaauaggccuguccuuaguugcaaguguagaguuaccaaauucuuuggaagaacuuggugacggacucgccaugggcaucaugauacuaaaacuccugaccgacuuccaaucgcaccagcucugggccacacuccugucccucacauucauaagaacuaccuucucacuacacuacgcguggaagacaauggccaugguccuauccauagucucacuauucccccuaugcuuauccacaaccucacagaaaacaacguggcuccccguacuccucggaucauuaggcuguaagcccuugacgauguuccucaucgcggaaaauaaaauauggggacggaaaucguggccacugaacgaaggaauaauggcagugggcauaguuagcauacuccuaucaagucucuugaaaaacgacguaccgcuagcggguccucuaauagccggcggcaugcuaauugcgugcuaugucauuucagggucaagcgcugaccugagucucgaaaaagccgcagaaguaucgugggaggaggaagcugagcacucaggcgccagccacaauauccuugucgaaguacaagaugacggcacaaugaagaucaaagacgaagaaagggaugacacauugaccauucugcuuaaggcgacucugcuggccguaagcggaguauauccccuauccaucccagcaacccuguucgugugguauuucuggcaaaagaaaaagcaacgaagcggcguacugugggacacccccucucccccagaggucgaacgagcuguccucgacgacggaaucuaucgcaucaugcagcgggggcuccugggucgaagucaagugggaguaggcguuuuucaggaaaacguauuccacaccauguggcacgugacucgaggggccguucucauguaccaaggaaaaaggcuugagccauccugggcaagcguuaagaaagaccuuauuucuuacgggggcggcuggcgacuccagggcuccuggaacacuggggaagagguccaaguaaucgcggucgaaccgggcaagaacccgaaaaacguacagaccgcaccgggcaccuucaagacuagcgaaggcgaggucggcgcaauagcacuggacuucaaacccggaacaucgggaaguccuauagucaacagagaaggcaagauagucgguuuauauggaaacggagucgugacuacuagcggaaccuacguaucggccaucgcccaggccaaagcaagccaagaaggcccucuaccagaaaucgaagacgaggucuuccgaaagcggaaucucaccaucauggaucuacacccaggaucaggcaaaacccgucgauaccuaccagcgaucgucagagaagcaacaaaacggcggcucagaacacuaauccucgcaccuacccgagucguagccagcgaaauggcggaggcccucaaaggcaugccgauucgauaccagaccacagcggugaaaucagaacacaccgguaaagaaauagucgacuugaugugccacgccacguuuacaaugcgccuucucagucccgugcgaguuccuaacuacaacaugauaaucauggacgaggcgcacuucacggaccccucaucaauugccgcuagagguuauauauccacucgaguuggcaugggcgaggcagccgcgauauucaugacagcaacgcccccugggucgguagaagcguucccccaguccaacgccgugauacaagacgaggaacgcgauauaccagaacgcaguuggaacagcggauacgaauggaucacagacuuuccaggcaaaacagucugguucguacccagcaucaagagcgguaaugacauugcgaacugccugaggaagaacgggaaacgaguaauacaguugaguaggaaaacauucgacacagaauaccaaaagacuaagaacaaugacugggacuauguagugaccacagacauuagcgaaaugggcgccaauuucagagcagacagaguaauagacccccgacguugccucaagcccgucauacuaaaggauggccccgagagagucauacuugccggccccaugcccguaacaguggccagcgcggcgcagaggcgaggcagaaucggaaggaaccacaacaaagaaggggaccaauacauuuauaugggccagccccuaaauaacgacgaagaccaugcgcacuggacagaggcaaagaugcugcuagacaacaucaauaccccagaagggaucauuccagcgcucuuugaaccagaacgcgagaaaagcgcagcaauugacggggaauaccguuugcgcggagaagcccgaaagaccuucguggagcugaugcgaagaggggaucuaccuguauggcuguccuacaagguagccucagaaggcuuccaguacucagauaggcgguggugcuucgacggggagcgaaacaaccaggugcuggaagaaaauauggaugucgaaaucuggacgaaggagggagaaaggaagaaauugcgcccucguuggcuagacgcaagaacauauucagacccgcuggcgcuaagagaauuuaaagaguucgcugcaggacgacgaucgguaagcggcgaccuaauucuggaaauaggaaaguuaccgcaacaccucacccaaagggcgcagaacgcccucgacaaccucguaaugcuacacaacucggaacaaggaggccgagccuaccgucacgcaauggaagaauuacccgacacgaucgagaccuuaauguuacucgcccuaauugcagugcucacgggcgguguaacucucuucuuucugagcgguagagggcucggaaaaacgucgauuggacugcucugcguuauggccuccuccguccuacuauggauggccagcgucgaaccacacuggaucgcagcuucaauaauacucgaguucuuuuugauggugcuacugauccccgaacccgaucgccaacgcacaccgcaggauaaccaacuagcauaugucguaauaggacuccucuucaugauauuaacaguggcagcgaacgagauggggcugcucgagacgacgaagaaagaccucggaaucggucacguagcagucgaaaaccaccaccacgcggcaaugcucgacgucgaccugcauccagccucagcauggacacuuuacgcuguagcaaccacuaucauaacgccaaugaugaggcauaccauugaaaauacuaccgcaaacauuagucuaacggcuaucgccaaccaggcggccauccucaugggguuagauaagggauggccuauauccaaaauggacaucggaguuccacuucuugcacucggcuguuacucgcaaguaaacccacuaacccugacggcggccguacucaugcugguugcucauuacgcaaucauagguccgggacuucaagccaaggcaacccgggaggcgcagaaaaggacggcagcggguaucaugaaaaaucccaccguagacggaaucguagcgauagaccuugaccccguuguuuaugacgccaaauucgaaaagcaacuaggccagaucaugcuguugauacugugcacaucccaaauccuacucaugagaacgacaugggcgcugugcgaaucuauuacacucgccacgggaccauuaacaacucuuugggaaggcucacccgggaaauuuuggaauaccacaauugcaguaaguauggcaaacauauuccguggaaguuacuuagcaggagcagggcuagccuucaguuuaaugaagucgcucggcgggggaaggcgcggcacaggcgcgcaaggggagacucuaggagagaaauggaaaaggcagcuaaaccaguuaucuaaaagcgaguucaacacuuacaaacggagcgggauaauggaaguugauaggucggaagccaaagaaggacucaaaagaggggaaacgaccaaacacgcugugagcagagggacugcuaaauugcgcugguucguagagagaaacuuagugaagccagagggaaaggugauagacuuaggguguggcagaggaggauggucauauuacugcgcuggauuaaagaaggucaccgaaguaaaaggauauacgaagggcgggcccggccacgaagaacccauacccauggcaaccuauggauggaaccuagugaaacuucacuccggaaaggauguuuucuucauuccaccagaaaaaugcgauacguuauuaugcgacauaggggaauccagcccaaacccgaccaucgaagaaggacggacacuuaggguucuaaaaauggucgagccuuggcuacgaggcaaccaguuuuguaucaaaauucuaaaccccuacaugcccagugucguagagacccuggagcagaugcagagaaaacauggcgggauguuagugcguaacccacuaagccggaacagcacccacgaaauguauuggguuucaugcggaacagguaauauaguaagcgcagucaacaugacguccaggaugcugcugaaccgcuucacaauggcccaccggaagcccacuuacgaacgggaugucgaccucggagcagggacacgucacguugccgucgaaccggaagucgcuaaccuagacaucauuggccaacgaauagaaaacaucaagcacgaacacaagucuacauggcacuacgacgaagacaaccccuacaagaccugggccuaucauggcucauacgaagugaaaccaucagggucagcaagcaguaugguaaacggaguggucaaacugcucacaaagccaugggaugucauaccgauggugacacaaauagcgaugaccgauacgacgccuuucggccaacaacgagucuuuaaggaaaaagucgacaccagaacaccuaaggcaaaacgcgggaccgcccaaauuauggaggucacggcuaaguggcuguggggauuucuuagucgaaauaagaaaccaaggaucugcacacgugaagaguucacccgcaaggugcgcaguaaugcagcaauaggagcagucuucguggaugagaaccaauggaacagcgcaaaagaggcagucgaagaugaaagauucugggaucuggugcaccgcgaacgggaacuacauaaacaaggcaaaugugcgacgugcgucuacaacaugauggggaagcgagagaagaaacucggcgaguucggaaaagccaaagggaguagggcaaucugguauauguggcugggagcgagguuccuggaguucgaggcauugggauuuaugaacgaggaucauugguucagccgagagaacucgcucucaggagucgaaggagaggggcuacacaaacucggauacauccugcgagauauaucgaaaauaccagggggaaacauguacgcggacgacacagcaggaugggacaccagaauaacggaagaugaccuccaaaacgaagcuaagaucacugacauaauggaaccggagcacgcucugcuggcgaaauccauauucaaacucacguaccaaaacaaaguagugcgcguccaaaggccggcgaaaaacggcacaguaauggauguaauaucccgcagggaucaaagggggucgggacaggucggcacauauggacuaaacaccuucaccaacauggaggcgcagcuaauacgacaaauggaaagcgaaggcauauucucgccaagcgaacuagaaacucccaaucuggccgggcgaguucuugauugguuggaaaaacaugggguagaacgacucaaaaggauggccaucagcggcgacgacugcguaguuaagcccauagaugacagguucgcgacagcccugaccgcacuaaacgacaugggaaagguaaggaaggacaucccucagugggagcccuccaaaggcuggaacgacuggcaacaggugcccuucugcagucaccauuuucaccaacucaucaugaaagacgggagggaaauugucguccccugccgaaaccaggacgaacucguugguagagcacgcgucagucaaggugcgggguggucccuucgggaaacggcaugccuugguaaauccuaugcacagauguggcagcucauguacuuccacaggcgagacuugcgcuuggccgccaacgcaauaugcagcgcagucccaguggacuggguaccaacgucgcgaacaacguggagcauacacgcacaucaccaguggaugaccacggaagacaugcucaguguauggaaucgagucuggauagaagagaacccauggauggaagacaaaacccacguauccagcuggggagacgucccguaccucgggaaacgggaagaucagugguguggaagccugaucggccugacggcccgagcgaccugggcaaccaauauacaaguggcgauaaaccagguaaggagacugcuggggaacgagaacuaccuugauuacaugacaucaaugaaaagguucaagaacgagagugacccagaaggggccuuaugguaa

SEQ ID NO: 24384 - RNA, 9879 nt, Artificial Sequence
  derived and/or modified CDS sequence (opt11) from DENV-1__GQ199846__SS-prME
uccguaaccaugcuguugaugcuaaugccgacugcgcuugccuuccaucuaacgacccgaggcggggaaccucacaugaucgucacuaagcaggaacgggggaaaagccugcuguucaagaccagcgcgggggugaacaugugcacgcucaucgccauggaucuuggcgagcucugcgaggacaccaugaccuacaaguguccccgcauuacggaagccgagcccgacgauguggacuguuggugcaaugccaccgacaccugggucaccuaugggaccugcagccagacuggggagcaucggagggacaagcggagcguggcguuggcuccucaugugggccuagggcuggagacucgcaccgagacuuggaugagcuccgagggcgcguggaagcagauccagcgcgucgagaccugggcacuucgccaccccggcuucaccgugaucgcccuguuccuggcgcacgccauaggcacguccaucacccagaagggcaucaucuucauucuucugaugcugguaacgcccagcauggccaugcgaugcgucgggauaggcucccgcgacuuuguagaggggcucagcggcgccaccuggguggacgucguucuggagcacgggucguguguaacuaucauggcucgggacaagcccacccuggauaucgaguuacucaagacggaagucaccaacccggcagugcugcgcaaguugugcaucgaagcaaagaucagcaauacgacaaccgacucuaggugcccaacccagggggaggccacccuaauggaggagcaggacgccaacuucgugugucggcggaccuucgucgaucgcggcugggggaacggcugcggguuguuuggcaaggggucacucaucacgugcgccaaguucaagugcgugacgaagcuggagggcaagaucgugcaauaugagaaccuaaaauacuccgucaucgugacagugcacaccggcgaccagcaucagguaggaaacgagucuacggagcacggcacuaccgcgaccaucacaccccaggcgccgacguccgagauccagcucaccgacuacggggcucugacgcuugacugcagccccagaacgggccuggauuucaacgagauggugcugcugacgaugaaggaaaagagcuggcucguccacaagcagugguuccucgaccugccgcuccccuggaccagcggugcgucaaccucccaggagaccuggaaucgccaggacuuacuggugacguuuaagacugcccacgcgaagaaacaggaaguggucgugcucggcagccaggagggagccaugcacaccgcacugacgggggcgacagagauccagaccuccggcacgacuacgaucuucgccggccacuugaagugccggcucaagauggacaagcugacccugaaggggauguccuacgucauguguacagguuccuucaagcucgaaaaggaggucgcggagacgcagcacggcacggugcugguucagaucaaguacgagggcaccgacgccccaugcaaaauacccuucagcacacaggaugagaagggggucacccagaacggcagacugaucacggccaacccgaucguuaccgacaaagagaagccagugaacauugaggccgagccgccauucggugagucuuacaucgucaucggagcaggcgagaaagcccuuaaacuuagcugguuuaagaagggaucaucaaucgggaagauguucgaggcaacggcccgaggggcccgccgcauggccauacugggcgacaccgccugggauuucggguccgugggcgguguguucaccucagucgggaaacuugugcaccagaucuucggcaccgccuacgguguccuguucucgggcgucagcuggaccaugaagaucggaaucggagugcugcuaaccuggcugggccuaaacucccguuccacgucgcugagcaugaccuguauugccguaggucucgucaccuuguaccuuggugugauggugcaggcggauuccgggugcgugaucaacuggaagggacgggagcugaagugcgggagcggcauauucgugaccaacgagguacauacuuggaccgagcaauauaaguuccaggcggacagccccaagagacugagcgccgccauaggcaaggccugggaggagggggucugcggcaucaggagcgcgacccgcuuagaaaacauaauguggaagcagaucucuaacgagcucaaccauauccuauuagagaaugacaugaaguucaccgugguagucggggacgugguuggcauccuggcgcagggcaagaagaugaucaggccccagccuauggagcacaaguauaguuggaaaagcuggggcaaggcgaagaucaucggagcagacguccagaauaccaccuuuauaaucgacgggcccaacaccccggaaugccccgacgaucagcgggcauggaacauaugggagguugaggauuacggcuuugguaucuucaccaccaacaucuggcugaagcuacgcgacagcuacacccaagugugcgaccaccggcugauguccgcggcaaucaaggauagcaaggcgguccacgccgacaugggcuacuggaucgagucugagaagaacgagacguggaagcuggccagggccagcuucaucgaagugaagacaugcaucuggcccaaaucccacaccuugugguccaacggcguccucgagucugagaugaucauaccuaagaucuacggcggcccgaucucgcagcacaacuacaggcccggguacuucacacaaacagccgggcccuggcaccuggggaagcuggaguuggacuuugacuugugugaaggcacaacggucgugguggacgaacacugcggcaaccgcggaccgucucugcggacgaccaccgucaccgggaagaucauacacgaauggugcugucggagcugcacgcugccaccccuccgauucaaaggugaggauggcuguugguacggcauggaaauccgccccguuaaggaaaaggaggagaaccuggugaagucgauggucagcgccggaagcggugagguggacuccuucagccucgguuuacuguguaucuccaucaugauagaggaaguaaugcggagccgcuggaguaggaagaugcucaugacgggcacccuggccgucuuccugcuccucauaauggggcagcugacguggaacgaccucauccgccugugcauaauggugggcgccaacgcaagcgaccgcaugggaaugggcacuaccuaccuggcccucauggccaccuucaagaugcggccgauguucgcuguaggccugcuguuccgccgccucaccucaagggagguccuccuacucacuauaggguugagccugguggccuccguagaguugcccaacagccuggaggaguugggcgacgggcucgcgaugggcaucaugauccugaagcugcucaccgauuuccagucccaccagcugugggccacccugcucagccugaccuucaucaagacgacccugucacuccacuaugcguggaagaccauggccaugguguuguccauugcaucccuguuuccccuaugccuuagcaccaccucucagaagaccacauggcugccagugcucuuaggcucauuggguuguaagccacugaccauguuuuuaaucacggagaccaagaucuggggucggaagucauggccgcugaacgaagggauaauggcgguaggcguugugagcauacuccucagcuccuuacucaagaacgacgucccccuggccgggccgcugaucgcgggcgguaugcucaucgccuguuacgugaucagcggauccagcgcggaccuuucccuggaaaaggcggcggaggucaguugggaggaggaggcugagcacuccggagccagccacaacauccucgugguggugcaggacgacgggaccaugaagaucaaggaugaggaacgcgaugauacccugaccauccugcucaaggcgacccugcuggccgucucaggaguguacccucucagcauccccgccacccuguucgugugguacuucuggcagaagaagaagcaacgguccgggguccugugggacacucccaguccacccgaaguggagcgcgccgugcuggacgacggcaucuaccggauaaugcaacgcgggcucuuggggcggucacaggugggcguggggguuuuccaagaaaacguuuuccacaccauguggcacguuacgaggggagccgugcuaauguaccaggggaagcggcuugaacccagcugggcguccgugaagaaagaccugaucucguacggcggaggguggcgccugcaaggcuccuggaauaccggggaggagguccaggugauugcagucgagcccggcaagaaccccaagaacguacagaccgccccgggcaccuucaagacaccggagggggaggugggcgcuauugcccuugacuucaagccggggaccagcggcucccccauuguaaaucgggaggggaagaucgugggccuguacggcaaugggguggugaccaccagcggcacguaugugagcgccaucgcucaggccaaggcuucacaggagggcccgcugcccgaaauagaggaugagguguuccgcaagcggaauuugacaauaauggaccugcaccccggcucugggaagacccgccgguaccucccggccaucguccgugaagccaucaagagaaaacuccguacccugauccuggcacccacacgcgugguggccuccgagauggccgaggcacuaaagggcaugcccauccgguaccagacuacagcggucaaaagugaacacacaggcaaagagauuguugaucugaugugccacgccacguucacgaugcgcuuguuaucgcccgugagggucccgaauuacaacaugaucaucauggacgaggcgcacuucaccgacccuucauccaucgcugcgaggggauacaucagcacccgggugggcaugggggaggccgcggccauauucaugacggcgacgccgcccgggaguguugaggcguucccgcaaagcaacgcgguuauccaggacgaggagcgagacauucccgagcgguccuggaacagcggguacgaguggaucaccgauuuccccgguaaaacagugugguuugugcccuccaucaagagcggaaacgacaucgcaaacugccugcgcaaaaacgggaagcgggucauccaguugucacgcaagacauuugacaccgaauaccagaagaccaagaacaacgacugggacuacguggugacgacggauauuagcgaaaugggagccaacuuucgggcggaccgcguaauugaccccagaaggugucuaaagcccguuauccugaaggacggccccgagagggugaucuuggccggcccgaugccugugaccguagcauccgccgcccagcgccgggggagaaucgguaggaaccacaacaaggagggagaucaauacauauacauggggcagccccucaauaacgacgaggaucacgcucacuggaccgaggcaaaaaugcugcuggauaacaucaacacccccgagggaaucauaccagcccucuucgagccggaacgcgagaaauccgccgcuaucgacggagaguaucgccugcggggcgaggcgcgcaagacguuuguugagcugaugcggcgcggggaucuccccguguggcuguccuacaaggucgccucagagggcuuccaguacagcgaccggcgcuggugcuuugacggcgaacggaacaaccagguccuggaggagaacauggauguggagaucuggacuaaggaaggugagcgcaagaagcuccggccccgcuggcuggacgcucggaccuauuccgaccccuuggcccuccgcgaguucaaggaguucgccgcgggccgacgcagcgucucuggugaccuaaucuuggaaaucggcaaacucccucagcaccugacccagcgggcccagaacgcacuugacaaucuggucaugcugcacaauagcgagcaaggugggagagcauaccgccacgcgauggaagaauugccggacaccaucgagaccuuaaugcugcuugcccucaucgcugugcugacuggcgggguuacccuguucuuccucuccggaagggggcugggcaaaacgucaauaggucugcucugugucauggccuccagcguccuacuguggauggccucgguggagccccacuggauugcagccuccaucauccucgaguucuuccugaugguccuauugauccccgagccggacaggcagagaacgccccaggacaaccagcuggcauauguggucaucgggcuccucuucaugauacugaccgucgccgccaacgagaugggcuuacucgagaccaccaagaaggaccuggggaucggccauguggcgguagaaaaucaccaccacgcgacaaugcuggacguggaccuccaccccgccuccgccuggacgcuguacgcugucgcgaccaccaucauuacaccgaugaugcggcacaccaucgagaacaccaccgccaacaucagccuaacggccauagcgaaccaggccgcgauacugaugggguuagauaaggguuggcccauuuccaagauggacaucggggugccccuccucgcgcugggcugcuacucucaggucaauccacugacccucaccgccgcagugcugaugcugguggcacacuacgccauuaucgguccgggacuccaggcaaaagcaacccgcgaggcacagaagcgcacggcggccggcaucaugaagaauccgaccguagacgggauuguggccaucgaccuggaucccgugguauacgacgcuaaguucgagaagcagcugggccagauuaugcuccugauccugugcaccucccaaauacuccuaaugcggaccacgugggcccugugcgagagcaucacccucgcgaccgguccccugacgacgcugugggaaggauccccuggcaaguucuggaacacgaccauagccgugagcauggccaauaucuuccgcggguccuaucucgccggcgcaggccuggcguuuucacugaugaagucacucggaggagggcgucgcggaaccggggcccagggggagacccugggugagaaguggaagcggcagcugaaccagcucuccaagagugaguucaacauauauaagcgguccgggaucauggaagucgacagaagcgaggccaaggaggggcugaaacgcggggagaccacucggcacgcuguaucacgcggcacggcaaagcucagaugguucguggagcguaacuuggugaagccggaaggcaaggugauagaccucgguugcggccgaggcggguggagcuacuauugcgccggucucaagaaggugacggagguaaagggguacaccaagggcgggcccggccacgaggagccaaucccgauggccaccuacggguggaaucuuguaaagcuccacucaggcaaggacguguucuucacaccacccgagaagugugacacgcuccugugcgacaucggggagagcucccccaacccaaccaucgaggagggccgcacucuuagagugcugaagauggucgagcccuggcuccgugggaaccaauucugcaucaagaucuuaaacccguacaugcccagcgugguggagacccuugaacagaugcaacgaaaacacggaggcaugcuagucaggaacccgcucuccagaaauucgacccacgagauguauugggucuccugcgggaccggaaacauagugucagcggugaauaugacaucucgcaugcuguuaaaccgcuucaccauggcccaccggaagccuaccuacgagagggacguugauuuaggagcggguacgcggcauguggcagucgaaccagaggucgccaaucuggauauaaucggccagcgcauagagaauaucaagcaugaacacaaaagcacguggcacuacgacgaggacaaccccuacaaaacgugggccuaccacggguccuacgaggucaaaccgaguggcuccgcuagcagcauggugaacgggguaguaaaacuguuaaccaagcccugggacgugauuccgauggugacgcaaaucgcgaugacggauaccacccccuucggccagcagcgggucuuuaaggagaagguggauacgcgcaccccuaaggccaagcgggggaccgcccaaaucauggaggucaccgcgcgcuggcuuuggggcuuccugucccggaacaaaaagcccaggaucugcacgcgggaggaguucacccgcaaaguccguaguaacgccgcgauaggcgccgucuucguggacgagaaccaguggaacagcgccaaggaggcugucgaggacgaacgcuucugggaucucgugcagaaagagcgggaacugcacaaacaggggaagugugcgacgugcgucuauaauaugaugggaaagcgcgagaagaagcugggagaguuuggcaaggccaaggggagccgggccaucugguacauguggcucggcgcccgcuuccuugaguucgaggcccugggguucaugaacgaggaucacugguucagccgggagaacagccucuccggggucgagggcgaaggccugcacaagcugggcuacauacuccgcgacaucagcaagauacccggcggcaacauguacgcggacgacaccgcaggcugggacacgcguauaacggaggacgaccugcagaacgaggccaagauaaccgacauaauggagcccgaacacgcgcugcucgccacauccauauucaagcucacguaucagaauaagguaguccgcguccagcgaccugcuaagaacgggaccguuauggacgugaucagccggcgcgaccagcggggcuccgggcaggucggcaccuacggacugaauaccuuuacgaacauggaggcccagcucauccgccagauggaaagcgagggaaucuuccugcccuccgaacuggagacacccaaccucgcugagcgggugcuggacuggcuugagaaauacggcguggagcgccucaagcggauggcgauaagcggggacgacugcguaguuaagccgauagacgaucgcuucgccacugcgcugaccgcccuuaacgacauggggaaggugcggaaggauauuccccagugggagcccuccaagggcuggaacgacuggcagcaaguccccuuuugcucgcaccacuuccaccaacucaucaugaaggacggccgcgagaucguagugccaugcaggaaucaggaugagcucgucggccgugccagggugucccagggggccggguggucgcuacgugagacggccuguuuaggcaagagcuacgcccaaauguggcaguugauguacuuucaucggcgagacuuacggcucgcagccaacgccaucugcuccgccguuccagucgacuggguccccaccucgcggacgacguggagcauccaugcccaccaccaauggaugacuaccgaggacaugcugucaguguggaaccggguuuggaucgaggagaacccauggauggaagacaagacccacguguccagcuggggcgacgugcccuaccuagggaagcgcgaagaucaguggugcggcagucucaucgggcuuaccgccagagccaccugggccagcaauauccaggucgcgaucaaccaggugcggcgucugaucgggaacgagaacuaccucgauuacaugacguccaugaagcgguuuaaaaacgagggcgaccccgaaggcgcacuaugguga

SEQ ID NO: 24385 - RNA, 9879 nt, Artificial Sequence
  derived and/or modified CDS sequence (opt11) from DENV-1__GQ199847__SS-prME
agugugaccaugcugcucaugcugaugcccaccgcccuggccuuccaccucacgacccggggcggggagccccacaugaucgucagcaagcaggaacggggcaaaagccugcuguucaaaaccuccgcaggggugaacaugugcacccucaucgccauggaccugggugaguucugcgaggacaccaugaccuauaagugccccagaaucaccgaggccgagcccgacgaugucgacugcuggugcaacgcgaccgauacgugggugaccuacgggaccuguagccagaccggcgaacaccggcgggacaagcgguccguggcccuggcgccucacgugggccucgggcuggagacgcguaccgagaccuggaugagcuccgagggggccuggaagcagauccagcgggucgagaccugggcccugcgccacccaggauuuacggugauugcccucuucuuggcgcacgccaucgguaccagcaucacccaaaaggggauaaucuucauccuacucaugcuggugacucccuccauggccaugcgaugcguaggcaucgggagccgcgacuucguagagggguuauccggggcaacauggguggaugucguccucgaacacgggagcugugugaccaccauggccaaggacaagccaacccuggacauugagcuucucaagacggaggucaccaaucccgcggugcugcguaagcuguguaucgaggcuaagaucucaaacaccaccacggacucgaggugcccgacccagggcgaggccacacucguggaggagcaggacgccaacuucgugugucggcgcaccuucguggaccgggguugggggaacggaugcgggcuguuuggaaaagggucccugaucacgugugccaaauucaagugcgugaccaagcucgagggcaagaucguccaguacgagaaccugaaguacagcgugauuguaacuguccacaccggcgaccagcaccagguggggaaugaguccacggagcacggcaccaccgccaccaucacgccgcaagcgcccuccaccgagauacagcugaccgacuacggggcccuaacccuggacugcucgccccggaccggccuggacuuuaacgaaaugguguugcugacgaugaaggagaaaucauggcuggugcacaagcagugguuucucgaccugccgcugcccuggaccucaggggccuccaccucgcaagagacauggaaccggaaggaucuccuggugaccuucaagaccgcccacgcgaagaagcaggaggucguggugcugggaucccaagagggcgccaugcacaccgcccucacuggcgccaccgagauacagacgagcggcaccaccacaauauucgccgggcaccugaagugccgcuugaagauggauaagcucacacugaagggaauguccuacguaaugugcaccgggagcuucaagcuggagaaagagguggccgagacccaacacggcacggugcucguccagaucaaguacgagggcacagacgcccccugcaagauucccuucucaacccaagacgagaagggggugacccagaaugggcggcugaucacggcgaacccgaucgugacugacaaggaaaagcccgucaauauagaggccgagccgcccuucggggagucauacauugugauaggcgcgggcgaaaaggcguuaaaacuauccugguucaagaaggggucaucaaucggcaaaauguucgaggccaccgcccgcggggcccggcgcauggcgauccucggcgacaccgccugggacuucgggagcaucgggggcguuuucacguccguagggaaacuggugcaccagaucuucggcacugccuaugggguguuguucucuggcgucaguuggacgaugaagaucgguauuggcgugcuccuuaccuggcugggccucaacagccgcuccacaagccugagcaugacuugcauugcgguggggcuagucacccucuaccugggcgugaugguucaagccgacagcgggugcguaauaaacuggaagggcagggagcugaaaugcgggucuggcaucuucgugaccaacgaggugcacacuuggacagagcaguacaaguuccaggcggacucuccgaagcgccuuagcgccgcgaucggcaaggccugggaggagggggucugcggaauccgguccgccacccgccuggagaacaucauguggaagcagaucucgaaugaauuaaaccacaucuuacuggagaacgacaugaaguucaccguuguggucggggacguggcgggcauccuggcccaagggaagaaaaugauacggccccagcccauggaguacaaguacuccuggaagagcuggggcaaggccaagaucaucggcgcagacgugcagaauacaacguucaucaucgaugggcccaacacaccggagugccccgaugaccagcgcgcguggaacaucugggaagucgaggacuacggcuuugggaucuucaccaccaacaucuggcucaagcugagagacuccuacacccaggugugcgaccaccgucugaugucugccgccaucaaggauagcaaggcgguucacgccgauaugggguacuggauagagagcgagaagaacgaaaccuggaaacucgcgcgggccuccuucaucgagguuaagaccuguauuuggcccaaaagccacacccugugguccaacggcgugcuggagucagagaugaucauccccaagaucuacgggggcccgaucagucagcacaacuaccgccccggguacuucacgcagaccgcuggcccguggcacuuagggaagcucgagcuggacuuugaccucugcgagggcaccaccguggucguggacgagcauugcggcaaucgagggccgagccugaggacgaccacuguaacgggcaagaucauucacgaguggugcugccgguccugcacgcugccgccgcugcguuucaagggagaggacggcugcugguacgggauggagauccggcccgucaaggagaaggaagagaaccucguuaagagcauggugagcgcuggcucgggcgaggucgacagcuucucccuaggccucuugugcauuagcaucaugaucgaagaggugaugcgcucccgguggucgcgcaaaaugcucaugaccggaacucucgccguguucuuucugcugaucaugggacagcucaccuggaacgaccugauacggcuguguaucaugguaggcgcgaacgccuccgaccgcauggggauggggacgacguaccuggcccugauggccaccuucaaaaugcgcccgauguucgcuguggggcuacuguuucggcgccugaccagcagggaagugcugcuccugacaaucgggcugucccucguagcuagcguggagcugcccaacucauuagaggagcucggcgacgggcuagccaugggcaucaugauucugaaacuccugaccgauuuccagagccaccagcugugggcuacccucuuaucacugacauucaucaagacgaccuucucacuccacuacgcguggaagacaauggcgaugguccuguccaucgugagccuguucccccucugccuguccaccacgucccagaagaccaccuggcugcccguacuccucgguucccugggauguaagccccucaccauguuccugaucgccgagaacaagaucuggggccgcaaaagcuggccccugaacgaagguaucauggccgucggcaucguaaguauccucuuaagcgcccuguuaaaaaacgacgugccccuggccgggccccugauugcgggcgggaugcucaucgccugcuacgucaucagcgguuccagcgcagaccuuucucuagaaaaggccgcagaggugucgugggaggaggaggccgagcacuccggcgcgagccacaauauccucguggagguccaggacgacgguacgaugaagaucaaggacgaagaacgugacgacacccugaccauccugcucaaggccacucugcuggccguguccggcguguauccgcucucgauccccgccacccuguucgugugguacuucuggcaaaaaaagaaacagcgcuccggggugcugugggacacgcccuccccgcccgagguagagcgagcgguccucgacgacggcauuuaccgcauuaugcagcggggccugcuggggcgcucccaggugggcgugggggucuuccaggagaacguguuccacacaauguggcacguuacgcggggcgccguccuuauguaccaggggaagcggcuagaacccucaugggccuccgugaagaaggauuuaaucuccuacggcggcggguggcgucugcagggcuccuggaacaccggggaggaggugcaggucaucgccguggagcccggcaagaaccccaagaacguucagacggccccugggacguucaagaccagcgagggcgaggucggcgcgaucgcccuggacuucaagcccgguaccuccggcagccccaucgugaaccgcgaggggaaaauagucggccuguacggcaauggggucgugacgaccagcggcaccuacguguccgcgaucgcccaggcaaaagcgagccaggagggaccccugccggaaaucgaggacgaggucuuccggaagcgcaaccucaccaucauggaccugcaccccgguuccgggaagacgcggcgcuaccugccagcaaucguacgggaagccaucaaacgcaaacugcggacccugauccuggcaccgacccgcgugguagcgagcgagauggccgaggcgcucaagggcaugcccauccgguaccagaccacggcugugaaauccgagcacacuggcaaggaaaucguggaccugaugugccacgccaccuuuacuaugcggcugcucagccccguccgugugcccaacuacaacaugaucaucauggacgaagcccacuucacggacccguccagcaucgccgcccggggguacaucagcacgcgcgugggcaugggggaggccgccgcgaucuucaugacagcuacgccccccggcagcgucgaggcuuucccccaguccaacgccgugauccaggacgaggaacgggauaucccggagcgaagcuggaauucgggguaugaguggaucacggacuuccccggcaagaccgugugguucguccccucuauuaaguccggcaacgacaucgcgaacugccugcggaagaacgggaagcgagugauucaguugagucggaagaccuucgauaccgaguaccagaagacaaagaacaacgacugggacuacgugguuacgaccgacaucuccgagaugggcgccaauuucagggccgaucgggugaucgacccccgccggugccucaagccggugauccugaaggacgggccagagcgcgucauacuggcgggucccaugcccgugacugucgccagcgccgcgcagcggcgcggucggaucggccgcaaccacaacaaggaaggcgaccaguacauuuacauggggcagccucucaacaaugaugaggaccacgcccacuggacggaggcgaagaugcugcuggacaauaucaacacccccgagggcauuaucccugcccucuucgagccugagcgggagaagagugcggccaucgacggggaguaccgccugcgcggcgaggcccggaagaccuucguggagcugaugcgccgcggggaccucccgguguggcugagcuacaaggucgccagcgagggcuuccaguacuccgaccgccggugguguuucgacggcgagcgcaacaaccaagugcuggaggagaacauggacguggagaucuggaccaaggagggagaacggaagaaacuccgcccccgguggcuggaugcccggacguacagcgaccccuuggcgcuccgggaguucaaggaguucgcggccgggcgccgguccgucagcggggaucugauacuggaaaucgguaagcucccccagcaccugacucagcgcgcccagaacgcacuggacaaccucgugaugcugcacaacuccgaacagggcgggcgagccuaccgccacgccauggaggagcuaccggacaccaucgagacgcucaugcugcuggcacugaucgccgugcuaacgggcggggucacacuguuuuuucuuaguggccgggggcuggggaagaccuccaucgggcuacucugcgugauggcgagcuccguguuacuguggauggccaguguggagccccacuggaucgccgccuccaucauccucgaguucuuucugaugguccuccucauacccgaacccgaccgccagcggaccccgcaggacaaucagcuggccuaugugguaauagggcuccucuucaugauccugaccguggcggcaaacgagaugggccugcucgagacgaccaagaaggaccuugguaucggccauguugccgucgagaaccaccaccacgccgccaugcuggacguggaucuccaccccgcgagcgccuggacccuuuacgccguggccacaaccaucaucacccccaugaugcgccacaccaucgaaaacaccacggccaacaucucccugaccgcaauagccaaucaggccgccauacugaugggucuagauaagggcuggccgauaagcaaaauggacaucggcgucccccugcuugcguugggaugcuauucccaggugaacccacugacuuuaaccgcagccguuuuaaugcugguugcccacuacgccaucaucggccccgggcuccaggcgaaagccacgcgggaggcccagaagcgaaccgccgccgguaucaugaagaacccgaccguggacggaauagucgcgaucgaccuggaccccgugguguacgacgccaaguucgagaagcagcugggccagaucauguuacugauccugugcaccagccagauccuccugaugcgcacgaccugggcccugugugaguccaucacgcucgccaccggcccgcugacgaccuuaugggaaggcagccccggcaaguucuggaauaccaccaucgccguguccauggcuaacaucuuccgggggucuuaccucgccggcgccgggcuggccuucagccugaugaagucccuaggcggcgggcgucggggcacgggcgcccagggcgagaccuugggggagaaguggaagcgccagcugaaccagcucucgaaguccgaauucaacaccuacaagcggagcgggaucauggaagucgaccgcuccgaggccaaggagggucugaaacgcggggagacuacgaagcacgccgugagccgcgggacagccaagcugcggugguucguugagcgcaaccucgucaaaccugaggggaaagugaucgaccuugggugcggucgcggcggguggucauacuacugcgccggguugaagaaggugacggaggucaaaggguacaccaagggagggccaggccaugaagaacccauccccauggcgacauaugguuggaaccuggugaaacuccauucaggcaaggacguguucuucaucccucccgagaagugcgacacccuauuaugcgacaucggggagaguucccccaacccuaccaucgaggagggccgcacccuccggguccugaagauggucgagccguggcugcgugggaaccaguucugcaucaagauauuaaaccccuacaugcccuccguggucgagacgcuggaacagaugcagcgaaagcacgggggcaugcugguacgcaacccccucagccguaacaguacccaugagauguacugggucagcugcgggaccggcaacaucgucuccgccgugaacaugaccucacgaaugcugcugaaccgcuuuaccauggcacaccgaaagcccacguaugagcgcgauguagaccucggggccggcacucggcacgucgccguggagcccgagguggcgaaccuggauaucaucggccagcgcaucgagaacaucaagcacgagcacaaguccaccuggcacuacgacgaagauaaucccuacaagacaugggcauaccacggaucguacgaaguuaagccuuccggcagcgccagcuccauggugaacggcgucgugaagcugcucacgaagccgugggacgugauucccauggucacccagauugccaugaccgacaccacgcccuuugggcagcagcggguguucaaggagaagguggacacccgcacucccaaggccaagcgggggaccgcgcagaucauggaagucacggcuaaguggcuguggggcuuccugagccgcaauaagaagccgcggaucuguacccgcgaggaguucacccggaaagugcgcuccaacgccgccaucggggccguguuugucgacgaaaaccaguggaacagcgcgaaagaggccguugaggacgagagguucugggaccucgugcaccgcgagcgggagcugcacaagcaggggaagugcgcgacgugugucuacaacaugauggggaagagagagaagaagcuaggggaguucggcaaggccaaggggucccgugcgauuugguauauguggcugggcgcccguuucuuagaguucgaggcccugggcuucaugaacgaggaccauugguucagccgggagaacucccucagcgggguggagggcgaggggcugcacaagcugggcuacauccuccgcgacauaucaaagauccccggggguaacauguaugccgacgacacggccggcugggacacccggauaacagaggacgaccugcagaacgaagcaaagaucaccgauaucauggagcccgagcacgcucugcuagccaaaagcaucuucaagcugacauaccaaaacaaggugguacgcguucagcggcccgccaaaaacgggacuguuauggacgucaucucccggagagaucagcgaggcucgggccaggugggcaccuacggccugaacaccuuuacgaauauggaggcccagcucauucgccagauggaguccgaggguaucuucagccccuccgaguuagagacccccaaccucgcaggccgggugcucgacuggcuggagaaacauggggucgaacgccugaagagaauggccaucucaggagacgauugcguuguaaaacccaucgacgacagguucgccaccgcccucaccgcccugaacgauaugggaaagguccggaaagacaucccacagugggagcccuccaagggcuggaacgacuggcagcagguccccuuuuguagccaccacuuccaucagcugaucaugaaggacggccgcgagaucguuguccccugucggaaucaggacgagcucguggggagggcgcgggugagccagggcgcgggguggucucugcgcgagacggccugucuggggaagagcuacgcucagauguggcagcucauguacuuucaccggcgcgaccugcggcuggcggccaaugccaucugcuccgcggacccggaugacuggguacccacaagccgcaccaccuggucuauccacgcccaccaccaguggaugacaacggaggacaugcucagcguguggaaccggguguggauugaggaaaaccccuggauggaagacaagacccacaucuccagcuggggcgauguucccuaccugggcaagcgcgaagaccaguggugcggcucucugaucgggcucaccgcgcgugccacgugggccaccaacauccagguagccaucaaccaagugcgccgccugaucggcaacgagaacuaccuggacuauaugaccucgaugaagcgguucaaaaacgaguccgacccggagggggcccucugguga

SEQ ID NO: 24386 - RNA, 9879 nt, Artificial Sequence
  derived and/or modified CDS sequence (opt11) from DENV-1__GQ199849__SS-prME
agcgucaccaugcugcuuaugcugaugcccaccgcccuggccuuccaccucaccacccgggguggggagccccacaugaucgugaccaagcaggagcggggcaaaagucugcuguucaaaaccagcgcuggggucaacaugugcacccucaucgcgauggaucugggugaguugugcgaagacaccaugacauacaaaugcccgcgaaucaccgaggccgagccggacgacguugacugcuggugcaacgccacggacaccugggugaccuacgguacgugcucaagaacgggcgagcaccgccgcgacaagaggagcguggcgcucgcgccucacgugggcuugggacuggagacccggacagagacuuggauguccagcgagggcgccuggaagcagauucagcgcguggagacgugggcccuccggcaccccggguucaccguaaucgcacuguuccuggcucacgccaucggcaccuccaucacacagaaggggaucaucuuuauccuccuaaugcuggugacgcccagcauggccaugcgcugugucggaauugggucccgggacuuugucgagggguugagcggcgcgacguggguggacgucgugcuggagcacgggucuugcgugaccaccauggcuaaggacaagccgacccuggacaucgagcuccugaagaccgagguaaccaaccccgcggugcugcgaaagcucugcauagaggcgaagaucagcaacaccacuaccgauucgcgcugccccacccagggcgaggcaacccuuauggaggagcaggacgccaacuucguaugccgcaggacguucgucgaccguggcuggggaaacggcugcgggcuguuuggcaaggggagccucaucacgugcgccaaguucaagugcgugaccaaacuggaaggcaaaauuguccaguacgagaaucugaaguacagugucaucgugaccguacacaccggcgaccaacaccagguugggaacgagagcaccgagcacggcacgaccgcuacaauuacaccccaggcuccuaccuccgagauacagcucaccgacuacggggcgcugacucuggacugcagcccccguacgggccucgauuucaacgagauggugcugcugaccaugaaggagaaguccuggcuaguccacaagcagugguuucucgaccugccacuccccuggaccagcggggccagcaccucccaagagacguggaaccgccaggaccugcuggucacguucaagaccgcccacgccaagaaacaggaggugguagugcucggcagccaggagggcgccaugcacaccgcacugacaggggcgaccgagauacagaccucaggcaccacgacaaucuucgccggccaccugaagugccggcucaagauggauaagcuggcucugaagggcaugagcuacgugaugugcaccggguccuucaaguuagagaaggaggucgccgagacccagcauggcacggugcuggugcaaaucaaauacgagggcaccgacgcccccugcaagauccccuucucaacccaagacgagaagggagucacucagaacggccggcuaaucaccgccaauccgauagugacagacaaggagaagcccgugaacaucgaagcggagccgcccuuuggcgaauccuauaucgucaucggcgccggcgaaaaggcccugaaacucagcugguuuaagaaggggagcagcauuggcaaaauguuugaggccaccgcccgcggagcccgucgcauggccauccugggcgacaccgccugggacuuuggguccauugguggcguguuuacgaguguggggaagcugguccaucagaucuucggaacagcuuacgggguccuuuucuccgguguguccuggaccaugaagaucgggauuggcguccugcuaaccuggcuuggccugaauucccggucuaccucucuaagcaugaccuguauugccguggggcucgugacucuguaccuaggcgucaugguccaggcugacuccggaugcgugaucaacuggaagggccgcgagcucaagugcgggagcgggaucuucguaacuaacgagguucacaccuggaccgagcaguacaaguuccaggccgacucaccgaaacggcuguccgccgccaucggcaaagccugggaggagggggugugcggcauucgcagcgcgacccggcuugaaaacauuauguggaagcaaaucuccaacgagcuuaaccauauccugcuggagaauggucucaaguucaccgucguggugggcgaugucguggggauccuggcacagggaaagaaaaugaucaggccccagcccauggagcauaaauacagcuggaaguccuggggcaaggcaaagaucaucggggccgacgugcagaacaccacguuuaucaucgacggccccaacaccccggagugccccgacgaccaacgggcguggaacaucugggagguugaggacuacggcuucggcaucuucaccaccaacaucuggcugaagcuccgcgacucguauacccaggugugcgaucaccggcugaugucagcugccauaaaagacagcaaagccgugcacgccgacauggguuacuggaucgaguccgagcguaaugaaaccuggaaacuggcgcgugccagcuucaucgagguuaagacaugcaucuggcccaaaucccacacccucuggagcaaugggguccuggagucggagaugaucauccccaagaucuacggcggcccgaucagccagcacaauuaccgcccaggauacuucacgcagaccgcagggcccuggcaccugggcaagcucgagcuggacuucgaccugugcgagggcaccaccguugucguggacgagcacugcgggaauagggggccgagucucaggacgacaaccgugacugggaaaaucauccacgaauggugcugcagaucaugcacgcugccgccccugcgcuucaagggcgaggacgggugcugguacggcauggagauacggcccgucaaggagaaggaggaaaacuuagugaaauccauggugagcgcuggcagcggcgaggucgacuccuucagucugggccugcugugcaccucaaucaugaucgaggaggugaugcgcagccgguggucccgcaagaugcugaugacugggacgcuggcgguauuucuccugcugaucaugggccagcuaaccuggaaugaccugaucaggcucugcaucauggucggggcgaaugccagcgaccggauggggaugggcaccaccuaucucgcccugauggccaccuuuaaaaugcggccgauguucgccgugggccuucuguuuaggcgccugaccucccgggagguguuacuccugaccaucgggcugagcuuggucgcguccguggagcuuccaaacagccuggaagagcucggggacggccuggcgaugggcauaaugauccuuaagcuccugaccgacuuccaaucgcaucaguugugggccacccuccugucucugacguucaucaagacaacccucucccuucacuacgccuggaagaccauggcgaugguccugagcaucgugucacucuucccccugugccugucuacgaccucccagaagaccaccuggcucccgguguuacuggguagccucggcuguaagccgcugacgauguucuugauugcugaaaauaaaauuugggggcgcaaguccuggccccugaacgagggcaucauggcugucgggguggugaguauccugcuaagcagucuccugaagaaugauguucccuuagccggcccccucaucgccggcgggauguugauugcaugcuacgugauuagcggcuccagcgccgaccugagucuggaaaaggccgccgaagugagcugggaggaagaggccgagcacaguggggcgagucacaacaucuucgucgaaguacaggacgacgggaccaugaagaucaaggacgaggagcgggaugacacccugaccauacugcucaaggccacccugcuggccguguccggagucuacccgcucagcauccccgccacgcuguucgucugguacuucuggcagaagaagaagcagcgcuccgggguguuaugggacacgcccagcccgcccgaggucgagagggccgcgcuggacgacggcaucuaccgcauuaugcagcgggggcuccugggccgcucccaggugggggugggcgucuuccaggagaacguguuccacaccauguggcacgugacccgcggggccguccugauguaccagggcaagcgccucgagcccaguugggccaguguaaagaaggaccugaucagcuacggcgggggauggagacugcaaggguccuggaacacgggcgaggagguucaggucaucgccguggagcccgggaagaacccuaagaauguccagaccgcccccggcacauucaagaccccagaaggcgaggucggggcgaucgcccucgauuucaagcccggcacgagcgggucccccaucgugaaccgagaaggcaaaaucgugggccuuuacggcaacggggucgugaccaccagcgggaccuacguaagcgccaucgcccaaacgaaggcgucccaggagggcccgcugccggaaaucgaggacgaggucuuccggaagaggaaccucaccauuauggaccuucaccccgggagcggcaagacacggcgcuaucugcccgccaucgugagggaggccaucaagcgcaagcuccgcacccugauccuggcccccacgcgcguagucgccuccgagauggcggaggcgcucaagggcaugcccauccgcuaccagacgaccgccgucaagagcgagcauaccgggaaggagaucguggaccugaugugccacgccacuuucacaaugcggcuguuaucccccguccgcgugccgaacuacaacaugaucaucauggacgaagcccacuuuacggauccaagcuccaucgccgcccgggguuauaucaguacucgaguugggaugggcgaggccgcggccaucuucaugacggcgacgccgcccggguccgucgaggcguucccgcagagcaaugccguaauccaggacgaggaacgggacauccccgaacgcuccuggaauagcggcuacgaguggaucaccgacuuucccggaaagaccgugugguucgugccuuccaucaagagcgggaacgacaucgccaacugccuccggaagaacggcaagcgcgugauccagcuaucccggaagaccuucgauaccgaguaccagaagaccaaaaacaaugacugggacuacguggucaccacggacaucagcgagaugggggcgaacuuccgcgcggaccgggugauagacccgcgccgguguuuaaagcccgugauccuaaaagacggccccgaacgcguuaucuuagccgggcccaugccagugacgguagcaagcgcugcacagcguaggggccggaucggucgcaaccacaacaaggagggggaccaguacaucuacaugggccagcccuuaaacaacgacgaagaucacgcccauuggaccgaggccaagaugcugcuggacaacaucaacacucccgaggguauuauccccgcccucuuugagccggaacgcgagaaguccgccgcgaucgacggcgaguauaggcugcgcggggaggcccggaagacguucguugagcugaugcgccguggcgaccuccccgugugguuaagcuacaagguggccagcgagggcuuccaguacagcgaccgccggugguguuucgacggggagcggaacaaccaagugcuggaggagaacauggacguagagauauggaccaaggagggcgagcguaagaagcugcgcccccgguggcuggacgcccgcaccuacuccgacccccuggcccucagagaauucaaggaguucgcagccgggcgacggucagucuccggcgaccugauccuggaaauaggcaagcuuccgcagcaccugacgcagcgcgcccaaaacgcccuagacaaccucguaaugcugcacaacagcgagcagggcgggcgggcguaccgccacgccauggaggagcugccugacacuaucgaaacccucaugcugcuggccuuaaucgccguucugaccgggggagucacgcuguucuuucucucugggcggggccugggcaagaccagcaucgggcugcucugcguuauggcgagcagcgugcugcuguggauggcguccgucgagccccacuggauugccgcgagcaucauccucgaguucuuccugauggugcugcucauccccgagccggaccgccagcggacgccccaggacaaccagcuggccuacgucgucauaggauuacucuucaucauccugacuguggccgcgaaugaaauggggcuguuggagacuaccaagaaagaccugggcauuggucacguggccguugagaaccaccaccacgcaacuaugcuggauguggaccuccaccccgccuccgccuggacccuauacgcgguggccacaaccaucauuacgccgaugaugcgccacaccaucgagaacaccaccgccaacaucucccugacugccaucgcgaaccaggcggccauacugaugggccuggacaagggcuggcccaucuccaagauggacaucggggucccccuguuggccuuagggugcuacagucaggugaauccccugacccuuaccgcugccguccugaugcuagucgcccauuacgccaucauugggccgggccuccaggcgaaggccacucgcgaggcgcagaagagaacggccgcugggaucaugaagaaccccaccguggauggcaucguggccauugaccuggaccccguaguguacgacgcuaaguucgagaagcagcugggccagaucauguugcugauccugugcaccucccagauucuccugaugcgcacgacgugggcgcugugcgagagcaucacccucgcuaccgggccccugaccacgcugugggagggcuccccggggaaguuuuggaauaccaccaucgccgugagcauggccaacaucuuccggggcuccuaccucgcuggcgcggggcuggcguucagcuuaaugaagucccucggcgguggacgccgggggacaggggcgcagggggaaacucuuggggagaaguggaagcgucagcugaaccagcucuccaaaagcgaguucaacaucuauaagcggaguggaaucauggaggucgaccgcagcgaagccaaggaggggcugaagcggggcgagaccacccgccacgcggugagucgggguacagccaagcugcgcugguucguggagcgaaaccuggucaagccugagggcaaggugauagaccuaggcugcgggcgcggcggguggagcuacuacugcgccgggcucaagaaggugacagaggucaagggcuacaccaaaggcggccccgggcaugaggagcccauccccauggcgaccuacggguggaaccuugucaaacuccacuccgggaaagauguguucuucacgccgccagagaagugugacacguuacuuugcgacaucggcgagagcucucccaacccgaccaucgaggagggccgaacuuugcguguccugaagaugguggagcccuggcugcgagggaaccaauucugcauaaagauccucaaccccuacaugcccagcguggucgagacccucgagcagaugcagagaaaacacggcgggaugcuggugcggaacccgcucuccagaaacagcacccacgagauguacuggguguccugcgguacggggaacaucgucagcgccgugaauaugaccuccagaaugcuucugaaccgauucaccauggcacaccgcaaaccaaccuaugagcgggacguggaucucggcgccggcacgcgccacgucgcgguggagcccgaggucgccaacuuggacauuaucgggcagcggaucgagaacaucaaacaugagcacaagagcaccuggcacuacgacgaagacaaccccuacaagaccugggccuaccacggcuccuacgaaguaaagccgagcggguccgcgagcagcaugguuaacggcgucgugaagcuucucaccaagccgugggaugugauccccauggucacgcagaucgcaaugaccgacaccaccccauucggccagcaacgcguguucaaggaaaagguggacacgcggaccccgaaggccaagcgaggcacggcgcagaucauggaggugaccgcccgcuggcuuugggguuuucuguccagaaacaagaagccccggaucugcacucgugaagaguucaccaggaaggugcgcagcaacgcagccaucggggccguguucgucgacgagaaccaauggaacuccgccaaggaggcgguugaggacgagcgguucugggaccuugugcagaaggagagagagcugcacaagcagggcaagugugcgacgugugucuacaauaugaugggaaagcgggagaagaagcuaggcgaguucgggaaggcaaagggcagccgcgccaucugguacauguggcucggcgcgcgguuccuagaguucgaggcgcucggauucaugaacgaggaccauugguucucccgcgagaauagccucuccggcguugagggcgagggccugcacaagcugggguauauccuccgggacaucagcaagauccccggcgguaacauguacgccgacgacacagcgggaugggauacccgcaucaccgaggacgaccuccagaacgaggccaagauuacagauaucauggagcccgagcacgcccugcucgcgaccuccaucuucaaauugacguaucagaacaaagugguccgggugcagcggccggcgaagaacggcacugucauggacgucaucagccgccgugaccagcgcgggagcggccaggugggcacguacgggcugaauaccuucacgaacauggaggcacagcuaauccggcagauggagagcgagggcaucuuccugcccagcgaguuagagacccccaaccucgccgagcgcguguuggacuggcuggagaaguacgggguugagagacucaagagaauggccaucucaggggaugacugcguggugaagccaaucgacgaccgguucgcgaccgcccuaaccgcccuuaacgauauggggaagguccgcaaggauaucccccagugggagcccuccaagggguggaacgacuggcagcagguccccuucugcucacaccacuuccaccagcucauuaugaaggacggacgggagaucguugucccgugccgaaaccaggacgagcugguggggcgggcgcgcguaucccagggcgccggcuggagccuacgggagacggcuugccucggaaagucuuacgcccagauguggcaauuaauguacuuccaucgccgggauuuacgcuuggccgccaacgcaaucuguuccgccgucccuguggacugggugcccaccucgagaacaaccuggagcauucaugcccaccaccaauggaugacgaccgaggauaugcugagcgucuggaaccguguguggaucgaagagaaccccuggauggaggacaagacccacguguccucguggggagacguaccguaccugggcaagcgcgaagaccaguggugcggcagccucaucgggcugaccgcccgagcgacgugggccagcaacauccaaguggccauaaaccaggugcgccggcugauugguaacgagaauuaccucgacuauaugacguccaugaagcgcuucaagaacgagggggaccccgagggagcccugugguag

SEQ ID NO: 24387 - RNA, 9879 nt, Artificial Sequence
  derived and/or modified CDS sequence (opt11) from DENV-1__FJ898410__SS-prME
agcgugaccaugcugcugaugcugaccccaaccgcacuggccuuucaccucaccacccguggcggggaaccccacaugauuguguccaagcaggagcggggcaagagccugcuguucaagaccuccgcgggcgugaacaugugcacgcugaucgccauggaccugggcgaguucugcgaggacaccaugaccuacaaauguccccgcaucaccgaagcggagcccgacgauguggauugcugguguaacgccacggacacaugggucaccuacgggacaugcagccagacgggcgagcaucggcgugacaaacguuccguagcccuggcgccccacgucggccuugggcuggagacccgcaccgaaaccuggaugagcuccgaaggggccuggaagcagauccagcgggucgaaacaugggcccuucgacacccugguuucacgguaaucgcccucuucuuggcgcacgccaucggaacgagcaucacccagaagggaaucaucuucauccugcucaugcuugugacgcccaguauggccaugcggugcgucggcauaggcagccgcgacuucguggaggggcugagcggcgccaccuggguagacgucguguuagagcacgggagcugcguuaccaccauggccaaggacaaaccuacgcuggacauugaguugcucaagacugaggucaccaaccccgcggugcugcggaaacuuuguaucgaggccaagauaaguaacacaacgaccgauucucgcugcccgacccagggcgaggccacccucgucgaggagcaggacgcgaauuucguuugcaggcgcacguuuguggaccgaggcugggggaacgguugugggcuguucggcaaaggcucccugauuacgugcgccaaguucaagugcgugaccaagcuagaggggaagaucguccaguaugagaaccugaaguacagcguuaucgugaccguacauacgggcgaccaacaccagguggggaacgaguccaccgagcacgguaccaccgcgaccaucacuccccaagccccgagcaccgagauccagcugaccgacuacggggcgcucacccuggacuguagcccgcggacgggauuagacuucaaugagaugguucuccugacgaugaaggaaaaguccuggcucgugcauaaacagugguuccucgaucugccccugcccuggacuagcggggccuccacuagucaagagacuuggaaccggcaggaccuccuggucaccuucaagaccgcccacgcgaaaaagcaagaggucguggugcugggcucccaggagggcgccaugcacaccgcccucaccggggccacggagauccaaaccagcggcacaacgacuaucuucgccgggcaccugaagugccgccucaaaauggacaagcucacccucaagggcaugucguaugucaugugcaccgggagcuuuaagcuugagaaggagguggcugagacgcagcacgggaccgugcucguccagaucaaauaugaggguaccgaugcgcccugcaaaauucccuucaguacgcaggaugagaaggggguaacgcagaacggccggcugaucaccgccaacccgaucgugaccgauaaggagaagccggucaacaucgaggcggagccgccuuucggggaaagcuacaucgugaucggcgcgggcgagaaggcacugaaacugucuugguucaagaaggggagcuccaucggcaagauguucgaagccaccgcccgcggggcucggcgcauggcgaucuugggcgacacggccugggacuuugggucgaucggcggcgucuuuaccuccgucgggaagcuggugcaccaaauuuucggcaccgccuacggugugcuguucagcggcgucuccuggacuaugaagaucggcauaggcguucuccugacguggcugggucucaacagccgcuccaccagccuuucgaugaccuguaucgcaguggggcuggucacgcucuaccugggcgugaugguacaggccgacagcgggugcgucauuaacuggaaaggcagagagcugaagugcgggucaggcaucuucgucacgaacgaggugcacacauggaccgagcaguacaaauuccaggcugacuccccaaaacgcuugagcgcugccaucggcaaggccugggaggaaggggucugcgguauccgguccgccacccgccuggagaauaucauguggaagcaaaucagcaacgaguuaaaccacauacuccuggagaacgauaugaagcugaccgugguggucggggacguggcgggcauccucgcgcaggguaagaaaaugauacggccccagcccauggaauacaaauacaguuggaagaucugggguaaggccaagaucaucggcgccgacgugcagaacacgacuuucaucauagacgggcccaacaccccagagugccccgacgaccagcgcgcguggaacaucugggaggucgaagacuacggcuuugggauauucaccacgaacauuuggcugaagcugcgggauucuuacacccaggugugcgaccaccgccucauguccgccgccaucaaggacagcaaggccguccaugccgauaugggcuacuggaucgaguccgagaaaaacgagaccuggaagcuggcgcgggccagcuucaucgaggucaagaccugcaucuggcccaaaagucacacgcuguggucaaacggugugcucgaauccgagaugauaauccccaagaucuacgggggcccgaucucucagcauaacuaccgcccaggguacuucacccagaccgcgggccccuggcaccuggggaagcuggaacucgacuucgaccugugcgagggcacgacgguggucguggacgagcacugcggcaaccgggggccgucccugcgcaccaccaccgugacgggaaaaaucauccacgaguggugcugccggagcugcaccuuaccgccgcuccguuucaagggggaggacggcugcugguacgggauggagauccggcccgucaaggagaaggaagagaaccugguuaaguccauggucagcgccggcagcggcgagguugacuccuucagcuugggucuccugugcauaucuaucaugauugaggaggugaugcggagccgcuggucccgaaaaaugcucaugaccggcacccuagcuguguucuuucugcucaucauggggcagcugacguggaacgaccugauccggcucuguaucauggucggcgcgaacgccucggaccguauggggaugggcaccacguaucuggcccugauggccaccuuuaagaugcgcccgauguucgcaguuggccugcuguuccggcgccugacuuccagggaagugcuccugcugacuauagggcucagccugguggcguccguggagcuucccaacagccucgaggagcuaggcgacgggcucgccaugggcaucaugauccuuaagcugcuaaccgacuuccagucccaccagcucugggccacgcuucugagucucacguucaucagaaccaccuucucccugcacuaugccuggaagaccauggcgaugguccuuagcaucgugucccucuuuccccugugccugucaacgaccucccagaagaccaccuggcugcccgugcugcuugguagucucgggugcaagccccugacgauguuccugaucgccgagaacaagaucuggggccguaaauccuggccccucaacgaggggaucauggccgucggaaucgugagcauccugcugagcucccuccugaagaacgacgugccgcuggccgggccccucaucgccggcgguaugcugaucgcgugcuacgucauaagcgggucuagcgcggaccugucccucgagaaggcagccgaggugaguugggaggaggaggccgagcacuccggcgccagccacaacauccugguagagguccaggacgacgggaccaugaagaucaaggacgaggagcgugacgacacccugaccauccuccugaaggccacucugcucgccgugucaggcguguacccgcugagcauaccagccacucuguucgugugguacuucuggcagaaaaaaaagcagcgguccgggguccucugggacacccccagcccgccugagguggagcgcgcggucuuggacgauggcaucuaccggaucaugcagcgcggacugcuggggcggucccaggugggcguaggggucuuccaagagaacguguuccacacgauguggcacgugacccgcggcgcgguccucauguaccaggggaaacgguuagagccgagcugggccuccgugaaaaaggaccuaaucagcuacggcggcgguuggcgccuccagggguccuggaauacgggggaggaggugcaagucaucgccguggaacccggcaagaaccccaagaacgugcagaccgcccccgggaccuucaagacgucggagggcgaggucggcgccaucgcgcuggacuucaagccggggacguccggcucacccaucgugaacagggaggggaagaucgugggccuguacggcaacggggucgugaccaccagcggcaccuacgugucagccaucgcccaggccaaggcgucccaagagggucccuuaccggagaucgaggacgaagucuuucgcaagcggaaccugacgauuauggaucugcacccgggaucggggaaaacccgcagguaccuccccgccauagugcgcgaggccaucaagcgucgccugagaaccuugauucucgccccgaccaggguggucgccagcgaaauggcagaggcccugaaggguaugcccauucgcuaucagacgaccgcggugaagucugagcacacgggaaaggaaaucguggauuugaugugccaugccaccuucacgaugcggcucuuaucccccguccgggugccuaacuacaacaugauuaucauggacgaggcacacuuuacugauccguccucaauugcggcacggggauacaucucuacccgcgugggcaugggggaggccgccgccauauucaugaccgcgacgccccccggcagcguugaagccuucccccaguccaacgccgugauccaggaugaggagcgggacaucccggagcgcucauggaacucgggguacgaguggaucaccgacuucccugggaagaccgugugguucguccccagcaucaaguccgggaacgacaucgcaaauugccugcggaagaaugguaagcgcgugauccagcucucucggaagaccuucgacacggaguaucagaagaccaagaacaacgacugggacuacguggucaccaccgacaucuccgagaugggugcgaacuucagggccgacagagugaucgacccccgccggugccucaaaccggugauccugaaggacggucccgagcgcgucauccucgccggccccaugccggugacagucgccagcgccgcgcagagacgcgggaggaucggccgcaaccacaacaaggagggggaccaguauauuuacauggggcaaccccugaacaacgaugaggaccacgcucacuggaccgaggccaagaugcugcuugacaauaucaacacccccgagggcauuauccccgcgcuguucgagcccgagcgcgagaaaucugcagcgaucgauggugaguaccggcugcgcggcgaggcucggaagaccuuuguggagcucaugcgaaggggcgaccugccuguguggcugagcuacaaagucgccagcgagggauuucaguauucagaccgccguuggugcuucgacggcgagcgcaacaaccaggugcucgaggagaacauggacguggagaucuggacgaaggagggggagagaaagaaacugcgcccccgauggcuggaugcucgcaccuacagcgacccccucgccuugcgagaguucaaggaguucgcggccggccgccgguccgucagcggggaccuuauccuagagaucggcaagcucccccagcaccugacgcagcgcgcucagaacgcccucgacaaccuugucaugcugcacaacucugagcaaggcgggcgggcguaccgccacgcaauggaggaguuaccagauacgaucgaaacgcugaugcugcucgcccugaucgccgugcugaccggcggugucacccucuucuuucugagcggccgggggcugggcaagaccuccaucggccuccuaugcgugauggcgagcuccgugcugcucuggauggcaagcgucgagccgcacuggaucgcggccaguaucauccuugaguucuuucugauggugcuccugauccccgagcccgaccgccaacggaccccccaggacaaucagcuggccuacguggucaucgggcuccuguucaugauccugacugucgccgcgaacgagaugggccucuuagagaccaccaaaaaggaucuagggauaggccacguggccgucgagaaccaccaucacgccgccaugcucgacgucgaccugcaccccgccucggcguggacccuguacgcuguagccacgaccaucaucacucccaugaugcgccacaccaucgagaacaccacugcgaacaucucccucacggccaucgccaaucaggcagccauccugaugggguuagacaagggauggccgaucucuaagauggacauuggcgugccguugcuggcgcuggggugcuauucccaggugaacccccuuacccugacggcggcagugcugaugcucgucgcccacuacgcuaucauuggcccggggcugcaggccaaggcgacccgcgaggcucaaaagcgaaccgccgccggcauuaugaagaacccgaccguggacgggaucguggccaucgaucuggaccccgucguguacgacgcgaaguucgagaagcagcucgggcagauuaugcugcugauccucuguacgagccagauccugcuaaugaggaccaccugggcccucugcgagucuauuacacuggcaacgggcccgcugacuacccucugggagggaagccccggcaaguucuggaacaccacgauugcaguguccauggccaauaucuuccggggaagcuaccuggcgggcgccggccuggccuucagccucaugaaaucccucggcggcgggcgcagagggaccggcgcccagggagagaccuugggcgaaaaguggaagcgccagcucaaccagcuaucuaagcccgaguucaauaccuacaagcgguccgggaucauggagguagaccgcagcgaggcgaaggagggccugaagcgcggggagacaacuaagcacgccgugucccgcggcaccgccaagcuucggugguucguugagagaaaccugguuaaacccgaggggaagguaaucgaccuggguugcggccggggagguuggagcuauuacugcgcugggcugaagaagguuaccgaggucaaaggguacacgaagggggggcccggccacgaggaacccaucccgauggccaccuacggauggaaccucgugaaacugcacuccggcaaggacguguuuuucauccccccggagaagugcgacacccugcucugcgacaucggggagagcuccccuaacccgaccaucgaggagggccgcacgcugcggguccugaagaugguggagcccugguugcgcgggaaccaguucugcaucaagauccugaaccccuacaugcccucuguggucgagacccuggagcaaaugcagcgcaagcacggcggcaugcucgugcgcaauccgcuuucccggaacagcacccacgagauguacuggguguccugugggaccggcaacaucgucagcgcggugaacaugaccagccgcaugcugcucaaccgcuuuacgauggcccaccggaagcccaccuacgagcgcgauguggaccugggggcaggcacccggcacgucgccguggagcccgaaguggccaaucuggacauaauaggccagcgcaucgagaacaucaaacacgagcacaagaguaccuggcacuacgacgaggacaacccguacaagaccugggcguaccacgggucguacgaggugaagcccuccggcucugccagcucaauggugaacgggguagugaagcucuuaacuaagcccugggacgugaucccgaugguaacccagaucgccaugaccgacacgacccccuucggccagcaacggguuuuuaaggaaaagguggacacccgcaccccgaaggccaagcgcgggacggcacaaaucauggaggucaccgcgaaguggcuguggggcuuucucucccgcaacaagaagccccggaucugcacuagggaggaguucacccggaaaguaagaucgaacgccgcuaucggugcaguguucgucgaugaaaaccaguggaauuccgcgaaggaggccgucgaggacgagcgguuuugggaccugguccaccgcgagagagagcuucacaagcaggggaagugcgccacgugcguauacaauaugaugggcaagcgagagaagaagcugggggaguucggcaaggcgaaggggucgcgggccaucugguacauguggcugggcgcgagauuccuggaguucgaggcccucggcuucaugaaugaggaccacugguucucccgggagaacagccuguccggcguggagggggaggggcuacacaagcucggcuacauccugcgcgacaucagcaaaaucccugguggcaacauguacgccgacgacacugcgggcugggacacccggaucaccgaggaugaccuccagaaugaagccaagauaacggacaucauggagccggagcacgcacuccuggccaagagcaucuucaaguugaccuaccagaacaaggugguccgcgugcagcgacccgccaagaacggcacggugauggacgucaucagccgccgcgaccagcggggcuccggccaagugggaaccuauggacucaauacguucacaaacauggaggcacagcugauccgacagauggagagcgaggggaucuucucccccagcgagcuggagaccccgaaccucgcuggccgcguucuggacugguuggagaagcacggggucgagcgccucaagcggauggcuaucuccggcgacgacugcguugugaagccgaucgacgaccguuuugccaccgcgcugacggcccugaacgauaugggaaagguucggaaggacauaccccagugggagccgagcaaaggcuggaacgacuggcagcagguucccuucuguucccaccacuuccaucaacucaucaugaaagacggccgcgagaucgugguacccugcagaaaucaggaugagcugguggggcgcgcucguguaucccagggcgcgggauggagccugcgcgaaaccgccugccucggcaagucguacgcccagauguggcagcugauguacuuccaccggcgcgaccugcggcucgcagcgaacgcaaucuguagcgcgguacccguggacuggguuccaaccucccgaaccacgugguccauccacgcccaccaccaguggaugaccaccgaggacaugcuguccguuuggaacagaguguggaucgaagagaaccccuggauggaggacaaaacccacgugucuucuuggggcgacgucccuuaccugggcaagcgagaggaccaauggugcgguucgcucaucgggcugacggcacgcgcgaccugggccaccaacauccaaguggccaucaaccaggugcggcgccugcucggcaacgaaaacuaccuggacuacaugacauccaugaagcgguucaagaacgagagcgauccugagggugcccuaugguga

SEQ ID NO: 24388 - RNA, 9879 nt, Artificial Sequence
  derived and/or modified CDS sequence (opt11) from DENV-1__FJ898411__SS-prME
ucggugaccaugcugcucaugcugaugcccaccgcgcuggcuuuccaccucaccacgcggggcggggagccccacaugaucguguccaagcaggagcggggcaaaucccugcuguucaagaccuccgccggcgucaacauguguacccucaucgcaauggaccuaggcgaguucugugaggacacaaugaccuacaagugcccccgcaucaccgaagccgagcccgaugacguggacugcuggugcaacgccaccgacacuugggugaccuacgggaccuguagccagaccggugagcacaggcgggauaagcgguccgucgccuuagcgccccacgugggccucggacuggagacgcgcaccgagaccuggaugagcuccgagggcgccuggaagcagauccaacggguagagaccugggcacuaaggcacccgggguucacagugaucgcucucuucuuagcucacgccaucgggacuucaaucacucagaaggguauaaucuucauucugcugaugcugguuaccccaucuauggcaaugcgaugcgucggcaucggcagcagggauuuuguggaggggcuguccggcgccacguggguggaugucgugcucgagcacgggucuugcgugacaaccauggccaaggacaagccuacucuggacaucgagcuucucaagacggaggucaccaaccccgcggugcuacguaaacugugcaucgaggccaagauaucgaacaccaccacugauagccgcugcccaacccagggagaggccacccucgucgaggagcaggacgccaacuuugucugccgacgaaccuuuguggacagggguuggggaaacggcugcggccuauuuggcaagggaagucuuauaacgugugccaaguucaagugcgugaccaagcucgaggguaagauuguccaguaugagaauuuaaaguacagcgugaucguaaccguccacaccggcgaucagcaccaggugggcaaugaaaguacggagcacggcaccaccgcaaccaucacgccccaggcccccagcaccgagauccagcugaccgacuauggggcucucacccuggacugcagcccccggacaggucuggauuucaaugagauggucuugcugacgaugaaggagaaguccugguuagugcacaagcagugguuccucgaccugccgcugcccuggaccagcggggccuccaccagccaagagaccuggaaccggaaggaucuccuggugacauucaagaccgcgcacgcuaagaagcaggaggucgucgugcugggcucccaagagggcgccaugcauaccgcccucacuggugccacggagauucaaaccagcggcaccaccacgaucuucgccggccaucugaagugcagauuaaaaauggacaaacucacccugaaaggcauguccuauguaauguguaccgggucuuuuaagcucgagaaggagguggcugagacccagcauggcacagugcuaguccagaucaaguacgaggggaccgacgcccccuguaaaauccccuuuuccacccaggacgagaagggggugacccagaacgggcgccugauaacugccaacccgaucgugaccgacaaggaaaagcccgucaacaucgaggccgagccgcccuucggagaaagcuacaucguaauuggcgcgggagagaaagcccuuaagcuauccugguucaagaaaggcucauccauuggcaagauguucgaagccaccgcacggggggcccggaggauggcgaucuugggcgacacugccugggacuucggaagcaucggcggcguuuucacguccguagggaaacuggugcaccagauuuucggcacugcauacgggguacuguucaguggcgucaguuggaccaugaagaucgggaucggcgugcuccugaccuggcugggccucaacagccgcaguacgagccugucuaugacaugcaucgccguggggcuugucacucucuaccugggcgugauggugcaggccgacagcgguugcgucaucaauuggaaaggcagagaacucaagugcggauccgguaucuucgugaccaacgaaguucacacuuggaccgagcaguacaaguuccaggcggacagcccgaagagacucagcgccgccaucggcaaagccugggaggaaggggucugcggcauccggucggccacccgucuggagaacaucauguggaagcagaucagcaacgagcuaaaccacauccuccuugagaaugacaugaaguucaccgugguggucggggacguggcgggcauauuggcccaggguaagaagaugauccggccccagcccauggaguacaaauacuccuggaaguccuggggcaaggcgaagaucauuggggccgacguucagaacaccacguucaucauagacgggcccaacaccccggagugcccagacgaccagcgagccuggaacauaugggagguagaagacuacggcuucgggaucuuuacuaccaacauauggcuaaagcugcgcgacuccuacacccaggucugcgaccaucgccugaugagcgcggccaucaaagacucaaaggccguccacgcugauauggguuacuggaucgagagcgagaaaaaugagacauggaaauuagcccgggccucguucaucgaggugaagaccugcaucuggccuaagagccacacccuguggagcaacggggugcucgaguccgagaugaucauucccaaaauuuacgggggcccuauaucccaacacaacuaucgccccggguacuucacacagaccgccggccccuggcaccuugggaaauuggagcuggacuucgaccucugcgagggcaccaccgugguuguugacgagcacugcggcaacagggggccgagccugagaacgaccacugugaccggcaagaucauccacgaguggugcugccgguccugcacgcugccaccccugcgcuucaaaggggaagacggcugcugguacgggauggagauccggcccgucaaggaaaaggaggagaacuuagucaaaucuauggugagcgccggauccggcgaaguagacagcuucucccucgggcuacugugcaucuccaucaugauugaggaggugaugcgcucccgauggagucgcaagaugcugaugacgggaacccucgccguguucuuccugcugaucauggggcagcucaccuggaacgaccucauccggcugugcaucauggucggugccaacgccuccgaccguaugggcauggguacgaccuaccuugcccugauggccacguucaagaugagaccgauguucgccgucgggcuccuauuccgacgccugaccagcagagaggugcugcucuuaacgaucggguuaagucucgucgcgucaguggagcugcccaacagccuugaagagcucggcgacgggcuagcaauggggaucaugauucugaagcuccucaccgacuuccagagccaccagcugugggccacccugcuaagcuugaccuucauaaagacgaccuucagccuucacuacgccuggaagaccauggcgaugguccugagcauaguuagccuguucccccucugccugagcaccacgagccagaagaccaccuggcugcccgugcuccugggcucccuuggguguaagccucucaccauguuccugaucgcggagaacaagaucuggggccgcaagaguuggccccugaacgaggggaucauggccgucgguaucgugagcauccuccuguccgcucugcucaagaacgacgucccccuugccgggccgcugaucgcgggcggcaugcugaucgccuguuacgucaucagcgguuccagcgccgaccugucccuggagaaggcugccgaggucagcugggaagaggaggcggaacacuccggcgccagccacaacauauuaguggagguccaggacgacggcacgaugaaaauaaaggacgaagagcgggaugacacccugacuaucuugcucaaagccacccugcuggcuguguccgguguguacccgcugagcaucccagccacccuguucgucugguacuucuggcagaagaagaagcagcgcuccggggugcugugggacaccccgucaccgcccgagguggagcgggcgguccucgacgacggcaucuaccgcaucaugcaacggggccugcuggggcgcucccagguggguguagggguuuuccaggagaacguuuuccauacuauguggcaugugaccaggggcgcaguccugauguaccaagggaagaggcucgaaccaagcugggcuuccgugaaaaaggaccugaucaguuacggcggaggguggcggcugcagggaucuuggaacaccggcgaagaggugcaggucaucgccgucgagcccgggaagaaucccaagaacguucagacggcccccgggaccuucaagacaagcgaaggcgaagugggcgcaauugcccucgacuucaaacccgggaccagcggaucccccaucgugaaccgcgaggggaagaucgugggccuguacggcaacgggguugugacgaccagcgguaccuacgugucggccaucgcccaggcgaaggccagccaggaggguccccugccagagaucgaggacgaagucuuucggaagcgcaaccucacgauuauggaucuucacccugguuccgggaagacgcggcgcuaucugccugccauagugcgggaggccaucaagcgcaagcucagaacucugauccuggccccgacccgcguugucgcgagcgagauggccgaggcccuaaagggcaugcccauccgauaccagaccacggccgucaaguccgagcacaccggcaaggaaaucguagaccugaugugccaugcaacuuucaccaugcgacugcugagccccguccgugugcccaacuacaacaugaucaucauggacgaggcucacuucacggaccccaguucuaucgccgcccggggguacaucuccacccgcgugggcaugggugaggccgccgcgaucuucaugacggcgacgccgcccggaagcgucgaggccuucccccagucgaacgccguaauucaggacgaggagcgagauaucccagaacgcagcuggaauuccggguacgaguggaucacggacuuucccgggaagaccgugugguucgucccgucuaucaagucuggcaacgacaucgcgaacugccuccgcaagaacggaaaaaggguaauccagcugagccggaaaaccuucgacacagaguaccagaagacaaagaacaacgauugggacuacguggucaccaccgauaucuccgaaaugggagccaauuuccgcgccgaccgggugaucgacccccgccggugccucaagccggugauccugaaggaugggcccgagcgggucauccuggcaggccccaugcccgugacugucgccucggcggcccagcggcggggaaggaucgggcgcaaccauaacaaggagggcgaccaguacaucuacauggggcagccgcucaauaacgaugaggaccaugcccacuggacagaggccaagaugcugcuggauaacauuaacacacccgaaggcaucaucccagcucucuucgagccggagcgcgagaaaucggccgccaucgauggggaguaccgccugcgcggcgaggcccggaagaccuucguggaacugaugaggaggggggaucucccaguguggcugucuuacaaggucgccagcgaaggauuccaguacucagaccgccgguggugcuucgacggcgagcgcaacaaccaaguucuggaggagaacauggacguggagaucuggaccaaggaaggggagcggaagaagcuccgcccccgauggcuugacgcccgcacguacagcgacccccuggccuuacgagaauucaaggaguucgcugccggccgccgguccgucagcggggaccugauccuggaaauugguaagcucccccagcaccugacccagcgcgcccagaacgcgcuggacaaccucgugaugcuccauaacuccgaacagggugggcgcgcuuaucgccacgcaauggaggagcugccugacaccaucgagacccugaugcugcuggcccucaucgccguguuaacgggcggggucacccuguucuuccucagcggccgggggcugggcaaaaccuccaucggacugcucugugugauggcaagcuccgugcugcuguggauggcgagcguggagccucacuggaucgccgcguccauaauuuuggaguuuuucuuaauggugcugcucauccccgagcccgaccgccaacggaccccgcaggauaaccaacuggccuacguggucauugggcuucuguucaugauccugaccguggcggccaacgagaugggccugcuagagacgaccaagaaggaccuaggaauaggccacguggcggucgagaaccaccaccacgccgccauguuagauguggaucuucaccccgcuucugccuggaccuuauacgccguugccaccacgaucaucacccccaugaugcgccacacgaucgagaacaccacggccaacauaucgcugacggcgaucgccaaccaagccgcuauccucaugggacuggacaaaggcuggccuauaucgaagauggacaucggcgucccccugcucgcgcuggguugcuacagucaagugaacccccugacucucaccgcggcuguccuuaugcuggucgcccacuacgcgauaaucggacccgggcuccaggccaaggccacgagagaggcccagaagcgcaccgcugcuggaaucaugaaaaacccgacaguggacggaaucguggcgaucgauuuggauccggucguguacgacgccaaguuugagaaacagcuggggcagauaaugcuccucauccucugcaccucacagauccugcugaugcgaacgacaugggcucugugugaguccaucacccucgccacgggcccacugacgacccugugggaggggucccccggcaaauuuuggaacaccaccauugcuguguccauggcgaacaucuuccgggggucuuaccuagccggagccggccuagccuucagccugaugaagucuuuggggggcggccgccgggggacuggugcgcagggcgagacccugggggagaaguggaagagacaauugaaucaacuuagcaagucggaguucaacacauauaagcggagcgggaucauggaggucgacaggagugaggccaaggaaggccugaagcgcggugagaccacaaaacacgccgugucucgcggcaccgccaagcugcguugguucguggagcgcaaucucgucaagcccgagggaaaggugaucgacuugggcugcggucgcggcggguggaguuacuacugcgcugggcugaagaagguaaccgagguaaagggguauacuaagggagggcccggccacgaggagccgauccccauggcgacguacggguggaaccuggugaaacuccacagcggcaaagacguauucuucaucccaccggagaaaugcgacacucugcugugugacaucggggagucuucgccaaauccuacaaucgaggagggccgcacacuccgaguacuaaagauggucgagccguggcugagggggaaucaguucuguaucaagauucuuaaucccuacaugcccuccgugguagagacgcuggaacagaugcaacggaagcauggcggcaugcuggugcgaaauccacucucccggaacucaacgcaugagauguacugggugagcugcgggacuggcaauaucgugagcgccguaaauaugaccucgcgcaugcugcugaaccguuuuaccauggcccaccgcaagccgacuuaugagcgcgacguagaucucggggcuggcacccggcacguagccguggagcccgagguggcgaaucuggacauuaucggccaacggaucgagaacauaaagcaugagcacaaguccaccuggcacuacgacgaggauaaccccuacaagaccugggccuaccacgggagcuaugaggucaagccauccgggagcgccucuuccauggugaacggggucgugaagcugcucacgaagccaugggaugucauccccauggucacccagaucgccaugaccgacaccacgcccuucggccagcagcggguguucaaggaaaagguggacaccaggaccccgaaagcaaagcgggggaccgcgcagaucauggaggugacggccaaguggcuguggggcuuccugagccggaacaagaagccccguaucugcacccgugaagaguucacacgcaaggugcgcucgaacgcagccaucggcgcgguguucguagacgaaaaccaguggaacagcgccaaagaagccguggaggacgagcgguucugggaccucgugcacagggagcgggagcugcauaagcaggggaagugugcgaccugcguguacaacaugaugggcaagcgagagaagaagcugggggaguucggcaaggccaaggggucccgggcgaucugguauauguggcucggcgcccgcuuccuggaauucgaggcccugggcuucaugaacgaggaccacugguucagccgcgagaacucccucagcgggguggagggagaggggcugcacaaacugggcuacauccuccgcgacaucuccaagaucccuggaggcaauauguacgccgacgacacugccggcugggacacccguauaacggaagaugaucugcagaacgaggcgaagaucacggacauaauggagcccgagcacgcccugcucgccaagagcaucuucaagcugacguaucaaaacaaggugguccgcgugcagcggccugccaagaacggcaccguaauggacgucaucucgagacgcgaccagcgugggagcggccaggugggaaccuacggccugaacacauuuacgaacauggaggcgcagcucaucaggcagauggagucagaggggauuuucagucccucggagcuggaaacccccaaccuggccggacgggugcucgauuggcuggaaaagcauggcgucgagcgccuaaaacguauggccaucuccggcgacgauugcgugguaaagcccaucgacgaccgcuucgcgacugcccuuaccgcgcugaacgacaugggcaaagucaggaaggacaucccgcagugggaacccuccaagggcuggaacgacuggcagcaggugcccuucugcagccaccauuuccaccaacuuaucaugaaggacgggcgagagauaguggucccaugccggaaccaggacgaauuaguggggcgggcgcggguaagccaaggcgccggguggagucugcgcgaaaccgccugccucgguaagucuuacgcccagauguggcagcucauguauuuccaucggcgcgacuuacgucuggcggccaacgccaucugcuccgcugucccgguggacuggguccccacgagcagaacuacauggaguauccacgcccaccaccaauggaugacgaccgaggacaugcucagcgucuggaaccggguguggaucgaagagaaccccuggauggaggacaagacccacaucuccagcuggggcgacgugccguaucugggcaagcgcgaagaccaguggugcggcucccugaucggccuaaccgcccgggcaacgugggccacaaacauccagguugccaucaaccaggugcgccgccugaucggcaacgagaacuaccuggacuacaugaccucgaugaagcgguucaaaaacgaguccgacccagagggcgcguuaugguaa

SEQ ID NO: 24389 - RNA, 9879 nt, Artificial Sequence
  derived and/or modified CDS sequence (opt11) from DENV-1__FJ898412__SS-prME
agcgugaccaugcugcucaugcugaugcccacagcccuggccuuccaccucaccacccgcgggggggaaccccacaugaucguaacaaagcaggagcggggcaagagccugcuguucaagaccagcgcaggggugaacaugugcacauugauugcuauggaccugggcgagcugugcgaggauaccaugaccuacaagugcccacggaucaccgaagccgagccugacgacgucgauuguuggugcaacgccacugacaccugggugaccuacgggaccugcagccaaacgggcgagcaccggcgcgauaagcggagcguugcccucgccccccacgugggccugggguuagagacccgcaccgagaccuggauguccagcgagggcgccuggaagcagauccagcgcgucgagacgugggcucucagacacccaggguucaccguuaucgcccuguuucucgcgcaugcgaucgggacauccaucacacagaaggggaucaucuucauccuccuaaugcuggugacgccaucaauggccaugcgcugcgucggcauaggcucgcgcgacuucguggaggggcucucaggcgccaccuggguggaugucgugcuggaacacggaucgugcgugacgaccauggccaaggacaagcccacguuagacaucgagcuccugaagaccgaggucaccaaucccgcggugcugcggaagcucugcauagaggccaagauaagcaacaccacgaccgacucccgcugccccacccagggcgaggccacacugauggaggagcaagacgccaauuucgugugccggaggacguuuguggaccgagggugggguaacggcugugggcuguucggcaaggggagccucaucacgugcgccaaguucaagugugugaccaagcuggaaggcaagaucguucaguacgagaaccugaaguacucggucaucgugacugugcacacgggcgaucagcaccagguggggaacgaaagcaccgagcacggcaccacagccaccaucacgccccaggcccccacguccgagauacagcuaaccgacuacggggcuuugacccuugacugcagcccccgcacgggucucgacuucaacgagaugguucugcugaccaugaaggagaaguccuggcucguccacaaacagugguucuuggaccuuccgcuccccuggaccagcggggcguccaccucccaagagacguggaaccggcaggaccugcuaguaaccuucaagaccgcccacgcgaagaagcaggagguggucguccucgguagccaggagggcgcgaugcauaccgcccugacgggggccaccgagauucagaccuccggaaccacgaccaucuucgccgggcaccuaaagugucgcuuaaagauggacaagcugacccugaagggcaugagcuacgugaugugcaccgggucguuuaagcucgagaaggaggucgcggagacgcagcacgggacugugcugguacagaucaaguaugaaggcacugacgcccccugcaagauccccuucagcacccaagaugagaagggggucacgcagaacggccggcugaucaccgccaacccgaucgugaccgacaaggagaagcccgucaacaucgaggccgagccuccauuuggggaguccuacaucgucaucggggccggcgaaaaggcccugaaguuaagcugguucaagaagggguccagcaucggcaaaauguuugaagcaaccgcccgcggggcccgccguauggcgauccuuggcgacacggcaugggacuucggguccaucggcgggguguuuacgagcguugggaaauuaguccaccagauuuucggcaccgccuacgggguucuauucuccggcgugagcuggaccaugaagaucgggauaggcguccugcugacguggcucggccugaacucccgcagcaccucacugagcaugaccugcaucgccgugggguuggugaccuuauaccugggcgucauggugcaggccgauuccgggugcgugaucaacuggaagggcagggagcucaagugcgggucaggcaucuucgugacaaacgaggugcacacuuggaccgagcaguacaaguuccaggcggacagcccgaagcgccuguccgccgccaucggcaaagccugggaggagggggugugcggcauccggagcgccacccgccuggaaaacaucauguggaaacagaucuccaacgaacucaaccacauacuucuggagaaugacaugaaguucaccgucguggugggcgacgucgugggcauccuggcgcaagguaagaagaugauccggccccagcccauggagcacaaguacuccuggaaguccuggggcaaagccaagaucaucggcgccgacgugcaaaacacaaccuucaucaucgacggucccaacacuccggagugccccgacgaccagcgcgcauggaauauuugggaggucgaggacuauggcuucggaaucuucaccacgaauaucuggcugaagcugcgcgacagcuacacacagguaugcgaccaccgccucauguccgcggccaucaaggacagcaaagcgguucacgccgauaugggcuacuggauagaguccgagaagaacgaaaccuggaagcuugcacgggcgagcuucaucgaggucaagaccuguaucuggccuaagucccacacccuguggagcaacggcguacucgaauccgagaugaucauccccaaaauauacgggggcccgaucagccagcacaacuaccgccccggguacuucacccagaccgcgggccccuggcaccuggggaagcuugaauuggauuucgaccugugcgagggcaccacgguagucguggaugagcacuguggcaacagagggccgucccuucgcacaaccacggugacuggcaagaucauccacgaguggugcugccggagcugcacgcugccgccccuacgcuucaagggggaggacggaugcugguacgggauggagauacggccugucaaggagaaggaggagaaccuggugaaguccauggugagcgcuggaagcggcgagguggacuccuucucgcucgggcugcugugcaucuccauaaugaucgaggaggugaugcgcagccggugguccaggaagaugcuaaugaccggcacccuggccguguuccuguugcugauuauggggcagcugacguggaaugaucucaucagacugugcaucaugguuggagccaaugcgagcgaccgcauggggaugggcaccaccuaccucgcccucauggcaaccuucaagaugcgcccgauguuugccguggggcuucuguuccgccgccucacgucccgggaggugcugcugcucaccaucgggcucagcuuaguggccuccguggagcuccccaacagccuagaggagcugggcgacgggcuggcgaugggcaucaugauucugaagcugcucacagacuuccagucccaccagcugugggccacccugcucagccugaccuucaucaagaccacccuguccuugcacuacgccuggaaaaccauggccaugguccugucuaucgugucccuguucccccuaugccugagcacgacaucccagaagacgaccuggcugcccgugcuccugggcagccuuggcugcaagccgcucacgauguuccuuaucgcagaaaacaagaucuggggccgaaagucguggccucugaacgaagguauaauggccgucggcguggugagcauccucuugaguucccugcucaagaacgacgucccccuggccgggccacugaucgccggcggcaugcucaucgcaugcuacgugaucagcggguccagcgcggaccugucgcuggaaaaggccgccgaagugagcugggaagaggaggccgagcacuccggcgccucgcacaacauccucgucgaggugcaggacgacgguaccaugaaaaucaaggacgaggagcgggacgacacacugaccauccugcuuaaggcgaccuuauuagccguauccggcgucuacccgcucagcauccccgccacgcuguucguuugguacuucuggcagaagaaaaagcagcgcuccggggugcuuugggacacccccagcccgccugaggucgagagggcaguacuggacgacggcaucuaccgcaucaugcagcggggccuccuagggcggucccaagugggcgucgggguauuccaggaaaacguuuuccacaccauguggcacgucacccggggggccgugcugauguaccaggggaagcgacucgagcccaguugggcguccgucaagaaggacuuaaucagcuacggcggcgguuggcgucugcaggguuccuggaacacaggagaggagguccaggugaucgccguggagcccggaaagaaccccaagaacguccaaaccgcccccgggacuuucaagacuccugagggcgagguuggggccaucgccuuggacuucaagcccgggacgagcggcucccccauagugaaccgcgaggggaagaucgucggccuauacggcaacggaguggugaccaccucugggaccuacgucucagcgaucgcccaggccaaggcuucccaggagggaccgcugcccgaaaucgaggacgagguguucagaaagcgcaaccuaacgaucauggacuugcacccgggcagcgggaagacccggcgcuaccugccggcgauugugcgcgaggcgaucaagcgaaaauuacggacccuuauccuggcucccacuagagugguggccuccgagauggccgaggcgcucaagggcaugcccauccgcuaccaaacgaccgccguaaaaagcgagcacaccggcaaagagaucgucgaccugaugugccacgcuacguuuacgaugcgccuucucuccccugugcggguaccgaacuauaacaugaucaucauggacgaggcccauuucaccgaccccagcagcaucgcugcgcguggguacaucagcacccgcgucggaaugggggaggcagcagccaucuucaugaccgccaccccgccuggaucgguggaggcguucccgcagagcaacgccgucauucaagacgaggaacgggauauccccgagcgcucuuggaacagcggguacgaguggaucaccgacuuccccggaaagaccgucugguucgugcccuccaucaagagcggcaacgauaucgccaacugccugcggaagaacgggaaacgcguuauccagcugucccggaagaccuucgacacggaguaccagaagaccaagaacaacgauugggacuacgucguuaccaccgacaucagugagaugggcgccaacuuccgcgcggaccgggugaucgacccgcgccggugcuugaaaccggucauccugaaggaugggcccgagcgcgucauacuggccggcccaaugccuguuacgguagccuccgccgcacagcggcgcgggcggaucggccgcaaccacaacaaggagggcgaccaguacaucuacaugggccagcccuuaaacaacgacgaggaccacgcucacuggacagaagccaaaaugcuuuuggacaacaucaacacccccgagggcaucauccccgcgcucuucgagccugagagagagaaguccgcugccaucgacggggaguaucgccugcgcggggaagcgaggaagaccuucguggaacucaugcgccgcggggaucuccccgugugguuaucguacaagguggccagcgagggcuuccaguacagcgaccgcagguggugcuucgacggggagcgcaacaaccaagugcuggaggagaacauggacgucgagauauggacgaaggagggggaacggaagaagcuccgcccccgcuggcuggaugcccgcaccuacucggacccacuggcccuccgggaguuuaaggaguuugccgcgggccgccggagcguguccggggaccugauucucgagaucggcaagcucccgcagcaccugacccaacgcgcccagaacgccuuggacaaccucgugaugcugcacaacagcgagcagggcgggcgagccuaccgccacgccauggaggagcugcccgacaccaucgaaacguugaugcuguuggcccucaucgcaguuuugaccggcggaguuacccuguucuuccucuccggccgcgggcugggcaagacaucaauaggacugcucugcgugauggccuccaguguucugcuuuggauggcauccguggaaccccauuggauugcggcaagcaucauucucgaguucuucuuaauggugcuucucauccccgagccggaucgccagcguacgccccaggacaaccagcuggccuacgucgugaucggacuccucuuuaugaucuuaacgguggcagccaaugaaaugggccugcucgagacuacaaagaaggaccuggggaucggccacgucgcgguggagaaccaccaccacgugaccaugcuggacgucgacuugcaucccgccagugccuggacgcuguacgcuguggccaccaccaucaucacaccuaugaugcgccauacgaucgagaauaccaccgcuaacaucagcuugacggccauagccaaccaggccgccauccucaugggguuagacaaaggcuggccuaucuccaagauggacaucggcgugccccugcucgcgcuggggugcuacucucaggucaacccccugacgcucacggcugcaguguugaugcuggucgcgcacuacgcgaucaucggcccggggcuccaggccaaggccacacgggaggcucagaagcgcaccgccgcagguauuaugaagaaccccaccgucgacgggaucguggccaucgaccuggacccagucguuuacgacgccaaguucgaaaagcagcugggccagauuaugcuccugauccugugcaccagccagauccugcugaugcgcaccaccugggcgcugugcgagagcaucacgcucgccacgggcccccugaccacccugugggaggggucacccggcaaguucuggaacacgaccauugccgucagcauggcgaacaucuuccggggguccuaccucgccggcgccggccuggccuucucucugaugaagucccucgggggcgggcgccgugguaccggggcucagggcgagacacugggcgagaaguggaaacgccagcuaaaccaguugucuaagagcgaguucaacauuuauaagcgguccgggauaauggagguggaccgcagcgaagccaaagagggccugaaacgcggagagacgacccgccacgccgucucacggggcacugcuaagcugcgcugguucgucgagcggaaccugguuaagcccgaggggaaggucaucgaccucggcugcggucgcgggggauggagcuacuacugcgccggguuaaagaaggugaccgaagugaagggguacacgaagggaggccccggccacgaggagcccaucccgauggcuaccuacggguggaaccuggucaagcuccacuccggcaaggacguuuucuucacgccccccgaaaaaugcgacacccugcugugcgacaucggggagagcucccccaacccaacgauugaggagggcaggacccucagggugcugaagauggucgagcccugguugcgugguaaucaguucugcaucaagauacucaaccccuacaugccuagcgugguggagacccuggagcagaugcagcgcaaacacggcggcaugcugguccggaauccacucucccgcaacagcacucacgagauguauuggguauccugugggacgggcaacaucgugucagccgucaacaugacgucccggaugcugcugaacagguucaccauggcccaccgcaagcccaccuaugagcgggacguggaccugggggcaggcacgcgucauguggcggucgagcccgaaguggccaaccuggacaucaucggccagcggaucgagaauaucaagcacgagcacaagagcacguggcacuacgacgaggauaaccccuacaagaccugggcauaccacggguccuacgaggucaaacccucgggcuccgccucuucgauggugaacggcguggugaagcugcucaccaaacccugggacgugaucccuauggugacccagaucgccaugacggacaccacccccuuuggacagcagcgcgucuucaaggagaagguggacacccggacgccgaaggcgaagcgugggaccgcccagaucauggaggugaccgcgcgguggcuguggggcuuccugucccggaauaaaaagccccguauuugcacacgcgaggaguucacacggaagguccgcaguaacgccgccaucggcgcgguguucguugaugagaaccaguggaauuccgcuaaagaggcgguagaggacgagcgguucugggaccucguacagaaggagcgcgaacugcacaagcaggggaagugcgcgaccuguguauacaacaugaugggcaagcgugagaaaaaacugggggaguuugguaaggcgaaggggucccgugccauaugguauauguggcucggggcccgguuccuggaguucgaggcccugggcuuuaugaacgaggaccauugguucucccgcgagaacagccucuccggggucgagggcgagggacugcacaagcugggauauauccuccgggauauaagcaagauccccgggggcaacauguacgccgacgauaccgcgggcugggacacccgcaucaccgaggacgaccugcagaacgaggccaaaaucaccgacauaauggagccggagcaugcccugcucgccaccuccaucuucaagcugaccuaccagaacaagguggugagggugcagagacccgcgaagaacggaacuguuauggacgugaucagucgccgggaccagcgcggauccgggcaagucggcaccuacggccuuaacaccuuuaccaacauggaagcgcagcucauccggcaaauggagagcgagggcaucuuccugcccuccgagcuggagacgcccaaucucgccgagcgcgugcuggauuggcuggagaaguacggcgucgagcgacucaagcgcauggccaucucaggggacgauugcgucgugaagccgaucgacgacagauucgccaccgccuuaaccgcccuuaaugacaugggcaaaguccgaaaggacaucccacaaugggagcccuccaaggguuggaaugacuggcagcagguucccuuuugcagccaccacuuccaccagcucaucaugaaggacggacgagagaucguggugccgugccgcaaccaggacgagcuagucggcagggcccgggugucccagggggccggcuggagcuuacgggagaccgccugccugggaaagagcuacgcccagauguggcagcugauguacuuccacaggcgggaccuucgccucgcggcgaacgccauaugcagugccgugccagucgacugggugcccacgucgcggaccaccuggucuauccacgcgcaccaccaguggaugaccacggaggacaugcuuagcguguggaaccgcgucuggaucgaggagaaccccuggauggaggacaagacgcacguguccagcuggggcgaugugccguaccuggggaaacgggaggaccaguggugcggcucccuaaucggccugaccgcucgcgcgacaugggccagcaacauccagguggccauuaaucaaguacgacggcugaucgggaacgagaacuaccucgacuacaugaccuccaugaagcgcuucaagaacgagggcgaccccgagggggcgcuuugguga

SEQ ID NO: 24390 - RNA, 9879 nt, Artificial Sequence
  derived and/or modified CDS sequence (opt11) from DENV-1__GQ199852__SS-prME
uccgugaccaugcugcucaugcugaugcccaccgcccuugccuuucaccugaccacgcggggcggggagccccacaugauugugaccaagcaagagcggggaaagagccugcuguucaaaaccagcgcgggggugaacauguguacccugauugccauggaccuuggugagcugugugaagacaccaugacuuacaaauguccccggaucaccgaggccgaacccgacgacguggacuguugguguaaugccacggauacuugggugaccuacgggacuugcucccaaacaggcgagcaucggcgcgacaaacggagcgucgcucucgcgccccacgugggccuugggcuggagacgcgcacggagacuuggauguccagcgagggcgcguggaagcaaauccagcgaguggaaacgugggcccuccgccacccgggguucacugugaucgcccuuuuccuggcccacgcaauuggaaccuccaucacccagaagggcauaauauucauccucuugaugcuggugacgcccucuauggcuaugcggugcguagggauaggcucccgcgacuucguggaggggcuuagcggcgcaaccuggguggacguagugcuggagcauggguccuguguuaccaccauggccaaagacaaacccacgcuggacaucgagcuccugaaaaccgagguaaccaacccagcggugcuacggaagcucugcaucgaagccaagauuagcaacaccacuacagauuccagguguccgacccagggugaggcaacccuaauggaggagcaggaugccaacuuugugugucggcgcacauucguggaccguggcugggggaacgguugugggcuguuuggcaaggggucuuuaauaacgugcgccaaauucaagugugugacaaagcuggaggguaaaaucgugcaauacgagaaccugaaguauuccgucaucguuaccguacacacuggcgaucagcaccagguggggaacgagagcaccgagcacgggacaaccgcgaccauuacgccccaagcccccaccuccgaaauccagcucacugauuauggggcccugaccuuggacugcagcccccgcacgggccucgauuucaacgagauggugcugcugaccaugaaggagaaguccuggcucguccauaagcagugguuccuggaccucccgcuccccuggacuagcggagcuagcaccagccaggaaacguggaaucggcaggaccuguuggugacuuucaaaaccgcucacgccaagaagcaggagguagucgucuuaggcagccaggaaggagccaugcacaccgcccugacgggggccaccgagauccagaccuccggcaccacgacuaucuucgccggucaccugaagugccgccucaagauggacaaacugacccugaagggaaugagcuacgugaugugcaccggauccuuuaagcucgagaaggaggucgcggagacgcagcauggaaccguccuaguacagaucaaguacgaaggcaccgacgcccccuguaagauccccuucagcacccaggacgagaaggggguaacgcagaacggccgacugaucaccgccaauccgaucgugaccgacaaagaaaagcccgugaacaucgaagccgagccgccuuucggggagucuuacauagucaucggggcgggcgaaaaagcccucaaacuuagcugguucaagaagggguccagcaucggcaaaauguucgaggccaccgcacgcggggcccggcgcauggcgauccuuggcgacacagcgugggacuucgggagugucgggggaguguucaccagcgugggcaagcuggugcaccaaaucuucggcacagccuacggcguccuauucaguggcgugagcuggaccaugaagauugggaucgggguacugcugacguggcucggccugaacucccguagcacaucccugagcaugaccuguaucgccgucgggcucguaacgcucuaccugggcgugaugguucaagccgacagugguugcgucaucaacuggaagggacgggaacuuaagugcgggagcggcaucuucgucacaaacgaggugcacaccuggaccgaacaguacaaguuccaagcggauagcccgaagagacuaucugccgccaucggcaaggccugggaggagggggucugcggcauccguagcgcaacucgccuggagaauaucauguggaagcagauuucgaacgaacugaaccacauccuccuggagaaugacaugaaguucacggugguggucggggacgucgugggcauucucgcgcaggggaagaaaaugauccggccucaacccauggagcacaaguacagcuggaaguccugggggaaggccaagaucaucggggccgacguacagaacacgaccuucaucaucgacggacccaacaccccagaaugccccgacgaucagcgcgccuggaacaucugggagguggaggacuacggcuucgggaucuuuaccacgaauaucuggcucaaacuucgggacagcuauacccagguuugcgaccaucgacuaaugucagcggccauuaaggacagcaaggccguccacgcagacaugggguacuggaucgagagcgagaagaacgaaacauggaagcuggcccgggcgagcuucaucgaagugaaaaccugcaucuggccaaaaagccacacucuguggagcaacggcguguuagaauccgagaugaucaucccgaagaucuacgggggcccgauaagccagcacaacuaccgccccggguacuucacacagacggccggcccuuggcaccuagggaaacuggagcucgacuucgaucugugcgagggcaccacggucguggucgacgagcacuguggcaacagggggcccucacugcguacgaccaccgucacggggaaaaucauccacgaguggugcugccgaagcuguacccugccgccucucagauuuaaaggugaggacggcugcugguacgggauggagauccggccugugaaggagaaggaggagaauuuaguaaaauccauggucagcgccgguagcggugagguggacuccuucagccuugggcuucugugcauuucuaucaugaucgaggagguuaugaggaguagguggucacgcaaaaugcugacuacgggaacccucgccguuuuccugcucuugaucauggggcagcuaaccuggaaugaccuaauucggcugugcaucauggugggcgccaacgccagcgaccguauggggauggguacgaccuaucuggcacucauggccacguucaagaugcgcccgauguucgccgugggccugcuguucagacgcuugacaagccgagaagucuugcugcucaccaucgggcuaagccucgucgccucuguagagcucccgaauagccuggaggaacuaggcgaugggcucgcgaugggcaucaugauccugaagcugcucaccgacuuccaaucccaccaguuaugggccacgcugcugucgcugacuuucauuaagaccacauuaccccuccacugugccuggaagacgauggccaugguucuguccaucgcaucgcuuuuuccccugugccuguccaccaccagccagaagacaacauggcugccgguguuacucggcucccuggggugcaagccucugaccauguuccuaauuaccgagaccaaaaucuggggccgcaaguccuggccucugaacgaagguauaauggccgucggcgucguguccauccucuugucuagcuugcuuaagaacgaugucccucuggcagggccacugaucgccggcggcaugcucaucgccugcuacguuaucagugguuccucggcggaucugagccuagagaaggcagcugagguguccugggaagaggaggccgagcacucaggcgccucucauaacauccucgucguggugcaggacgacgggaccaugaagaucaaagacgaggagcgggaugacacgcugacaauccugcuaaaggcgaccuuacucgccgugagcggaguguacccucucuccauucccgccacgcuguucgucugguauuucuggcagaagaagaagcagcgcuccgggguccugugggacacgcccuccccgccggagguggagcgggccgugcuggacgacggaaucuaccgcaucaugcagcggggccuucugggccgcucucaggucgggguugggguguuucaggaaaacguauuccacaccauguggcacgugacccggggugccgugcugauguaccaggguaagaggcuggagcccuccugggcgagcgucaagaaagaucugaucuccuauggcggcggguggcgguugcaaggcagcuggaacaccggcgaggagguacaggugaucgccgucgagcccggcaaaaacccgaagaacguccagacggcccccgggacauucaagaccccagaaggggagguuggcgccauagccuuagauuucaagcccgggaccucuggcagucccauuguuaauagggaagggaagaucguagggcuuuacggcaauggggugguaacaaccucgggcacguaugugucagcgaucgcgcaggccaaggccagccaggaggggccuuuacccgagauugaggaugaggucuuccggaagcgcaaccucaccaucauggaccugcacccggguucaggaaagacucggcgauaucuuccugcgaucguccgagaggccaucaaacgcaaacuccggacccugauccuugccccuacccgcgugguggccagcgagauggccgaggcgcucaaaggaaugcccauucgcuaccaaacaacggcagucaaauccgaacacaccggcaaggagaucguggaccugaugugccacgccaccuucaccaugcgucugcucagcccggugcgcguuccuaacuauaacaugaucaucauggaugaagcccacuucacggaccccagcagcauugcggcgcggggguacaucucuacccgcgugggaaugggggaggcagccgccaucuucaugaccgccacgccacccggcagcguagaggccuucccccagagcaacgcagucauacaggacgaagaacgugacauacccgaacgcagcuggaacuccggguacgaguggauaacggauuucccaggcaagaccgucugguucguacccaguaucaaguccgguaaugauaucgccaacugccugcggaagaacgggaagcgggugauccagcugagccggaagacguucgacaccgaauaucagaagacaaagaacaacgacugggacuacguggugaccacugacauuucagagaugggcgccaacuuccgcgcggaccgggugaucgacccccgccguugucucaagccggugauccuuaaggacgggccagagcgcguuauacuugccgguccgaugcccguaaccguggccagcgccgcgcagcggcgcgggcggauaggccgcaaccacaacaaagagggggaccaguacauuuauauggggcagccccugaacaacgacgaggaccacgcgcacuggacggaggccaagauguuacuggauaacaucaacaccccggaaggcaucaucccugcccucuuugagccagaacgagaaaaauccgccgccaucgacggggaguacagauugcgcggcgaggcgagaaaaaccuucgucgagcugaugcgccguggggaucucccaguguggcugaguuacaagguggccuccgagggcuuccaguacagcgacagacgguggugcuucgacggcgagaggaacaaccagguccuggaggagaacauggacguggagaucuggacgaaggagggcgagcggaagaagcuccgcccccggugguuggaugcucguacguacagcgaccccuuagcgcuccgggaguucaaggaguucgccgcgggccggcggagcgugucaggggaccugauucuugagauugguaaguugccucaacaccugacgcagcgcgcgcagaacgcccucgauaaccucgucaugcugcauaacuccgagcagggcgggcgggcuuacaggcaugcgauggaggagcugcccgauaccaucgagaccuuaaugcugcuagcauuaaucgccguacugacgggcggggugacccuguucuuccucagcggccgggggcuggggaagaccuccaucggccugcucugcgucauggcuagcagcguacugcuguggauggcgagcguggagccccacuggauugcggccuccaucauccucgaguucuuccuaaugguccucuuaauaccggagcccgaucgccagcggacgccccaggacaaccagcuggcuuauguagugauaggacuccuguucaugauccugaccgucgccgccaacgaaaugggccucuuagagacgaccaaaaaggaccuugggauaggccacgucgcgguggaaaaccaccaccacgccaccaugcucgaugucgaccuccacccggccagcgcauggacccuguacgccguggcgaccacuauuaucacacccaugaugagacacacuauugagaauacgacagccaacaucucccugacugccaucgcuaaccaagcggcgauacucaugggcuuagacaagggcuggccuaucagcaagauggauaucggcgugccccuccuggcgcuggguuguuacucccaggucaacccacugacacucacagcagcugugcugaugcugguggcgcacuacgcgauaauuggccccgggcuccaagccaaggccacucgggaagcccagaagaggaccgcggccggcaucaugaagaacccaacagucgauggaauuguggcgauugaccuggaucccguagucuaugaugccaaguucgagaagcagcugggccaaaucauguugcuuauccucugcacgagccagaucuugcucaugcggaccaccugggcccugugugaauccaucacauuggcgacgggcccgcugacuacccuuugggaggggucuccggguaaguucuggaauaccacgaucgccguguccauggccaacaucuuccgggggaguuaccucgcaggcgccggccuggcuuucucccugaugaagucccucgggggcgggagacggggcacaggugcccagggcgagacccugggcgagaaguggaagaggcaguuaaaccagcuaagcaaguccgaguucaauauauacaagcgguccgggauaauggagguggaucgcucagaggcgaaggagggccuaaaacgcggggagaccacgaggcacgccguuucucggggcacagcgaagcugcgaugguuuguggagcggaacuuaguaaagcccgaggggaaggucauagaccucgguugcggacgcgggggcugguccuacuacugcgccgggcugaagaagguaacugaggucaagggcuacaccaaaggcgggcccggccacgaggagccgauuccaauggccacguauggguggaaccugguuaagcuacacagcggcaaagacguguucuucacgccgcccgagaaaugcgauacccuguuaugcgacaucggggaguccagcccgaaccccaccauugaggaaggccggacacuccgcgugcugaaaauggucgagccguggcugcgggggaaccaguucugcaucaagaucuuaaacccuuacaugccguccguuguggagacgcuggagcaaaugcagcguaagcauggcggcaugcugguucggaauccucucucacggaacuccacccacgaaauguacugggugagcuguggaacgggcaauaucguguccgccgucaacaugacaagccgaaugcucuuaaaccgcuucacgauggcucaccgcaagcccaccuacgagcgcgauguggaccucggggcgggaacccgccacguggcuguagagccggaagucgccaaccuggacauuauuggccaacggauagagaauauuaagcacgagcacaaguccaccuggcauuacgacgaagacaauccuuauaaaacgugggcuuaccacgggagcuacgaggucaagccaagcggcagcgccucuagcauggugaacggggugguaaagcugcucaccaagcccugggacguuauuccaauggugacacaaaucgccaugacggacacgaccccguucggccaacagcgcgucuucaaagaaaagguagacacccguacccccaaggcuaagcgcgggaccgcccagaucauggaagugaccgcccgauggcuuuggggcuucuuaagcagaaacaagaagccccggaucugcacuagggaggaguuuacucgaaaggucagguccaacgccgcgauuggagcaguguucguggaugagaaccaguggaacagcgccaaggaggccgucgaagaugagcgguucugggaucucgugcagaaggaacgcgagcugcauaaacaagggaagugugccacaugcguuuauaacaugauggggaagcgagagaagaagcugggggaguucggcaaggccaaggggucacgagccaucugguacauguggcucggcgcccgguuccuagaguucgaggcccuggguuucaugaacgaggaccacugguucagccgcgagaacucuuugaguggggucgagggcgaggggcugcacaagcuaggcuacauccuccgggacauuuccaagauccccggcgggaacauguacgcugacgacaccgccgggugggauacgcgcaucaccgaggacgaccugcagaaugaagcgaagaucacggacauuauggaacccgagcacgcucugcucgcaacuucuauuuucaagcugaccuaucagaauaagguggugcggguacagcgccccgcgaagaacggaaccgucauggacgugauuucccggcgggaccagcgcggcagcgggcaggucgguacguauggcuugaauacuuuuaccaauauggaggcgcaacucauaagacagauggaguccgaggggauauuuuugcccagcgagcuagagaccccgaauuuggcagagcgcgugcuggacuggcuggagaaauacggcgucgagcggcucaagcgcauggccaucuccggggacgacugcgucguaaagcccaucgacgaccgguucgccacggcacuaaccgcccugaaugacauggguaaagugcgcaaagacauuccccagugggagcccuccaagggguggaaugacuggcagcaggucccguucugcucucaucacuuccaccagcucauuaugaaggacggcagagagaucgucgugcccugucgcaaccaggacgagcuagugggccgggcccgcgugagccagggggcaggcuggucccugcgggagacugccugccucggcaagagcuacgcccaaauguggcaguugauguacuuucacagaagggaucugcgacucgcugcaaaugccaucugcagcgcggugcccguggauugggugccaaccucacggacaaccuggagcauccacgcccaccaccaguggaugacgaccgaggacaugcugucaguguggaaccgcguauggaucgaagaaaacccguggauggaggacaagacccauguaagcuccuggggcgacguccccuaucugggcaagcgggaggaccaguggugcggcucgcucaucggcuuaacggccagggccacgugggccuccaacauccaggucgcuauuaaccaggugagaagauuaaucgggaacgaaaacuacuuagacuacaugaccagcaugaagcgcuuuaaaaacgagggagacccagagggugcccugugguga

SEQ ID NO: 24391 - RNA, 9879 nt, Artificial Sequence
  derived and/or modified CDS sequence (opt11) from DENV-1__FJ898415__SS-prME
agcgugaccaugcugcucaugcugaugcccaccgcccuggcuuuccacuuaaccacccggggcggggagccccacaugauagugaccaagcaggaacggggcaaaagccugcuguucaagacauccgcaggggucaacauguguacccucaucgcaauggaucugggcgagcucugcgaagacaccaugacuuacaaguguccgcggaucaccgaggcugagccugaugacguggacugcuggugcaacgccaccgacaccuggguaaccuaugggaccugcucucagacgggugagcaccggcgggauaaacggagcguggcccucgcaccccacgugggccuggggcuggaaacccgcaccgaaacauggaugaguuccgagggcgccuggaagcagauucagcgggucgagacgugggcucuccgccaucccggguucaccgugaucgcccuguuccuggcacacgccauaggcaccucuaucacccagaagggcauuauuuuuauucucuugauguugguuacccccagcauggccaugcguugcgucggcauaggcucccgcgacuucgucgaagggcucagcggcgccaccuggguggacgucgugcuggagcaugggaguugcguaaccaccauggccaaggacaagcccacguuggacaucgagcucuugaagacugagguaaccaaccccgcgguguugcggaaacucugcauagaagccaagaucuccaauaccacgaccgacucccgaugccccacccagggcgaggccacucugauggaggaacaggacgcuaacuucgugugccggagaacguuugucgacagaggcuggggcaacggcugugggcuuuucggcaagggcucucugaucacaugugccaaauucaagugcguaaccaagcuggaaggcaagauugugcaguacgagaaccugaaguacuccgucaucgucaccgugcacacaggcgaccagcaccaggucgggaaugagagcaccgagcauggcaccaccgcgaccauaacgccccaggcccccaccagugagauucaacucaccgacuacggugcucugacccuggacuguucgccccgaacaggccucgacuucaacgaaauggugcugcugaccaugaaagagaaaucguggcucguccacaagcagugguuccuggaccugccguugcccuggaccagcggggccagcaccucccaggagacguggaaccggcaggaccugcuggugaccuucaagaccgcgcacgcaaagaagcaggagguggucguccucggcucccaggagggggccaugcacaccgccuuaacgggcgcgaccgagauccaaaccuccggcacgacgaccaucuucgccgggcaccugaagugccgacugaaaauggauaagcugacccugaagggcaugagcuacgugaugugcaccggguccuucaaacucgagaaagaggucgcggaaacgcagcacggcacaguccugguucagaucaaguacgaggguaccgacgcccccugcaagauccccuuccugacacaggacgaaaagggggucacgcaaaacggccggcugaucaccgccaacccgaucgugacggacaaggagaagcccguaaacaucgaggccgaaccgccuuucggggaaagcuauaucguuaucggcgcgggcgagaaggccuugaagcugucaugguucaaaaaggggagcaacaucggcaagauguucgaggccaccgcccggggggcccggcgcauggcaauacugggcgacacagcgugggacuucggcuccaucggcggcgucuucacuagcguggggaagcucguccaccagaucuucggcacagccuacgggguucuauuuuccggcgucagcuggaccaugaagaucgggaucgguguccugcuuacguggcuagggcugaacucccgcagcaccucucucagcaugaccugcaucgccgucggacuggugacccuguaccuuggcgucaugguacaggcagacaguggguguguuaucaauuggaaaggccgggagcugaaaugcgggagcggcaucuucgucacgaacgaggugcacaccuggaccgaacaguacaaauuccaggcggacuccccgaagaggcugagcgccgccauuggcaaggccugggaggagggggugugcgguauccguagcgccacccgacuugagaacauaauguggaagcagaucuccaacgagcuuaaucacauccugcucgagaacgacaugaaguucaccgucguggugggggacgucgucgguauccuggcgcaggggaaaaagaugauccggccccagcccauggaacacaaguauagcuggaaauccuggggcaaggccaaaaucaucggcgcugacgugcaaaacacgaccuucaucauagacgggccuaacacgccggagugucccgacgaccagcgggccuggaauaucugggaggucgaggacuacggguucgggaucuucaccacuaauauuugguugaagcuccgcgacagcuacacccagguaugcgaccaucgccugauguccgcggcuaucaaggacagcaaggccguucaugccgauaugggcuacuggaucgaguccgagaagaacgagaccuggaaacuggcgcgggccucguucaucgaggucaagaccugcaucuggccgaagagccacacgcucuggagcaacggcguucuggaguccgagaugaucauccccaagaucuacgggggcccgaucucacaacacaacuaccgccccggguacuucacccagaccgccggccccuggcaccuggggaagcucgagcuggacuucgaccugugugagggcaccacagugguuguagacgagcacugcggcaaccggggcccgucucuccgcaccaccaccgugacgggaaagacgauccacgaguggugcugccggagcugcacacugccgccacugcgcuucaagggggaggacggcugcugguacgggauggagauccggcccgucaaggagaaggaggagaaccucgugaaguccaugguguccgcuggcuccggcgagguagacagcuucagcuuagggcugcucugcaucuccaucaugaucgaggaggugaugcgcagucgguggucccgaaaaaugcuaaugaccggaacuuuagccguguuccuccugcucaucauggggcaacuuaccuggaacgaccugauccggcugugcauuaugguaggugccaacgcgagugacaggauggggaugggcaccacuuaccucgcucugauggccacauuuaagaugcgccccauguucgcagucgggcuacucuuccgucgccugaccagucgggagguacugcuccugaccaucgggcugagccucguagcuuccguagaacugccgaacucucuggaagagcucggcgacgggcucgcgaugggcauuaugaucuuaaagcuccucaccgacuuccagucccaccagcugugggcuacgcuccugagccugaccuuuauaaagaccacccucucccuccacuacgccuggaaaacuauggccaugguacugagcauaguaucccuguucccccugugcuugagcaccaccucccagaagacuacguggcuccccgugcugcugggcagccucgggugcaagccguuaaccauguuccugauugcggagaauaagaucuggggacgcaaguccuggccccucaacgaggggauuauggccgucggcguggugucgauacugcuguccucccuccuaaagaacgaugucccccuggccgggccccucauagccggcggcaugcugauagccuguuaugugauuagcggguccagcgcggaccugucccucgagaaggccgccgaggugagcugggaggaggaggccgagcacuccggggccagccacaacauccugguugagguccaggacgacgggacuaugaagaucaaggacgaggagcgggaugauacccuaaccauccuccuuaaagcgacccuucuugccguguccggagucuacccucugucuaucccugcaacucuguuugugugguacuucuggcagaaaaagaagcagcgcucgggggugcugugggacacccccagcccgcccgaggucgagcgugccgugcucgacgacggcaucuaccgcaucaugcagcggggacucuuagggcgcucccaggugggcgucggcguguuucaggagaacguguuccacaccauguggcacgugacgcggggcgccgugcucauguaccaggggaagaggcuggagcccagcugggcguccgugaagaaggaucugaucagcuacggcggcggguggcgucuccagggcuccuggaacaccggagaggagguccaggugaucgccguggagccggguaagaaccccaagaacguccagaccgcccccgggaccuucaagacgcccgagggcgaggugggcgccaucgcccuagacuucaaacccgggacgagcggcagccccauagugaaccgcgaggggaagaucgucggccucuacggcaacgggguggugaccaccucuggcacguaugucagcgcgaucgcccaggcaaaggccagccaggaagggccccucccggagauugaggacgagguguuccggaagcgcaaccugacaaucauggaccugcaccccggcagcgggaagacccggcgcuaccucccggcaauagugagagaggccaucaagcgcaagcugcggacccuaauccucgcccccacgagggucguugccuccgagauggcagaagcgcucaagggcaugcccauccgcuaccagaccacggccgucaaaagcgagcacaccggcaaggagaucgucgaccucaugugccacgccacguuuacuaugcgacuccugagccccgugcgcgucccaaacuauaacaugauuaucauggaugaggcccacuucaccgaucccagcuccaucgccgcgagaggguacauaagcacccgagucggcaugggggaggccgccgccaucuuuaugaccgccacgccgccgggcucuguggaggcguuuccacagucgaacgccguaauccaggacgaggagcgggacauccccgagcgcuccuggaacagcgguuaugaguggaucaccgacuucccugggaagacugucugguucgugccauccauuaaaagcggcaacgacaucgccaacugccugcggaagaacgggaagcgcgugauccaacucucccggaaaacguucgacaccgaguaucagaagacaaagaacaaugacugggacuacgucgucaccacggauaucucugagaugggugccaacuuccgcgcggaucgggugaucgacccgcgccggugccugaagcccgucauucugaaagacgggccagagcgcgugauccucgcgggucccaugccaguuacuguggcuuccgccgcccagcggcgcgggcggaucggccgcaaccacaacaaagagggcgaucaguacauuuacauggggcagccauuaaauaacgacgaagaccacgcgcacuggaccgaagcaaagaugcugcucgacaacauaaacacccccgagggcauaaucccagcccuuuuugagccugagcgggagaaguccgccgccauugacggggaguacaggcugcgcggagaggcacgaaagacguuuguggaacucaugcggagaggcgaccugcccguaugguuauccuacaaaguggcuuccgaaggcuuccaguauucagaccgccgguggugcuucgacggagagaggaauaaccaggugcucgaggagaacauggacguagagaucuggaccaaggagggugagcggaagaagcuccgcccccgguggcuagacgcuaggacauacagcgacccccucgcccugcgagaguuuaaggaguucgccgcgggcaggcggucuguguccggggaccugauccucgagaucgguaagcugccgcagcaccugacccagcgcgcccagaacgcccucgacaaccuggugaugcuacauaauagcgagcagggcgggcgggccuaccgccacgcgauggaggagcuucccgauacuaucgagaccuuaaugcugcucgcccugaucgcagugcugaccggcggggugaccuuauuuuuucuauccggccgggggcugggcaaaaccagcaucggccuccucugcgugauggcuucaagcgugcuccucuggauggcguccguggaaccccauuggaucgcggcuagcaucauuuuggaguucuuccugaugguacuccugaucccugagccggaccgccaacggacgccccaggacaaccagcuggccuacgucgugaucgggcuccuguucaugauccugaccguggccgccaacgaaaugggccuccuggagacgaccaaaaaagaccucgggauugggcacgucgcgguggagaaccaccaucacgcgacgaugcucgacguggaccugcaccccgccuccgccuggacccuguacgccguugcgaccacgauuauuaccccgaugaugcgccacaccaucgaaaacacaaccgccaacauuagcuugacggccaucgcgaaccaggccgcgauccugaugggucuggacaagggcuggcccaucuccaagauggacaucggcgugccccuccuagcccuggggugcuacagccaggugaacccccucacccugacagccgccguccugaugcuuguggcgcacuacgccauuauuggcccggggcugcaggccaaggcgacccgggaggcccagaagcgcaccgcggccggcaucaugaagaacccuaccguggacgggauuguugccaucgaccuggaccccgugguguacgacgccaaguucgaaaagcagcucggacagaucaugcugcugauacucuguacaucccaaauccugcugaugcggaccacgugggcccucugcgagagcaucacccuggccaccggcccccugacuacgcuaugggagggguccccgggcaaauucuggaacacuaccaucgcugucagcauggccaacaucuuccggggguccuaccuggccggcgccggccuggcguucagcuuaaugaagucccuagggggugggcggcgagggaccggggcccagggcgagacgcugggagagaaguggaagcgccaguugaaccagcugagcaaaagcgaguucaacauuuacaagcgguccgggauaauggaggucgaccgcagugaagccaaggagggccugaagcgcggggagaccacccggcaugccgugucccggggcacugcuaaguuacgcugguucguggagcggaaccucgugaagccugaggggaaaguuaucgacuugggcugcggccgcggaggcuggaguuacuacugcgcuggguuaaagaaggugacugaggugaaggguuacaccaagggcggaccaggccacgaagagcccaucccgauggccaccuauggauggaaucucguuaaacugcacuccggaaaggacgucuuuuucacgccucccgagaaaugugacacgcuguuaugcgacaucggggagucaucccccaauccgacuaucgaggagggcagaacccugcgcgugcugaaaaugguggaacccuggcuccgggggaaccaguucugcaucaagauccugaaccccuacaugcccagcgucguggagacccuggagcaaaugcagaggaagcacggcggcaugcuggugaggaacccgcugucccgcaacagcacccacgagauguacugggucuccugcgggacgggcaacauagucagcgccgugaacaugaccuccagaaugcugcucaaccgcuucacuauggcccauaggaagccuaccuacgagagagacgucgaccugggggcaggcacgcgccacguggccguggagcccgagguagccaaccuagacaucaucggccagcggaucgagaacauuaagcacgagcauaagagcacuuggcacuacgacgaagacaaccccuacaagaccugggccuaccacggguccuacgaaguaaagccgagcgguuccgccagcuccauggucaacggggugguaaaguugcucaccaagccgugggacgucaucccaauggucacgcaaaucgcgaugacugacaccaccccuuucggccagcagcggguguucaaggagaaggucgauacgcgcaccccgaaggcaaagcgagggaccgcccagaucauggaggugaccgcccgguggcuguggggcuuccucucccgcaauaagaagcccaggaucugcacucgcgaggaguucacccggaaagugcgcagcaacgccgcgaucggcgccguuuucguggaugagaaccaguggaacuccgccaaggaggccguggaggaugagcgguucugggaccugguccagaaagagcgcgagcuucacaagcaggggaagugcgccaccugcguguacaacaugaugggaaagcgggagaagaagcuaggcgaguucggcaaggccaaagggagccgcgcaaucugguacaugugguugggcgcccgguucuuggaguucgaggcccugggcuucaugaacgaagaccacugguucucccgcgaaaacagccuguccggaguggagggugaggggcugcacaaacucggauacauucugcgcgacaucagcaagauccccgggggcaacauguacgcggacgacacugccggcugggauacgcgaaucacugaggacgaccuacagaacgaggccaaaaucacagacaucauggagccugagcaugcccuccuggccaccuccaucuuuaaguugacguaccagaauaagguggugcgagugcagcgccccgcgaagaacgggacagucauggacgugaucagccgacgagaccagcgcggcuccggccaggucggcaccuacggccucaacaccuucacgaacauggaggcacagcugauccggcagauggagagcgaagggaucuucuccccuagugagcuggagauccccaaccuagcggagcgcguccuagauuggcuggagaaguacgggguggagcgucucaagcgcauggccaucuccggagacgacugcgugguaaagccgaucgacgacagauucgcuaccgcucugacggcccugaacgacaugggcaaggugcguaaggacguaccucagugggagccaagcaaaggguggaacgacuggcagcaggucccguuuuguucccaccauuuccaccagcucauaaugaaggacggccgcgagaucguugugccgugcaggaaccaggacgaacuggucgggcgggcccgagugagccaaggggccggcuggucccugcgggagaccgccugccucggaaagagcuacgcccagauguggcagcugauguacuuccacaggcgggaccugcgccucgccgccaacgccauuuguagcgcagugcccgucgauuggguucccacgucccggaccacauggagcauccacgcccaccaccaguggaugaccacggaggacaugcugagcguauggaaucgggucuggaucgaggagaaccccuggauggaggacaaaacccacguuuccuccuggggcgacgugccuuaucuggggaagcgggaagaccaguggugcggcagccucauuggucugaccgccagggccaccugggccuccaacauccaggucgccaucaaccaggugcgcagacugaucgggaacgagaacuaccucgacuauaugaccuccaugaagcgcuucaagaacgagggcgaccccgagggggcacucugguga

SEQ ID NO: 24392 - RNA, 9879 nt, Artificial Sequence
  derived and/or modified CDS sequence (opt11) from DENV-1__FJ898416__SS-prME
agcgugacgaugcugcucaugcuaaugccaaccgcgcuggcauuccaccucacuacccgagggggggaaccccacaugaucgugaccaagcaagagcgcgguaagucacugcuguucaagacuagcgcuggggugaacaugugcacccucaucgccauggacuuaggcgagcugugcgaggauaccaugaccuacaagugcccccggaucaccgaagcugagcccgaugauguggacugcuggugcaacgcaaccgacacaugggugaccuacggaaccuguagccagaccggcgagcaccggcgcgacaagcgaagcguggcccucgcgccccacguggggcuggggcuggagacucgcaccgagaccuggauguccucagaaggagccuggaagcaaauccagcgggucgaaaccugggcacuccgccacccgggauucaccgugaucgcccuguuucuggcgcacgccaucggcaccuccaucacccagaaagggaucauauucaucuugcucaugcuaguuacgcccucaauggccaugcggugcgucggcauaggcucccgagacuuuguggaggggcucagcggcgcgacguggguggaugucgugcuggagcaugggucuugcgugaccaccauggccaaggacaagcccacauuagacauugaguuacugaagaccgaggucacgaauccggcggugcugcggaaguuaugcaucgaggccaaaaucucgaacaccacuacggacucccgcugcccgacccaaggcgaggccacccugauggaggagcaagaugcgaauuucgugugccgucgcacguucgucgaccggggcuggggcaacggcugcggacuguucggcaaggggucccucaucacgugcgccaaguucaagugcgugaccaagcuggaaggcaagaucguacaguacgagaacuugaaguacuccgucaucgugaccgugcacacaggcgaucagcaccaagucggcaacgaaagcacagagcacggcaccaccgcgaccaucacgccccaggcccccaccucggagauccagcucaccgacuacggggcccuuacccuugauugcagcccccgaacgggccuggacuucaacgagauggugcugcucacuaugaaggagaaguccuggcugguacacaaacagugguuucuagaccucccguugcccuggaccagcggggccucuacuucucaggagacguggaaccggcaagaccugcuugugaccuucaagaccgcccacgccaagaaacaggagguggucgugcucggcagucaggagggagccaugcacaccgcccugaccggggccaccgaaauccagaccuccggcaccacgaccaucuucgccgggcaucugaagugccgccuaaagauggacaaacugacucugaagggcaugucguacguaauguguaccgggagcuucaagcucgaaaaggaggucgcggagacgcagcacggcacagugcuggugcagaucaaauacgaggggaccgacgcucccugcaagauucccuucagcacccaggacgagaagggggucacgcagaacggccggcuaaucaccgcaaacccgaucgugaccgacaaagagaagccaguaaacaucgaggccgagccgccguuuggggaguccuacauagucaucggcgcuggcgaaaaggcucugaagcucagcugguuuaaaaaaggcuccagcauaggcaaaauguucgaggccaccgcccgcggggcgcggcggauggcgauccugggcgacacggccugggacuuugguucgguaggcgguguguucaccagcgucgggaaacucgugcaucagaucuucggcacagcguacgggguacuguucuccggcgucagcuggaccaugaagauuggcaucggcgugcugcugacuuggcucggcuugaacucccgcagcaccucccugagcaugacaugcaucgcaguggggcucguuacccuguaccugggagugauggugcaggccgauagcgggugugucauaaacuggaagggcagggagcucaaaugcgggagcggcaucuucgugacgaacgagguacauaccuggaccgaacaguacaaguuucaggcggacucgccgaagcgccugagugcggccaucggcaaggccugggaggagggggucugcggcauccggucggccacccgccuggagaacaucauguggaagcagaucuccaacgagcuuaaccacauccuguuggagaacgacaugaaguuuaccgugguagucggggacguggugggcauucucgcgcaaggaaagaagaugauucggccucagcccauggagcacaaguacuccuggaaauccuggggcaaggcaaagaucaucggcgccgacguccaaaacaccacguucaucaucgacgguccgaauacaccggagugccccgaugaucagagagccuggaauaucugggagguggaggacuacggcuucgguaucuucacaacuaacaucuggcugaagcuucgggacagcuacacccaagucugcgaccaccgccucauguccgcagccauaaaagauaguaaggccguacacgcugacaugggauauuggaucgagucagagaagaacgagaccuggaaacuugcgcgugcgagcuucaucgaagugaagaccugcauuuggccaaagucucacacgcuguggagcaacggugugcuagaguccgagaugauuauaccaaagauuuaugguggcccgaucucgcagcacaauuaccgccccggguacuucacccagaccgccggccccuggcacuuggggaagcuugaacucgacuucgaccugugcgagggcacgacggucgugguggacgaacacugcggaaaccgggggccgucuuuacgcaccaccacagucacgggcaagaucauccaugaguggugcugccggucgugcacccugccgccacuccgcuucaagggggaggacggauguugguacgggauggagauccgccccgugaaggagaaggaagagaaccuggugaaauccaugguuucggcaggcagcggcgagguggacuccuucagcuuggggcugcugugcaucagcaucaugaucgaggaagugaugagaagccgguggucccgcaagaugcucaugaccggcacccuggccgucuuccuccuccugaucaugggccaacuuacguggaacgaccucauccggcuguguaucaugguaggcgccaaugcgagugaccgcauggggaugggcaccaccuaccuggcccugauggccacuuucaagaugcgcccgauguucgcaguugggcuccuguuccggaggcucacgucucgggagguccugcugcucaccauagggcugagccugguggcauccgucgaauuaccgaacucacuugaggagcugggcgacggucucgcuaugggcaucaugauccugaagcugcucaccgacuuccagucccaccaacugugggccacguuacucagccugacguucaucaaaaccacgcugagccuacacuaugcguggaagaccauggccaugguccugagcauugcuucccuguuccccuugugccugagcacgaccucccagaagaccaccuggcugccaguccucuugggcagccugggauguaaaccacucaccauguuccuuauuaccgaaacgaagaucuggggccggaaguccuggccccugaacgaggggauaauggcagucggcguggucagcauucucuugagcucccugcucaaaaacgaugucccccuggccgggccccugauagccggcggaaugcuaaucgccugcuacgugaucucgggcucuagcgcggaccugucccuggagaaggccgccgaggugagcugggaggaggaggccgagcacuccggcgccagccauaacauucucgucguggugcaggacgacgguaccaugaagauaaaggacgaggaacgggacgacaccuuaacgauacugcucaaggcgacgcugcuggccgucuccggcguuuacccacucagcauccccgcgaccuuguucgugugguacuuuuggcaaaaaaagaagcagcggucagggguccugugggacacgcccagcccuccagaggucgagcgggccguguuggacgauggcaucuauagaaucaugcagcggggucucuuagggcguucccaggucggcguuggagucuuccaggagaauguguuucacacaauguggcacgucacccggggcgccguucugauguaucaggggaaaaggcucgagcccucuugggcauccgucaaaaaggaccuaaucagcuacggcggcggguggcggcugcagggcuccuggaacacgggugaggagguccaggugaucgccguggaacccggcaagaacccaaagaacgugcagaccgcucccgggacguucaagacacccgagggcgaagugggcgccaucgcccuagacuucaagcccgggacaagcggcuccccuauagucaaccgagagggaaagaucgugggccuuuacggcaaugggguggucaccacaagcggcaccuaugugagcgcgauugcccaggcgaagaccagucaggaggggccacugcccgagaucgaggaugaggucuuucgaaagcgcaaucucaccauaauggaccuacacccgggcagcgggaagacucggcgcuaccugccugccauaguccgggaggcuauaaaacgcaagcuccggacgcugauccucgccccuacccgcgugguggccucagagauggccgaggcacucaagggcaugcccauccguuaccagaccacggcaguaaagucggagcacaccggcaaggagaucguagaucugaugugccacgcaaccuucacuaugcggcuacucucccccgugcgcgucccaaacuacaacaugauaauuauggacgaagcgcacuucacggaccccagcuccaucgccgcccggggcuacaucucuacccgcgugggcaugggggaggcggcugcuaucuucaugaccgcgacgccccccggcaguguugaggcguucccgcaaagcaacgcuguuauccaggacgaggagcgggacauaccggaacgcuccuggaacucuggauaugaguggaucaccgacuuccccggcaagaccgugugguuugugcccuccauuaagagcggaaacgacauugcuaauugcuuacggaagaacgggaagcgcgugauccaacugucccggaagaccuucgauaccgaguaccagaagacaaagaacaacgacugggacuauguggugaccaccgacaucucugagaugggugccaacuuccgcgccgaccgggucauugacccgcgccggugccucaagcccguaauacugaaggaugggcccgagcgcgucauccuggcgggccccaugcccgugaccguggccuccgcugcgcagcggcgcgggcggaucggcaggaaucacaacaaagagggcgaccaauacaucuacauggggcagccacucaacaacgacgaggaccacgcccacuggacggaagcgaagauguugcuggacaacauuaacacccccgagggcauuaucccggcccuguuugagccggagcgugaaaaguccgcagccaucgauggggaguaccgcuuaagaggugaggcgcguaagacuuucgucgagcuuaugaggcgcggggaucuaccgguguggcuuuccuacaagguggcuuccgaggguuuccaauacagcgaucgccggugguguuucgacggcgagcgcaacaaccaaguccuggaagagaacauggacguugaaaucuggaccaaggaaggggagcggaaaaagcuccgaccccggugguuggaugcucgcacguacagugauccccuggcccuccgagaguucaaagaguucgccgccggucgccggagcguuaguggcgaccugauccuggaaaucggcaagcucccgcagcaccugacacagagagcgcagaacgcccuggauaaccucguuaugcugcacaacucggagcagggcgggcgggcauaccgccacgccauggaggagcuuccugacaccaucgagacccucaugcugcuggcgcugaucgccgugcuuaccgguggggugacgcuauucuuccucucgggccggggccugggcaagaccagcaucggccugcucugcgucauggccuccucugugcugcuguggauggcaaguguggagccacacuggauugcugcgagcaucauacucgaguucuuccugaugguccugcuaauccccgagccggaucgccagcguacgccccaggacaaucagcuggccuacguggugaucgggcuccucuucaugaucuugaccguugccgcaaacgagaugggccugcucgagacgaccaagaaggaucuugguaucggccacguggccguggaaaaccaccaccacgcaacuaugcuggacgucgaccuccacccagccuccgccuggacccuguaugccguggccacuacgaucauuacaccgaugaugcgccacaccauugagaacacgacggcgaacauuagucugacggccaucgcuaaccaggccgccauccucauggggcuugacaagggcuggccuaucuccaagauggacauaggcgugccacuucuugcgcuggggugcuacagccaggucaacccccuaacccucacggccgccgugcugaugcuuguggcucacuacgcaaucauuggcccugggcuccaggcaaaggcuacccgugaggcucagaagagaaccgcggcgggcauuaugaaaaacccuaccgucgacggaaucguggccaucgacuuagacccuguggucuacgacgcuaaguucgagaagcagcugggccagaucaugcuccugauccuaugcacgucucagauccugcugaugcguacuaccugggcccugugcgagagcaucacccucgcuacuggcccgcugaccacccugugggaggguuccccggggaaguucuggaauacaacgaucgcaguuagcauggccaacaucuuccggggguccuaccucgcaggcgccggcuuagccuucagccugaugaaaucccucgggggcgggaggcgggggaccggggcucagggcgagacccugggagaaaaguggaagcgccaacugaaccaacucuccaagagugaauucaacaucuauaagcgguccgggauaauggaggucgacagaagcgaggcaaaggaaggccucaagcgcggugagacuacacgccacgcagucucccggggcacugccaagcuacgcugguucguugagcggaaucuggugaagcccgagggaaaggucaucgaccucgguugcggccgcgggggcugguccuacuacugcgcuggguuaaagaaggugaccgaagucaaaggcuacaccaaggguggccccggccacgaagagcccaucccgauggccacauacggcuggaaucucgucaagcuccacuccggcaaggacguguucuuuacgccgcccgagaagugcgauaccuuacuaugugacauaggggagagcucgccaaacccgaccaucgaggagggccguacccuccggguguuaaagauggucgagcccuggcugcgagggaaucaguucugcaucaaaauauuaaacccauauaugccgucggugguugagacccuggagcagaugcagcgcaagcacggcggcaugcugguccgaaacccgcugucccguaacagcacccacgagauguacugggugaguugcgggacaggaaacaucgugagcgccgucaacaugacuuccaggauguuacugaaucgcuucacaauggcccaucgcaaaccaacguaugagcgggauguggaccucggggcgggcacgcgccacgucgcggucgagcccgagguagccaaccuggacaucauuggccagcggaucgagaacaucaagcacgagcacaaaagcaccuggcacuacgaugaggauaaccccuauaagacgugggccuaccacgggagcuacgaggucaagccgagcggcagcgccagcuccauggucaacggaguugucaaacugcucaccaagccaugggaugugauacccauggugacccagauugccaugaccgacacgacucccuucgggcaacagcgcgucuucaaggagaagguggauacccggacuccgaaagcgaaacgcgggacggcacagaucauggaggugacagcccgguggcuguggggauuccugucccgaaacaagaagccgcggaucugcacacgcgaagaauuuacccggaagguccgcagcaacgccgccaucggcgcgguguucguggacgagaaccaguggaauuccgcuaaggaggccgucgaggacgagcgguuuugggaccucguucagaaagagcgcgagcuccacaaacaggggaagugugcaacgugcguguacaacaugaugggcaagcgggaaaagaaacugggugaguuuggcaaggcuaaagggucgcgcgccaucugguacauguggcucggcgcgcgguuccuggaguucgaggcccugggcuucaugaaugaggaccacugguucucccgcgaaaauagccucuccggggucgagggcgaagggcuacauaagcugggcuacauucuccgggacaucuccaaaauacccgggggaaauauguacgccgaugacaccgcgggcugggacaccaggaucaccgaggacgacuuacagaacgaagccaagauaacggacaucauggagccggagcacgcguuacucgccacguccaucuuuaagcucacuuaccagaacaaggugguccggguccagcggcccgccaaaaacggcacggucauggacgugaucagccgcagagaccagcguggcuccgggcaggucggcacguauggccugaacaccuucaccaacauggaggcgcagcuuauccggcagauggaguccgaggguauauuccugccuuccgagcuggagacucccaaccucgcagagcggguccuggacuggcuggagaaguacgguguggagaggcucaagcgcauggccaucagcggugacgauugcgucguuaagccgaucgacgaccgguucgcgacagcccugaccgcucuuaacgauaugggcaaggugcgcaaggacaucccccagugggagcccuccaagggguggaacgauuggcagcagguacccuucugcucucaccacuuccaccaacuaauaaugaaagauggccgagaaaucguggucccuugccgcaaucaagaugaacuggucggccgugcccgcgucucccagggugccgguuggagccuacgagagacggcgugccucggcaagagcuacgcccaaauguggcaacugauguacuuccaccgccgggaccugcgacucgccgcaaacgcgaucugcucagccgugcccgucgacuggguccccaccagccggacgaccuggucaauccacgcacaucaccaguggaugaccaccgaggacaugcugucgguguggaaucgcgucuggaucgaggagaaccccuggauggaggacaagacccacguguccagcuggggagacgucccguacuugggcaagcgagaggaccaguggugugguucauuaaucggccugaccgcccgugccaccugggccagcaacauacaaguggccauuaaccaggugcgccgucuuaucggcaacgagaacuaccucgacuacaugacgucaaugaagagauucaagaacgagggcgacccagagggggugcugugguga

SEQ ID NO: 24393 - RNA, 9879 nt, Artificial Sequence
  derived and/or modified CDS sequence (opt11) from DENV-1__FJ898417__SS-prME
ucgguuaccaugcuucuaauguugaugcccaccgcacuggccuuccaccucacgaccagaggcggggagccccacaugaucguuagcaagcaggagcggggcaagucacugcuguucaagaccucagccggcgugaacaugugcacccucauugccauggaccugggcgaguuuugcgaggacacaaugacguacaagugcccccgcaucacggaggccgaacccgacgacguggacugcuggugcaacgcgaccgacacgugggugaccuaugggaccugcagccaaaccggagaacaccggcgggauaagagguccguggcccuagcaccccacgugggucucgggcuggagacgcgcaccgagaccuggauguccuccgagggcgccuggaagcagauccagcgggucgagaccugggcucugaggcaccccggguuuacggugaucgcccucuuucuggcacacgccauaggcaccucaaucacccagaaggggaucauauucauccugcugaugcugguaaccccuuccauggccaugcgcugugugggaaucggcagccgcgacuucguggaggggcuguccggcgccacauggguggacgucguacucgagcacgggagcugugugacuaccauggccaaggauaagccuacccuggacaucgagcugcugaagacggaggucaccaacccggccguacugcgcaagcugugcaucgaggccaaaaucuccaauaccaccacggacagccguugcccgacccagggcgaagccacccucguggaggaacaggacgcuaauuucgucugucggcgcacguuuguggacagaggcuggggcaacggcugcgggcuguucggcaagggaucccugauaacgugugccaaguucaagugcgugacaaaguuggaaggcaagaucguccaguacgaaaauuuaaaguauagugugaucgugaccguacacaccggcgaccaacaccagguugggaacgaguccacggagcacggcaccaccgcgaccaucacgccccaggcacccaguacggagauccagcugaccgauuacggggcccucacccuggauugcagcccccgcacaggccuggacuucaacgagaugguccuucugacgaugaaagagaaguccuggcugguucacaagcagugguuccucgaccugccgcugcccuggaccagcggagcguccaccagccaagaaacauggaaccguaaagaccugcuggugacguucaagaccgcccacgcgaagaagcaggagguuguggugcugggcagccaggaaggcgccaugcauacggcccucaccggagccacagagauccagacaagcggcacgaccacuaucuucgcaggucaccugaagugccgccucaagauggauaagcucacucugaagggcauguccuacguuaugugcaccgggagcuucaagcuggagaaagagguggccgagacacagcacggcacgguacucguacagaucaaguacgagggcacggacgcccccugcaagauccccuucuccacccaggacgagaagggugugacccagaacggccggcugaucacggccaacccgaucgugacugacaaagaaaagcccgugaacaucgaggccgaaccgcccuucggggagagcuacaucgugaucggcgcuggcgagaaggcucuuaaauuguccugguucaagaaggggagcuccauuggcaaaauguucgaggccaccgcccgcggggcccggaggauggcgauccucggcgacaccgccugggacuucgggagcaucggcggcguguuuacauccguagggaagcugguucaucaaauauucggcaccgccuacggggugcuguucaguggcgucuccuggaccaugaagauugggaucggcgugcuccugaccuggcugggacucaacagccgcuccacaagccuguccaugaccugcauugccguggggcuggucacccucuaccugggcgugauggugcaggccgauucgggaugcgucauuaacuggaagggccgggagcugaagugcgguagcggcaucuucguaaccaacgagguacacacguggaccgagcaguacaaauuccaggcggacuccccgaaacgccuaagcgccgccaucggcaaggccugggaagagggggucugcggcauccggucugccacgcgacuugagaacaucauguggaagcagaucagcaaugaacugaaccacauccuccuggagaacgacaugaaguucaccguuguggucggggacguggcaggcauccuggcccaggggaagaagaugauccguccccagccgauggaauacaaguacuccuggaaguccugggguaaggccaagaucauaggcgccgacgugcaaaacacgacguucaucaucgacgggcccaauacccccgagugccccgacgaucagcgggcguggaacaucugggaggucgaggacuacggcuucgggaucuucaccaccaacaucuggcugaaacugagggacucguauacccaggugugugaccaccgccugaugagcgcagccauaaaggauuccaaagcagugcacgccgacaugggguacuggaucgagagcgagaagaaugagaccuggaagcuugcacgggccucauuuaucgaggucaagaccuguaucuggcccaagucgcacacccuaugguccaacggcgugcuggagagcgagaugauaaucccuaagauuuacgguggcccgaucucccagcacaacuaccgccccggguacuucacgcagacugccggccccuggcaccucgggaagcuugagcuggacuucgaccucugcgagggcaccacgguagugguggaugagcacugcggcaaccgggggcccucacuacgcacgaccaccgugaccggcaaaaucauccacgaguggugcugucgauccugcacucugccaccccugcgcuucaagggggaagacgguugcugguacgggauggagauccggcccgugaaggagaaagaggagaaccuggugaaaagcauggugagcgccgguucgggcgaggucgacagcuucagucugggucuccuuugcaucagcaucaugaucgaggaggugaugcgcucccguuggagccgcaagaugcugaugaccggcacacucgccguauucuuccugcugaucauggggcagcucaccuggaacgaccuuauccggcuuugcauuauggucggggcgaacgccuccgaccgcauggguauggggacgacauaccucgcccugauggccacguucaagaugcgcccgauguuugccguggggcuccuguuccguaggcugaccagccgggaggugcugcuucugacgaucgggcugucccuaguggcgagcgucgaacugcccaacagucuggaggaacugggcgaugggcuggccaugggcauuaugauccuuaagcucuugaccgacuuccagagccaccagcugugggccacccuccugucacugaccuucauaaagacgacauucucccuccauuacgccuggaagaccauggcgaugguccuguccauugugucacuguucccucucugccugucuaccacgagccagaagaccaccuggcugcccgugcuccugggcucacuggggugcaagccgcucaccauguuccugaucgccgagaacaagaucuggggucgcaaaagcuggccccugaacgaggggaucauggccgucggcaucgucagcauccuccuguccgcccuucucaaaaacgaugucccccuggcugggccucugaucgcggggggcaugcucauagccugcuacgucaucagcggguccagcgccgaccugucguuagagaaggccgccgaggugagcugggaggaggaggccgagcacuccggggcgagccacaauauccucguggagguccaagacgacggaacgaugaagaucaaggacgaggagcgggacgacacucuaacgauccuguuaaaggcaacgcuucuggccguuuccggcguuuacccucugagcauucccgcaacacuguucgucugguacuucuggcagaagaagaagcagcgcagugggguguuaugggauacgcccagcccgcccgagguggagcgggcuguccucgaugacggcaucuaccgcaucaugcagagaggccuacuggggcguucccaggugggcgugggcgucuuucaggagaacguguuucacaccauguggcacgugacccgcggcgccguucugauguaccagggaaagcgccucgagcccagcugggccuccgugaagaaggaccuaaucucguacggcgguggguggcggcugcaagguucguggaacaccggagaggaggugcaagugaucgccguggagccaggcaagaaucccaagaacgugcaaacggcccccggaacguucaagacuagcgagggcgaggugggagcgauagcccucgacuucaagcccggaaccucaggaagccccaucguaaaccgcgaggggaagaucguggggcuguacggcaacggggucgugacgacgagcggcacuuacgugucagcgauagcccaagcgaaggccucacaggaggggccacugccggagauagaagaugagguauucagaaagcgcaaccuaacgaucauggaccugcaccccgggagugggaagacgcggcgcuaccugcccgccaucgugcgagaggcgauaaagcgcaaacuccggacccugauccuggccccgacccgcguggucgcgagcgagauggccgaggcccucaagggcaugccaauacgcuaucaaaccacagccgugaagucugagcacacuggcaaggagaucguggaccuaaugugucacgccaccuucaccaugcggcugcucagcccaguccgcgugccgaacuauaacaugauuauaauggaugaggcgcacuucacggacccaaguagcaucgcugcacggggguauauauccacacgagucggcaugggcgaggccgccgccaucuucaugaccgcaacgccgcccggcagcgucgaagccuucccacaaucgaacgccgugauucaggacgaggaacgcgacaucccggagcgcagcuggaacuccggguacgaauggaucacggacuucccuggcaagacugugugguucgucccuucaaucaaguccggcaacgacaucgccaacugccugcggaagaacgggaagcgcgugauccaacucagcagaaagaccuucgacaccgaguaucagaagaccaagaauaacgacugggacuacguggucaccaccgacaucuccgagaugggugccaacuuccgugccgaccggguaaucgaccccagacgcugucucaagccggucauccugaaagaugggcccgagcgcgucaucuuagccggccccaugcccgugaccgucgccagcgcggcccagcgccgcggucggauaggcaggaaccacaacaaggagggggaucaguacaucuacauggggcagccgcugaacaacgacgaagaccaugcccacuggacggaggcgaagaugcugcuggauaacaucaacacccccgagggcaucauccccgccuuauucgagcccgaaagagaaaagucggcggccauagacggggaguaccgccuaaggggcgaggcacguaaaaccuuuguggaacugaugcgccggggggaccucccggugugguugagcuauaagguggccagcgaaggcuuccaguacuccgaccgccgguggugcuucgacggggagcgcaauaaccagguacuggaggagaacauggacguggagauauggacuaaggaaggggagcggaaaaaacuacgcccucgauggcuggacgcacgcacuuacagcgacccccuggcgcugcgggaguucaaggaguucgccgccggccgccgguccgucagcggggaccugaucuuagagaucggcaagcucccccagcaccugacccagcgcgcccaaaaugcgcuggacaaucucgugauguuacacaacuccgagcagggggggcgggccuaucgucacgccauggaggagcuuccggacaccaucgagacccucaugcugcuggcccucauugcugugcugacgggcggcgucacccuguucuucuuaagcggccggggguuaggcaagaccuccaucggccugcuaugcgucauggcgagcagcgugcuacuguggauggccagcgucgaaccccauuggaucgcagccuccaucauccuggaguuuuucuuaauggugcugcucauaccugagcccgaccgccagaggaccccacaggauaaccaacucgccuacgucgucaucgggcuccuuuuuaugauccugacuguggcggccaacgagaugggccugcucgagacgaccaagaaggaccuggggaucggccacguugccgucgagaaccaccaccacgccgccaugcuggacguggaccuccaccccgcgucggcguggacccuguacgcgguagccaccacgaucaucacaccgaugaugcgccacaccaucgagaauaccacggccaacaucuccuugacggcgaucgccaaccaggccgccauccucaugggcuuagacaagggcuggccgaucucgaagauggacaucggcguaccccugcucgcgcuggguugcuauucacagguuaacccccugacgcucaccgccgccguacucaugcugguugcacacuacgcgaucaucggaccagggcuccaggcgaaagcuacacgcgaggcucaaaagcgcacagccgccggcauuaugaagaacccgaccguggaugggaucguggcgauugaccuugaucccgucguuuacgacgccaaguucgaaaagcaguugggccagaucaugcuccucauccugugcaccagccagauccuucugaugcgcacgaccugggcccugugcgaguccauuaccuuggcaaccggcccccugacgacccugugggagggcagcccgggcaaauucuggaacaccacaaucgccguauccauggcaaacaucuuccgggggagcuaccucgccggcgccggccuugcuuucagcuugaugaagagucucgggggcggccgccggggcacgggagcucagggcgagacccuaggcgaaaaguggaagcgccagcugaaccagcugagcaaguccgaguucaacaccuacaagcggagcgggaucauggaggucgaccgcuccgaggccaaggagggccucaaacgcggggagaccacaaagcacgccgugucgcguggaaccgcgaaguugcgcugguucguggaacgaaaccucgucaagccagaggggaaggugaucgaccugggcuguggccgcggcgggugguccuacuacugugcaggguugaagaaggugaccgagguaaagggguauaccaagggcgggcccggccacgaggagcccaucccuauggcgacguacggguggaaccuaguuaagcuccacagcggaaaggacguguucuucauuccgccggagaagugugacacacugcugugugauaucggcgagagcagccccaaccccacaaucgaagaaggccgcacccuccggguccugaagaugguggagccguggcugcgcgggaaccaguucuguauaaagauccucaacccauacaugcccuccguggucgagacgcuggagcagaugcagcgcaagcauggcggcauguuggugcgcaacccccucucucggaacuccacccacgagauguacugggugaguugcgggaccggcaacaucguguccgccgucaacaugaccagccgcauguuacugaaccgcuuuaccauggcgcaccgcaagccgacauacgagcgcgacguggaccugggggccgguacccgucacgucgccgucgagcccgaaguggcgaaccuggacauaaucggccagagaaucgagaacaucaagcaugaacacaaguccaccuggcacuacgacgaagacaaccccuacaagaccugggccuaucacgggucuuaugagguaaagcccucuggcagcgccagcuccauggugaacggagucgugaagcugcucacaaagccgugggacgugaucccgauggucacccaaaucgcuaugaccgacacaacgcccuucggccagcagcggguguucaaggaaaaaguagacacccgcacgcccaaagccaagcggggaacagcgcaaauaauggaggucacggccaaguggcuguggggcuuccugagccgcaacaagaagccgcggaucugcacccgcgaggaguuuacccggaaggugcgcuccaacgccgccaucggugcaguuuucgucgacgagaaccaauggaacagcgcuaaggaggcuguggaagacgagcgguucugggaccucgugcaccgcgagcgggaacugcacaagcagggcaagugcgcgaccugcgucuacaacaugaugggcaaacgcgagaagaaacugggggaguucggcaaggccaaagggucccgggcgaucugguacauguggcucggcgcccgcuuucuggaguucgaggcccugggauucaugaaugaggaccacugguucucgcgggagaacucccucagcgggguggagggcgaggggcugcacaagcugggcuacauccuccgcgacaucuccaagaucccggggggcaacauguacgccgacgauacggccggaugggacacccggaucaccgaggacgaccugcagaacgaggcgaagaucaccgacaucauggagcccgagcacgcccugcucgcaaagagcaucuucaaacugacguaccagaacaaggugguccgcgugcagcggccggccaagaaugguacugugauggacgucaucucccgacgcgaccaacggggcagcggccaggucgguacguacggccugaacacauuuacgaauauggaggcccagcucauacgccaaauggaaucagagggaaucuucagccccuccgagcuggagaccccaaaucuggcgggccgggugcucgacuggcuggaaaagcacggggucgagcgcuugaagcggauggccaucucgggcgacgacugcguggugaagcccaucgaugaccgcuucgccaccgcucucaccgcccugaaugacauggggaagguucggaaggacaucccccagugggaacccuccaagggcuggaaugacuggcagcaggucccauucugcucucaucacuuccaccaacuuaucaugaaggacggccgcgagaucgugguccccuguaggaaucaggacgagcuugugggucgcgcgcgcgugagccagggcgccggauggucccugcgagagacggccugccugggcaagaguuacgcccagauguggcagcugauguacuuucaucggcgggaccuucggcucgcggcuaacgccaucugcuccgccgacccggucgacugggugcccaccagccgcaccaccuggagcauccaugcccaccaccaguggaugacuacggaggacaugcucagcguguggaaccgggucuggaucgaggagaaucccuggauggaagacaagacccacaucuccagcuggggcgacgugcccuaccuaggcaagcgcgaggaccaguggugcggcaguuuaauagggcucaccgcacgggccacgugggccaccaacauccagguugcaaucaaccagguacgcagacugaucggcaacgagaacuaucuggacuauaugaccucgaugaagcgguucaagaacgagagcgacccggaaggggccuugugguaa

SEQ ID NO: 24394 - RNA, 9879 nt, Artificial Sequence
  derived and/or modified CDS sequence (opt11) from DENV-1__GQ868612__SS-prME
uccguaacgaugcuccucauguugaugccaacggcccucgccuuucacuuaaccaccagaggaggugaaccgcauaugauuguguccaagcaagaaagaggaaaaucacuguuguuuaaaacgucagcaggcgucaacaugugcacauuaaucgcgauggaccucggggaacuaugcgaagacacaaugacauacaagugcccaaggauaacagaagcggaaccugacgacgucgacugcuggugcaacgcaacagacacaugggugaccuacgggacaugcucacaaaccggagaacaccgucgcgauaaacgaagugucgcucuugcgccacacgucggacuaggucucgaaacgcguacggaaaccuggaugaguucagagggcgccuggaagcaaauacaaagagucgaaacaugggcccuccggcauccaggguucacugucauagcacucuuccuugcacacgcaaucggcaccucaauaacacaaaagggcauaaucuucauccuacugaugcucguuacaccuagcauggcaaugcguuguguagguaucggauccagagauuuuguggagggccucucgggcgccacuugggucgacguagucuuagagcauggcuccuguguuacaacgauggcgaaggauaaaccaacccucgauaucgaacuacuaaaaaccgaggucacgaaccccgcggugcugaggaaauuaugcaucgaagcaaaaauaucaaacacuacgaccgacucacgauguccgacacaaggagaagccacccucguggaagaacaagaugcaaacuucgucugccgacgcacauuuguggaccgaggguggggcaacggaugcgggcuauucgggaaagguagccuuauaacgugugcgaaauucaaaugcguaacaaagcuggaaggaaaaaucguacaauacgaaaaucuaaaguacagcgucauaguuaccgugcacacaggagaucaacaccagguuggaaacgagagcaccgagcacggaacuacggcaacuaucacgccgcaggcuccgaccacagaaauucagcucacggacuacggggcucucacgcuggacugcucgccacggaccgggcuagauuucaacgagauggugcugcuaaccaugaaggagaaaagcuggcuuguacacaaacaaugguuccucgaccucccacuaccauggacguccggagcaucgacaucccaagaaacuuggaauaggcaagaccuccuugucacauucaagacagcacaugcuaagaaacaggaaguuguuguacugggaagccaagaaggagcgaugcacaccgcacucacuggggcuacugaaauacaaacauccggaacaacaacaauuuucgccgggcaucugaaaugccgucucaaaauggauaaacuuacgcugaagggaaugagcuaugugaugugcacaggcagcuucaaacucgagaaggaaguagcugaaacacaacacggaaccguccucgugcagauaaaauacgaaggaaccgacgcucccugcaaaauuccauucagcacacaagaugaaaaagguguaacacaaaauggucggcugauaacagccaacccgaucguaaccgacaaagagaaaccuguaaauaucgaagcagaaccuccuuucggagagagcuacaucguaaucggcgcuggcgagaaagcucucaaacugaguugguucaaaaagggaucaaguaucggaaaaauguuugaggcaacagcaaggggagccagacgaauggcgauccuuggcgauaccgccugggacuuugguucgaucgguggcgucuucacgagcgucgguaaguugguccaccaaaucuucggaacagcguacggaguccucuuuuccggcguguccuggacgaugaaaauuggcauaggaguccuacugaccuggcucggccuaaauaguaggucaaccagucuaagcaugacaugcauagcgguaggacuggucacgcuuuauuuaggagccaugguccaagcagacaguggaugcgucauaaacuggaaaggcagagagcuaaagugcgggucgggaaucuucgucacaaaugaaguacauacguggacugaacaguacaaguuccaagccgacagccccaaaagguuaucagcagcaauagggaaagcaugggaagaaggugugugcggaaucaggagcgccacaagacuagagaauaucauguggaaacagaucagcaacgaacugaaccauauccugcuggaaaacgacaugaaacucacugucgugguaggagacguagcagggaucuuaggacagggcaagaaaaugauacgcccucagccgauggaguacaaguacucguggaaauccuggggaaaagcaaagauuauaggcgccgacgcacaaaacacgacauuuaucaucgacggucccaauaccccagagugucccgacgaucagcgggcguggaacauuugggaaguugaagacuauggauucgggaucuucacgacgaauauuuggcucaaacuccgggacagcuauacccaggucugcgaucaccgccugaugagugccgcgauaaaagacucuaaggcaguacaugcggacaugggauauuggauagaaucggagaaaaacgaaaccuggaaacuagcaagggcaucacugauagaagugaagacuugcaucuggcccaaaucccauacacuauggucaaaugguguacuggaauccgaaaugauuaucccaaaaauauacggcggaccuauaucucaacauaauuauaggccgggauacuucacacaaacggcgggacccuggcaccugggaaaguuagagcuagacuucgaucucugugagggcaccacugucguaguggacgaacacugcggcaauagaggcccaucacucagaacgacaaccgugacgggcaaaauaauccacgaauggugcugcaggagcugcacgcugccaccccuccgauucagaggggaagacggcuguugguacggaauggagauaaggcccgucaaggagaaagaggaaaaccucgugaagucuauggucucagcagguagcggggaggucgacucguucagcuuaggcuugcucugcauaucuaucaugauugaagaagucaugcguagccgaugguccagaaagaugcucaugaccgguacacuagcaguguucuuccugcuaaucauggggcaacucaccuggaaugaccuaauacgacuuuguaucaugguuggagcaaacgcaagugauagaauggggaugggcacgacuuaccuagcucuuauggccaccuucaagaugagaccaauguuugcagucggccuacuuuuccgccgucuaaccagccgagaagugcuauuacuaacgauaggacuaagucucguugccagcgucgaacuuccgaacagccuggaggagcucggcgacggcuuagcaaugggaaucaugauacucaaacuacugacggacuuccagucccaccaacuuugggccaccuuacuuucgcuaacguuuauaaagaccaccuucagccuccacuacgcuuggaagaccauggcgaugguacuaagcauaguaaguuuauucccguugugccuaucgaccaccagccagaaaacaacaugguugccgguccugcuagguagccugggcugcaagccgcuaacaauguucuugauagccgagaacaagaucuggggacgcaaaucguggccucugaacgaaggaauaauggccgucgggaucgucucaauccuacuaucgagucuccuaaagaacgaugugccccucgcugggccccucaucgcuggggguaugcugaucgcaugcuacguaauaucgggaagcuccgccgaccugucccucgaaaaagcagcugagguaucaugggaggaagaggccgaacacagcggggcgagucauaacauuuuaguagaaguccaagacgacgggacaaugaaaaucaaagacgaagaaagggacgacacucugaccauacuacuaaaagcaacucuacuagcagucagcggcgucuacccacuaucgaucccggcuacccucuuugugugguauuucuggcagaagaaaaagcaaaggucaggggugcucugggacacaccguccccgccggagguugagcgagcaguacuggacgacggcauuuaucgcauuaugcaaagaggacuccugggccggagccagguuggagucggcguauuucaggaaaacguauuccacacaauguggcacgugacaagaggugcuguccuuauguaccaaggaaaaaggcuagaacccaguugggcaagugugaagaaagaccugauaagcuacggcggaggauggagacuucggggaucguggaacacaggcgaagagguucaggucauagcggucgagccaggcaaaaaccccaaaaacguccagaccgccccgggcacauucaaaacaccagagggagaagucggggccauugcgcuagacuucaaaccaggaacaucggguagcccgauaguuaaucgagaagggaagauagugggcuuauauggaaacggaguggucacaacaucugguacguacguaucagccaucgcccaagccaaggccucacaagaggguccccuaccugagaucgaagacgagguauuccggaaacgaaaccucaccauaauggaccugcacccuggcucgggcaaaacgcggcgauaucucccagcgaucgugcgugaagcaaucaagcggaaacugcgcacgcucauccuggcuccgacgcgcgugguggcaagcgagauggcagaagcacucaaggggaugccgauccgauaccaaacgaccgcagucaaaucggagcauacaggcaaggaaauaguagacuuaaugugucacgcaacauucaccaugaggcucuugagucccguccgcguacccaacuacaauaugauaauaauggaugaagcacacuucaccgacccaagcucgauagccgccaggggguacauuuccacaagaguuggcaugggagaggcugcagcgauuuucaugaccgcgacuccgcccgguucaguggaagcauuuccacagagcaaugcugugauccaggaugaagaacgggacauaccagaaagaucauggaacucgggcuacgaauggaucacggacuuuccagggaaaacgguaugguuuguccccucuauaaagucgggcaacgacaucgccaauugucuacgcaagaauggcaagcgggugauccagcugucaagaaagacauuugacacagaauaccagaaaaccaagaacaacgauugggauuacgucguaaccacagacauuuccgaaaugggugcaaacuuucgcgcggaccgagugauagaccccagacggugucuaaaaccggucauauugaaagauggacccgaacgagugaucuuagcaggacccaugccaguaaccguugccagcgccgcccaaagacgugguagaaucggcagaaaccacaacaaagagggugaucaauauauuuauaugggacaaccccuaaacaaugaugaggaccacgcccacuggaccgaggcgaaaaugcugcuugacaacaucaacaccccagaggggauaaucccggcucuuuuugagccggagagagagaaaagcgccgccguggacggugaauauagauugcgcggagaggcccgaaagaccuucguagaguugaugcguagaggugaccuuccaguauggcuauccuacaagguggcgagcgaaggauuccaauacagcgaccgaagguggugcuucgacggagaaagaaacaaccaagugcucgaggaaaacauggauguugagauauggaccaaagaaggagaaaggaagaaacuuaggccacgauggcucgacgcgcggacauacagugauccacuugcccugcgggaauuuaaagaauuugccgcgggacgacgcucagugaguggggaccugauuuuagaaauagguaaacugccacagcacuuaacucaaagggcacagaaugcgcuugauaaccuuguaaugcugcacaacagcgaacaaggagggcgcgcuuaccggcacgcaauggaggagcucccagauaccaucgagacgcuaaugcugcuagcacuuauagcaguacuaacgggcggggucacgcuauuuuuccucuccggcagagggcucgguaaaacgagcauaggccugcucugcgucauggcgagcagcguccuccuauggauggcgagcgucgagccccacuggaucgcggccagcauaauucuggaguucuuccugaugguguugcuuauaccggagcccgaccggcaaaggacaccgcaggacaaccaauuagcuuacguggucaucggcuuacuguucaugaucuugaccgucgcggcuaaugagaugggccugcuagaaacaaccaagaaagaccuaggcauuggacauguugcgguagaaaaccaccaccacgcagcgaugcuggacguggauuugcaucccgccucagccuggacccuauacgcugucgcgaccacgaucauaacgccaaugaugcgacacaccaucgaaaauaccacugcaaacauuucauuaacagcuauugcgaaccaggcagcgauacucaugggucuggacaaaggcuggccgaucagcaaaauggauauuggaguaccacuccuggcccugggauguuacucccaagucaacccacucacccugacagcugccguccugaugcuagucgcgcacuacgcgauaauaggcccgggacuacaagccaaggcaacucgggaggcacagaaaagaacugccgccggaauaaugaagaaucccacaguggacgguaucguagcgaucgaucuagacccggucgucuacgacgccaaauucgaaaaacaacuaggccagauaaugcuuuuaauacuaugcacuagccagauucuccuaaugagaacgacuugggcacuaugugagucgaucacguuagccaccggcccacucaccacgcugugggaaggaagccccggcaaauucuggaauaccacaaucgcggugagcauggccaacaucuuuagaggaagcuacuuagccggagcaggccuggccuucucucugaugaaaucacuaggaggagggcgacgcgguacaggggcccagggagagacccucggcgaaaaguggaaacgccaacuaaaccaauuaucgaagucagaguucaacacauacaagcgaucugggaucauggaaguggaccgcucugaggcaaaggaaggacuaaagagaggggaaacgacuaaacacgcugugucacgcggaacugccaagcuccgcugguucguagagaggaauuugguuaaaccagagggaaagguuauagaucucggcugcggccgaggcgguuggucguacuacugcgccgggcucaaaaaggucacagagguaaagggauacacaaaagguggcccggggcacgaggagcccauaccuauggcgacauacggcuggaaccucgugaagcuacacagcgggaaagacgucuucuuuauaccgcccgagaagugugacacacuccucugugacaucggugagucaucacccaacccgaccauagaagaggggcgcacacucagggugcugaagauggucgagccuuggcuuagaggaaaccaauucuguauuaaaauacugaacccuuacaugccaucagucguagaaacccuagaacagaugcaacgcaaacauggcgggaugcucguccgaaacccacucucgaggaacucgacgcacgaaauguacuggguaagcugcggcacaggaaacauagucagcgccguaaacaugaccagucgcaugcuucucaacagauucacaauggcccaccgcaaacccaccuacgaaagagaugucgacuuaggaacagggacuagacauguggcagucgagcccgaaguggcaaaccuggacaucaucggccagaggauagaaaacauaaagcacgaacacaagagcacauggcacuaugacgaggacaacccguauaagacaugggccuaccauggguccuacgaagucaaaccaagcggguccgcaucaucaauggucaaugggguggucaaguuacugacgaagcccugggacgugauaccaauggugacccaaauagcgaugacugacacaacaccuuucggccaacagaggguauuuaaggagaagguagacacgagaacaccuaaggcgaagcgcggaacugcccagaucauggaagugacagcacgguggcuauggggauuccucucgcgaaacaagaaaccgagaaucuguacccgagaagaguuuacaaggaaaguacgaagcaacgcagcaaucggggccguuuuuguagacgagaaccaauggaauagcgcaaaagaagcgguggaagacgaacgcuuuugggaccucgugcacagggagagggagcuccacaaacaggguaagugcgcaaccugcguauauaacaugauggggaaaagggagaagaaacuaggagaguucggcaaagcaaagggcuccagagcuaucugguacauguggcucggcgcacgcuuccucgaguucgaagcucuaggcuuuaugaacgaagaccacugguucuccagagagaacagccuaagcgggguugagggggaaggccuacacaagcucgguuauauccugcgggacauaucaaaaauccccgguggcaacauguacgcggacgacaccgcagggugggacacacgaauaacagaagacgaccuacaaaaugaggcaaagauuacagacauuauggaaccugaacaugcgcuucucgcaaaagccauauucaaacugaccuaccaaaauaaaguaguucgcgugcaacgaccagcgaaaaacgggacggucauggaugucauaucacggcgugaucaacgaggcagugggcaaguaggcacauacgggcucaacaccuucacaaauauggaggcgcaacucauccgacagauggagucggaaggcaucuuuaguccgagugaauuagaaaccccaaaccucgcagagcgcgcccuugacuggcuugaaaaauacggaguagagcguuugaagagaauggcuauuucaggagacgacugcgugguaaagccaauugacgaccguuucgcaacggccuuaaccgcucuuaacgacaugggaaaagugcgcaaagacauaccgcaaugggagccauccaaaggguggaacgacuggcaacagguccccuucugcagccaccacuuccaccaacucauaaugaaagacggacgcgaaaucguaguaccaugcaggaaucaagacgagcuaguugggagagcaagagugagccagggagccggcuggucgcuccgggaaaccgccugccuaggaaaguccuacgcccagauguggcaacucauguauuuccauaggagggaucugcgacuagcagccaacgccaucugcagcgccguaccgguggacuggguaccaacgucucggacuacauggagcauccaugcacaucaucaguggaugacgacugaagacaugcuaagcgucuggaacagaguguggaucgaggagaacccauggauggaggauaaaacccacauaaguaguugggaggacguaccauaccugggcaaacgagaggaccaauggugcggaagccucaucggccucaccgcacgggcgaccugggccacuaauauacagguggcgaucaaucaagucagacgacuuaucgguaaugaaaacuauuuagauuauaugacaucaaugaaacgcuucaagaaugagucggaccccgaaggagccuuaugguga

SEQ ID NO: 24395 - RNA, 9879 nt, Artificial Sequence
  derived and/or modified CDS sequence (opt11) from DENV-1__FJ898419__SS-prME
agcgugaccaugcugcucaugcugaugcccaccgcgcuggccuuccaccucacaacccggggcggcgaaccccacaugaucgugagcaagcaggagcggggcaagagccuacuguuuaaaacauccgccgggguuaacauguguaccuuaaucgccauggaucuaggcgaguucugugaggacacaaugaccuacaaguguccccgcauaacagaggcagagcccgacgacguugacugcuggugcaacgcuaccgacacgugggucaccuacgggaccuguagucagacgggggagcaccggagagacaaacgauccguggcccuggcgccccacgugggccuggggcuagagacgcgcaccgagacguggaugagcuccgagggcgcguggaaacagauccagcgggucgaaacgugggcucugcgccaccccgguuucacggugaucgcccucuuucuggcgcaugccaucgggaccagcaucacccagaaggggauaaucuucauccugcucaugcucgugacccccagcauggccaugcggugcgucggcaucggcucgcgagacuuuguggaaggucuuuccggcgccacauggguggacgucgugcucgagcacgggagcugcgugacuaccauggccaaggacaagcccacccuggauaucgagcugcucaagacagagguuacgaacccggcgguguuacggaagcugugcaucgaggcuaagaucuccaauaccaccaccgacagccgcugcccgacccagggcgaggcgacccucguagaggaacaggacgccaauuucgucugccggcgaaccuucguggaccgagguugggggaacggaugcgggcuauucggcaaagggucccugauuacgugcgccaaguucaaaugcgugaccaagcuagagggcaagauaguccaguaugagaaccugaaauacagcgucaucguuacaguacauaccggcgaccagcaccaggugggaaacgaguccacggagcacggcaccaccgcgaccaucacuccccaggcucccagcacggagauccaguugaccgacuacggagccuuaacccuggacugcucuccccggaccggcuuagauuucaacgaaaugguccuccuaaccaugaaggagaaauccuggcuugugcacaaacagugguuccucgaccugccgcugcccuggaccucgggggccagcaccagccaggaaacuuggaaccggaaagaccuccuggugaccuuuaagaccgcccacgcgaagaagcaggaggucguugugcugggcucccaggagggcgcaaugcauaccgcacucacaggagcaacggaaauucagaccagcggcaccaccacgauauucgcugggcacuuaaagugccgacugaagauggauaagcucacccugaagggcaugucuuacgucaugugcaccgguagcuuuaagcuggagaaggaggucgcggagacgcaacacggcacggugcugguccagauuaaguacgagggcaccgacgcacccugcaagauaccuuucuccacccaggacgagaaggggguuacacagaacgggcgucuaaucacggccaacccgaucgugaccgacaaggagaagccugugaacauugaggccgagccgcccuucggggagagcuacaucgugaucggcgcgggcgagaaggcguuaaagcuauccugguucaagaaagggagcuccaucgguaagauguucgaagccaccgcacgcggggcccggcgcauggcgauucucggagacaccgcgugggacuuugguagcaucggcggcguguucacgagcgucgggaagcuggugcaccagaucuucggcaccgccuacggggugcuguucagcggugucuccuggaccaugaagaucggaaucggcgugcugcugaccuggcugggccuaaacagucgaucaacgucccucuccaugacuugcauugccguggggcucgucaccuuguaccuaggcgugaugguacaggcagacucagggugcgugauaaacuggaagggccgggaauuaaaaugcgggucgggcaucuucguaaccaacgaggugcacacguggacggagcaguacaaauuccaggcggauucaccgaagcgccucagcgccgcgauuggcaaagcaugggaagagggcgucugcggcauccgcuccgccacgcgcuuggagaacaucauguggaagcagaucucaaaugagcugaaccacaucuugcuugagaacgacaugaaguucaccguaguugucggggacguggcggguauccuggcccaggggaagaagaugauucgcccccagcccauggaauacaaauacuccuggaaguccuggggcaaagccaagauaaucggcgccgacgugcagaacaccacguucaucaucgacggucccaacaccccggaaugccccgacgaccagcgggcuuggaacaucugggagguggaggacuauggcuucgggaucuucacgaccaacauauggcucaagcugcgggacuccuacacccaggucugcgaccaccgauugaugucagccgccaucaaggacuccaaggccgugcacgcugacaugggcuacuggaucgagagcgagaagaaugagaccuggaagcucgcccgggcuuccuucaucgaggucaagaccugcaucuggcccaagucacacacccugugguccaacggugugcuggaguccgagaugaucauccccaagaucuacggaggaccgaucucccagcacaacuaccgacccggguacuucacacaaaccgccggucccuggcaccucgggaagcuugagcuggacuucgauuugugcgaaggcacuacuguggucguugacgagcacugcggcaaucgggggccgagccugcgcacgaccaccgugaccggcaagauaauucacgaauggugcugccggaguugcacgcucccaccccugcgcuucaagggugaggaugguugcugguacgggauggagauccggcccgucaaagagaaagaggaaaaccuggucaagagcauggugagcgccggcuccggcgaagucgacagcuucucccugggacuccugugcauuagcaucaugauagaggaagugaugcggucccgguggucgcgcaagauguuaaugaccggaacccuagccgucuucuuccugcugauuaugggacagcucacguggaacgaccugauccggcucugcaucaugguaggagcgaaugccuccgacagaauggggaugggcacgaccuaccuugcccuaauggccaccuucaagaugcguccaauguucgccgugggccuccuguuccggcgccucaccagccgggagguccugcuccugacgaucgggcugucccuggucgcgagugucgaguugccuaacucccuggaagaauugggcgacgggcuggccauggggaucaugauacugaaacuccugaccgacuuccagucccaccagcuuugggccacccuccugagucugacguucaucaagacuaccuucagccuccacuacgccuggaagacuauggcgaugguccuguccaucgugucucuguucccucuaugucuguccacgacgagccagaagacgaccugguugcccguucuccucggcucccucggaugcaagccgcucaccauguuccugauagccgagaacaagaucuggggccguaagagcuggccccuuaacgagggaauaauggccgucgguaucguuagcauccuauuaagcgcccugcuaaagaacgacgucccccuggccgggccucugaucgcgggcgggauguugaucgccugcuacgucaucagcggguccuccgcggaccugucacuggagaaggccgccgaggugagcugggaagaggaggcggagcacucaggcgccucccacaacauccucguggaggugcaagacgacgggacgaugaaaauaaaggaugaggagcgugacgacacucugaccauccugcucaaggccaccuuacuggccgugaguggcguguacccgcucagcauaccugccacccuguucgucugguacuuuuggcagaagaagaagcagcgcuccggggugcugugggacacgcccuccccgcccgagguggagcgggcaguccucgaugacggcaucuacaggaucaugcagcgcggacuacucggaagaucccaagugggcgugggggucuuucaagagaacguguuucacaccauguggcacgugacccgaggcgccguacugauguaccagggcaagcgccucgagcccagcugggccaguguaaagaaggaccuaaucagcuacggcggcggguggcggcugcaaggcaguuggaacaccggggaggagguccaggucaucgccguggagcccggcaagaacccgaaaaaugugcagacggcccccgggacguucaaaaccagcgagggcgaagucggugcgaucgcccucgacuucaagcccgguacaucaggcagccccauugugaaccgagagggcaagaucguaggccuguacggcaacggugucgugacgaccucaggcaccuacgugucggcgaucgcgcaggcaaaagccagccaggaggggccacugcccgagaucgaggacgaagucuuccggaaacgcaaucucaccaucauggaccugcaccccggcuccggcaagacgcggcgcuaccugcccgccauaguucgggaggccaucaagcgcaagcuccggacacugauccuugccccgacccgcgucgucgcaagcgaaauggccgaggcccucaaggguaugcccauccgcuaucagacgacggccguaaaaucagagcauaccggcaaagagaucguugaccugaugugccacgcaaccuucaccaugcggcugcugagccccguccgcgugccgaacuacaacaugaucaucauggacgaagcacacuucacggacccguccagcaucgccgcccggggguacaucuccacccgcgucggcaugggggaggccgccgcaaucuucaugacagccacgccgcccgggagcguagaggccuuuccccaaagcaacgccgucauccaggacgaggagcgggacaucccggaacgcaguuggaacucuggcuacgaguggaucaccgacuuucccggcaaaaccgugugguucgucccaagcaucaaguccggcaacgacauugcaaauugccuacggaaaaacggcaagcgcgugauacaauuaucacggaagaccuuugacaccgaguaccaaaagacgaagaacaacgacugggacuacgugguaacgacggauauauccgagaugggcgccaacuuccgcgccgaucgugugaucgaccccaggcggugccuuaagccggugauccucaaggacgggcccgagagagucauccuggcaggccccaugcccguaacggucgccucugccgcccagcggcgcgggcggauagggcgcaaccauaacaaggagggggaccaguacaucuacauggggcaaccguugaacaacgacgaggaccacgcccacuggacggaggccaagaugcuucuggacaacauuaacacgccugagggcaucauccccgccuuauucgagcccgaacgggagaagucugcggccaucgacggggaguacagacuccggggcgaggcccggaagaccuucguggagcugaugcgucgcggggaccucccgguauggcugucguacaaaguagccagcgagggcuuucaguacuccgaccgccgguggugcuucgauggcgagcgcaacaaucaggugcuugaggagaacauggacguggaaaucuggaccaaggagggugagcggaagaagcugcgcccccgguggcuggacgcccguacguacagcgacccgcucgcgcuccgggaguucaaggaguuugccgcgggccgccgguccgucagcggagaccugauccuggaaaucgguaagcucccgcagcaccugacucagcgcgcccagaacgcgcuggacaacuuggugauguuacacaacuccgaacagggcggccgggccuaccgccacgcaauggaggagcucccggacaccaucgaaacccucaugcugcuggcccucaucgccgugcugacgggugguuggacccuguucuuccucucuggccguggucuaggaaagaccuccaucggccuccucugcgucauggcgagcucuguucuuuuguggauggcgagcguagagccccacuggauugccgccucuaucauauuagaguucuuuuugaugguccugcuaauccccgagcccgaccgccagcggacgccgcaggacaaccagcuggcauauguaguaauaggucuccucuucaugauccugaccguugcagccaacgagaugggucugcucgagaccacaaaaaaggaucuugggauaggccacgucgccguggagaaccaccaccacgccgcaaugcuugaugucgaccuccaucccgcgagcgccuggaccuuguacgccguggcgaccacgaucaucacaccaaugaugcgccacaccaucgagaacacuacugccaacauaucacugaccgcgauagccaaccaagccgccauucucauggggcuggacaagggguggccgaucucaaagauggacaucggugugccguugcuggcacuggggugcuacucccaggugaacccccugaccuugaccgcggccguucuaaugcugguggcccacuaugccaucauaggccccgguuugcaggcgaaggccacgcgggaggcccagaaacgcaccgccgccggcaucaugaagaacccaacagucgaugggauaguggcuaucgaccuugaccccgucgucuacgaugcuaaguuugaaaaacagcugggccaaaucaugcuccuuauccuaugcacaucccaaauccuacugaugcgcacgaccugggcccugugcgagucgaucacccucgccaccgggccccugacgacuuugugggagggcagcccugggaaguucuggaacaccacuaucgccgugaguauggcgaacaucuuccgggggaguuaccucgccggugccgguuuagcuuucagccugaugaagucccucgggggcggccgccgaggcacaggcgcccaaggagaaacgcuuggcgagaaguggaagcgccagcugaaccaacuuucuaaguccgaguucaacaccuacaagcggucugggauaauggagguggaucgcucggaagccaaggaaggccugaagcgcggggagaccacgaagcacgcagucagcagagggaccgcaaagcugcggugguucguggagcgcaaccuggugaaaccggagggaaaggucaucgacuuaggcugcggcagaggcgggugguccuacuacugcgccgggcugaagaaggugaccgagguuaagggguacacaaagggcgggcccggccacgaggagcccauccccauggcgacguacggguggaaucuggucaagcuccauuccggcaaggacguguucuucaucccgcccgagaagugugauacgcugcugugcgauaucggcgagagcagcccgaaccccaccaucgaagagggccgcacccuccgggugcucaagauggucgagccguggcugagggggaaucaguucuguaucaagauccucaaccccuacaugcccucugugguggagacacucgagcagaugcagcggaaacacggcggcaugcugguccguaacccccucagccguaacucuacccacgagauguacugggugagcugcgggaccggcaacauaguguccgccgucaacaugaccagccgcaugcuuuugaaucgguucaccauggcccacagaaagccuacguaugagcgcgacguggaccuaggggccgggacccggcacguggccgucgaaccggagguggccaaccuggacaucaucggucagcgcauugagaacauuaagcaugaacacaaguccaccuggcacuacgacgaggacaaucccuacaaaacaugggccuaccauggcagcuacgaggucaaaccuucaggguccgccucaucuauggucaaugggguggucaagcuucucacgaagccgugggacgucauccccauggucacacagauugccaugaccgacaccacacccuucggacagcagcgggucuucaaggagaagguggacacccgcacccccaaagcuaagcgagggaccgcgcagaucauggaggugacggccaaguggcuauggggcuuccugucaaggaacaagaagccgcggauuugcacgcgcgaagaguucacccggaagguccgauccaacgccgccaucggcgcgguguucguggacgagaaccaauggaacagcgcaaaggaggccguugaggacgagcgguuuugggaccuaguccaccgcgagcgggaacuccacaaacaggggaagugugcaaccugcguguacaacaugaugggcaagcgcgagaaaaaguuaggagaauucggcaaggccaaggguuccagagcgauuugguacauguggcuuggggcccgcuuucuggaguucgaggcacugggcuuuaugaacgaagaccacugguucucacgcgagaacucccucagcggggucgagggagagggacugcacaaguugggcuacauccuccgcgacaucuccaagaucccggggggaaacauguacgcagacgacacggcgggcugggacacccggauuaccgaagacgaccuccagaacgaggcuaagaucaccgacaucauggagccugagcacgcccugcucgccaaaagcaucuucaaacugacauaccagaacaagguggugagaguccagcgcccugccaagaacgggaccguaauggacgugaucagccgccgggaccagcgggggagcggccaggucggcaccuacggccugaacaccuucacgaauauggaggcccagcucauucgacagauggaguccgaggguauuuucagccccucggagcuggagacccccaaccuggcggggcgggugcuggacuggcuggagaagcacgggguggagcgccucaagcggauggcgaucagcggagacgacugcgucgucaagcccauagacgaccgcuucgcuaccgcccuaacggcccugaaugacauggggaaggugcggaaagacaucccccagugggagccguccaagggcuggaacgacuggcaacaagucccuuuuuguagccaccacuuccaccagcugaucaugaaggauggccgcgaaaucguggugcccugccggaaccaggaugaguugguagggcgcgcgcggguuagccagggcgccggguggagucugcgcgagacggccugucugggcaagagcuaugcucagauguggcagcucauguacuuccaccggcgcgaccugcggcuugcggccaacgccauuugcuccgcagucccgguggacugggugccaaccagccguaccaccugguccauccacgcacaccaccaguggaugacgaccgaggacaugcuuagcguguggaaccgggucuggauugaggagaacccguggauggaggacaagacacauaucuccagcuggggcgacguaccuuaccuaggcaagcgcgaggaucaguggugcggcagucugaucgggcucaccgcgcgugccacgugggccaccaacauacagguggccaucaaccaaguccgccgccugauaggcaaugagaacuaccuggacuacaugaccagcaugaagcgauuuaagaacgagucggacccggagggggcucucugguga

SEQ ID NO: 24396 - RNA, 9879 nt, Artificial Sequence
  derived and/or modified CDS sequence (opt11) from DENV-1__FJ898420__SS-prME
agcgugacgaugcugcugaugcugaugccgaccgcgcuggccuuccaucucaccacaaggggaggggagccccacaugaucgugagcaagcaagagcggggcaagucucugcuguucaagaccagcgccggggugaacauguguacccucaucgccauggaccugggagaguuaugcgaggacacgaugacguacaagugccccagaaucaccgaggccgagcccgacgacguggauugcuggugcaaugcgaccgacacgugggugaccuacgggaccugcagccaaacgggcgagcaccgucgcgacaagagguccgucgccuuggcaccccacguuggucuggggcuggagacgcgaaccgagaccuggaugucuuccgaaggugccuggaagcagauccagcggguggagacaugggcgcuccgccaccccgguuucacgguuaucgcuuuguuucucgcgcacgccaucggcaccagcauaacccagaaggggaucaucuucauccuccugaugcuggugacccccuccauggccaugcggugcgucggcaucgggagccgcgacuuuguggagggccucuccggcgcgacguggguugacgucguguuggagcaugggagcugcgucaccaccauggccaaggacaagcccacccuggacaucgagcuccugaagacagaagucaccaaccccgcuguccuccggaaguugugcaucgaggcuaagaucuccaacaccaccacggacagucgcugcccgacacagggcgaggccacccugguugaagagcaggacgccaacuucguaugccggagaaccuucguggaccggggcugggggaacggcugcgggcuguucggcaaggggucccuaaucacgugcgcuaaguucaagugcgugaccaaacuggaggggaagaucguccaguacgagaaccugaaguacagcgucauaguaaccguccacaccggcgaucaacaccagguggggaacgagucaacggagcauggcaccacagcgacuaucacgccccaggcccccacgaccgagauucagcuaaccgacuacggggcccucacccuggacugcagcccccgaacgggcuuggacuuuaacgagaugguccugcugacgaugaaggaaaaauccugguuggugcacaaacagugguuccuggaccugccccuccccuggaccagcggcgcaagcaccucccaggagacguggaaccggcaggaccugcuagugaccuucaagaccgcccacgcgaagaagcaggaggucguggugcuuggcagccaggagggcgccaugcacaccgcccugacgggcgccaccgagauccagaccuccggcaccacgaccaucuucgccggccaccugaaaugccgccugaagauggacaagcuuacccugaaggggaugagcuacgucaugugcaccggguccuucaaacucgagaaggagguggcggagacccagcauggcaccgugcugguccagaucaaguaugagggcaccgacgcgcccugcaagauccccuucagcacccaggacgagaagggggugacgcagaacggccggcugaucacggccaacccgaucgugacagauaaagagaagcccguaaacauagaggccgagccgcccuuuggugagucauacaucgugauaggcgcgggcgaaaaggccuuaaagcucaguugguucaagaaaggguccagcauugggaaaauguuugaagcuaccgccaggggggcccggagaauggcuauccugggcgacacggccugggacuucgguuccaucggugguguguucaccagcgucgggaagcuggugcaccaaaucuucggcaccgcauacgggguccucuucuccggcgucagcuggaccaugaagaucgguaucggaguucuccugacguggcucggccugaacucccgaagcaccucccugagcaugaccugcauagccguggggcucgucacccuguaccugggcgcuauggugcaggcggacuccgggugcgugaucaauuggaagggccgggaauugaagugcgggagcggcauuuucguuacgaacgaggugcacaccuggacggagcaguauaaguuccaggccgacagcccgaagcgccuguccgccgccaucggcaaggccugggaggagggcgucugcggcauccggagugcgacacgccucgagaacaucauguggaagcagaucuccaacgagcugaaccauauccuccuggagaacgacaugaagcucacagugguagugggggacgucgccggcauccuggggcagggaaagaagaugauucguccccagcccauggaguacaaguauagcuggaaguccuggggcaaggccaagaucaucggggcggacgcgcagaacacgacuuuuauaaucgacggcccgaacaccccggagugcccugaugaccagcgcgccuggaacaucugggagguggaggauuacggguucggcaucuucaccacgaacaucugguuaaagcugcgggacagcuacacccaggugugcgaccaccgccugauguccgccgccaucaaggacagcaaggcaguccacgcggacaugggguacuggaucgagagugaaaagaacgagaccuggaaguuagcccgggccagcuucaucgaagugaagaccugcaucuggcccaagucccacacgcucuggagcaacggggugcuggaguccgagaugaucauccccaagaucuacggcgggccgaucucacagcacaacuaccgccccggcuacuucacccagaccgccggacccuggcaccugggccggcucgaacuggauuucgaccugugcgagggcacgacggucgucguagacgagcacuguggcaacaggggcccgucccucagaaccaccaccgucaccggaaagaucauccacgaguggugcugccgcagcugcaccuugccgccucuccgguucagaggcgaggacgggugcugguacggcauggagauccgccccgugaaggagaaggaggaaaaccuugugaaaaguauggucagcgccggcagcggggagguggacagcuucagccuggggcuucuaugcauauccaucaugaucgaggaggucaugcgcagccgguggucccgcaagaugcugaugaccgguacccucgcggucuucuuccuccugaucaugggccagcugacauggaacgaccucauccgucugugcaucauggugggggcuaacgccuccgaccggaugggcaugggcaccaccuaucuggcccucauggccacguucaagaugcgcccgauguucgccgugggccugcuguuccggcgccucacgucucgggaggugcugcugcucaccaucggacugagccuaguggccucuguggagcuccccaacagccuggaagaguuaggggacggucuugccaugggcaucaugauccugaagcugcucaccgacuuccagucccaucagcucugggccacucugcucagccuuacguucaucaagaccaccuucuccuugcacuaugcguggaaaaccauggcaaugguccucagcauuguuucccucuucccccugugccucagcacgacuagccagaagacaaccuggcuccccguucuacucgggucacucggcugcaagccgcugacgauguuccucaucgccgagaacaagaucugggggaggaaaucauggccccugaacgagggcaucauggccgugggaauagugagcauacugcucagcucccugcuuaagaaugacgucccucucgccgguccccugaucgcgggcgggauguuaaucgccugcuacgugaucagcgggaguagcgcagaccucucccuggagaaagccgccgaggugaguugggaggaggaggcggagcacuccggggccagccauaacauacuggucgaggugcaggacgacggcacgaugaagauuaaggacgaggagcgggacgacacccucaccauccuccugaaggccacauuacuggccgucuccggagucuacccccugaguauccccgcgacccuuuucgugugguacuucuggcagaagaagaaacagcgcuccggcgugcugugggacacucccagcccacccgagguagagcgggcggugcuggacgacgguauauaccgcaucaugcagcggggguuacucggccgcucccaggugggggucggggucuuccaggagaacguguuccacaccauguggcauguaacgcgaggggccgugcucauguaccagggcaagcgccuggaacccagcugggccagugucaagaaagaccucaucucguacggcggcggauggcgucugcgcggguccuggaacacgggcgaggagguccaagugauagccguugagcccgggaagaaccccaagaacguccagaccgcccccggcaccuucaagacccccgagggcgaggugggggcgaucgcccuggauuucaaacccggaacgucagggucccccaucguuaaucgggagggcaagauaguuggccucuacgggaacggcgucgugaccaccagcggaaccuacgucagcgccaucgcccaggcgaaggccucccaagagggcccgcugcccgagaucgaggacgaaguguucagaaagcggaaccugacgaucauggaucuccaccccgggagcggcaagacucgccgguaccugccggcaaucgugcgcgaagccauaaagcgcaagcugcguacuuuaauccuggcccccacucgcgucguggcguccgagauggcggaggcccugaagggaaugccgauccgguaccaaacgaccgccgucaagagcgaacacaccgggaaggaaauugucgaucuuaugugccacgcgaccuucacuaugcgccuucucucucccgugcgggucccgaacuacaacaugaucauaauggacgaggcgcauuucaccgaccccagcuccaucgcugcccgcgguuacauuucuacccgggucggcaugggugaggcugcagcgaucuucaugaccgccacgccgcccgggagcguggaggcguuuccgcagagcaacgccgugauucaggacgaggaacgagacauccccgagcggucauggaacagcggcuacgaguggaucacugacuuccccggcaagaccgucugguucguaccaaguaucaagagcgggaacgauaucgcgaauugccuccgcaagaacggcaagcgggugauccaguugucccgcaagacuuuugauacggaauaucagaaaaccaagaauaacgacugggacuacgucgugaccaccgacaucagcgaaaugggggccaacuuccgggccgaccgugugauugacccgaggcgcugucugaagcccgucauucucaaggacggccccgagagggugauccuggccgggcccaugcccgugacggucgccuccgcugcgcagcgucggggccgcauaggccgcaaccacaauaaggagggggaccaguacaucuacaugggacagccccugaacaaugaugaggaccacgcgcacuggaccgaggcgaagaugcuccuggacaacaucaacacacccgaggguaucauucccgcccuuuucgagccggagcgggaaaaguccgcggccguggacggcgaguacagauugcgcggggaggcgcgcaagaccuucgucgagcugaugcggcgaggcgaccugcccguuuggcucuccuacaagguggccagcgagggauuccaguacagcgaccgccgcuggugcuucgacggagagcggaacaaucagguccuggaggagaacauggacguggagaucuggaccaaggagggcgaacgcaagaagcugcggccccgcuggcucgacgcgcggaccuacucugacccucuggcgcuuagagaauucaaggaauucgccgccggccgccgaagcguguccggcgaccucauccuggagauaggcaagcugccgcagcaccucacgcagcgggcacagaacgcgcucgacaaccuggucaugcuccauaacagcgagcaaggcgggcgggcauaccgacacgccauggaggaguugcccgauaccaucgagacgcugaugcuccuggcccucaucgccgugcuaaccgggggggugacccuguucuuccugucggggcgcggccucggcaagaccagcauagggcuacugugcgugauggccuccagcgugcuccuguggauggcuuccguggagccccacuggaucgcugccagcaucauucuggaguuuuuccucaugguccugcugauccccgagccggaccggcagcgcacgccccaagauaaccaacuggccuacguggugaucggccugcuguucaugauacucacggucgcggccaacgagaugggucugcuggagaccaccaaaaaggaccucggcaucgggcacguggccguggagaaccaccaccacgccgccaugcuggacgucgaccuucaccccgcguccgcguggacccucuaugccguggccacgaccauuaucacgccgaugaugagacacacuaucgagaacacgacugccaacaucagcuuaaccgcgaucgccaaccaggcagccauucugaugggacucgauaagggcuggcccauauccaagauggacauaggggugccacugcuggcgcucggcugcuacagccaggucaauccccugacccuaacggccgccgugcucaugcuuguagcccacuacgccaucaucggaccgggccuacaggcgaaggccacccgcgaggcccagaaacgaaccgccgccgggaucaugaagaaccccacgguagacggcaucguggccaucgaccuggaccccguggucuacgacgccaaguucgagaagcagcugggccagauuaugcugcucaucuuaugcacgagucaaauccuccugaugcggaccaccugggcccuaugcgaaucuaucacgcuggccacgggcccgcuaaccacccugugggaggguucuccggggaaguucuggaacaccacgaucgccgugagcauggcgaauaucuucaggggguccuaucuggccggcgccggacucgccuucagccugaugaagucccugggcgggggccgucgcgguaccggcgcgcagggugagacccugggcgagaaguggaagcggcaacucaaccagcuuuccaagagcgaguucaacaccuacaagagauccggcaucauggagguggaccgguccgaggcgaaggaagggcucaagcgcggcgagacgaccaagcacgccgucucccgcgggaccgccaagcugcgcugguucguggagcggaaccucgugaagcccgaggggaaggucaucgaccugggcugcgggcgcgguggguggagcuacuacugcgcaggccucaagaaggugacagaggugaagggguacacgaagggcggccccgggcacgaggagccaauuccgauggcgaccuacggcuggaaccugguuaagcugcauuccgggaaggaugucuuuuucaucccgcccgagaagugcgacacccuccugugcgacaucggcgagagcucccccaacccgaccaucgaggaaggccguacgcugcgcgugcucaagaugguggagccguggcugcgaggcaaccaguucugcauaaagaucuuaaacccguacaugcccucugugguggagacacucgagcaaaugcagcgaaagcacggcggcaugcucguacggaacccguuguccaggaauagcacccacgagauguacugggucuccuguggcaccgggaacauugugucagccguaaacaugacgucucgcauguugcugaaccgguucacgauggcucaccgcaaaccuaccuacgaacgggacguggaccuuggcaccggcacccgccacguggccgucgagccugaaguggccaaccuggacaucauuggacagcgcaucgagaacauaaagcaugagcauaagucuacauggcacuacgacgaggacaaccccuacaaaaccugggcguaccacggauccuacgaggugaagccgaguggguccgccagcagcauggucaacggcguggucaagcugcugaccaagccgugggacguuauccccauggugacccagaucgccaugacggacacaacgcccuucgggcaacagcgcgucuucaaagaaaagguugacacacggacaccgaaggccaagcgaggaacugcccagaucauggaggucaccgcgaggugguuauggggguuccugucccgcaacaagaagccccggauuugcacccgcgaggaguucacgcggaaggugcgcagcaaugccgccaucggggcgguguucguggacgagaaccaguggaacuccgcaaaggaggcagucgaggacgagcgguucugggaccucgugcaccgcgagcgggaguuacauaagcaggguaagugcgcgaccugcguguacaacaugauggggaagcgcgagaagaagcugggcgaguuugggaaggccaagggcagccgggcaaucugguacauguggcugggcgcccgcuuccucgaauucgaggcccugggcuucaugaacgaggaucacugguucucccgggaaaacagcuuauccggcguagagggggaaggccuccacaagcuaggguauauucugcgcgacauuagcaagauacccggcgguaacauguaugccgacgacaccgcggguugggacacccgcaucacagaggaugaccuccaaaaugaggcgaaaaucaccgacaucauggagccggagcacgcgcugcuggccaaggccaucuuuaagcugacauaccagaacaagguggucaggguccagcgccccgccaagaacggcaccgugauggacguuaucucccgccgcgaccagcgggggagcggccaggucggcacguacgggcuuaauaccuuuaccaacauggaggcgcagcucauccgccagauggaguccgagggcaucuucagccccuccgaacucgagacgcccaaccucgcggagagagcccuugacuggcucgagaaguaugggguggagcggcugaagcggauggccaucagcggcgacgacuguguggucaagccgauagacgaucgcuuugccacggcccugaccgcgcucaacgacauggggaaggugcgaaaggacaucccccaaugggaacccaguaagggcuggaacgacuggcagcaggugcccuucugcucucaccauuuccaccagcugauuaugaaagacggccgcgagaucgucguaccgugccggaaucaggacgagcugguugggagggcccgggucucucagggcgccggguggagccuccgcgagacugcaugccugggcaaaagcuacgcgcagauguggcaguugauguacuuccacaagcgggaccucagacuggccgcgaacgccaucugcuccgccgugcccguugacugggucccuaccucucggacaaccugguccauccacgcgcaccaucaguggaugacuaccgaggacaugcugagcguguggaaccgcguguggaucgaggaaaaccccuggauggaagacaagacucauaucuccuccugggaggacgucccguaucucgggaagcgcgaggaccaguggugcggaucccuaaucggccuaaccgcccgggccaccugggccaccaacauccagguggccaucaaccaggugcgccggcucaucgguaacgagaacuaccuggauuacaugaccagcaugaagcgguuuaagaacgagucggaucccgagggggcgcugugguga

SEQ ID NO: 24397 - RNA, 9879 nt, Artificial Sequence
  derived and/or modified CDS sequence (opt11) from DENV-1__FJ898421__SS-prME
agcgugaccaugcugcucaugcugaugccgaccgcccuggcguuccaccucaccacccgcggcggggagccccacaugaucgucuccaaacaggagcggggcaagagccugcuguucaagacuuccgccggggugaauaugugcacccucaucgccauggaccugggcgagcugugcgaggacacaaugacauacaaaugccccaggaucaccgaggccgagcccgacgacguugacuguuggugcaacgccaccgacacgugggugaccuacgggaccugcagccagacaggcgagcacagacgcgacaagcgguccguugcacucgcgccccacguggggcuggggcuugagacgcgcaccgagaccuggaugagcuccgagggcgcauggaagcagauccagcgggucgagacgugggcccucagacaccccggguucacggugaucgcacuguuccuggcgcacgccaucgggaccagcaucacccagaaggggauuaucuucauccuccugaugcuggugacccccuccauggccaugcggugcguaggcauuggcagccgugacuuuguggaggggcucuccggcgccacguggguggaugucgugcuggagcacgggagcugcgugaccaccauggccaaggauaaacccacucuggacaucgagcuccugaagacagaggucacgaaucccgcggugcugcggaagcucugcaucgaggccaagauuuccaacaccaccacggacagccgcugcccgacccagggcgaggccacccugguggaggagcaggacgcuaauuucgucugccggcgcacauucguggaccggggcuggggaaacggcugcgggcuguucggcaaggggucccucaucacgugcgccaaguucaaaugcgugaccaaacuggaggggaagauuguacaguacgagaaccugaaguauucagucaucgugacaguccacaccggggaccagcaucagguggggaacgaauccacugagcacggcaccaccgcgaccaucacgccccaggcgcccacgaccgagauccaacucaccgacuacggggcccuaacucuggacugcagcccccgcacgggccuggacuucaacgaaaugguccugcugaccaugaaagagaaguccuggcucgugcacaagcagugguuccuagacuugccccuccccuggaccagcggggccagcacgucccaggaaacguggaaccggcaagaccuccuggugaccuucaagaccgcccacgcaaagaagcaagaggucguugugcugggcagccaggagggcgccaugcacaccgcccugacgggggccaccgagauccagacauccggaaccacgaccaucuucgccggacaccugaagugccguuuaaagauggacaagcugacccuaaagggcaugagcuacguaaugugcaccggauccuucaaguuagagaaggagguggcggagacgcagcacggcaccgugcugguccagaucaaguaugaggggaccgacgcacccugcaagauccccuucagcacccaagaugagaagggggugacacagaacggccggcugaucaccgcaaacccgaucguuaccgacaaggagaagcccgucaacaucgaggccgagccgcccuucggggaguccuauaucgugauuggcgcgggcgagaaggcucugaaguuaagcugguucaagaagggguccuccaucggcaagauguucgaggccaccgcccgcggggcccggcgcauggcgauccugggcgacacggccugggauuucgggucuaucggcggcguguucacgagcgucgggaagcuggugcaccagaucuucgguaccgccuaugggguccucuucucuggcgucagcuggaccaugaagauugggaucggcguccuacugacgugguugggccugaacucccgcucgaccucccuuagcaugaccugcaucgccgucggucucgucacccuguaccugggagugauggugcaggcugacuccggaugcgucaucaacuggaagggccgagagcucaagugcgggucaggcaucuucgugacgaacgaggugcacacuuggacggagcaguacaaguuccaagcggacucgccaaaacgccuguccgccgccaucggaaaggccugggaggaaggggucugcggcauccggagcgccacccgccuggagaacaucauguggaagcagaucuccaaugagcucaaccacauacugcuggagaacgacaugaaguuaaccgugguggucggggacguggcgggcauacuggggcagggcaagaagaugauccggccccaacccauggaguacaaguauagcuggaagucauggggcaaggccaagaucaucggggccgacgcccagaacacgaccuucauuaucgacggcccgaacacgccggagugucccgacgaccaacgcgcguggaacaucugggaaguggaggacuacggguucggcaucuucaccacgaacaucuggcugaaguugcgggacagcuacacccaggucugcgaccaccgccugaugucugccgccaucaaggacagcaaggcaguacacgccgacaugggcuacuggaucgaguccgagaagaacgaaacauggaagcuggcgagagcaagcuucaucgaagugaagaccugcauauggcccaagucacacacgcucuggucaaacgggguccuggaguccgagaugaucauccccaagaucuacggcgggccgaucagccagcauaacuacaggcccggcuacuucacccagaccgccgggcccuggcaccugggcaaacuagagcuagacuucgaccugugcgagggcaccacggugguggucgaugagcauugcggaaaccggggcccgucccuccgcaccaccaccgugacggggaaaaucauccacgaauggugcugcagaagcugcacccuuccgccccuacgcuuccggggcgaagacgggugcugguacggcauggagauccgcccugugaaggagaaggaggagaaccuaguaaaguccaugguguccgccggcagcggggagguugacuccuuuagccugggccugcucuccaucagcaucaugaucgaggaggucaugagaucccgcuggagccggaaaaugcugaugaccggcaccuuggcaguguucuuccuccucaucaugggucagcugacguggaacgaccucauccgccugugcaucauggugggggccaacgccuccgaccgcauggggaugggcaccaccuaccuggcccucauggcgaccuucaagaugcggccgauguuugccgucgggcugcuguuccgccggcucacgagcagggaggugcugcuucucaccaucggccugucccugguggcgagcguggaguuaccgaacucccuggaggagcugggggacggccucgccaugggcaucaugaucuuaaagcuacucaccgacuuccagagccaccagcugugggcaacccuacucucccugacguucaucaagaccaccuuuagccugcacuaugccuggaagacaauggcgaugguguuauccaucguaagccuguuucccuuaugccucaguacgaccagccagaagacaacguggcucccggugcugcucgggucccugggguguaagccgcuuacgauguuccuaaucgccgagaacaagauaugggggcggaaguccuggccccugaacgagggaaucauggcaguggggaucgucagcauccugcucucgucacugcugaagaaugacgugccccucgccggcccacugaucgccggcggcauguuaaucgcgugcuacgugaucuccggcagcuccgcugacuugucgcuggagaaggccgccgaggucuccugggaggaggaagccgagcacagcggggcuucccacaacauccuggucgaaguccaggacgaugggaccaugaagaucaaggacgaggagcgcgacgacaccuugacaauccugcugaaggccacgcucuuggccgucagcgggguguacccgcugucuauccccgccacccucuucgugugguacuucuggcagaagaagaagcaacggagcggcguccugugggacacccccagcccgccugagguggagcgcgccgugcuugaugacggcaucuaccgaaucaugcagcgcgggcugcucggcagaagccaggucggggugggcguuuuccaggagaacgucuuccacaccauguggcacguuacccgcggggcggugcugauguaccagggcaagcggcuagagcccagcugggccagcgucaagaaggaccugaucuccuacggggggggcuggaggcugcgggggagcuggaacacgggcgaggagguccaggugaucgccgucgagcccgggaagaaccccaagaacgugcagaccgcccccggcacuuuuaagacucccgagggcgagguaggagccauagcgcuagacuucaagcccggcacauccgggucgcccaucgucaaccgagagggcaaaaucgugggucucuacgggaacggcgucgucaccaccagcgggaccuacguguccgcaaucgcgcaggcgaaggcuagccaggaggggccgcugcccgagaucgaggacgaggucuuccguaagcgcaaccugaccaucauggaucuccaccccggguccggcaagacucggcgcuaccugccggccauuguccgggaggccaucaagcgcaagcuacgcacccucauccuggcccccacccgggugguggccagcgagauggcggaggcccugaagggcaugcccauccgauaccagacgaccgccgugaaguccgagcacaccggcaaggagaucguggacuugaugugccacgccaccuucacgaugcggcugcugagcccggugcgcgucccgaacuacaacaugauaaucauggacgaggcccacuucacggaccccuccagcauagcggcccggggcuacaucagcacccgcguggggaugggcgaggcugccgccaucuucaugaccgcgacgccgcccggguccguggaggccuucccacaguccaacgcaguuauccaggacgaggagcgcgacauccccgagcgcagcuggaacaguggauacgaguggaucaccgacuuccccggcaagaccgucugguucgugccuagcaucaaguccggaaacgacauugccaacugccuccggaagaacggcaagcgcguuauccagcugagcagaaaaaccuucgacacggaguaucagaagacaaagaacaacgacugggacuacguggugaccaccgacauuuccgaaaugggagcgaacuucagggccgaccgggucaucgacccucgccggugccugaagcccgugauccucaaggacggccccgagcgcguaauccuggccgggcccaugccugucacgguggccagcgccgcgcagcggcgcggccggaucggacgcaaccacaacaaggagggggaccaguacaucuacaugggacagccccugaacaacgacgaggaccacgcccacuggaccgaggccaagaugcuccuggacaauaucaacacucccgagggaaucauccccgcccuguucgagccggaacgcgagaagucugcagcggucgacggugaguacagauugcgcggggaggccaggaagacauucguggaacucaugcgccggggcgaccugcccgugugguugagcuacaaggucgccagcgagggcuuccaguacagcgaccgccgguggugcuucgacggggagcgcaacaaccaggugcuggaagagaacauggacguggagaucuggacgaaggagggcgagagaaaaaagcuacgcccccgguggcucgacgcccgcaccuacagcgauccccuggcccugcgggaauucaaggaguucgcggccgggcgccgguccgucagcggcgaccucauccuagagauuggcaaguuaccgcagcaccugacccagcgcgcccagaacgcucuggacaaucuggugaugcuccacaacuccgagcagggcgggcgggcguaccgccacgccauggaggagcugcccgacacuaucgagacgcugaugcuccuggcccugaucgccgugcucaccgggggcgucacccuguucuuccucucagggcggggccuaggcaaaaccuccaucgggcugcugugcgucauggccagcuccgugcuccuguggauggcgagcguagagccccacuggaucgccgccuccauuauccuagaguucuuccucaugguacugcuaauccccgagccggaccgccagcggacgccccaggacaaccagcuagccuacguggucaucggccugcuguucaugauacucacuguggccgcaaacgagauggggcuacuggagaccaccaagaaggaccucggcaucgggcacguugcagucgagaaccaccaccacgccgccaugcuggacguggaccugcaccccgccucggcauggacccucuacgcuguggccacgaccaucaucaccccgaugaugcgccacaccaucgagaacacgacggccaacaucucccugacugccauagccaaccaagccgccauccugaugggacucgacaagggcuggcccaucagcaaaauggacauaggugucccccugcuugcccucggcugcuauucccaagucaacccccugacauugacggcggccgugcucaugcuggucgcccacuacgcuauuaucggucccggccugcaggccaaggcgacccgcgaagcacagaagcggaccgccgccgggaucaugaagaaccccacuguggacggcaucguggccaucgaucucgacccagucguguaugacgccaaauucgagaagcagcugggucaaaucaugcugcuaauccugugcaccagccagauucugcucaugcgcaccaccugggccuuaugcgaguccaucacucuagccacggggccccucaccacucugugggagggcagcccggggaaauucuggaacaccacgaucgccguguccauggcuaacaucuuccggggcagcuacuuggccggcgccggguuggccuucagcuugaugaagucccugggcgggggccgucgggggacuggcgcccagggcgagacccucggggagaaguggaagcgccagcugaaccagcugucaaaauccgaguucaacaccuacaagcggagcggcauuauggagguugacagguccgaggcgaaagaagggcucaagaggggcgagacuaccaagcacgccgugagccgcgggaccgcgaaacugcggugguucguggagcgcaaccuugucaagcccgagggcaaggugaucgaccugggcugcgggcgggguggcugguccuacuacugcgcuggacucaagaaggugaccgaggucaagggguacacgaaaggcgggcccgggcacgaggagcccaucccgauggccaccuacggguggaaccuagugaagcugcacagcgggaaggacguguucuucaucccgccggagaagugcgacacccuacugugcgacaucggcgaguccagcccuaacccgaccaucgaagaggggcgcacgcugaggguacucaagaugguggagcccuggcugcgcggcaaccaguucugcaucaagaucuuaaaucccuauaugcccuccguggucgagacgcucgagcaaaugcagcggaagcacggcgguaugcuggugcgcaauccgcugagucggaacuccacccacgagauguacugggugagcugcggaacagggaacaucguauccgccgugaacaugacaagccgcaugcuucugaaccguuucacgauggcccaccgcaagcccacuuacgagcgcgacguggaccuggggaccggaacccggcacgucgccguggagccggagguggccaaccucgacaucaucgggcagcgcaucgagaacaucaagcacgagcacaaguccacguggcacuacgacgaagacaaccccuacaagaccugggccuaccacggcaguuaugagguuaaaccguccgggagcgcaagcuccauggugaacggcguuguuaaacugcugaccaagcccugggacgugauccccauggugacccagaucgcaaugacggacaccacccccuucgggcagcagcggguguucaaagaaaagguugacacccgcaccccgaaggcuaagcggggcacugcccagauuauggaggucaccgcacgcuggcucuggggcuuucugagccguaauaagaagccccgcaucugcacccgggaggaguucacgcgcaaagugcgguccaacgcggccaucggggccguguucgucgacgagaaccaguggaacagcgccaaggaggcggucgaggacgagcgcuucugggaccugguucaccgggagcgcgagcuccacaagcaagggaaaugcgcgaccugcgucuacaacaugauggggaaacgggagaagaagcugggcgaauuugguaaggccaagggcucccgcgccauuugguacauguggcugggcgcccgguuccucgaguucgaggcgcugggguucaugaacgaggaccauugguucagccgcgagaauucgcugagcggcguggagggggaaggccuccacaagcugggauacauccugcgggacauauccaagauccccggcggcaacauguacgccgacgacaccgccgggugggacacccgcaucacagaggacgaucuccaaaacgaggccaagaucaccgacaucauggaaccggagcacgcccugcuggcgaaggccauuuuuaagcugaccuaccagaacaaggugguccgggugcagcgacccgccaagaacggcaccgugauggacgucaucagcagacgggaccaacgcggguccggccaggugggcacguacgggcugaauaccuucaccaauauggaggcccaguuaauucggcaaauggagagcgagggcaucuucucccccagcgagcucgaaacgcccaacuuggccgagcgcgcgcuggacuggcucgagaaguacgggguggagcggcugaagcgcauggccauuuccggcgacgauugcguggugaagccgaucgacgaccgguucgccacggcccugaccgcccucaacgauauggggaagguccgcaaggacauuccucaaugggagcccagcaagggcuggaacgacuggcagcagguucccuucuguucccaccacuuccaccaguugauaaugaaggacggccgggagaucguugugccgugccgcaaccaggacgaauuggugggacgggcgcgagugagccagggggcugguuggagccuccgggagaccgccugccugggcaaguccuacgcccagauguggcagcucauguauuuccaccgacgggaccuccgcuuggcggcgaacgccaucugcagcgccgugccggucgacugggugcccacaucucggacgaccuggagcauccacgcucaccaccaguggaugaccaccgaggacaugcuguccguguggaaccgcguauggauagaagagaaccccuggauggaggacaaaacgcacaucucauccugggaggacguuccguaccucggcaagcgcgaggaccaguggugcggcucgcugaucggccugaccgcgcgggccaccugggccaccaacauccagguggccaucaaccaggucagacggcucaucggcaacgaaaacuaccuggacuacaugaccuccaugaagcgcuuuaagaacgagagcggccccgagggagcgcugugguga

SEQ ID NO: 24398 - RNA, 9879 nt, Artificial Sequence
  derived and/or modified CDS sequence (opt11) from DENV-1__FJ898423__SS-prME
agcguuaccauguuacucaugcugaugcccaccgcccuugccuuccaucucaccacgcggggcggggagccccacaugaucguauccaagcaggagcgggguaagagccuccuguucaagaccuccgccggggugaacaugugcacucucaucgccauggaccugggcgagcucugcgaggacaccaugaccuauaagugcccccggaucacggagguggagcccgacgacguggauuguuggugcaacaccacggacaccugggugacuuaugggaccugcagccagacgggcgaacaccggcgggacaaacgcuccguggcccucgcgccccacgucggccuggggcuggagacgcgggccgagaccuggaugagcucugagggcgcguggaagcaaauccagaaaguggagaccugggcccuccgccaccccggguucaccgugaucgcccuguuuuuggcccacgcgauaggcaccucuauaacccagaaggggaucaucuucauucuccugaugcuggucacccccuccauggccaugcgcugcguuggcaucggcucgcgggacuucguggaggggcugucuggcgccacguggguggacguggugcuggaacacgggagcugcgucaccaccauggccaaggacaagcccacccuggacauagaacucuuaaagacggaggugaccaaccccgccgugcuacgcaagcucugcaucgaagcgaagaucaguaacacaacuacggacagccgaugcccgacccagggcgaggcuacccuggucgaggagcaggacgcuaacuucguaugucgccggacguucguagaccgcggcugggggaaugguugcgggcuguucggcaaggggucccucaucaccugcgcaaaguucaagugcguaaccaagcuggaggguaagaucauccaguacgagaaccugaaguacucugugaucgugaccguccacaccggagaccaacaccagguggggaacgaguccacggagcacggcaccaucgccaccauuacgccccaggcgcccaccuccgagauccagcucacggacuacggggcacugacgcuggacugcagcccccguaccggccucgacuucaacgagaugguccugcugaccaugaaggagaaauccuggcucgugcacaaacagugguuccuggaucugccccuccccuggacgaguggggccuccacuagccaggagaccuggaaccgucaggaccugcugguaaccuucaagacggcccacgccaagaagcaggaggucgucgugcucggcucccaggagggcgcgaugcacacggcccugaccggcgccaccgagauccagacaaccgggaccaccacgaucuucgccgggcaccugaagugccggcucaagauggacaagcugacccugaagggcaugagcuacgucaugugcacggggucguucaagcucgagaaggagguggccgagacacagcacgggacggugcugguccaaaucaaguaugaggguacagacgcgcccugcaagauccccuucagcacccaggacgagaagggggugacccagaacggccgccugaucacagccaacccgaucgugacugauaaggagaagccagucaauauagaggccgagccgcccuucggggaguccuacaucgugaucggcgccggcgagaaggcguuaaagcucagcugguucaaaaagggguccagcaucggcaagauguuugaggccaccgcccgcggggccagacgcauggccauccugggcgauaccgcgugggacuucggcuccaucgguggcguuuucacgucggucgggaaacuggugcaccagaucuucggcacggccuacggugugcuguuuuccggcgucagcuggaccaugaagaucgggaucggcgugcugcugaccuggcucggccugaacucccgcagcacaucccuguccaugaccugcaucgcagugggucucauuacccuguaccugggugucauggugcaggccgacuccgggugcgugauuaacuggaagggccgcgagcucaaaugcgggucaggcaucuucgucacuaacgaggugcacacguggacagagcaauacaaguuccaggccgacagcccgaagcggcuguccgcagccaucgggaaggccugggaggagggagugugcggcauacgcagugccacccggcuggagaacaucauguggcgacagaucuccaacgagcucaaucacauccugcuggagaacgacaugaaguucaccgucguggugggggaugucgugggcauacucgcccaggggaagaagauggugcgaccgcagccuauggagcacaaguacagcuggaaguccuggggcaaggcgaagaucaucggcgccgacguucaaaacaccacguucaucaucgacgggcccaacaccccggaaugccccgacgaucagcgcgccuggaacaucugggagguggaggacuacggcuucgggaucuucaccaccaauaucuggcugaagcugcgggacagcuacacucaggugugcgaccaccgccucauguccgccgcgauuaaggacagcaaggccguccacgccgauaugggauacuggaucgaaucugagaagaacgagaccuggaagcuggcccgggccuccuucaucgagguaaagaccugcauuuggcccaaaucccacacccuguggagcaauggcgugcucgaguccgaaaugauaauccccaagaucuacggaggcccgaucagccagcacaacuaccgccccggguacuucacacagaccgcgggccccuggcaccuggggaagcuggagcucgacuucgaccuuugcgagggcaccaccguugugguggacgagcacugcggcaaccggggaccgucucugcgcacaaccaccgucaccggcaagaucauccacgaguggugcugccggagcugcacgcugccgccccuccgcuucaagggggaggauggcuguugguacggcauggagauccggccagugaaggagaaggaggagaaucugguuaaguccaugguaagcgcugggagcggcgagguggacucauucagccucgggcugcugugcaucuccauuaugaucgaggaggugaugcgcucucgcuggucccgcaagaugcucaugaccggcacccuggccguuuucuuccugcucaucauggggcagcugaccuggaacgaucugauucgaucaugcaucauggugggcgccaacgccagugaccgcauggggauggguacgaccuaucucgcgcugauggccaccuucaagaugcgcccgauguuugccguuggacuucuguuccggcgccugaccucgcgggagguccugcuccugacuaucggucugucccucguggccagcguagaacuucccaacucccuggaggagcucggcgacggccuugccaugggcaucaugauccugaaacucuuaaccgacuuccagagcuaccaacucugggcgacccuccugucccugacuuucaucaagacgacguucagccuccacuacgccuggaagaccauggccauggugcugaguaucgugagccugcucccacugugccuguccacuacaagccaaaagaccaccugguuacccguccugcugggcucccucgguugcaagccgcugaccauguuccugaucgccgagaacaagaucuggggccgcaagagcuggccccucaaugaagggaucauggcaguuggcaucgugagcauccugcugucaagccuacugaaaaacgacgucccccuggccgggccccucaucgccggcggcaugcugaucgcgugcuacgugaucucggggagcuccgccgaccugucucucgagaaggcagccgaggugagcugggaggaggaggccgagcacagcggcgccucccacaacauucuggucgaggugcaggacgacgggacgaugaagaucaaggacgaagagcgggacgacacccugaccauccuccugaaggcuacccuguuagccguuagcggcgucuacccgcuguccauccccgccacccuguucgugugguauuucuggcagaagaagaagcagcggagcggggugcucugggacacgcccagcccgcccgaggucgagcgggccguccucgacgaugggaucuaucgcaucaugcagcggggccugcugggccgcagccaggugggcgucggcguguuucaggagaauguauuccauacgauguggcacguuacccggggcgcagugcucauguaccaggggaagcgcuuagaacccuccugggcaagcgugaagaaggaccugaucuccuauggcggcggguggcggcuccaaggcagcuggaacaccggggaggagguacaggugaucgcgguagagccaggcaagaaccccaagaacguccagacggcccccgggaccuucaaaaccccugagggggaggugggagcuauugcccuggacuucaagcccgggaccucaggcagccccaucgugaaccgugagggaaagauugucggcuuauacggcaacgggguggugacgacaagcggcaccuacguuuccgccaucgcccaggccaaggccagccaagaagggccacuccccgagaucgaggacgagguuuuccgcaagcgcaaccugacgaucauggaccugcaccccggcucugggaagacccgccgcuaccucccggccauagugcgagaggcgaucaagcguaaacugcggacccuuauccucgcccccacccgcguuguggccagcgagauggcggaggcccugaaggguaugccuauccgcuaccagaccacggcagugaaguccgagcacaccggccgggagaucguugaccuuaugugccacgccaccuucaccaugcgccuccugagccccgugcgggugccgaacuacaacaugaucaucauggacgaggcccacuuuacggaccccuccagcaucgcggcaaggggguacaucucgacccgggucggcaugggggaggcggccgccaucuucaugaccgccacgccgcccggcagcguggaggccuucccacaguccaacgcggugauccaggaugaggagcgcgauaucccugagcggagcuggaacuccggguaugaguggaucacugacuuccccgggaagaccgugugguucgugccuagcaucaaguccggcaacgacauugccaacugccugcgcaagaacgggaagcgggugauucagcucagccgaaagaccuucgacacugaauaccagaagacaaagaacaaugacugggacuacgucguuaccaccgacaucuccgagaugggcgccaacuuucgggccgaccgagugaucgacccgcgccgcugccuuaagcccguaauccugaaagacgggcccgagcgggugauccucgcgggccccaugccggucaccguggccagcgccgcccagcgccgggggcgcauaggccggaaccacaauaaagagggcgaucaguacaucuacaugggucagccuuuaaacaacgacgaggaccacgcccacuggacggaggcgaagaugcuguuggacaacaucaacacccccgagggcauuauccccgcauuguuugagccugagcgcgaaaagagcgccgcgaucgacggggaguaccgccugcggggcgaggcccgcaagaccuucguggaacucaugcggcgcggcgaccugcccgucuggcugagcuacaagguagcgagcgagggcuuccaguacuccgaccggcgcugguguuucgacggcgagcggaacaaccaggugcuggaggagaacauggacgucgagauuuggaccaaggagggggaaaggaagaagcugcggccccgcuggcuggacgccagaacauacagcgacccucucgcccugcgcgaguucaaggaguucgccgccggccgccgcuccgugagcggggaccugauccucgagaucggcaagcuaccgcagcaccugacccagcgggcgcagaacgcccucgauaaccugguaaugcugcacaacuccgagcagggcgggcgcgccuaccggcacgcgauggaggagcuccccgacaccaucgagacccucaugcugcucgcgcugauugccguccugacgggcggcgugacccucuucuuccugagcggccgcgggcuggguaaaaccuccaucggccuccugugugugauggccagcuccgcgcugcucuggauggccagcgucgagccgcacuggaucgcggccuccaucauccuggaguucuuccugauggugcuccugauccccgagccugaccggcagcgcacgccccaggacaaccagcuggccuacguggucaucgggcucuuauucaugauccugacuguugccgcuaacgagaugggccuccuggagacgaccaagaaggaccuggggaucggccacgucgcggucgagaaccaccaccacgccaccaugcuagacguggacuugcaccccgcaagcgccuggacccuguacgccgucgcgaccaccaucaucaccccgaugaugcggcacaccauugagaacacgaccgccaacaucucccucaccgccaucgccaaccaggccgccauccuuauggggcuggacaagggcuggcccaucagcaagauggacaucggcgugccucuccuggcccuggggugcuacucucaggugaacccccucacccugacugccgccgugcugaugcucguugcgcacuacgccaucaucggaccggggcugcaggccaaggcgacccgcgaggcccagaagcgcaccgcggccggcaucaugaaaaacccgaccguagacgggaucguggccaucgaccuggaucccgucguguacgacgccaaauucgagaagcagcucggucagaucaugcugcugauccucugcacgagccagauccugcuuaugcggaccacgugggcccucugcgaauccauaacgcuggcaacggguccccugaccacccucugggaggggagcccgggcaaauucuggaauaccacgauagccguauccauggccaacaucuuccgcgggagcuaccuggccggcgccggccuagcguucagccucaugaaguccuuggggggugggcggagagggacgggggcgcagggcgagacccugggcgagaaguggaagcggcaacucaaccagcugagcaaguccgaguucaacaccuacaagcgcagcgggauaauggagguagaccgauccgaggccaaggagggccuucgccgcggggagacgaccaagcacgccgugagccgcggcaccgcgaagcuccguugguucguggagcgaaaucuggucaagccggaggggaaggugaucgaccugggcugcggccgcggcggguggucguacuacugcgccggucugaagaaggugacggaggucaaaggguacacaaagggcggccccggacacgaggagcccauccccauggccaccuacggguggaaccuagugaaacugcacagcggcaaagacguguucuucaucccgcccgagaaaugcgacacucuacucugcgacauuggggagucuagccccaacccgacgaucgaggagggccgcacccugaggguccugaaaauggucgagcccuggcuccgggggaaccaguuuugcaucaagauccugaacccuuacaugcccucuguggucgagacccuggagcacaugcagcggaaacacggagguaugcuggugcgcaacccgcugagccggaacuccacccacgagauguauugggugagcugcgggaccggcaacaucgucuccgccgugaacaugaccagccgcauguuauugaaccgcuucacgauggcccaccgaaagcccaccuacgagcgcgacguggaccugggggcgggcaccagacacgucgccguggagcccgagguggccaaccucgacaucaucggccagcguaucgagaacaucaagcacgagcacaaguccaccuggcacuacgacgaggauaaccccuacaaaacgugggccuaccaugggucauacgaggugaagcccuccggcagcgcaucguccauggugaacggggucgugaagcuccugaccaagcccugggacgugaucccaauggucacccagaucgcgaugaccgacacgacccccuucggccagcagcggguguuuaaagagaagguggacacacgcaccccaaaggccaagcgaggaacggcccaaaucauggagguaaccgcccgcugguuguggggcuuccucagccguaacaagaagccccgcaucuguacccgggaggaguucacucgcaaggugcgguccaacgcugcgaucggcgccguguucgucgacgagaaccaguggaacuccgccaaggaggccgucgaggacgagcgcuucugggaucuggugcaccgggagcgcgagcugcacaagcaggggaagugcgcgacgugcgucuauaacaugauggguaagcgggagaagaagcucggggaguucgggaaggccaaagggucccgcgccaucugguacauguggcucggcgcccgguuccuggaguucgaggcccucggcuucaugaacgaggaccauugguucagcagggagaacucccugagcgggguggaaggcgaggggcugcacaaacucggcuacauccugcgggacaucuccaagauccccggggggaacauguacgcggacgacacggccggcugggacaccaggauuaccgaggaugaccugcagaacgaggccaagaucacggacaucauggagccggagcacgcccuccuggccaccucgauauucaaacuaacuuaccagaacaaggugguccgcgugcagcggccugcgaagaaugggaccgugauggacgucauuagccgccgggaccagcgcgguagcggccaagugggcacguacggacuuaacaccuucaccaacauggaggcccaacugauccggcagauggagucugaggggauuuucagccccagugagcuggagaccccgaacuuggcggagcgcgugcuggacuggcuggagaaguacggcgucgagcgucucaagcgaauggccaucagcggggacgacugcguggugaaaccgauugaugacagauucgccacggcucugacggcccugaacgacaugggcaagguccgcaaagacaucccccagugggagcccuccaagggguggaacgacuggcagcagguccccuucugcagccaccacuuccaccaguuaaucaugaaggacggcagggagaucguggucccgugccgcaaccaggacgagcuugugggccgggcccgcgugagccagggggccggauggucccuucgggagaccgccugccucgguaagagcuacgcgcagauguggcagcugauguacuuccaccgccgggaccuccgccuggccgcgaacgcgaucugcucagcgguccccguagauuggguccccaccagccgcacgaccugguccauccacgcgcaucaccaguggaugaccaccgaggacaugcugagcguguggaaccgcguauggaucgaggaaaaccccuggauggaggacaagacucacaucuccuccuggggcgacgugccguaccuggggaaacgcgaggaccaguggugcggcucccucaucggccugaccgcccgggccaccugggccaccaauauccagguugcgaucaaccagguaagacggcugaucgggaacgagaacuaccucgacuacaugaccagcaugaagcgcuucaagaacgaguccgaccccgagggcgcccugugguga

SEQ ID NO: 24399 - RNA, 9879 nt, Artificial Sequence
  derived and/or modified CDS sequence (opt11) from DENV-1__FJ898424__SS-prME
agcgugacgaugcugcucaugcugaugcccaccgcccuagcuuuccacuuaaccacccggggcggugagccccacaugaucgugagcaagcaggagcgggguaagagccugcuguuuaagaccagcaccggggugaacaugugcacccucaucgcaauggacuugggcgagcucugcgaggacaccaugaccuacaagugcccacggauuaccgagguggagcccgacgacguggacuguuggugcaacacuaccgauaccugggugaccuacgggacuugcucgcaaacuggcgagcaccggcgcgacaagcggucugucgcacucgcgccccacgugggccuggggcuggagacucgggccgagaccuggaugagcuccgagggugccuggaagcagauccagaagguggagacgugggcccuccgucaucccggguucacggugaucgcccuguuccuggcccacgccaucggaaccagcauuacccaaaaggggaucaucuucauccuccugaugcugguaacucccuccauggcgaugcgcugcgugggcaucggcagccgggacuucguggaagggcucuccggcgccaccugggucgauguaguucuggagcacgggucgugcgucaccaccauggccaaggauaagcccacgcuggacaucgagcuccugaagaccgaggugaccaaccccgcggugcuucgcaagcucuguaucgaggccaagaucuccaacaccacgaccgacagccggugcccuacccaaggcgaggcgacccuggucgaggagcaagacgcuaacuucgugugccgccggacuuucguggaccgcggaugggggaacggcugcgggcuguuuggaaagggaucccucauuacgugcgccaaguucaagugcgucaccaagcuggagggcaagauugugcaguacgagaaccucaaauacagcgugaucgucaccgugcacaccggcgaccaacaccaggucggaaacgagagcaccgagcacgggacgaccgccacgaucacgccccaggcccccaccagcgagauacagcucacugacuacggcgcgcugaccuuggacugcaguccgcggacgggacucgacuucaaugagauggugcugcugaccaugaaggaaaaguccuggcucgugcacaaacagugguuuuuggaccugccccuccccuggaccagcggcgccuccaccucucaggagaccuggaaccgccaggaccuucuggucaccuucaagaccgcccacgccaagaaacaggagguggugguccucggcucccaggaaggcgccaugcacaccgcgcugacgggggccaccgagauccagaccagcggaaccacgaccauauucgccgggcaccugaagugccgucucaagauggacaagcugacucugaagggcauguccuaugugaugugcacagggagcuuuaagcuugagaaggagguugccgagacgcaacacgguaccguacuggugcagaucaaguacgaggggaccgacgcccccugcaaaauacccuucaguacccaggacgaaaaaggggugacucagaacggccgccugaucaccgcgaacccgaucgucacagacaaggaaaaacccgugaacaucgaggccgagccgccauuuggagagagcuacaucgugaucggcgccggcgaaaaagcccugaagcucaguugguucaagaaagggagcucaaucgggaagauguucgaggcgaccgcccgcggggcgcgccggauggcgauucugggcgauacagccugggacuucgggucgaucgguggggucuuuaccuccguggggaagcuggugcaccagaucuucggcacagcguacgggguccuguucagcggcguguccuggacaaugaagaucgggaucggcguccuacucacguggcucgggcugaacucucgcuccaccagcuuauccaugacuugcaucgccgucggguuggugacccuguaccugggagugaugguucaggccgauagcgguugcgugauuaacuggaagggccgagagcucaaaugcgggagcggcaucuucgugacgaacgaagugcacaccuggaccgagcaguacaaguuccaggccgacuccccgaaacggcugagcgcagcgaucggcaaggccugggaggagggggugugcggaauccgcuccgccaccagacuagagaacaucauguggcgccaaaucagcaacgagcucaaccacauccuguuggagaacgacaugaaguucacgguagucguuggugacgucgucggcauccucgcccaggggaagaagaugauccggccccaaccgauggagcauaaguacuccuggaaauccuggggcaaggccaaaaucaucggcgcggacgugcagaacacgacauucauuaucgacgggccuaauaccccggagugcccugacgaccagcgcgccuggaacaucugggagguggaggacuacgguuucgggaucuucacgacgaacaucuggcuuaaacugcgggacuccuacacccaggugugcgaccaccgccucaugucagccgcaauaaaggacuccaaagcggugcacgccgacauggguuacuggauugagagcgaaaagaacgagaccuggaagcucgcccgcgccagcuuuaucgaggugaagacaugcaucuggccgaagagccacacgcuguggucaaacggcguccucgagagcgagaugaucaucccaaagauuuacgggggcccgaucucccagcacaacuaccgccccggguacuucacccagacugccggcccauggcaccuggguaagcuggaacucgacuucgaucugugugagggcaccacggugguaguugacgagcacugcggcaaccgggggcccagucugcgcaccaccacugugacgggcaagaucauccacgaauggugcugucggaguuguacccugccuccgcuccgcuucaagggggaggauggcugcugguacgggauggaaauccggcccguuaaggagaaagaggagaaccuggucaagagcauggugucggccggguccggcgagguagacagcuucucccuagggcugcuaugcaucagcaucaugaucgaggagguuaugcgcucccgcuggagccgaaagaugcuaaugacaggcacccuggccguguucuuccugcucaucaugggccaguuaacguggaaugauuugauccggucgugcaucauggugggggccaaugcuagcgaccggaugggaaugggcacuaccuaccucgcacugauggcaaccuuuaagaugcggccgauguucgccgugggccugcuguuccggcgcuugaccucccgggagguacugcucuugaccaucgggcugagccucgucgccuccguggagcugcccaacucauuagaggagcucggcgacggguuagccaugggcaucaugauucugaaacucuuaacagacuuucagucguaccaacugugggccacucuccugagcuuaacguucaucaagaccaccuucucccuccacuacgcguggaaaaccauggccauggugcuguccaucgucucccugcucccccugugccugagcacaaccucccagaaaaccacaugguugcccgugcugcugggcucacucggguguaagccgcugacgauguuccugaucgccgagaacaagaucuggggucgcaagagcuggccccucaacgaggggauaauggccgugggcaucguaucgauccugcuaagcucacuccugaaaaacgaugugccccuggcuggaccccuaauugcgggcggcaugcugaucgcuugcuacguaauuagcggauccagcgccgaccugucccucgagaaagcagcggaagucagcugggaggaggaggcggaacacuccggcgcaucgcacaacauccugguggaagugcaggacgacgggaccaugaagaucaaggacgaggagcgggaugauacccugaccauccuacugaaggccacccugcucgccgucuccggcguguacccgcugucaauaccagcgacgcuguucgugugguacuucuggcagaagaagaagcagaggucuggugugcucugggacacccccucgccgcccgagguagagcgggcuguucuggacgacggcaucuaccgcauuaugcaacggggccugcuggggcggucgcaggucggcguggggguguuucaagagaacgucuuucacacaauguggcacguaacccggggugccgugcucauguaccaggggaagagacuggagcccagcugggccucugucaagaaggaccugaucagcuacggcgggggauggaggcuccaggggaguuggaacacgggugaagagguucagguaaucgccgucgaacccggaaagaaccccaagaaugugcagaccgcccccgggaccuucaagacucccgagggugaggugggugcgaucgcgcucgacuucaagcccgggacgucuggcucuccgauugucaaccgcgaagggaaaaucgugggucuguacgggaaugggguggugaccaccagcggcacguacgugagcgccaucgcucaggcgaaagccucccaggaggggccgcugcccgaaauagaggacgagguguuccggaaacggaaccucacaaucauggaccugcaccccgggagcgggaagacucggcgcuaccugccggcgaucguacgugaggccaucaagaggaagcugagaacccugauccucgcgcccaccagagugguagcuuccgagauggccgaggcccugaagggcaugccgauccgcuaccaaacgaccgccgugaagagcgagcacaccggccgggaaaucguggaccugaugugccacgcgacguucaccaugagacuccugucccccgugcgggucccgaacuacaacaugaucauaauggacgaggcccacuuuaccgaccccagcucaaucgccgcgcgcggguacaucucaaccagggugggaaugggggaggccgcggcuaucuucaugacugccacgccgcccggcuccguggaggccuucccgcagagcaacgcgguaauccaggacgaggagcgggacauccccgagagauccuggaacagcggguacgaguggaucaccgacuuccccggcaagaccgugugguucgugcccuccaucaagucaggcaaugacaucgcgaauugcuuacgcaagaacgggaagcgggucauccagcucucucgcaagaccuucgacacggaguaccagaagaccaagaauaacgacugggauuacguugugacgaccgauaucucagagaugggugccaacuuccgggcggaccgcguaaucgacccgcggcgcugccuaaagcccguuauacugaaggacgggcccgagagagucauccucgccggcccgaugccggugacgguggccuccgcagcccagcgucgggggcgcaucggccggaaccauaacaaggaaggcgaccaguacaucuauauggggcagccccugaacaacgacgaggaccacgcccacuggaccgaagcgaagaugcugcucgacaacauuaacacccccgaaggcaucauccccgcgcuguuugagccggagcgcgagaaguccgcugccauugacggggaguauaggcugcggggugaggcccgcaagaccuucgucgaacucaugcggcgcggggaccugcccguauggcugucuuacaagguggccuccgagggcuuccaguacucggaccggcgcuggugcuucgauggggagcgaaacaaccagguccucgaggagaacauggacguggagaucuggacgaaggagggagagcgcaagaagcuuagaccccgcuggcuggacgcgcggaccuacucggacccucucgcucugcgugaguuuaaggaguucgccgccggucggaggagcguuucaggggaccugauccuggagaucggcaaacuaccgcagcaccugacgcagcgggcacagaacgcgcuugacaaucuggucaugcugcacaacagcgagcagggcgggcgcgccuaccgccacgccauggaggagcuucccgacacuaucgagacacuuaugcugcucgcguuaaucgcagugcugaccggcggggugacacucuucuuccuguccggcagggggcuuggcaagacaagcauuggcuuacuuugcgucauggccuccagcgcccugcucuggauggccuccguggagccccacuggaucgccgcgucgauuauccuggaguucuuccugaugguguuacucauccccgagccggaucggcagcgcacgccccaggacaaccaguuggcguacgucgugaucgggcuccuguucaugauacugacgguggccgccaacgagaugggccuccuggagacaaccaagaaagaccuuggcauuggucacgucgccguggagaaccaccaccacgccaccaugcucgacgucgauuugcaccccgccuccgcuuggacccuguacgccgucgccaccaccauaaucaccccgaugaugagacacacgaucgagaauaccacugcgaacaucagccucacagccaucgccaaccaggcagcaauccugauggggcuggacaagggcuggcccaucuccaagauggacauuggcgugccacuccuugcguuagggugcuauagccaggugaacccccucacgcugaccgccgccguccugaugcucguggcccacuacgccaucauuggcccugggcugcaggccaaggccacccgggaggcgcagaagcgcaccgccgcggguaucaugaagaaccccacgguggacgggauuguggccaucgaccuggaucccguaguguacgacgcgaaguucgagaaacagcucggucagauuaugcuuuuaauccucugcaccucucagauccugcuuaugcggacgaccugggcccucugcgagagcaucacgcuggccaccggcccccugaccacccucugggagggaagcccgggaaaguucuggaacacgacaaucgcgguaucgauggccaacaucuuccgcgggaguuaccuggccggugccggguuggccuucucccucaugaaguccuuagguggugggcgucgcgggaccggggcgcaaggcgaaacccugggcgagaaguggaagcggcagcucaaccagcugucaaagagcgaguucaauacguacaagcgcuccgggaucauggaaguggaccggagcgaagcgaaggagggccuucgccgcggggagaccaccaagcacgcugugucucgcggaaccgcaaagcuccggugguucgucgagaggaaucuggugaagccugagggaaaagugauagaccucggcugcggucgcgggggcuggagcuacuacugcgcggggcugaagaagguaacggaaguuaaggguuacacuaagggcgggcccggucacgaggaacccaucccgauggccaccuacggguggaaccucgugaagcuccacuccggcaaggacgucuucuucauaccgcccgagaaaugcgauacccugcucugugacaucggggagagcucccccaacccgacgauagaggaaggccgaacacugcgagugcugaagaugguggagcccuggcugcgcgggaaccaguucugcaucaagauccugaaccccuacaugcccagcgucguggagacccuggaacagaugcaacggaagcacggcggcaugcucgugcgaaacccacucucccggaacagcacccacgagauguacugggucucaugcgggaccggcaacaucgugagcgccgugaacaugacgucccgcaugcuguuaaaccgcuucaccauggcccaucggaagcccaccuacgaacgcgacgucgacuugggggccggcacccggcacguggcaguggagcccgaggucgccaaccuggacaucaucggccagcgcaucgagaacaucaagcaugagcacaagagcaccuggcauuacgaugaggacaaucccuacaagaccugggccuaccacggguccuacgaggugaagccgagcggcagcgcguccagcauggucaacgggguggugaagcuccugaccaagcccugggaugucauccccauggugacccagauugccaugacggauaccacccccuucgggcagcagcggguguuuaaggagaaggucgacacccgcacgccgaaggcgaagcgggguaccgcccagaucauggaggugaccgcccgcuggcuguggggcuuccucucccggaacaagaaaccccgcaucugcaccagggaggaguuuacgaggaaaguucgaagcaacgccgcuaucggcgcugucuucguggacgaaaaccaauggaacucggcuaaggaggccguggaggacgagcgcuucugggaccucguucaucgugaacgcgaguuacacaagcaagggaagugcgcgaccugcguguauaacaugaugggcaaacgggagaaaaaacucggugaauuuggcaaggcgaaggggagccgcgccaucugguacauguggcugggcgcucgguuccuggaguucgaggcccucggcuucaugaaugaggaucacugguuuucgcgcgagaauagccuguccgggguggagggugagggacuacacaaacugggcuacauccugcgagacauuagcaaaauccccgggggcaacauguacgccgacgauaccgcgggcugggacacccgaaucacugaggacgaccugcaaaacgaggccaagaucaccgauaucauggagccggaacacgcccuccuggcaacguccaucuucaagcugaccuaccagaacaaggucgugcgcgugcagcggcccgcgcgcaaugguaccgucauggacguaaucagccggcgcgaccagcguggcaguggccaggucggcaccuacggccuaaacaccuucaccaacauggaggcgcagcugauccgccagauggagagcgaggggauuuucuccccuagcgagcuagagacgcccaaccucgccgagcgcguccuggacuggcuugagaagcacggcguggagcgcuugaaacggauggcuaucuccggcgacgacugcguggugaagccaaucgacgaccgcuucgccaccgcccuguccgcucugaacgacaugggcaaggugcggaaggacaucccccagugggagcccucuaagggcuggaaugacuggcagcagguccccuuuugcagucaccauuuucaccagcuaaucaugaaagauggccgugagaucgucgucccgugccguaaccaggacgagcuggugggccgcgcccgggucagccagggggcuggauggucccuccgcgagaccgccugccucggcaaaagcuaugcccagauguggcaacugauguacuuccaccggcgcgacuuacggcucgcggccaacgccaucugcagugccguccccgucgacuggguccccacaagccgcaccaccugguccauccacgcucaccaucaguggaugacgacugaggacaugcugagcguguggaaccgcgucuggaucgaggaaaaccccuggauggaagacaagacgcauaucagcagcuggggggacguccccuacuuagggaagagagaggaccaguggugcggcucgcucaucggccugaccgcccgcgccaccugggccaccaacauccagguggccaucaaccaggugcggcgccugauugggaacgagaacuaccucgacuauaugaccagcaugaagcgauucaaaaacgagucggacccugaaggcgcgcugugguga

SEQ ID NO: 24400 - RNA, 9879 nt, Artificial Sequence
  derived and/or modified CDS sequence (opt11) from DENV-1__FJ898425__SS-prME
agcgugaccaugcugcucaugcugaugcccaccgcccuggccuuccaccucaccacccgaggaggugagccccacaugaucgugacuaagcaggagcggggcaagucucugcuguucaagaccagcgccggagugaacauguguacccucauagcgauggaccugggcgaacugugcgaggacaccaugaccuacaagugcccccggaucaccgaggcggagcccgacgacguggauugcuggugcaaugccacggacaccugggugaccuacgggaccugcagccaaaccggcgagcauagacgcgacaaacggagcguggcgcucgcaccccacguuggccugggacuggagacccgcaccgagaccuggaugucuagcgagggcgccuggaaacagauccaaagagucgagacaugggcccuccgccaccccggcuuuaccgugaucgcccucuuucuggcgcacgccaucggcaccuccauaacccagaaggggaucaucuucauucuccuuaugcuggugacgccgagcauggccaugcggugcgucgguaucgggucccgcgacuuuguugaggggcucucgggcgccaccuggguggacgucgugcuggagcacgggucgugcgugaccaccauggccaaggacaagcccacgcuggacauagagcuccugaagaccgaggucaccaaccccgcaguacugcggaagcuaugcauagaggcuaagaucucgaacaccacgacagacucccgcugccccacccaaggcgaggccacauugauggaggagcaggacgccaacuucgugugccggcgcaccuucgucgaccggggcugggggaacggcugcggguuguucggcaaggggucccucaucacaugcgccaaguucaagugcgugaccaagcuggagggcaagaucgugcaguacgaaaaccugaaguacuccgucaucgugaccgugcacacgggcgaccagcaccaggucgggaacgagagcaccgagcacggcacaaccgcaaccaucacgccacaggcccccaccagugagauacaacuuaccgacuacggggcccugacgcuggacugcagcccccgcacgggccucgacuucaaugagaugguucugcugaccaugaaggagaaguccuggcucguccacaagcagugguuccuagaccuaccacucccauggacgagcggggcgagcaccucccaagagacguggaaccggcaggaccugcuugugaccuucaagaccgcccaugcgaaaaaacaagagguggucgugcucggcagccaggagggcgccaugcacaccgcccugacuggggcuaccgagauccagacauccggcaccacgaccaucuucgcugggcaccugaagugccgcuugaagauggacaagcugacccugaagggcaugagcuacgugauguguacugguucguuuaagcucgagaaggaagucgcggaaacgcagcacggcaccgugcuggugcagaucaaguacgagggcaccgaugcccccuguaagauccccuucaguacccaagaugagaagggggucacgcaaaauggccggcugaucaccgccaacccgaucgugacagacaaggagaagcccgugaacauugaggccgagcccccauucggcgaguccuacauugucaucggugcuggagaaaaggccuuaaagcugaguugguucaagaagggguccucuaucggcaaaauguucgaggccaccgcccgcggggcccggcgcauggcgauccugggcgacacggccugggacuucggcuccaucggcggcguguucaccagcaucgggaaacucgugcaccagaucuucggcacugccuacgggguccucuucuccggcgugagcuggaccaugaagaucggcauuggugugcugcugacgugguuaggccugaacucacgcagcacaucccugagcaugaccugcaucgccguggggcucgugacccuguacuuaggcgugaugguccaggccgacuccgggugcgugauaaacuggaagggcagagagcucaagugcgggagcggcaucuuugugaccaacgagguccacaccuggaccgaacaauacaaguuccaggcugacagcccgaagagauuauccgccgccaucggcaaggccugggaggaggggguaugcggcauccggagcgccacccgccuggagaacaucauguggaaacagauaucaaacgagcuuaaccacauccugcuggagaacgacaugaaguucaccgucgucgugggugacguggucgguauccucgcgcaagguaagaagaugauucggccgcaacccauggagcauaaguacagcuggaaaagcuggggcaaggcuaagaucauuggcgccgacguacagaacacgacguucaucaucgacgggcccaacacgccggagugcccagacgaccagcgcgcauggaauaucugggagguggaagauuacggauucgggaucuucaccacgaauaucugguuaaagaugcgggacuccuacacgcagguaugcgaccaccgccugauguccgccgccaucaaggacucaaaagcggugcacgccgauaugggauacuggauugagagugagaagaacgaaaccuggaagcuugcucgggcgagcuucaucgaaguuaagaccugcaucuggcccaagagucauacgcuguggagcaacggugucuuagaguccgagaugaucauacccaagaucuacgggggcccgaucucccagcacaauuaucgccccggguacuuuacccagaccgccggccccuggcaccucgggaagcuggagcuggacuucgaccucugcgagggcaccacgguggugguugacgagcacugcggaaaccgggggccguccuugcgcacuaccaccgugacggguaagaucauccacgaguggugcugccggagcugcacccugccaccccugcgauucaagggggaggacggaugcugguacgggauggagauccggcccguuaaggagaaggaggagaaccuggucaaauccauggugagcgccggcagcggagagguggacuccuuuagccuggggcuccugugcaucuccaucaugauagaagaggucaugcgcagccgguggucccgcaaaaugcucaugaccggaacauuagccguguuccugcuucucaucaugggccagcugacuuggaacgaccugauccgucucuguaucaugguaggcgccaacgcgagcgaccgcauggggaugggcaccaccuaucuggcccugauggcuaccuucaaaaugcgaccgauguucgccgucggguugcuguuucggcgccugacgucccgcgaggugcuccugcuuaccaucgggcucagccugguugccuccgucgagcugcccaacagccucgaggagcugggcgacgggcuggcgaugggcaucaugauccucaaacugcugacggauuuccagucccaccagcugugggccacccuccuaucccucacauucaucaagaccacccugucccugcacuacgccuggaagaccauggccauggugcucucgaucgucucacuuauaccccugugccuaagcacgaccucccagaagaccaccuggcugcccgugcuguuagguagccuggggugcaagccgcugacgauguuucucauagcggaaaacaagaucuggggccgcaaguccuggccccuaaacgaggggauaauggcggugggcgucgugagcauucugcucagcucccugcugaagaacgacgugccacucgccgggccccugaucgcagggggcaugcugauagccugcuacgucaucagcggguccagcgcggaccucucgcuugaaaaggccgccgaggucucgugggaggaggaggcagagcacuccggcgccagccacaacauccugguggagguccaggacgacggaaccaugaagaucaaggacgaggagcgggacgacacacucacgauucugcugaaggcgacacuccuggccgucaguggcguauauccgcugaguauaccggccacgcucuucgucugguauuucuggcagaagaagaaacagcgcuccggggugcugugggacaccccuagcccgcccgagguggaacgggcaguucuggacgacgguaucuaccgcaucaugcaacggggccugcucgggcggucccaggugggcgugggagucuuucaggagaacguguuucacaccauguggcaugugacucggggcgcuguccugauguaccaagggaagcgccuggaacccagcugggcgagugugaagaaggaccucaucagcuacggcggcggguggcgucugcaggguuccuggaacacuggcgaggaggugcaggucaucgccguggagcccgggaaaaaccccaagaacgugcagaccgcccccgggacauucaagacccccgagggcgaagugggcgccaucgcccuggacuucaagccagggacgagcgguuccccgaucgucaaccgcgaagggaagaucgugggccucuacggcaacggcgucgugaccaccuccgggacauacgugagcgcuaucgcccaggccaaggccucccaagaagguccgcugcccgagaucgaggacgaggucuuucggaaacggaaccugacgaucauggaccuccaccccggcagcgguaagacccggcgcuaccugccggcaaucgugcgagaagcgaucaagcgcaagcugcggacgcucauccuggcccccaccagaguggucgccagcgagauggccgaggcguuaaaggggaugccgauccguuaccagacgaccgccgucaagagcgagcacacaggcaaggagaucguugaccucaugugccacgccaccuucacgaugcggcugcuauccccaguccgcguaccgaacuacaacaugaucauaauggacgaagcccacuucaccgaccccucgucaauagccgcgcggggguauauaagcaccagagugggcaugggggaagcagccgccaucuucaugacggcgacgccgcccgguuccgucgaggcguucccgcagagcaacgcugugauccaggacgaggagagggacauccccgagcgcuccuggaacagcggauacgaguggauaaccgacuuccccggcaaaaccgugugguuugucccaagcaucaagaguggcaacgacaucgcgaacugccuccggaagaaugggaagcgcgugauccagcugucccggaagaccuucgacaccgaguaccagaagaccaagaacaacgacugggacuacguggucaccacagauaucagcgagaugggugcgaacuuucgcgcggaccgggugaucgacccccggcggugccucaagcccgugauccucaaggacgggcccgagcgcgucauucuggccggccccaugccgguuacggucgcuuccgccgcccagcggcgcggacggaucggccgcaaccacaacaaggagggagaccaauacauauacaugggucaaccccugaacaacgacgaggaccacgcgcacuggaccgaagccaagaugcuccuggacaacaucaacaccccagagggcaucauccccgcccuguuugagccggagcgggagaaguccgcagcuauugacggggaguaccgccuucgcggagaggcgaggaagacauucguugagcugaugcgccgcggggaccugcccguguggcucuccuacaaagucgccucagagggcuuccaguacagcgaccgucgguggugcuucgacggcgagcgcaacaaccaggugcucgaggagaacauggacguggagauuuggacgaaggagggggagcggaagaagcugaggccccgaugguuagacgcccgaaccuacuccgaccccuuagcccugcgggaguuuaaagaguucgccgcaggacgacggagcgucuccggggaccucauccuggagauaggcaagcugccgcagcaccucacccaacgcgcccagaaugcccuggacaaccuggugaugcuccacaacagcgaacagggcgggagggccuaucgccacgcgauggaggagcugcccgauaccaucgagacccugaugcuccuggcccugaucgccgugcuaaccggcggggucacccuguuuuuccucuccggccgggggcucgggaagacuagcaucggccugcugugcgugauggccuccagcguacuccuguggauggcauccgucgagccccacuggaucgcggccagcaucauccuggaguucuucuugauggugcugcugauccccgaaccggaccgccaacggacgccacaggauaaccagcuugcguacguuguuaucggguugcuguucaugauacucacgguugccgcgaacgagaugggccugcuggagaccacgaagaaggaccucgggaucggucacguggcugucgagaaccaccaucacgccaccaugcuggauguagaccugcaccccgccuccgccuggacgcucuaugcgguggcgaccaccauuaucacuccgaugaugcgacacacgaucgagaauaccacugcaaacaucagccugaccgccaucgccaaccaggccgcgauacugauggggcucgauaagggcuggcccaucuccaagauggacaucggcguccccuuacuggcucuagggugcuacagccaaguaaacccucugacgcucaccgccgccgugcugaugcuagucgcgcacuacgccauaaucggcccggggcugcaggccaaggcaacccgggaggcccaaaaacgcaccgcggccgggaucaugaaaaacccgacgguggacgggaucguugccaucgaccucgaccccgucguguaugacgccaaguucgagaagcagcugggucaaaucaugcucuugauccuuugcacaucccagauuuugcucaugcgcaccaccugggcccugugcgaaaguaucacgcuggcgaccggaccccucaccacccuaugggagggguccccaggcaaguucuggaacacgaccaucgccgugagcauggccaacauuuuccggggguccuaccuggccggcgccggccucgccuucagcuugaugaaguccuuggggggcggcagacguggcaccggggcccagggcgaaacccucggcgagaaauggaagcgccagcuaaaccagcuuuccaaaagcgaguucaacaucuauaagcgguccgggaucauggaaguggaccgcagcgaggcuaaggagggccucaagcgcggggagacgacccgucacgccgugucccggggcacugcgaaguuacgaugguucguggagcggaaccuggucaagcccgaggguaagguuauagacuuaggcugcggccgcggcggcuggagcuacuacugcgccgggcuuaagaaggugaccgaggucaagggcuacacgaagggcggaccaggccacgaggagcccauccccauggcuaccuacggguggaaucucgugaaguuacacuccgggaaggacguuuucuuuaccccgcccgagaagugcgacacccuccugugugacauuggcgagagcucccccaacccgacgauugaggagggccggacgcugcgcguccucaaaaugguggagccgugguuacgggggaaccaguucuguaucaagauccugaaccccuacaugcccagcgugguagagacucuagagcagaugcagcguaagcacggcggcaugcugguacgaaacccgcugagccgcaacuccacccacgagauguauuggguguccugcgggaccggcaacaucgucucggccguaaacaugaccucccgcaugcuccugaacagguucaccauggcccacagaaagcccaccuacgagaaggacguagacuugggggcgggcaccagacacguagccguggagcccgagguggccaaccuugacauuaucggucagcguaucgagaacaucaagcacgagcacaagucuacguggcacuacgacgaggacaaccccuacaagaccugggcauaccacggguccuacgaggucaagccgagcggcuccgcuagcagcauggugaacggugucgugaaguugcugaccaagcccugggacgugauccccauggucacgcagaucgcaaugacggacacuaccccuuucgggcaacagcggguguucaaggagaaaguggacacccgcacuccgaaggccaaacggggcaccguccagaucauggagguuaccgcccgcuggcucuggggcuucuugucccggaauaagaagccccgcaucugcacgcgggaggaguucacgcgcaagguucgguccaacgcagccaucggcgcggucuucguggacgagaaucaguggaacagugccaaggaagccguggaggacgagcgcuucugggaccugguccaaaaggagcgggaauuacauaagcaggggaagugcgcgacguguguauacaauaugaugggcaagcgcgagaagaagcugggggaguucggaaaggcgaaggguagccgggccaucugguauauguggcugggcgcccguuuccucgaguucgaagcucugggcuucaugaacgaagaucacugguucucccgggagaacagccugagugggguugagggcgagggguuacacaaacugggcuacaucuuacgcgacaucucaaagauccccgggggcaacauguacgccgaugacaccgcgggcugggacacacguaucacggaggacgacuuacaaaacgaggccaagaucacugacaucauggagccggagcacgcccugcuggccaccagcaucuucaagcucacguaucagaacaagguagugcgcgugcagcggcccgccaaaaacgggacggucauggacgugaucagccgccgggaucagcggggcucaggccaagugggcaccuacgggcugaacaccuucaccaauauggaggcgcaguuaauccgccagauggaaagcgaggggaucuuccuccccucggagcuggaaacgccgaaccuggccgagcggguccuugacuggcuggagaaguaugguguggaacgccuuaagcggauggccaucagcggggacgauugcguggucaagccgaucgacgaccgguucgccaccgcccuaaccgcgcuuaacgacauggggaaagugcggaaggacaucccccaaugggagccauccaagggguggaacgacuggcagcagguccccuucugcagccaccauuuccaccagcugaucaugaaggauggcagagagaucgugguccccugcagaaaccaggacgaacuggugggccgcgcacgggucucgcagggggccggcuggagccugcgcgagaccgccugcuuaggcaagagcuacgcccagauguggcagcucauguauuuccacagacgcgaccugcggcuggcggccaaugccaucuguuccgcugugcccguggacuggguccccacgagccguaccacaugguccauacaugcgcaccaccaguggaugaccaccgaggacauguuguccguuuggaaccguguguggauugaagagaaccccuggauggaggacaagacgcacgucuccagcuggggcgacgugccguaccuaggcaagcgcgaagaccaguggugcggcucccuaaucggcuuaaccgcccgggccaccugggccagcaacauccagguggcaaucaaccagguccgccgccuaaucgggaacgagaacuaccuggacuacaugaccuccaugaagcgguucaagaacgagggcgaccccgagggggcgcucugguga

SEQ ID NO: 24401 - RNA, 9879 nt, Artificial Sequence
  derived and/or modified CDS sequence (opt11) from DENV-1__FJ898426__SS-prME
agcgugaccaugcuucucaugcugaugccgaccgcgcuggccuuccaccucaccaccagaggcggcgagccucacaugaucguguccaagcaggagcggggcaagagucugcuguucaagaccagcgccggggugaacaugugcacccucaucgccauggaccuuggcgaguucugcgaggauaccaugacguacaaguguccaaggaucacugaagcugagcccgacgacguagacugcuggugcaaugccaccgacaccugggugacauacgggaccugcagccagaccggcgagcaccgaagagacaaacguuccguggcacuggcgccccacgugggcuuagggcuggagacgcgcaccgagaccuggaugucuucagagggugccuggaagcagauccagcgcguggagacaugggcccuacgccaucccggguuuacggugauagcccucuuccuagcgcacgcuauaggcacuagcaucacccagaagggaaucaucuucauccugcucaugcuggugacccccuccauggccaugcggugcgucggcaucggcagccgcgacuucguggagggacuguccggcgccacguggguggacgucguacuagagcacgggagcugcgugaccaccauggccaaggauaagcccacgcuggacauagagcuucucaaaacggaggucgcuaacccagccgugcugcgcaagcucugcaucgaggcgaagaucaguaacaccaccacggauucccgcugccccacucagggcgaggcgacccucguagaggaacaggacgccaauuucgucugccggaggaccuucguggaccggggcuggggaaacggcugcggguuguucgggaagggaucccucaucacgugcgccaaguucaagugcguuacgaaacucgaggguaagauaguacaguacgaaaacuuaaaauacagcgugaucgugaccguccacacaggcgaccaacaucaggugggcaaugaguccaccgaacauggcacgacugccaccauaacgccccaagcucccagcaccgaaauccagcugacagacuacggggcucucacccuagacugcagcccucggaccggccuggacuucaacgagaugguccuucugacgaugaaggagaaauccuggcuggugcacaagcagugguuccuagaccugccgcugcccuggacgaguggggccuccacgucacaggagaccuggaaccggaaggaccuccuggugaccuucaagacggcgcacgccaagaagcaagaggucguagugcugggcucccaggaaggcgccaugcauaccgccuugaccggcgcgaccgagauccagacgagcgggacuaccacuaucuucgcgggucaccugaagugccgccugaagauggacaagcucacacugaaaggcaugucguacgucaugugcacuggcagcuuuaagcuggagaaggagguggccgagacccagcacggaacugugcucguccagauuaaguacgagggcacggacgcgcccugcaagauucccuuuuccacgcaagacgaaaaggggguaacgcaaaacggccggcugaucacggccaacccaaucgugaccgacaaggagaagccagucaauaucgaggcggagccgcccuucggggagucauacaucgugaucggcgccggcgaaaaggcccugaagcuguccugguucaaaaaggggagcuccauuggcaagauguucgaggccacagcccgcggggcgcggcgcauggcaauccucggcgacacugccugggauuucgggagcaucgggggcguguucaccuccgucggcaaguuaguacaccaaaucuucggcacggcuuacggggugcuguuuucgggcgucuccuggacaaugaaaauagggaucggcguacuccugaccugguuaggccucaacagccguuccaccagccuuaguaugaccugcaucgcuguggggcuggucacucucuaucugggcgugauggugcaggcggacagcggcugcgucauaaacuggaagggacgggagcucaagugcgggagcgggauuuucgugacuaacgaagugcacaccuggaccgagcaguauaaguuccaggccgacuccccgaagcgucucagcgccgccaucggcaaggcgugggaggaagggguuugcggcaucaggagcgcgacccgccuggagaacauaauguggaagcagauaagcaacgagcuuaaucacauccuccuggagaaugauaugaaauucaccgugguggucggggauguggcaggcauacuugcccaggggaagaagaugauucggccccagcccauggaguacaaguacagcuggaaaagcuggggcaaggccaagauaaucggcgcggacguccagaacaccaccuucaucaucgauggacccaacacuccggagugccccgacgaccagcgcgccuggaauaucugggaaguugaggacuacgguuucgggauauucaccacgaacauuuggcucaagcugcgggacuccuacacccaggugugcgaccaucgacugaugucggccgccaucaaagauuccaaggcgguacaugcggacaugggcuacuggaucgagagcgagaagaaugagaccuggaagcucgcccgggccagcuuuaucgaagucaagaccugcaucuggcccaagagccacaccuuauggaguaacggcgugcucgaaagcgagaugaucauacccaagaucuacggaggcccgaucagucagcacaacuaccgccccggguauuucacccaaacggccggccccuggcaccuggggaagcuggagcuggacuucgaccucugcgagggcaccacggucgugguagaugagcacugcggcaaccgggggccgucccuccggacaacaaccgugacgggcaagauuauccacgaguggugcugcagauccuguacacuaccgccccugcgcuucaagggggaggacggcugcugguacggaauggagauccggcccgucaaagagaaggaggagaaccuggucaagucaauggucagcgccggcuccggcgaggucgacaguuucucccugggccugcuguguaucagcauuaugaucgaggaagugaugcgcucacgguggucacgcaagaugcugaugacgggcacccucgcgguguuuuuccugcugauaaugggucagcucaccuggaacgaccugauccggcugugcaucauggucggcgccaacgccuccgaccgcauggggauggggaccacguaccucgcccugauggccaccuuuaagaugcgccccauguucgcggugggguuguuguuccggagacugaccagccgggaggugcugcuccugaccaucgggcugucacucgucgccagcguagagcugccaaacucccuagaagaacucggcgacgguuuagccaugggcaucaugauccugaaguuauugacggacuuccaaucucaccagcugugggccacccuccugucccugaccuucauaaaaaccacguucagccuacacuacgcguggaagaccauggccaugguucuguccaucgugagcuuauucccccucugccugucgaccaccucucagaagaccaccuggcuucccgugcuccugggcucccuggggugcaagccgcucaccauguuccugauagccgagaacaaaaucuggggccgcaaguccuggccccuuaacgagggcaucauggccgucggcaucgugagcauccuccugagcagccugcucaagaaugacgugccccuggcggggccacugauugccggcgggaugcucauagccugcuacguuauaaguggcagcagcgccgaccugagccuggaaaaagccgccgagguguccugggaagaggaggcggagcacagcggcgccucccauaacauccucguugagguccaagacgacgggacuaugaagauuaaggacgaggaaagagaugacacgcugacaauccugcucaaggcaacccugcuggccguuagcgggguguacccgcuguccaucccggcaacccuauucgucugguacuuuuggcagaagaagaagcagcgcagcgggguacugugggacaccccuagcccgccagaggucgagcgggcaguccucgaugacggcaucuaccgcaucaugcagcggggccuucucgggaggucacaggugggcgugggggucuuccaagagaacguguuccacacuauguggcacgugacucggggugccguucugauguaucaggggaagcgccuugagcccaguugggccuccgugaagaaggaccugaucagcuauggagguggguggcgccugcaaggaagcuggaacacgggggaggaggugcaggucaucgccguggagccgggcaagaaucccaagaacgugcaaaccgcgcccgggacguucaagacuuccgaaggagaaguaggcgcgaucgcccucgacuucaaacccgggacaagcgguucucccauuguuaaucgcgaggggaagauagugggucuguacggcaacggggucgugacuacauccgggaccuauguaagcgccaucgcccaggcgaaagccucccaggaggggccccugccggagaucgaggaugaagucuuccgaaagcgcaaccucaccaucauggaccuucacccagggagcggaaagacccgccgauaucugcccgccaucguacgggaggccauaaagcgcaaacucaggacgcugauccuggcaccgacccggguaguugcguccgaaauggcugaggccuugaagggcaugcccauucgcuaccaaaccaccgccgugaaaagcgaacacacgggcaaggagaucguggaccugaugugccacgcaaccuucaccaugcgccuauuauccccggugcgagugccgaacuacaacaugaucauuauggaugaagcgcacuuuaccgacccgagcuccaucgccgcacgaggguacauuagcacucgcguaggcaugggggaggcagccgcuauuuucaugaccgccacgccgccuggcuccguggaggccuucccccagagcaacgccgugauccaggaugaggagcgggacaucccggagcgcuccuggaacucuggguacgaguggaucaccgacuuccccgggaagacggugugguucguccccuccaucaagagcggaaaugacaucgcuaacugccugagaaagaacgggaagcgcgugauucagcuaucccggaagaccuucgacaccgaauaccagaagaccaagaacaacgacugggauuacguggucacgaccgacaucagcgagaugggugccaauuucagggccgaccgggugaucgacccucgacguugccucaagccggugaucuugaaagacggacccgagcgcgucauccuggcugggcccaugcccgugaccguggcuuccgcggcccagcgccgcgggcguaucggccgcaaccacaacaaagaaggcgaucaguauaucuacauggggcagccauuaaacaacgacgaggaccaugcccacuggaccgaggcaaagaugcugcuggacaacaucaauacgcccgaaggcaucauccccgcccucuucgagcccgagcgggagaaguccgcugcgauugacggggaguaccgccuacgcggcgaagcgcggaagacguucguggagcugaugcgccgcggggaccucccgguguggcugagcuacaaggucgccuccgagggcuuucaguacagcgacaggcgguggugcuucgacggggaacgcaacaaucaggugcuggaagagaacauggacguggagaucuggaccaaggaaggggagcggaagaagcugcggccccggugguuagacgcgcguaccuacuccgauccgcuggcgcuccgggaguucaaagaguuugccgcgggccgccgcagcgucaguggcgaucugauccuggaaaucggcaaacuuccccagcaucugacgcagcgcgcacagaacgcucuggacaaccuggugaugcuccacaacagcgagcagggcgggcgagccuaccgccacgccauggaggaacugccggauaccaucgagacgcucaugcuguuagcacucauagccgugcucaccggaggggucacgcuuuucuucuuguccggccgggggcugggaaagaccagcaucggccuucucugugugauggcgucuucagugcuucuguggauggccuccgucgagccccacuggauagccgcaagcauaauacucgaguucuucuuaauggugcugcucauucccgagccagaccgccagcggaccccgcaggacaaccagcuggcguacguuguuaucgggcuccuguucaugauccugaccguggcggccaacgaaaugggccugcucgagaccacgaagaaggaucuggggaucggccauguggccgucgagaaccaccaccaugccgccaugcuggacgucgaccuccaccccgcguccgcauggaccuuguacgcuguagccaccaccauuaucacgcccaugaugcgccacacuaucgagaacaccacggcuaacaucagccucacggcgaucgccaaccaggcggccauauuaauggggcuggacaaggguuggccgaucuccaaaauggacaucgguguaccccugcucgcgcuggggugcuacagccaggugaacccgcugacccucaccgccgccgugcugaugcuggucgcccacuacgccaucaucggcccagggcuccaggcuaaggccacccgggaggcccagaaacgcacggccgcaggaaucaugaaaaacccgacgguggacgggaucguggcaauugaccuggaccccgucguauacgaugcaaaauucgagaagcagcuuggacagauuaugcuccugauucuauguacuucccagauccucuuaaugcgcaccacgugggcccugugcgagucgaucacgcucgccacggggccgcugaccacgcuaugggaagggucccccgguaaguuuuggaacacuaccauagcggugagcauggcgaacaucuuuagaggaagcuaucucgccggcgccggccuggcauuuucccugaugaagucccucgguggcggucgccgcggcacgggggcgcagggcgagacgcugggggagaaguggaagcgccagcuuaaccaauuauccaaaucugaguucaauacguacaagcgaagugggaucauggaggucgaucgcagcgaggccaaggagggccucaagcgcggggagaccaccaagcacgccgugucccgcggcacggccaagcuacgaugguucguggaacgcaaucuagugaagcccgaagggaaggucaucgaccuuggcugcggcagaggcggguggucauauuacugcgcaggacuuaaaaaggugaccgaggugaaagguuacacgaaaggcgggcccggccacgaggagccuaucccaauggcgaccuacggguggaaccuggugaaacuccacagcggcaaagaugucuucuucaucccacccgagaagugugacacgcugcugugcgacauaggggaaagcagucccaaccccaccaucgaggagggccgcacccuccggguucuuaagaugguggagccguggcugcgggggaaccaauucugcaucaagauccucaacccauacaugcccucaguggucgaaacucuggagcaaaugcaacggcgccauggcgguaugcuuguucggaauccacucucgcgcaacagcacucaugagauguacuggguuagcugcgggaccggcaauaucgucagcgcuguaaacaugacguccaggauguugcuaaaccgcuucaccauggcccaccgcaagccgaccuacgagcgggacguggaccucggggcgggcacgcgccacgucgcuguggagcccgaaguggcgaacuuggacaucaucggccaacggaucgaaaacaucaagcacgaacacaagagcacuuggcacuacgacgaggacaaccccuacaagaccugggcguaccacggguccuacgaggucaaacccagcggguccgccuccagcauggugaauggagucgugaagcugcucaccaaaccgugggacgugauaccgauggucacgcagaucgccaugaccgauacaaccccuuucggccagcagcgaguguucaaggaaaagguggacacgcggaccccaaaggccaagcgcgggaccgcgcagaucauggagguaaccgccaaguggcuguggggcuuccugucacggaauaagaagccgcgcaucuguacgagagaggaguucacccgcaagguaaggagcaacgcugccaucggcgcgguguuuguagacgagaaccaguggaauagcgccaaggaggccguggaggacgagagauuuugggaucucgugcacagagagagagagcugcacaagcaagggaagugcgcgaccugcguauacaacaugauggggaagcgggagaagaaacuuggagaguucggcaaggccaaggggagccgagcaauaugguacauguggcucggcgcgcgguuucuggaguuugaggcgcugggauucaugaacgaggaccacugguucucccgcgagaacagccucuccgggguggagggugagggucugcacaaacugggcuacauccuccgugacaucagcaaaauccccgggggaaauauguacgccgacgacaccgccggcugggacacgcgcaucaccgaagacgaccugcagaacgaggcgaagauaaccgacaucauggagccagagcacgcccugcucgcgaaaucgaucuuuaagcugacauaccagaauaaggugguccgggugcagcgcccggccaagaacgguacaguaauggacgucaucagucgcagagaccagcgcggcucgggccaggucggcacguauggccuaaacaccuucacgaauauggaggcccaacucauccgccagauggagagugaagguaucuucagccccagcgagcuugagacgcccaaccucgcuggccgagugcucgacuggcuugagaagcacggggucgagcggcuaaaacgcauggcaauuuccggcgacgacuguguggucaagcccauugacgaccgguucgcgaccgcgcucaccgcccugaacgacauggggaagguccguaaggacauuccgcagugggagcccagcaaggguuggaaugacuggcaacaggugcccuucugcagccaccacuuccaucaguuaauaaugaaggacggucgggaaauugugguccccugccgcaaccaggaugagcuagugggccgcgcgcguguuucacagggcgccggguggagccugcgggaaacugccugccuggggaaauccuaugcacagauguggcagcucauguacuuucauaggcgggaccugcgcuuggcagcuaacgcgaucugcagcgccguaccgguggacugggugcccacgagccggaccaccuggagcauucacgcccaucaucaguggaugacgacggaagacaugcucuccguauggaaccgcguguggauugaggagaaccccuggauggaggacaagacccacaucagcucauggggcgacguacccuauuugggcaagagagaggaccaguggugcggcagccugaucgggcucaccgcgcgcgccacgugggccacgaacauucaggucgccauuaaccaagugcgcaggcugauaggcaacgagaacuaccuggacuacaugaccagcaugaagcgcuucaagaacgagagcgacccggagggggcccucugguga

SEQ ID NO: 24402 - RNA, 9879 nt, Artificial Sequence
  derived and/or modified CDS sequence (opt11) from DENV-1__GQ199856__SS-prME
agcgugacgauguugcucaugcugaugcccaccgcucuggccuuucacuuaacgaccaggggcggggaaccccauaugaucguaucgaaacaagagcgcggcaaaucguugcuguucaagaccagcgcgggggugaacaugugcacccucguggccauggaccugggugaguuuugcgaagacacgaugaccuacaaaugcccccgcauaacugaggcugagcccgacgacguggacuguuggugcaacgccaccgauaccugggucacuuacgguacuugcucgcaaaccggggagcaucgaagagauaagcggucgguggcccuggcgccccacgugggccuuggucuugagacucguaccgagacuuggaugagcuccgagggugcauggaagcagauccagcggguggaaaccugggcacugcgccaccccggguucacggugaucgcccuauuccucgcgcaugccauaggcaccagcaucacgcaaaaagggaucauauucauccuacucaugcuugucacacccucgauggccaugcguugcgugggaaucggcucaagggauuucguggaggggcuguccggugccaccugggucgacguaguuuuggagcacgggucaugugucacgaccauggccaaggauaagccaacccuggacaucgaguuacucaagacggaggugacaaauccugcagugcugagaaagcucugcauugaggcgaaaauauccaacaccaccacggacagccgcugcccgacccaaggcgaggccacguuagucgaggagcaggacgcuaacuucgugugccggcgaacuuucguugaccgggggugggguaacggcugcggcuuguuuggaaagggcucccugauaacuugugccaaauucaagugcgucaccaaacuggaggggaagacagugcaguacgaaaaccucaaguacagcgucaucgucaccgugcauacuggcgaccagcaccaggucgggaaugagucuaccgagcacggcacuacggcaaccauuacgccccaagccccguccaccgagauacaguugacggauuacggcgcccugaccuuggacugcucaccccgcaccggcuuagacuucaacgagaugguguuacugaccaugaaggagaaguccuggcuggugcacaagcagugguuuuuagaucuaccucugcccuggaccagcggggcgucuaccagucaggagacguggaaccggaaagaucuccuggugacauucaaaaccgcucacgcgaagaagcaggagguaguggugcuggggucgcaggagggagccaugcacaccgccuugacgggggccaccgagauccagaccucggggacuacgaccauauucgccgggcaccugaaaugucgucugaagauggacaagcucacacugaagggcauguccuauguuaugugcaccgguucguucaagcuggagaaggagguggcggaaacccagcauggcaccgugcucguacagaucaaguaugaggggaccgacgcccccugcaaaauacccuucuccacccaggacgagaaaggggucacgcaaaacggccgguugaucaccgccaauccuauugucaccgacaaggagaagccuguuaacauugaggcagagccgcccuucggcgagagcuacaucgugaucggcgcaggcgaaaaggcacugaagcuauccugguucaagaaggggucaagcauuggcaaaauguucgaagccaccgcacgcggggcgagacguauggcgauccuaggagacacggccugggauuucgggagcaucgggggcgucuucacguccguggggaagcugguacaucagaucuucggcaccgcguacggcguccuuuucagcggcgugucguggacgaugaaaauagggaucggggugcuccugacgugguugggccucaacagccgcuccacaagccuguccaugaccugcaucgccguggggcuagugacgcucuaccugggcgugaugguccaagcggacagcgggugcguaaucaauuggaagggccgggagcugaagugugggucggggaucuucguuacgaacgagguacacacuuggacugaacaguauaaguuccaagcggacuccccgaagcgccucagcgcagccaucgguaaggccugggaggagggggugugcggcauacgauccgccacccgcuuagagaacaucauguggaagcagaucucgaacgaguugaaucacauucuccuggaaaacgacaugaaguucaccguggucgucggggacguggccgggaucuuagcgcaagggaagaagaugauccggccgcagcccauggaguacaaauacagcuggaagaguuggggcaaagccaagauuauaggagccgacguccagaacacuaccuucauuaucgacgggccgaacaccccggagugcccugacgaucagcgcgccuggaacaucugggaagucgaggauuauggauucgguaucuucacgacgaacaucuggcucaaacugagagauucuuauacccaggugugcgaccaccgcuuaaugagcgccgcuaucaaggauuccaaagccguccacgcggacaugggguacuggauagaaagcgagaagaaugagaccuggaagcucgcgcgggccuccuuuaucgaagugaagacgugcaucuggccaaagagccacacgcuguggucuaacggcguauuagagagugaaaugaucauacccaagaucuacgguggaccgauaucccaacacaacuaccgacccggcuauuucacccaaaccgccggccccuggcaccucggaaaguuagagcuggacuuugaucucugcgagggcaccacugucgugguggacgagcacugcggaaaccgggggccgagcuugcgcaccaccaccgucacgggcaaaaucauucaugaaugguguugcagaagcugcacccugccgccccugcgcuucaaaggagaggacggcugcugguacggaauggagauccggccagugaaagagaaggaggagaaccuggugaagucaauggucagcgccggcucuggagagguggacagcuucucgcugggccuccugugcaucagcaucaugauagaggaggugaugcgcagucgguggagccgaaagaugcuuaugacgggcacauuagcggucuucuuucugcugaucaucgggcagcucaccuggaaugacuuaauacggcugugcauaauggugggugccaaugcuucggaccgcaugggaaugggcaccaccuaucuggcccugauggccaccuucaagaugcgcccgauguucgccgugggccuccuguuccggagacuaacgagccgggaaguccuuuugcuuaccauugggcugucccucguggcuagcgucgaacugcccaacucccuggaggagcucggcgacgggcuggccaugggcauuaugauccugaagcuccugaccgauuuccagagccaccagcugugggccacgcuccugucccuuacauucaucaagacuacauucucacuccacuacgcuuggaaaacuauggcgauggugcuuuccauaguaagccuguucccccucuguuugaguacaaccucccagaaaacgacuugguuaccuguccuacugggauccuugggaugcaagccgcucaccauguuucuaauagcggaaaacaagaucuggggccgccguagcuggccgcuaaacgaggguaucauggccguuggcauaguauccauccugcuguccagucugcucaagaaugacgucccucucgcuggaccucugauugccggcggcaugcucauagcgugcuacgucaucuccgggucauccgccgaucugagccuggagaaggccgcggaggugaguugggaggaggaagccgagcacagcggcgcgagccacaacauccuugucgagguucaagaugacgggacgaugaagauaaaggaugaggaacgggaugacaccuugacuaucuuacugaaggcuacccugcuggccgugagcgggguauauccgcucuccauccccgccacgcuguuugucugguauuucuggcagaagaagaagcagcggagcggggugcugugggauacacccagcccgccagagguggagcgcgccguacucgacgacggcaucuaccggauuaugcagcgcggccugcucgggcggagccaggucggagucggcguguuccaggagaacguuuuccacacaauguggcacgugacccgcggcgcaguuuugauguaccaggggaaacggcucgagccuaguugggcgucagugaagaaggaccucaucagcuacggcggaggguggcgcuuacagggcagcuggaacacgggagaggagguccagguuaucgccgucgagcccgguaagaaccccaaaaacguccagaccgcgccagggaccuucaagaccuccgaaggcgagguaggagcuaucgcgcucgacuucaagcccgggacgagcggcucacccaucgugaaccgggaagggaaaaucgucggccuguacggcaauggugugguaaccaccaguggcacguaugugagcgcaaucgcgcaagccaaggcgagccaggaagggccccugccagagaucgaggacgagguguuccgcaagcggaacuuaaccauuauggaccugcacccaggcagcgggaagacccgacgguaccugcccgccaucguccgggaggccaucaagcggaagcucagaacacuaauuuuggccccgacccgcgucguggccagugagauggcggaagcccucaaagguaugcccauccgguaccagacgaccgcagugaaaagcgagcauaccggcaaggagauuguggaccugaugugccacgccaccuucacgaugcgccuccuuuccccggugcgggugccgaacuacaacaugauuaucauggacgaggcccauuucacagauccgagcuccaucgcggccagaggauacauaagcacccgggucgggaugggggaagccgccgccaucuucaugaccgcaacaccucccggcuccguggaagccuucccucagagcaacgcagugauccaggacgaagaaagggauaucccggagagauccuggaacucaggguacgaauggaucacggauuuccccgguaagaccgucugguucgugcccucuauaaagagcggcaaugacaucgccaauugccuccgcaagaacgguaagcgaguuauccagcugucccgcaagaccuuugacacggaguaccaaaagacaaagaacaacgacugggacuacgugguuaccaccgacaucagcgagaugggcgcgaacuuccgggccgaucgcgugaucgacccccggcguugucuaaagccuguuauccuuaaggacggucccgaacgcgugauucuagcuggccccaugcccgucacaguggcgucugccgcucagcgccgggggcgcauugggaggaaccacaacaaggagggcgaccaguacauuuacaugggccaaccgcugaauaacgacgaggaccaugcccacuggaccgaggccaagaugcuguuggauaacaucaauaccccggaggguauuaucccugcacucuucgagccggaacgagagaaguccgccgcaaucgacggggaguauaggcugcggggcgaagcgcgcaagaccuucguggaguuaaugagacgaggggaccucccgguguggcuaagcuacaagguggcgagcgagggguuccaguacuccgaccggcgcugguguuucgauggggagcggaacaaccagguacuggaggagaacauggaugucgagaucuggacgaaggaaggggagcgcaaaaagcuaaggccgagauggcuggacgcccggaccuacucagauccccuggcccucagagaguucaaggaguuugcggccggccggcgcucuguuagcggggaccugauccuagagauuggcaagcucccucagcaucucacucaaagagcccagaacgcccuggacaaccucgugaugcuacacaauucggagcagggcggccgcgcguaccggcaugccauggaagaguugccggauaccauagaaacgcugaugcuauuggccuugauagccguucugacaggaggggugacccucuuuuuccucuccggccgggggcugggcaagaccuccauaggcuuacuaugugugauggccuccagcguccugcuguggauggcguccguagagccgcacuggaucgcagccagcaucauccuagaguuuuuccugauggugcugcuuauccccgagcccgaccgacagcgcaccccgcaagacaaucagcuagccuaugucgugaucgggcuucucuucaugauauugacaguggccgcgaacgaaaugggcuugcucgagacgaccaagaaggaccuggggauagggcaugucgccguggaaaaccaccaccacgcugccauguuggacguugaccuacaucccgccuccgcauggacccuguacgccguagccacuaccaucaucacacccaugaugcggcauaccauagagaacacgacggccaauaucucgcugacagccaucgcgaaccaggccgccauucuuaugggcuuagauaaaggcuggcccaucaguaagauggacaucggugugccauuauuggcccugggaugcuacagccagguaaacccacugacccuuacggccgccguccugaugcuuguugcucauuacgcaaucaucgggcccggacuccaggccaaggcgacucgcgaggcgcagaagcgcacagcugccgggauaaugaagaacccgacuguggacgggaucgucgccaucgaccuggaccccguuguguaugaugcgaaauucgagaagcagcugggccagaucaugcugcucauauuaugcacgucccaaauacuccucaugcgcaccacuugggcucugugugagagcauaacccucgccaccggcccccugaccacgcugugggaggggucaccaggcaaguucuggaacaccacgauugccgucagcauggccaauaucuuccggggcagcuaccucgcgggagccggcuuggcguucucccucaugaagucucucggaggagggcggcgcgggaccggcgcccagggcgaaacucuaggcgagaaguggaagagacaacugaaccaguuauccaagagcgaguucaacacuuacaagcgcagugggaucauggaaguggaccguucugaggcgaaggagggccucaagcgcggagagacgaccaagcacgcaguaucucggggcaccgccaagcuccgcugguucguagagcguaacuuugugaagccagaagggaaagugaucgaucucggcugcggccgcgggggcuggagcuacuacugcgccggacugaaaaagguuacggaggugaagggauacacgaagggcgggcccggccaugaagaacccauucccauggccacguauggguggaaucuagugaaacugcacuccgggaaggacguauucuucaucccgcccgaaaagugcgacacguuacugugcgacauuggggagagcucccccaacccgaccaucgaagaaggacggacccugcgcguuuuaaagaugguugaacccugguuacgggggaaccaguucugcauaaagauccugaacccguacaugccgucugucguugagacucuagagcguaugcagcggaaacacggcggaaugcuuguaagaaauccccugagccguaacagcacccacgagauguauugggucucgugcgggaccggcaacauuguuucagcggugaacaugaccucccgcaugcuacugaaucgcuucacgauggcccaccggaaaccgaccuacgaacgcgauguugaccucggggcaggcacgaggcacguggccguggagcccgagguagcuaaucucgauaucaucgggcagcgcaucgaaaacauaaagcaugagcacaagcucaccuggcacuacgacgaggacaacccuuauaaaacgugggcguaucacgggagcuacgaagugaagccgucuggcagcgcgucguccauggucaacgggguggugaagcugcucaccaagccgugggacgugaucccuauggugacccagauagcaaugacggacacgacccccuucggccagcagaggguguucaaggagaaggucgauacccgcacccccaaagccaagcggggaacagcccagaucauggagguuacugcgaaguggcuauggggauuccucagccgcaacaagaagccccggaucugcacgagggaagaauuuacucguaaggugcgcuccaaugcggcuaucggcgcaguguucguagacgaaaaccaguggaacuccgcuaaggaggcuguggaggacgagcgguucugggaccuagugcaucgcgagcgggagcugcacaagcaggguaaaugcgccacgugcguguacaauaugauggguaaacgcgagaagaaacucggugaguucggcaaggccaagggcucucgcgcuauaugguacaugugguuaggagcgagguuccuggaguucgaggccuugggcuucaugaacgaagaucauugguucagccgagaaaauucgcucaguggcgucgaaggagaggggcugcauaaguugggauacauacugagggacaucuccaagauuccagggggaaacauguacgcggaugacacagccgguugggacacccgaaucacugaggacgaccuccagaacgaagccaagaucacggacaucauggagccggagcacgcucugcuagccaaaaguaucuuuaagcuaacuuaccagaacaaagucgugcgcgugcagcgcccggccaagaaugggaccgucauggacgugauuucccggcgcgaccagcgggggaguggccaggugggcaccuacggcuugaacacguucacuaacauggaggcgcagcucauccgccagauggagucagagggcaucuucagccccuccgaacuggagacccccaaccuggccggucggguuuuagauuggcuagagaagcacgggguggagcgccuuaagcggauggcgaucagcggcgacgauugcguagucaagccgauagacgaccgcuucgccaccgccuugacagcccugaacgacauggguaagguccggaaagacaucccucagugggaacccuccaagggcuggaaugacuggcaacagguucccuucuguagccaccacuuccaccagcucaucaugaaggauggucgcgagauagucgugcccugccggaaucaggacgagcucguugggcgagcccgaguaagccaaggcgcgggguggucccuccgcgaaacagccugccuugguaagaguuacgcccagauguggcagcucauguauuuccaccggcgagaccugcggcuggcggccaacgccauauguuccgcgguuccgguugacuggguccccacuagcaggacaacguggucgauacacgcacaccaucaguggaugaccacagaggacauguuaagcguguggaacagaguuuggauagaggagaaccccuggauggaggacaagacccacaucucgagcuggggcgacguccccuaccugggcaagcgcgaagaccaguggugcggcucgcucaucggucucacggcccgcgcgaccugggccaccaacauucaagucgccauaaaccaagugcggcgccuuaucggcaacgagaacuaccuggauuacaugacgucuaugaaacgguuuaagaacgagucggauccggagggcgcccucugguag

SEQ ID NO: 24403 - RNA, 9879 nt, Artificial Sequence
  derived and/or modified CDS sequence (opt11) from DENV-1__FJ898427__SS-prME
agcgugacgaugcugcugaugcugaugcccaccgcccuggcauuccacuuaaccacacgggguggcgagccccacaugauugucaccaagcaagagcggggaaagucgcugcuguucaagacauccgcgggagugaauaugugcacauuaaucgcuauggaucugggcgaguuaugcgaagauaccaugaccuacaaaugcccacguaucaccgaggccgagccagacgacguggacugcuggugcaacgccacggacaccuggguaacauacgggaccuguagccagaccggcgagcaccggcgggauaagcggagcguggcacuugcgccgcacgugggcuuagggcuggagacccgaacggagaccuggaugucgagcgagggcgccuggaagcagauccagagaguggagacgugggcccucagacacccaggguucacgguaauagcccuuuuccuugcgcacgcaaucgguacuuccauaacccagaaggguaucauuuucauccucuugaugcuggugacccccaguauggccaugcggugcgucggcaucggcucccgcgacuucguggagggauugucgggcgcaaccuggguggacguuguucuggagcacggcuccugcgugaccaccauggccaaggacaagcccacccuugacaucgaacuccugaaaaccgagguuaccaaccccgcggugcugcgcaagcuuugcauugaggcuaagaucagcaacaccacaacagacagccguugccccacccagggcgaggccacgcugauggaggagcaggaugcaaauuucgugugccggagaaccuucgucgaucggggcuggggaaauggcugcgggcuguuugggaaggggucacucauaacgugcgccaaguucaagugcgugaccaagcuggaagguaagaucgugcaguacgagaaccugaaauacagcgucaucgugacgguccacacgggcgaccagcaccaggucgguaacgagagcaccgagcacggcaccaccgcgacgaucacaccccaggcccccaccuccgaaauccaauugaccgacuauggcgcauuaacccuggacugcagcccccggacgggucuagacuuuaacgagauggugcuacuaacaaugaaggaaaagaguuggcucguccacaagcagugguuccuggacuuaccguuacccuggacuagcggcgcuagcaccucacaggagacguggaaccgucaggaccuucuggugaccuuuaaaacugcccacgcgaaaaagcaggaggugguagugcucggaagccaggagggugcuaugcacaccgccuuaacgggggccaccgaaauccagaccucgggcaccacuaccauauucgccggccaccugaagugccgccucaagauggacaaguugacccuaaaggggaugucguacguaaugugcaccgguucuuucaagcucgagaaggaggucgcggagacgcagcacggcaccguguuaguccagaucaaguacgagggcacugacgcccccugcaagauccccuuuagcacccaggacgagaagggggucacgcagaacggccggcugaucacagccaauccaaucguuaccgacaaggaaaagccggucaauaucgaggcugagccgccuuuuggagagucauacaucgucaucggagcgggcgagaaggcccucaagcucucaugguucaagaaggggucaagcaucggcaagauguucgaggccacggcucgcggggcacgccgcauggcgauucugggggacacggcuugggacuuuggauccgucgguggcguuuucacgagcgucgggaagcuggugcaccagauauuugguaccgccuacggcguccuguucuccggcgucagcuggacaaugaagaucgguaucggcguuuugcugaccuggcuuggacugaacucgcgguccaccucacugucgaugaccugcaucgccgugggccucgucacccuguaccugggcgugaugguucaggccgacagugggugcguuaucaacuggaaaggccgggagcucaagugcggcagcgguauauucgugacaaacgaggugcacacuuggaccgaacaguauaaguuccaggcggauagcccgaagcgcuuguccgcagccauaggcaaggccugggaggaaggagucugcggcauucggagcgccacccgccuugagaacauaauguggaagcagaucuccaacgagcucaaccacauccugcuggaaaacgacaugaaguucaccguggugguuggugacgugguaggcauccucgcacaaggaaagaagaugauucguccccagccuauggaacauaaguauagcuggaaguccuggggaaaggccaagaucaucggcgcggacgugcaaaacacgacguucaucauugacgggccgaacaccccggaauguccggacgaccagcgugccuggaacauaugggaaguggaagacuacggcuuuggaaucuucaccacgaauaucuggcugaaguuacgggacucauacacgcagguaugcgaccaccgccucaugucugccgcaaucaaggacagcaaggccguacacgccgacaugggcuacuggaucgagucugaaaagaacgaaaccuggaaauuagcccgcgccagcuucaucgaggugaagacuuguauauggccaaagucacauacguuguggucuaacggcgugcuugaguccgagaugaucaucccuaagaucuacgggggcccgaucucgcaacacaacuaccgccccggauacuucacccagaccgcaggccccuggcaccuggggaagcuggaguuggacuucgaucugugcgagggcacaacgguagucguggacgagcacugcgggaacagggggccgucucugcgcaccacuaccgucacggguaaaaucauacaugaguggugcugccgaagcugcacccugccgccguugcgcuucaagggcgaagacggaugcugguauggcauggagauucggcccgugaaggaaaaggaggagaacuugguuaaauccauggugagcgccggcagcggagagguggacuccuucagucugggacugcugugcauuuccauuaugaucgaggaagugaugcgcagccgguggucacggaagauguuaaugaccggaacacucgcggucuuccugcuacugaucauggggcagcucacguggaacgaccucauccggcugugcaucauggugggugcaaacgccagcgaucgcaugggaaugggaaccacguaccuggcccucauggcaaccuuuaagaugagaccgauguucgcuguugggcuguuauuucggcgccucacgucccgagaaguccugcuucucacgaucggcuugagccugguagccuccgucgagcuccccaacucacuggaagaacuaggagacggccucgcuaugggcaucaugauccugaagcuucuuacugauuuucagagccaccagcucugggccacccuccuuucacugacguucaucaagaccacguugucguugcacugcgcuuggaaaaccauggccauggugcuaagcaucgcgucccuguucccucucugcuugagcacuaccucacaaaagaccaccuggcugcccgugcugcuuggcagccucggcugcaaaccgcuaacuauguuccugaucacagagaccaagauauggggccgcaaguccuggccacuuaaugaggggaucauggccgucggcguggugagcauccucuugagcagccugcucaaaaacgacgucccacuugccgggccccucauugcaggcgguaugcugauagccuguuaugucaucucuggguccagcgcggaccuuagccuggaaaaggcagcugaagugagcugggaggaggaggccgaacauaguggcgccagccacaacauccucguggucgugcaggacgaugggaccaugaaaauaaaagacgaggagcgcgacgacacccugacgauccugcucaaagcgacccugcuugccguuagcggagucuacccgcucagcauccccgccaccuuguuugugugguauuucuggcagaagaagaaacagagaucagggguucucugggacacccccucgccaccugaaguggagcgcgcggugcuggacgacggcaucuaccgcaucaugcaacggggccuccucgggcgaucccagguuggcguagggguguuccaggaaaacgucuuucauacgauguggcacgugacuagaggagcagugcugauguaccaggggaagcgccucgagcccuccugggcgucagucaagaaggaccugaucuccuacgguggcggguggcgcuugcagggcuccuggaacacgggugaggagguccaggucaucgcgguagagcccggaaagaaccccaagaacgugcagaccgccccugggacguuuaagacccccgaaggggaggucggcgccaucgcucuagauuucaagccggggaccagcggaucccccaucgucaaccgcgaggggaaaauaguaggucucuacggcaauggcgugguuacaacgucgggcaccuacgucagcgcgauugcucaggccaaggcuucccaagaggggccgcugccggaaaucgaggaugagguauuucggaagcguaaccucaccauaauggaccugcaccccggcuccgggaaaacccgccgcuaccugccggcgaucguccgggaagccaucaagcggaagcuacgcacgcugauacucgcccccacccgagugguggccagcgagauggccgaggcacucaaaggcaugccaauccgcuaccagaccaccgcggucaagagcgagcacacggggaaggagaucguggacuugaugugccacgccacuuucaccaugcggcuacucuccccaguacgcguuccgaacuacaacaugaucauuauggacgaggcccacuucaccgauccaagcuccaucgccgcgcggggauacaucagcacgcgcgugggcaugggggaggccgccgccaucuuuaugaccgccacgccgcccggcucaguggaggccuucccacagucuaaugcggucauccaggacgaggagcgagacauaccugagcgauccuggaacuccggguacgaauggaucacggacuucccggggaagacagugugguucguccccucuauuaaguccgguaacgacauagccaacugccugcggaaaaacgggaaacgcgucauccagcugucccggaaaaccuucgacaccgaauaccagaaaaccaagaacaaugacugggacuacguggugacuacagacaucucggagaugggcgccaauuuccgcgcggaccggguuaucgauccgcgccgaugccuaaagcccgugauccugaaggacggacccgagcgagucauacuugccggcccaaugccggucacuguagcgucugcagcucaacgaagggggcggaucggccgcaaccacaacaaagaaggcgaccaguacauauacauggggcagccucucaacaacgaugaggaccacgcccacuggaccgaagccaaaauguuacuggacaauaucaauaccccugagggcaucauccccgccuuguucgagcccgaacgggagaaguccgccgcaaucgacggggaguaucgucugcgcggugaggcacggaagacauucguagaacugaugcgccgcggggaccucccuguauggcugucauacaagguugccagcgaaggauuccaguacagcgaccgccggugguguuucgauggagaaagaaacaaccaaguccuggaggagaacauggauguggagauuuggacuaaggagggggagcguaagaaacuuagaccucgguggcuggaugccaggacguacuccgacccccuggcucuucgggaauuuaaggaauucgccgcgggccggcgcagcgugucaggcgaccugauacuggagaucggaaaacuuccacagcaccugacccagcgcgcccagaacgcccuggacaaucucgucaugcuccacaauagcgaacagggcgggcgagcguaccgucacgcaauggaggaacugccggacacuauagagacgcucauguuacuggcccuaaucgccgugcucacgggcggcgugacacucuucuuucucaguggccgaggucucgguaagacaaguauuggacugcucugcgucauggcauccaguguucuccuguggauggcuuccguggaaccgcacuggaucgcugccucgaucauuuuggaguucuuccucaugguacugcucauccccgagccggaucgccaacggacgccccaggacaaccaacuggccuacguggucauaggguugcuguuuaugauccugaccgucgccgccaacgagaugggccugcuggaaacgacuaaaaaggaucuggggaucggccacguggcuguggaaaaccaucaccacgcuaccauguuggacgucgaccuccaucccgccuccgcauggacccuguaugcuguggcgaccaccaucaucaccccgaugaugcgucauacgauugagaacaccacggcuaacaucagccugacugcaaucgccaaccaggcugccauccucauggggcucgacaagggcuggcccauaucgaagauggacaucggcguaccccugcuagcccugggaugcuacagccaggucaacccguuaacccuaacggccgcgguucugaugcugguggcucauuacgccauaaucggccccggacuucaggccaaagccacaagagaggcgcagaaacgaaccgcggccgguauaaugaagaacccuaccgucgacggaauuguggccaucgaccuggauccagugguuuacgacgcuaaauucgagaaacagcucggacagauaaugcuccucauucugugcaccucccagaucuugcugaugcgcacgacaugggcccugugcgagagcauaacccuagcgaccggcccucucacgacccugugggaggggucuccaggcaaauuuuggaauaccacgaucgcagugagcauggccaacauauuucgcggcuccuaccucgccggcgccggacucgcguucucccugaugaagagccucgggggcgggcgccguggcacgggggcccagggcgagacucugggcgagaaguggaagcgccagcugaaucagcucaguaagagcgaguucaauauuuacaaacggucagguaucauggagguggaccgcagugaagccaaggagggccuuaagagaggggagaccacccgccaugccguuucccgggggacggcgaagcugcgcugguuuguggaacggaacuugguaaagccagaagggaaggucaucgacuuaggcugcggacgcgggggauggagcuacuauugcgccgggcuaaagaaaguaaccgaagugaaaggauacaccaagggggggcccggacaugaagagcccauaccuauggcaaccuacggauggaacuuggucaaacuucacuccggcaaggacguguuuuucacgcccccggagaagugcgacacccuccugugcgauaucggggagagcucccccaacccgacaaucgaggagggccggacacucagaguuuugaagauggucgagccguggcugcgggggaaucaguucugcaucaagauccucaacccguacaugcccagugucgucgagacccuggagcagaugcaacgaaagcauggcgguaugcugguccggaacccuuugucccgcaauuccacgcacgaaauguauuggguaucaugcgggaccggcaacaucguuucugccgucaacaugaccucccguaugcugcugaaccgguucaccauggcacacaggaaaccuaccuacgagcgugauguugaucucggggcggguacgcgucacguggccguagagcccgaggucgcaaaccuggacaucaucggccagaggaucgagaacauaaagcacgaacacaagagcaccuggcacuacgacgaggacaaccccuacaagaccugggcguaccacggguccuacgaggucaagccgagcggcuccgccagcucgauggucaacggcguggugaaacuucuaacgaaacccugggacgugaucccaaugguaacccagaucgcgaugacagacacgacgcccuuuggccagcagcgaguauuuaaagagaaaguggauacccggacccccaaagccaaacgcgguacugcgcagaucauggaagugacggcucgguggcugugggguuuucugaguagaaacaagaagccccggaucugcacucgcgaggaauucacucggaagguucguagcaacgccgcuaucggcgcugucuuuguggacgagaaccaauggaacuccgccaaggaggcagucgaggaugagagguucugggaccuuguccaaaaggagcgcgaacugcacaaacaggggaagugcgcgaccugcguguacaacaugauggggaagagagagaagaagcugggggaguuugguaaggcaaaggggagucgcgcuaucugguauaugugguugggcgcccgguuccuggaguucgaggcccugggguucaugaacgaagaccacugguucagucgcgaaaacagccucuccgguguagagggggaagggcugcauaaguuggguuauauccuccgggauaucagcaagauccccgggggcaacauguaugcggacgacacggccggcugggacacccgcaucaccgaggacgaccugcagaacgaagcuaagaucaccgacaucauggagccggagcaugcccugcucgccacguccauuuucaaguugaccuaccagaacaagguuguaaggguacaacgccccgcuaagaacggcaccgugauggacgugauaagccgccgggaccagagagguagcggccagguuggaaccuacggauugaacacuuucaccaacauggaagcccaauuaauucggcagauggagucagaggggaucuuccugcccuccgagcuagaaacgcccaaccuagcagaacgcguauuggacugguuagagaaguacggaguggaaagacuuaagagaauggccauuagcggugaugacugugucgucaagccaaucgacgaucgguucgccaccgcgcugacugcacugaacgacaugggcaagguccgcaaggacaucccccagugggagccauccaaaggguggaacgauuggcagcagguccccuucugcagccaucacuuucaccagcucaucaugaaggacggcagggagaucguugugccgugcagaaaccaggacgagcuggucgggagagcccgcgugagccagggggcgggcuggagccugcgggagaccgccugccuaggcaagagcuacgcgcagauguggcaacucauguauuuccaccgccgggacuuacgucucgccgcaaacgccauuuguuccgcggugcccgucgacugggugccaacgucacggaccacguggaguauccaugcacaucaucaguggaugaccacugaggacaugcuuagcguguggaaccgcguauggaucgaggagaacccuuggauggaggacaaaacccacguguccuccuggggcgacgugcccuaucugggcaaacgggaggaccaaugguguggcuccuuaauagggcugaccgcccgcgccacgugggccagcaacauacagguagcgauuaaccaggugcgccgguugaucggaaacgagaacuaccucgauuauaugaccucgaugaagcguuucaagaacgagggcgaccccgagggggcccugugguaa

SEQ ID NO: 24404 - RNA, 9879 nt, Artificial Sequence
  derived and/or modified CDS sequence (opt11) from DENV-1__JF937599__SS-prME
agcgugaccauguuacucaugcugaugccaacggccuuggccuuucaucugaccgcccggggcggagagccccauaugaucgugagcaagcaggagcggggcaaaucucugcuguuuaagacaagcgccggcguaaacaugugcacccucaucgccauggaccugggcgaguucugcgaggauaccaugaccuacaagugcccaagaaucaccgaggcugagcccgacgacguggacugcuggugcaacgccaccgacaccugggugaccuacggaaccugcagccagacaggcgagcaccggcgggauaagaggucgguggcguuagccccacaugucggcuuggggcucgagacccgcacggaaacuuggauguccuccgagggcgccuggaagcagauccagaggguggagaccugggcccuccgccaccccggauucaccgugaucgcauuauuucuggcccacgccaucgguacaagcaucacacagaaggggaucauuuucauccuguuaaugcuugugacccccucuauggcaaugaggugcgucgguauagggagccgggauuuuguggaggggcuuuccggcgcaaccugggucgaugucgucuuagaacacggauccugcgugacgacaauggcaaaggacaaacccacgcuggacauagagcuucucaaaaccgaggucacgaauccggccguguugcggaaguugugcauagaagcgaagaucucuaacaccaccaccgacagccgcugcccgacccagggcgaggccacgcucguggaggagcaggacgcuaacuucgucugucggcgcaccuuuguggauaggggcugggggaaugggugcgggcuguuuggcaaggggucacugauaacgugcgcgaaguucaagugcgugacgaaacucgagggcaaaaucgugcaguacgagaaccugaaguauucggugaucgugaccguacacaccggggaccaacaccaaguugggaacgaauccaccgagcacggcacaaccgcaaccaucacgccccaggcacccuccaccgagauucagcugacggacuacggggcccucacccuggacugcagcccccggaccggccuagacuucaacgagaugguccuuuuaaccaugaaggagaaaagcuggcucguccacaaacagugguuucucgaccugccccugcccuggaccaguggggcguccacgucacaggagaccuggaaucgccaggaccucuuagugaccuuuaagacggcacaugcuaagaagcaggaagucguagugcucggcucccaggagggagccaugcacacggcccucacuggggccaccgagguucagacgagcggcacaacaacgauauucgccgggcaccugaagugccgcuugaagauggacaagcucacgcucaaggguaugucuuacgucaugugcaccggguccuucaagcuggagaaggaaguugccgagacccagcacggcaccgugcuggugcagaucaaauaugagggcacggacgcgccguguaagauccccuucuccacccaggacgaaaaaggagugacccaaaacggccgacucaucacugccaacccgaucguuaccgauaaggagaagcccgucaacaucgaggcugaaccacccuuuggggagagcuacauagugaucggcgccggcgagaaggcccuuaaguuaucuugguuuaaaaaggggucaucgaucggcaagauguucgaggccaccgcgagaggggcgcguagaauggccauccuuggcgacaccgccugggacuucgggucaauaggcggcguauucacaaguguugggaaacuaguucaccagauauucggcacggccuacggggugcuguucucaggagugagcuggaccaugaagaucgguaucggggugcuccuaacauggcucggccucaacucccgcuccaccagccuguccaugacgugcaucgccgucgggcugguaacccucuaccuuggcgugaugguacaggccgacuccgggugcgugaucaacuggaagggccgggaguugaaaugcgggagcggcauuuucgugaccaacgagguccacacauggacggaacaauacaaguuccaggcggacucuccgaagaggcucucugcagccaucggcaaggccugggaggagggggugugcggcauacgauccgcgacucggcuggagaacaucauguggaagcagauaucgaacgagcugaaccacauccuacuggagaaugauaugaagcugacggugguuguaggggacguggccgggauccucgcccaggguaagaagaugauccguccgcaacccauggaguacaaguacuccuggaaauccugggguaaggcaaaaauaauaggagcggacguccaaaacaccaccuuuaucaucgacggacccaacacuccggagugccccgacgaucagcgggccuggaacaucugggaaguggaagauuacgguuucgggaucuucaccacaaacaucuggcugaagcugcgagacuccuacacccagguuugugaccacagguuaauguccgcagccaucaaggacuccaaagccguccacgcggacauggguuauuggaucgagagcgaaaagaacgagacguggaaguuggcccgggccaguuuuauugaagugaagaccugcauauggcccaagagccauaccuuauggucgaacggagugcucgagagugaaaugauuauuccaaagaucuacgggggcccgaucagucaacacaauuaccgcccagguuacuuuacccagacggccggcccguggcaccuggggaagcuagaacucgauuuugaccugugcgaggggaccacgguagugguggacgaacauugcggaaacagagggccgagccuccgcaccacgaccgucaccggcaaaaucauccacgaguggugcugccggagcugcacccucccgccucucagauuuaaaggggaggacggcugcugguacgggauggagauccgcccaguaaaggagaaagaggagaaccugguuaaguccauggucagcgccggcuccggugaaguggacaguuucucccucgggcugcuauguaucagcaucaugaucgaggaggugaugagaagucgguggagccgcaagaugcugaugacgggcacccuggccgucuucuuccugcucaucauggggcagcugacuuggaacgaccugauccgccucugcaucauggugggcgccaacgccuccgaccgcaugggcaugggcaccacguaucuggcccucauggccaccuuuaaaaugcgaccgauguucgcugugggcuuacucuuccggcgccugaccagcagagaaguccuccuccugaccaucggguugucccugguugcgagcgucgaguuacccaacagccucgaggaguugggcgacggccuggccaugggcauaaugaucuugaaacugcugaccgauuuucagagccaucaacucugggccacccugcugucccucaccuuuauaagaacgacguucagccugcacuacgcguggaaaaccauggccauggugcuguccaucguaagccucuucccccucugucuguccacuaccagccagaagacgaccuggcucccagugcuucugggcagccucggguguaaaccauuaaccauguuccugauugcagagaacaagaucuggggccgcaagagcuggccccucaacgaagggauuauggcuguaggcaucgucagcauauugcuguccagccuccuuaagaacgacguuccccuggccgggccucucauagccggcggaaugcugauagccugcuacgugaucagcgggagcuccgcagaccugaguuuggagaaggcagcggagguguccugggaagaagaggcggagcacagcggugccagccacaacauccuggucgaagugcaggacgacggcacuaugaaaaucaaggacgaagagcgcgacgacacgcugaccauccugcugaaggccacccuccucgcggugagcggcgucuacccccuguccauccccgccacccuauucgugugguacuuuuggcaaaagaagaaacagcggagcggggugcucugggacacccccaguccgccagaggucgaacgcgcggugcuggaugacgguaucuaucggauaaugcagcgcggccuguugggucggucgcaagugggggucgggguguuccaggagaacguuuuccacacaauguggcacguuaccaggggcgccgugcucauguaucaagggaagcgucuggagcccuccugggccucaguaaaaaaagaccugaucuccuauggggggggguggcgccuccagggcagcuggaacaccggugaggaaguccaggucaucgccgucgagcccggcaagaauccuaagaacguccagaccgccccagggacguucaaaaccuccgagggcgaagugggcgcgaucgcacucgacuuuaagcccgggaccagcgggagcccgauaguuaaccgggaaggcaaaauugucggucuguauggcaauggggucgugaccacuuccgguaccuacgucagcgccaucgcccaggcgaaggcuucccaggaggggccccucccggagauagaagaugagguauuucgcaagcggaaccuuacuaucauggaccugcaccccgguucggggaagacccgccgguaccuccccgcuaucguacgagaggccaucaagcgacgccugcggacgcucauacuugccccuacccgggucguggccuccgagauggcagaggcccucaagggcaugcccauucgcuaucagacaacagccguaaagagcgagcacacgggcaaggagauuguagaccugaugugccacgccacguucaccaugcgguuacugucccccgugcgcgugcccaauuacaacaugaucaucauggacgaggcccacuuuaccgacccgagcuccaucgccgcgcgcggauacauaagcacgcgcgucggaaugggggaagccgcagcgaucuucaugacagccaccccgcccggcuccgucgaggccuucccccagucuaacgccgugauacaggacgaagagcgcgauauaccugagcgcuccuggaacagcggguacgaguggaucaccgacuuucccggcaaaacugucugguucgugcccagcaucaagagcggcaaugacaucgcaaacugucuuaggaagaacggaaagcgcgugauacagcuaucgagaaaaacauucgacaccgaguaccagaagaccaagaacaacgauugggacuacgucguaaccaccgacaucagcgagaugggcgcaaacuuccgcgcugaccgcguuaucgacccccgccggugccugaagccgguuaucuuaaaggaugggcccgagcgcguaauucucgcuggccccaugcccgugacgguggcguccgcugcccaacggcgcgggcggauaggucgcaaccacaauaaggagggcgaccaguauaucuauaugggccaaccgcugaacaacgacgaggaucacgcccauuggaccgaggccaaaaugcugcucgacaacauaaacacgccggagggcaucauccccgcuuuauucgaacccgagcgcgaaaaguccgcagcuaucgacggggaguauagacugcguggcgaggcccggaagaccuucguggaacucaugcgccgcggggaccugccggucuggcugucguacaagguggcauccgaggguuuccaguacagugacagaagguggugcuuugacggagagcgcaacaaccaggugcucgaggagaacauggacgucgagaucuggaccaaggagggggagcguaagaagcugcguccccguuggcuagacgcccgcaccuacucugacccgcucgcgcugcgggaauuuaaggaguucgccgccggccgccguagcguguccggcgaucucauccucgaaauaggcaaacugccccagcaccugacgcagcgcgcccaaaacgcacucgacaaccuggugaugcuccacaauagcgagcagggcgggcgggccuacaggcacgccauggaggaacucccggauaccaucgaaacacugauguuguuggcccugauugccguccugaccggcggggugacccucuucuuccuuuccggccggggacuggguaaaaccagcaucgggcuauuaugcgugauggccucgucuguccugcucuggauggccucugucgaaccucacuggaucgccgccagcauuauccuggaguucuuccugauggugcuccugauccccgaacccgaccgccagcggacaccgcaagacaaccagcuggcauacgucgugaucgggcuuuuauuuaugauccucaccguggcggccaacgagaugggccuccuggagaccacgaaaaaagaucuaggcaucggccacguggccguggagaaucaucaccacgccgccauguuggacguggaccuacauccugcguccgccuggacacuguacgccguagcaaccaccaucaucacgccgaugaugcgucacaccauagagaacacuacagccaauaucagccucaccgcgauugccaaccaggcugcuauccugaugggccuggacaagggguggccgaucuccaagauggacaucggcguaccauuauuagcguuagggugcuacucccaggucaacccccucacccuaacggcggccguacugaugcucguggcccacuaugccauaaucggacccggcuuacaggcaaaggccacccgcgaggcccagaaacggacggccgcggggaucaugaagaacccuacaguggacgggaucgucgcgaucgaucucgaccccgugguguacgacgccaaguucgagaagcagcucggccagauaauguugcugauucuaugcaccucccagauucugcuuaugcgaaccacuugggcccuaugcgaguccaucacccuggccacggguccccugaccacacugugggaaggcuccccugggaaguucuggaacacaaccaucgccgucagcauggcgaacaucuuucguggaagcuaucuagccggcgccggcuuagccuucaguuuaaugaaguccuuagguggcgggagaagagggacuggggcgcagggcgagacacuuggugagaaguggaaacgccagcucaaccagcuauccaagccugaguucaacacguauaagcggagcgggaucauggagguggaccgcagcgaagccaaagagggcuuaaagcgcggagagaccaccaagcaugcggugagccgcggaacagccaagcucagaugguucgucgagaggaaccuagugaagcccgaagggaaaguaauugaucuggggugcggccgcgggggaugguccuauuacugcgcugggcugaagaaaguaaccgaggugaagggcuacaccaaaggcgggcccggccacgaggaacccauaccuauggcgaccuauggguggaaucucgucaagcuccacagcgguaaggacgucuuuuucaucccgccggagaagugcgacacucugcugugugacaucggggaauccagccccaauccgacuaucgaagagggccgaacccugcgggugcugaagaugguggaaccgugguugcgcgggaaccaguuuugcaucaagauccuuaaccccuauaugcccucagucgucgagacccuggagcaaaugcagcgaaagcacggaggcaugcuagugcgaaacccgcuuucgcgcaauuccacgcacgagauguacugggucagcugcgggacggguaacauaguguccgcagucaacaugaccagcaggauguugcucaaccgcuucaccauggcccacagaaagccgaccuacgagcgagacgucgaccugggggccggcacgcgccacgucgccgucgagcccgaagucgcgaaccuagacaucaucggccaacgcauugagaacaucaagcacgaacacaaguccacauggcacuacgacgaggacaacccuuacaagacuugggccuaccaugguucguacgaagugaagccguccggcagcgccucguccaugguuaacgggguggugaaacuccugaccaagcccugggacgucauucccaugguuacgcagauugccaugaccgacaccaccccguucgggcagcagcggguguuuaaggagaaaguugacacgcgcaccccgaaggcuaagcggggaaccgcucagaucauggaagugaccgccaagugguuauggggauuccucagccggaauaagaagccccggauuugcacacgcgaggaauucacgcggaaggugcgcucgaacgcugccaucggcgcugucuucguggacgaaaaccaauggaauagcgcaaaagaggccguggaggacgaacgguucugggaucugguccaccgcgagcgggagcugcacaagcaggggaagugcgcgacgugcguuuacaacaugaugggcaagagagagaagaagcucggagaguucggcaaagccaagggcucccgggcgaucugguacaugugguuaggugcccgcuuccuggaguucgaggcgcucggcuucaugaaugaggaccacugguuuucgagggagaacucccugagcgggguggagggagaggggcuccauaagcucggcuacauauugcgcgacaucuccaagauacccggagggaacauguacgccgacgacacugccggcugggacacacggaucaccgaggacgacuugcagaacgaggccaagauuaccgacauuauggagccggagcacgcccugcuggccaagagcaucuucaagcugaccuaccagaacaaggucguacgcguucagcgccccgccaaaaacgguacgguuauggacguuauuucacggcgcgaccaacggggcagcggacaggugggcaccuacgguuuaaacaccuuuaccaacauggaggcccagcuaauccgccaaauggaguccgaagggaucuucagccccuccgaguuagaaacgcccaacuuggcgggccgggugcuggacuggcuggagaagcaugggguggagcggcucaagcggauggcgaucagcggcgacgacugcguagucaagccgaucgacgacagauucgcaaccgcccugaccgcccucaacgacauggggaaagugaggaaggacaucccccaaugggaacccuccaagggguggaacgacuggcaacagguucccuucuguagccaccacuuccaccagcuuaucaugaaggacggccgugagauagucguaccgugccggaaccaagacgagcugguggggcgugcgcgggucagccagggcgccggauggucccuucgcgagaccgccugccucgggaagagcuacgcccagauguggcagcugauguacuuccaccggcgugauuuacggcucgcagcaaacgcgaucugcucugccguacccgucgacuggguccccacgucgcgcaccacuugguccauccacgcccaccaccaauggaugaccacggaggauaugcugagcguguggaaccggguauggauugaagagaacccauggauggaggauaagacucacgucucuagcuggggagauguaccguaccugggcaagcgagaggaucaaugguguggcucccucaucggccuuaccgcgcgcgcaaccugggcuaccaacauucagguggccaucaaccaaguucggcgacugcucggcaaugaaaauuaccuggauuacaugacaagcaugaaacgguucaaaaaugaguccgacccggaaggggcccugugguga

SEQ ID NO: 24405 - RNA, 9879 nt, Artificial Sequence
  derived and/or modified CDS sequence (opt11) from DENV-1__FJ898431__SS-prME
agcgugaccaugcugcucaugcugaugcccaccgcccuggcuuuccaccugacgacccggggcggggaaccccauaugaucguuagcaagcaggaacgcggcaagagccugcuguucaagaccagcgccggggugaacaugugcacgcucauugcgauggaccugggugaguucugcgaagacacaaugacguacaagugcccccgcaucaccgaggcagagcccgacgacguggacugcuggugcaaugccaccgacacgugggugaccuacggaaccugcagccaaaccggcgagcaucggcgugacaagcgguccguggcccucgcgccccacgugggccucggcuuagaaacaagaacagaaacuuggaugagcuccgagggcgccuggaagcagauucaacggguggagaccugggcccugcgucacccgggguucacggugaucgcccucuuccuggcgcacgccaucgggaccagcaucacccaaaaagggaucaucuucauccugcucauguuagugacuccuucgauggccaugcggugcgucggcaucggcagccgcgacuucguggagggguuaucaggcgccacguggguagacgucguucucgagcacggcagcugcgugaccaccauggccaaggacaagcccacccuggacauugagcugcucaaaacggagguaacaaacccggcaguucugcggaagcucugcaucgaggcgaagaucucaaacaccacaacggacagccgcugcccgacccagggcgaggccacccuaguggaggaacaggacgcaaacuuugucugccgacgcaccuucguggaucgcggcugggggaacggcugcgggcuguucggcaaggggucccugaucacgugcgcaaaguucaagugcguaaccaagcucgagggcaaaaccguccaguaugagaacuugaaguacagcgugaucgucaccguccauacgggcgaccaacaccaggugggcaacgaguccaccgaacacggaacgaccgcuacaauaacaccccaggcucccagcacggaaauucagcugaccgacuacggggcccuuacccuggacugcagcccccggacgggucuugacuucaacgagauggucuugcugacuaugaaggagaaguccuggcuggugcacaagcagugguucuuagaccucccgcugcccuggacgaguggggcgaguaccagccaagagacguggaaccggaaggaccuccuggugaccuucaagaccgcccacgcgaaaaagcaggaggucgucguguuaggcucacaagagggcgccaugcacaccgcccucacgggugccacggagauccaaaccagcggcaccacgaccauauucgccgggcaccugaagugccgccugaagauggacaagcucacucugaagggcauguccuacgucaugugcaccgggagcuucaagcuggaaaaagaaguggcggagacgcagcacgggaccgugcucguccaaaucaaguacgagggcaccgacgccccuuguaagauccccuucuccacccaggacgaaaagggcguuacgcagaacggccggcuuaucaccgccaacccgaucguaaccgacaaggagaagccgguuaacaucgaggcggagccgccauucggagagagcuacaucguaaucggcgcgggcgagaaggcccugaagcugucaugguucaagaaggggagcuccauaggaaagauguucgaggccaccgcccgcggggcccggcgcauggcaauccucggcgacacggccugggacuucgggagcaucggugggguguucaccuccguggggaaacuggugcaccagauauuuggcacggcuuacggcguucuguucagcggcgucuccuggaccaugaagaucgggauuggagugcuucugacguggcugggucugaacucgcgcaguaccucuuuauccaugaccugcaucgccguggggcuggucacccucuaccugggcguuauggugcaggccgacagcgggugcgucauuaacuggaagggccgggaacugaagugcgggagcggcaucuucgugaccaacgaagugcacaccuggaccgagcaguacaaguuccaggcggacucaccaaagcgccucagcgcggccaucggcaaggccugggaggagggagucugcgguauccgguccgccacccgccuggagaacaucauguggaagcagaucagcaacgagcugaaccacauccucuuagaaaacgauaugaaguucaccgugguggucggugacguggcgggcaucuuagcccaggggaagaagaugauccggccccagccgauggaguacaaguacuccuggaagucuuggggcaaagccaagaucaucggggcggaugugcagaacacgacguucaucaucgacgggcccaacaccccggaaugcccggaugaccagcgcgcguggaacaucugggaggucgaggacuauggcuucgggaucuucacgacgaacauuuggcucaagcugcgggacuccuacacccaggugugcgaccaccgccuuaugagcgccgccaucaaggacaguaaggccgugcacgccgacaugggcuacuggauagagagcgagaaaaacgagaccuggaagcuggcacgggccuccuucaucgaagucaaaaccugcaucuggcccaagagccacacgcugugguccaauggcgugcuagagagcgagaugaucauucccaagaucuacgggggcccgaucucccagcacaacuaucgccccggauacuucacccagaccgccggccccuggcaccucgggaagcuggagcuggacuucgaucucugcgaggguaccacgguggucguggacgagcauuguggcaaccggggacccagccugcgcaccaccaccgugacagguaagaucauccacgaguggugcugccggucuuguacacugccgccccugagguucaagggggaggauggcugcugguacgggauggagauccggcccgucaaagaaaaagaggagaaccugguaaagagcaugguuagcgccggcuccggggaaguagacagcuucucccuggggcuguuauguaucagcauuaugaucgaagagguuaugcgcagccgguggucacgcaagaugcugaugaccggcacccuagcugugcuguuccuauugaucauggggcagcugacguggaacgaccugauccggcucugcaucauggucggcgcgaacgccuccgauaggauggggaugggcaccaccuaccuggcccugauggcaaccuuuaagaugcguccgauguucgccgugggcuugcuguuccgacgacugacaucacgggaggugcuccuccugaccaucgggcucucccuggucgcgucgguggagcugcccaacagccucgaggaguugggugacgggcuagccaugggcaucaugauccucaagcugcugaccgacuuccagagccaccagcucugggccacccugcugagucucacguucauuaagaccacuuucagccugcauuacgccuggaagaccauggcaaugguccuguccaucgugagccucuucccccuuugcuuguccacgaccucucagaagaccaccuggcuccccguucugcugggcucccucgguugcaagccgcugacgauguuccugaucgccgagaauaaaaucuggggccgcaagagcuggccccuaaacgagggcaucauggccgucggcaucguuagcauccugcuauccagccuacugaagaacgaugucccccuugcagggcccuuaaucgcaggcggcaugcugaucgccugcuacgucaucuccgggagcuccgcggaccugucacucgagaaggccgcagagguuuccugggaagaggaggccgagcauagcggcgcgucccacaauauccuaguggaaguccaggacgacgggaccaugaagauuaaagacgaggagcgggaugauaccuugaccauacuucugaaggcaacccuccucgccgugagcggcguguauccucugaguauccccgccacgcucuuugugugguacuuuuggcagaagaagaagcaacgcagcggggugcucugggauacccccagcccgcccgagguggaacgggccguauuagacgacggcaucuaccgcaucaugcagcgaggucugcugggucgcagccaggugggcgugggggucuuccaggaaaacguguuucacacaauguggcacguaacacggggcgccguccuaauguaccaggggaaacgccuggagcccuccugggccagugugaagaaagaccugaucuccuacggcggcggcuggcggcuccaaggcucuuggaacacgggggaggaggugcaagucaucgcaguagagcccggcaagaaccccaagaacgugcagaccgcccccggaacuuucaagaccuccgagggcgaggugggcgccauugcgcuggacuucaagccugguacgagcggcucccccauagugaaucgcgaggggaagauagugggacuguacggaaacggggucgugaccacauccggcacguacguguccgccaucgcccaggccaaggcgucccaggaggggccacucccggagaucgaagacgaggucuuccggaagcgcaaccugacgaucauggaucuucaccccggcagcgggaagacacggcgcuaccucccggccaucguccgugaagcuaucaagcgcaagcugcggacccucauccucgccccgacacgcguggucgccuccgagauggcggaagcccugaagggcaugcccauccgcuaccagacgaccgccgucaaaagcgagcacacuggcaaggagaucguggaucugaugugucacgccaccuucacgaugcggcuccugucccccguacgcguucccaacuacaacaugaucaucauggacgaggcccacuucaccgacccgagcuccaucgcggcccggggguacaucagcacccgagugggcaugggcgaggcugccgccaucuucaugaccgcgacgccgcccgguuccgucgaggccuucccccaaucuaaugcuguuauccaggacgaggagcgggacaucccugagagguccuggaacucaggguacgaguggaucaccgacuuccccggcaagaccgugugguucguucccucaaucaaaucaggcaaugacaucgccaacugccuucggaagaacggcaagagggucauccagcucucccggaagacauucgacacggaguaccagaaaaccaagaacaacgauugggacuacguggucaccaccgauaucucagagaugggcgcuaacuuccgcgccgacagggugaucgaccccaggaggugccugaagccggugauucugaaagacgggccggagaggguuauauuagccggccccaugcccguuacggucgccuccgccgcgcagcggcgcgggcggauugggcgaaaucacaacaaggagggcgaccaguacaucuacaugggucagccgcugaauaacgacgaggaccacgcccauuggaccgaagccaagaugcugcucgauaacaucaacacccccgagggcaucauccccgcccuguuugaacccgagcgcgagaaguccgccgcgaucgacggggaguaucgccugcgcggcgaagcacggaagaccuucgucgagcuuaugcgccgcggggaccugccgguuuggcugagcuacaaggucgcuuccgagggcuuccaauauagcgaccgccgguggugcuucgauggcgagagaaacaaccaggugcucgaggagaacauggauguggagaucuggacgaaggagggggagcggaaaaagcugcgaccucgauggcuagacgcccgcaccuacuccgacccccucgcccugcgggaguuuaaggaguucgcggccggccgccggagcguguccggagaccugauccucgaaaucggcaaguuaccucagcaccugacccagcgcgcacagaacgcccucgacaaccuggugaugcugcacaauagcgagcagggcgggcgggcguaccgccacgccauggaagaacucccugauaccaucgagacgcugaugcugcucgcucugaucgcagugcuuaccgguggugucacccucuucuuccuguccggucgaggucugggcaagaccagcauuggccuccugugcguaauggccuccagcgugcugcucuggauggcguccguagaaccccacuggaucgccgccagcaucauccuggaguucuuccugauggugcuccugauccccgagccugaccgacagcggaccccgcaggauaaccaacuggccuacguagucaucgggcuccucuuuaugauucugaccguggcugcgaacgaaaugggccuccuggaaacaacaaagaaggaucuggguauuggccacguggcggucgagaaccaccaccacgccgccauguuagacguggaucugcaccccgccucggcguggacccuguacgcgguggcuacgaccaucaucacacccaugaugcgucacacgaucgaaaacacgaccgcaaacaucagcuuaacugccaucgcaaaccaggccgccauccugauggggcuggacaaaggcuggccgaucucaaagauggacaucggcgucccccuccuggcccuggggugcuacagccaggugaacccccucacacuaacagcugccgucuuaaugcucgucgcccacuacgcaaucaucggccccggucugcaggccaaggcgacccgagaagcccagaaacgcaccgccgcaggcauaaugaagaacccgacgguggacgggaucguagccaucgaccuggacccagucguguacgacgcgaaguucgagaagcagcucggccagaucaugcugcugauccucugcacgucccagauccugcugaugaggaccaccugggcccucugcgagagcaucacccuugcaacuggcccccugaccacacucugggaggggucccccgggaaguuuuggaacaccacgaucgcugugagcauggccaacauauuccgugggagcuaccuggcgggcgccggccuagccuuuucccucaugaaaucccucgggggcggacgccgggggacaggggcccagggcgagacccugggcgagaaguggaagcgccaacucaaccagcugucgaagucugaguucaauaccuacaaacgguccgggaucauggaggucgacaggagcgaggccaaggagggccugaaacgcggggaaacgaccaagcacgccgugucccgcgggacggccaagcuccggugguucguggagcgcaaccuggucaagccggaggggaagguaaucgaccugggcuguggccggggcggguggucguacuauugcgccgggcugaagaaggugaccgaggucaaggguuacacaaagggcgggcccgggcacgaggagcccauucccauggcuacguacggguggaaucucgugaaacuucacuccggcaaggacguguucuucaucccgcccgagaagugcgacacccugcucugcgacaucggggaaagcucccccaacccaaccaucgaggaggguagaacgcugcggguacuaaagaugguggagccguggcuccgcggaaaccaauuuugcaucaagauccugaacccuuauaugcccuccgugguggagacccuggagcagaugcagcggaagcauggcggcaugcucgugcgcaacccccugucccggaacucgacccacgagauguacuggguguccugcgggacuggcaacaucgucagcgcgguuaacaugaccuccaggaugcugcucaaccgguucacgauggcccaccgcaagccgaccuacgagcgcgacgucgaccugggggccggcacccggcacgucgccguggagcccgagguggcuaaccuggacaucauuggccagcgcaucgaaaacauuaagcacgagcacaagucaacuuggcacuacgaugaggacaaccccuacaagaccugggcguaccacgggucuuaugaggucaagcccagcggcagcgccuccuccaugguuaacgggguaguaaaacuccugacuaagccgugggacguaauccccauggucacccaaaucgccaugacagacacgaccccuuucggucaacagcggguguuuaaggagaagguggacacuaggacccccaaagcaaagcgggggaccgcccagauaauggaggucacagcgaaauggcuguggggcuuccucaguaggaacaagaagccacggaucugcacgcgcgaggaguucacccggaaggugagaagcaacgcagccaucggcgccguguucgucgacgagaaccaguggaacuccgcgaaggaggccguggaggacgaacgguucugggaccuugugcaccgcgaacgcgagcugcauaaacaggggaagugcgccacgugcguauauaacaugaugggaaagcgcgagaagaagcucggggaguuuggcaaggccaagggaagccgggcaaucugguacaugugguugggcgcgcgcuucuuagaguucgaggcccuaggcuuuaugaaugaggaccacugguucagucgggagaacagccugagugggguagagggcgaggggcugcacaagcucggcuacauucugcgcgacaucagcaagaucccugguggaaacauguacgccgacgacaccgccggcugggauacccggauaaccgaggacgaccugcagaacgaggccaaaaucacugacaucauggagcccgagcaugcgcucuuagccaaguccaucuucaagcugacuuaccagaacaaagugguccgcgugcagcggccggccaagaacgguacggucauggaugucaucucacgccgcgaccagcggggcuccggccaggugggcacuuacggccucaacacguucaccaacauggaggcacagcugaucagacagauggaguccgaggggaucuucucccccuccgagcuggagaccccaaaccucgccggccggguauuagacuggcuggagaagcacgggguugagcgccucaagcggauggcgauauccggggacgacugcguugugaaacccaucgacgaccgguuugccaccgcccugacggccuugaacgauauggggaagguccggaaagacaucccgcaaugggagcccagcaagggguggaacgacuggcagcaggucccguucugcagccaccacuuccaccagcucaucaugaaggacgggcgcgagaucguggugcccugccggaaccaggacgagcuugugggucgcgcccggguaucccaaggcgcgggguggagccugcgcgagaccgccugccucgguaaguccuacgcccagauguggcagcugauguacuuccaccggagagaccugcggcucgcugcgaaugccaucuguagcgccguaccgguggacugggugcccaccuccaggacuacguggagcauacacgcccaccaccaguggaugaccacugaagacaugcuuuccgucuggaaccgugucuggauugaggagaaccccuggauggaggacaagacccacaucucuuccuggggcgacgugcccuaccugggcaagcgcgaggaccaguggugcggcagccucauaggacugacggcacgggcgaccugggccacuaacauccagguggcuaucaaccaaguccggcgccugaucggcaacgagaacuaccucgacuacaugaccagcaugaagcgguucaaaaacgagagcgacccggagggggcccuuugguga

SEQ ID NO: 24406 - RNA, 9879 nt, Artificial Sequence
  derived and/or modified CDS sequence (opt11) from DENV-1__GU131678__SS-prME
agcgugaccaugcugcucaugcucaugcccacggcccuggccuuccaccucaccacucggggcggagaaccgcacaugaucgugagcaagcaggagcggggcaagagccugcuguuuaagaccuccgcgggggugaacaugugcacccugaucgccauggaccugggggaguugugcgaggacaccaugaccuacaagugcccucgcaucaccgaggccgagcccgaugacguagauugcuggugcaacgccaccgacacgugggugacuuaugggacaugcucccagaccggcgagcaccggcgggagaagcgguccguugcccucgcgccccacguuggucucggguuggagacgcgcaccgagacauggaugucuuccgagggcgccuggaagcagauccagcgggucgagaccugggcccuccgccaccccggguuuacggugauagccuuguuccuagcgcacgccaucggcaccagcaucacccagaaggggaucaucuucauccuucugauguuagucacacccucuauggccaugcggugcguagguauuggcucuagggacuucgucgaggggcucagcggcgccacgugggucgacguuguguuagagcacgggagcugcgugaccaccauggcuaaggacaaacccaccuuggacaucgagcuucuaaagacggaggucaccaaccccgcgguccugcggaagcucugcauugaggcaaagaucucaaacaccacgacggacagccgcugcccgacccagggcgaggcaacccugguggaagaacaggacgcuaacuucgucugcaggcgcaccuucguggaccggggaugggggaacgggugcgggcuguucgguaaggggucccuacugacgugcgcuaaguucaagugcaugaccaagcuagagggcaagaucgugcaguacgaaaaccucaaguacucugucaucgugaccgugcacacaggcgaccagcaccagguaggaaacgaauccacggagcacggcacaaccgcgaccaucacgccccaggcccccacaacggagauucaacugaccgacuacggggcccuuacccuugacuguagcccccgcacgggccuggacuucaacgaaauggugcugcucaccaugaaggagaaguccuggcugguccacaaacagugguuccuggaccuaccgcugcccuggaccagcggggccucuaccucccaagaaacguggaaccggcaggaccugcuagugacauucaaaaccgcccaugcgaagaagcaggagguggucguacugggcucccaggaaggcgccaugcacaccgcccugacgggugccaccgagauccagaccuccggcaccacgacgaucuucgccgggcaccucaagugccgccugaaaauggacaagcugacucucaagggcaugagcuacgugaugugcaccggaucauucaagcuggagaaagaggucgcggagacgcagcauggcaccgugcugguucagaucaaguacgaggggaccgacgcccccugcaaaauccccuuuagcacccaggaugagaaggggguuacgcagaacggucgguuaaucaccgccaacccaaucguaaccgacaaggagaagcccgugaacaucgaggccgagccuccauucggggagagcuauauugucaucggcgcgggcgagaaggcccucaagcugagcugguuuaagaaaggguccagcaucggcaagauguucaaggccaccgccagaggggcccggcggauggcuauccugggcgacacugccugggauuucgggucgaucggcggcguguucaccagcguggguaagcucguccaccagaucuucggcaccgccuacggggugcuguucuccggcgugucguggaccaugaagaucgggaucggcguccugcucacguggcuuggucugaacucccgcagcaccagccucuccaugaccugcaucgccguagggcuugucaccuuauacuuaggcgucauggugcaggccgacuccggaugcgucaucaauuggaagggccgggagcuaaagugcgggucuggcaucuucgucacgaacgaggugcacaccuggaccgagcaguacaaguuucaggcggauagcccgaaacgucuuucugcagccaucggcaaggccugggaggagggggugugcggcauccggagcgcuacucgccucgagaacaucauguggaagcagaucuccaaugagcugaaccauauccugcucgagaacgacaugaaguucacagucgugguaggggacguugcgggcauccugguacaaggaaagaagaugauccguccccagcccauggaguacaaguacagcuggaaaagcuggggcaaggccaagaucaucggcgccgacguucagaacucuacguucauaaucgacgggcccaacaccccggagugcccggacgaccagcgcgccuggaauaucugggaggucgaggacuacggcuucgggaucuucaccaccaacaucuggcugaaacuucgugacuccuacacccaggugugcgaccaucgucugaugagcgcggcuaucaaggacucaaaggccgugcacgccgacaugggauacuggaucgagagugagaaaaacgagaccuggaaacuugcccgcgcgucuuucauugagguaaagaccugcauauggccaaagagccauacccucuggucuaacggagugcuggagagcgaaaugaucauaccgaagauccaugggggcccuaucucucagcauaacuaccgccccggguauuucacccagacagccggccccuggcacuuggguaagcucgagcuggacuucgaccugugcgagggcaccacaguggucguggacgagcacugcggcaaccgggggccgagcuuacgcacgaccaccguuacaggcaagaucauccacgaguggugcugccggaguugcacucuaccuccccugcgcuuccgcggggaggauggcugcugguacgggauggaaauccgacccgucaaggagaaggaggaaaaccuugucaagaguauggugagcgcaggaucaggcgaggucgacaguuuccugcuggggcuccugugcauaucaauaaugaucgaggaggugaugcgcagccgcuggucccggaagaugcugaugaccgguacacucgccguguucuucuuauuaaucauggggcagcucacuuggaacgaccugauacggcugugcauuauggugggcgcgaacgcgagcgaccgcaugggaaugggcacgaccuaccucgcccugauggccaccuucaagaugcggccgauguucgcgguggggcucuuguuucgccggcuaaccucccgcgaggugcugcuccugacgaucgggcugucccuagucgcuuccguggagcugcccaacucacuggaggagcucggugacggguuggcgauggguaucaugauccugaagcuccugacugauuuccaguccuaccaguuaugggccaccuugcugagccugaccuucaucaagacgaccuucucccuccacuacgccuggaagaccauggccaugguccugucaauaguaucccuguucccccucugccugagcaccacaucccagaagaccaccuggcugccggugcuccugggcagcuuagggugcaaaccgcucacaauguuccuaauugcggaaaacaagaucuggggccguaaguccuggccgcugaacgaagggaucauggccgugggcaucgugucuauccuccugaguucucuuuuaaagaaugacgugccccuggccgggccacugaucgccggcgggaugcucaucgccugcuacgucaucucugggagcagcgcggaccugucccuggagaaggccgccgaggugagcugggaggaagaggcggagcacuccggcgcuagccacaacauccucguggaggugcaggaugacgguacgaugaagaucaaggacgaggagcgcgacgacacccugaccauccugcucaaagcgacccugcuggccgugucugguguuuacccgcucuccauacccgccacccuauucgucuggcacuucuggcaaaagaagaaacaacggaguggaguacuuugggacacgcccaguccgcccgagguggagcgcgccguccuggacgacggcaucuacagaaucaugcagcgcggccucuuggggcggucccaggugggcgugggggucuuucaggagaacgucuuccauaccauguggcacgugacgagaggcgcgguccugauguaccaggggaaacggcucgagcccagcugggcaucugugaagaaggaccuaaucagcuauggcggcggauggagauuccagggcuccuggaacaccggggaggaggugcaagucauugccguggagcccggcaagaaccccaaaaacgugcagaccgcccccgggaccuucaagacacccgagggcgaggucggcgccaucgcccuagacuucaagcccgggaccagcggcuccccaauagugaauagagaggguaagaucgugggucucuacggcaacgggguggugacgacaucuggaaccuaugugucagcgaucgcccaggccaaggccucccaggaggggccgcuccccgagaucgaggacgaggucuucagaaagcggaaccugacaauuauggacuuacauccaggcagcgggaaaacgcgccgguaccugccggccaucgugagggaggccaucaagcggaagcugcgcacccucauccuggcuccgaccagaguggucgccuccgagauggccgaggcgcuaaaagguaugcccauccgguaccagaccacagccgucaagucugagcacacgggcaaggagaucguggacuuaaugugucacgccacauucaccaugcgccugcugucuccuguccgagugccgaauuacaacaugaucaucauggacgaggcccacuucacagaccccagcuccaucgcggcgagaggguacaucagcaccagggugggcaugggggaggcugccgcgaucuucaugaccgccacgccucccggcuccauggaggcguucccgcagagcaaugccgucauucaggacgaggagcgcgacauccccgagcgguccuggaauagcggguacgaguggaucacagauuucccaggcaaaacggugugguuugugccuuccaucaaggccggcaacgauaucgccaacugccucaggaagaacgggaagcgagucauccagcugagccgcaagaccuucgacacagaauaucagaaaacgaagaacaacgacugggauuacguuguuaccaccgacaucuccgagaugggcgcgaacuuccgggcugaccgcguuaucgacccgcggagaugucuuaagccugucauccucaaggacgggcccgagcgagugauuuuagccggcccaaugccggugaccgucgccagcgccgcgcagcgcagggggcgcaucggccggaaccccaauaaggagggcgaccaguacauauacauggggcaaccucugaacaacgaugaggaccacgcccacuggacggaggccaagaugcuccuggacaacaucaacacccccgagggcauuaucccggcccucuucgagccagagcgcgaaaaguccgcugcaauagauggugaguaccgccuccggggcgaggcccgaaagaccuucguugagcugaugcggcgcggcgaccugcccgugugguugagcuacaagguggcguccgagggguuccaguacuccgaccggcgcuggugcuucgccggcgagcggaauaaccagguccuggaggagaacauggacguugagaucuggaccaaggagggugagcgcaagaaacuacucccucgcuggcuggacgccaggacguacagcgauccgcuggcccuccgggaguucaaggaguucgccgccggacgccggagugugagcggggaccugauccucgagaucggaaaguuaccccagcaccuuacucagcgcgcccagaacgcacuggauaaccucgucauguuacacaacuccgagcagggcgggcgugcguaucgccacgccauggaggagcuccccgacaccauagagacgcucaugcugcuggccuuaaucgcaguccugacaggcggggugacgcuguucuuccucagcgguaagggucugggcaaaacgucuauaggauuauugugcgugauggccagcuccguccuguuauggauggggagcguggagccccacuggaucgccgccuccaucauccucgaguucuuccugaugguccugcucaucccggagcccgaucggcagcgcacaccacaagacaaccagcuagcauacguggucaucggcuugcuguuuaugauccugacuguugccgcaaacgagaugggguuauuggagacgaccaagaaggaccugggcaucggccacguggcugucgagaaccaucaccacgccgccaugcuggacgucgaccuccacccggcgagcgcuuggacccuguacgcaguggccaccaccaucaucacccccaugaugcggcacaccaucgaaaacaccacggccaauaucucccugaccgcaaucgcgaaccaggccgccauccuaaugggucuggccaaaggcuggcccaucucgaagauggacauaggagugccacuacucgcguuggguugcuacucccaaguuaacccuuuaacccucacggccgccgugcugaugcugguagcccauuaugccaucauuggccccggccuucaggcgaaggccacucgagaggcccaaaagcggacggccgccgggaucaugaaaaaucccaccaucgacgguauugucgcaaucgaccuggaccccgugguguaugacgccaaguucgagaagcagcucggucagaucaugcucuuaauccuaugcaccagccagauauugcugaugcgcacgaccugggcccugugcgaguccauaacccucgccaccgggccguuaacgacccugugggagggcagccccgggaaguucuggaauaccaccaucgccgucaguauggcgaacaucuuccgcggcagcuaccucgcuggcgccggacuggcuuucagccugaugaagucccuaggcgggggccggcgcgggacuggcgcccagggcgagaccuuaggggagaaguggaagcggcaacuuaaccagcucagcaaguccgaguucaacaccuacaagcgcucugggaucauggaaguggaccgguccgaagccaaggagggguuaaagcggggcgagaccacuaagcacgccgugagccgggggcccgccaagcugcgaugguucgucgagcggacccucguuaaccccgagggcaaggugaucgcccugggcugcgggcggggcgcgugguccuacuacugcgccgggcuuaagaagggcaccgaggucaagggguacaccaagggcggcccggggcacgaggagcccauccccauggccacauauggcugggacuuagugaaacuucacagcgggaaggacguguuuuucauucccccggagaagugcgacacccuucuuugcgacaucggcgaguccagccccaaccccacgaucgaggagggucggacucuccgcguccugaagaugguggagcccuggcugcggggcaaccaguuuugcaucaagauccucaaccccuauaugcccucuguagucgagacccuggagcagaugcagcgcaagcacggcgggaugcuggugagaaacccacuaagccgcaacaguacacacgagauguacugggugagcugcggcaccgggaacauagucuccgccguaaauaugaccagccggaugcugcuaaaccgcuuuaccauggcccaccgcaagccaacguacgagcgcgauguggaccuuggcgccggcacgcgccacgucgccguggacccugagguggccaaccuggacaucaucgggcagcggaucgagaacaucaaacacgagcacaaguccaccuggcacuacgacgaggacaaccccuacaagaccugggccuaucacggaagcuacgagguuaagcccuccgggucagcuagcagcauggugaacggcguggucaagcuguugacgaaacccugggacguaaucccgauggucacccagaucgcgaugaccgauaccacgccguucgggcagcagcgcguguucaaggagaaaguggacacucggaccccuaaggcaaagcgcgggaccgcccaaauuauggaggucacugcccgguggcugugggguuuccuuagccgcaacaagaaaccaaggaucugcacacgcgaggaguucacccggaaggugcgcucaaacgcggccaucggggccguguucgucgaugagaaucaguggaacuccgccaaggaggccguggaggacgaucgcuucugggaccucguccaucgcgagcgggagcugcacaagcagggcaaaugcccgaccugcgucuacaacaugauggggaagagagagaagaagcugggcgaguucgggaaggcgaagggcucccgacccaucugguauauguggcucggcgcccgcuuucuggaguucgaggcucugggguucaugaacgaggaucacugguucagccgggagaacucccucagcggcguggagggggaggcccuacacaagcuggguuacauccuccgcgacaucuccaagauccccgggggcaacauguacgccgacgacacggcgggcugggacacccggauaaccgaggaugaccugcagaacgaggggaagaucacagacaucauggagccggagcacgcccugcucgccaagagcaucuucaaacugacuuaccagaacaaggugguccgcgugcagcggcccgccaagaauggcacaguaauggaugucaucagucgccgugaccagcggggcagcggccagguagggaccuacgggcugaauaccuucacgaacauggaggcccagcucaucaggcagauggaauccgaggggaucuuccugccgaacgagcuggagacacccaaccuugcggggcgggugcuggacuggcuggaaaaguacggcgucgagcgccuuaagcggauggccaucagcggggacgacugcguggugaaaccgaucgacgaccgcuucgccaccgcccugaccgcccugaacgacaugggcaagguccggaaggacaucccccagugggagccuaguaaaggcuggaacgacuggcagcagguccccuuuugcucccaccauuuccaucagcucauaaugaaagacgggcgcgagaucguggucccgugccggaaccaggaugagcuggugggcagagcgcgggugucccagggggcaggcuggacgcuccgcgagacugccugcuuaggcaagagcuacgcccagauguggcagcugauguacuucccgcggcgcgcacugcggcucgccgccaacgccaucuguuccgccguccccguggacugggugcccaccagccgcaccacauggagcauccacgcacaccaccaguggaugaccacugaggacaugcugucggucuggaaccggguguggaucgaggagaacccguggauggaggauaagacccgcaucagcuccugggaagacgugccuuaccugggcaagagagaggaccaguggugcggcagccucaucggccugacgccccgggccaccuggcccaccaauauucaggucgccaucaaccaggugcgacgguugaucggcaacgagaacuacuccgacuauaugacgagcaugaaacgcuucaagaacgagucagagccggagggcgcccucugguga

SEQ ID NO: 24407 - RNA, 9879 nt, Artificial Sequence
  derived and/or modified CDS sequence (opt11) from DENV-1__GU131679__SS-prME
agcgugaccaugcugcugaugcugaugcccaccgcccuggccuuccaccucacaacccggggcggggagccccacaugaucguguccaaacaggagcggggcaagucucugcuuuucaagaccuccgccggcgugaacaugugcacccucaucgccauggaccugggcgaguucugcgaggauacgaugaccuauaagugcccccgcaucaccgaggccgagccagacgacguggacugcuggugcaacgccaccgacacgugggucaccuaugggacuuguagccaaacgggcgagcaccggcgggacaagcgguccguggcgcuggcgccccacgugggcuuaggucuggagacgcgcacggagacauggaugucuucugagggcgccuggaagcagauccagcgugucgagaccugggcccuucgccaccccggguucacggugaucgcccucuuccuggcgcacgccauaggcaccagcaucacccagaagggaaucaucuucauacugcucaugcuggugacccccagcauggccaugcggugcgucggcaucgguucccgcgacuucguggaagggcuguccggcgccacguggguggacgucguucucgaacacgggagcugcgugacuaccauggccaaggacaagcccacccuggacaucgagcugcucaaaacggaaguaacuaaccccgcggugcugcgcaagcugugcaucgaagccaagaucuccaacaccaccacagacagcagaugcccaacccagggcgaggccacucucguggaggagcaggacgccaauuucgucugccggagaacuuuuguggaccgggggugggggaacggcugcgggcuuuuuggcaaggggucccugaucaccugcgcaaaguucaagugcgugaccaagcucgagggcaagaccguccaguacgagaaccuuaaauacucagugaucgugaccguccacacgggagaccagcaccagguggggaacgaguccaccgaacacggcaccaccgcgaccaucacgccccaggcccccagcaccgagauucagcugaccgacuauggggcccucacccuggacugcagcccccggacgggccuggacuucaacgagaugguccuccugaccaugaaggagaaggccuggcuagugcacaagcagugguuucucgaucucccgcugcccuggaccagcggugccagcaccucccaggagacguggaaccggaaggaucuccuggugaccuucaagaccgcgcacgccaagaagcaggaggucgugguauuaggcagucaggagggcgccaugcacaccgcccucacaggggccaccgagauccagaccuccggaacgacgaccaucuuugcugggcaccugaagugccgcuuaaagauggacaagcucacccugaagggcaugagcuacgugaugugcaccgguuccuucaaguuagaaaaagagguggccgagacgcagcacggcaccgugcucguucagaucaaguaugagggcaccgacgcucccugcaagaucccuuucagcacccaagacgagaagggggugacgcaaaacggccggcugaucaccgccaacccgaucgugaccgacaaggagaagcccgucaacauugaagcugaaccgcccuucggggagucauacaucgugaucggugccggcgagaaagcccugaagcuguccugguucaagaagggguccucgaucggcaagauguucgaggccaccgcucgcggggcgcggcgcauggccauccucggcgacacggccugggacuucggguccauuggcggcguguucaccagcguugggaagcugguucaccagauuuucggcaccgcuuacgggguccuguuuuccggcgucagcuggaccaugaagaucgggaucggcguucugcugacgugguuaggguugaacucccggagcaccucccugagcaugaccugcaucgccguggggcuggucaccuuguaccucggcgugauggugcaagcggacuccggcugcgucaucaacuggaagggucgcgagcugaaaugcggcagcggcaucuuuguaacgaacgaagugcauacguggaccgagcaauacaaguuccaggcggacuccccgaagcgccucuccgccgccaucggcaaggccugggaggagggggucugcgggauccggagcgcgacacgccuggagaacaucauguggaagcagaucuccaacgagcugaaccacauucucuuggagaacgacaugaaguucaccgugguggucggggacguggcgggcauccuggcccaggggaaaaagaugauaagaccccagcccauggaguacaaguacucuuggaaguccuggggcaaggccaagaucaucggcgcggacgugcagaaugccacguucaucaucgacgggcccaacaccccggagugccccgacgaccagcgcgccuggaacaucugggaagucgaggacuacggcuucgggauauucaccaccaacaucuggcucaaguuaagggacaguuacacccaggugugcgaccaccgcuugaugagcgccgcgaucaaggacagcaaggcgguccaugccgacauggguuacuggauugaaucugagaagaacgagaccuggaaacuugcucgugccucuuucauugaggucaagaccugcauuuggcccaagucccacaccuuguggagcaacggugugcuggaguccgagaugauaauacccaagaucuacgggggcccgauuagccagcacaauuaucgcccgggguauuucacacagaccgccggccccuggcacuuggggaagcuggagcuggacuucgaccucugcgagggcaccaccguggucguggacgagcacugcggaaaccgagggccaucccugcgcacgaccaccgugaccggcaagaucauccaugaguggugcugccggagcuguacgcuaccgccccugcgcuucaagggggaggacggcugcugguacgggauggagauccggccugucaaggagaaggaggaaaaccuggugaaguccaugguuagcgcgggcagcggcgaagucgacuccuucagcuuggggcuccucugcaucuccaucaugaucgaggaagugaugcgcucgcgguggagucgcaagaugcugaugaccgguaccuuggccguuuucuuccugcugaucauggggcagcucaccuggaaugaccugauccgguugugcaucauggucggcgcaaacgccagcgaccgcauggggaugggcacgacguaccucgcccugauggcaaccuucaagaugcguccgauguucgccguggggcuccuguuccggcgccugaccucacgggaggugcugcuccugacgaucgggcucagccucgucgcguccguggagcugcccaacagccuggaggagcucggcgacggguuagcgaugggcaucaugaucuugaagcuccugaccgacuuucagucgcaccagcugugggcgacccuccugagccugaccuucaucaagacaaccuucucccuccacuacgccuggaaaaccauggccaugguucugagcaucguuucccuguuuccccugugccugagcaccacgucccagaagaccacuuggcugcccgugcuccuaggcagccuggggugcaaaccgcucaccauguuccugaucgccgagaacaaaaucuggggccgcaaguccuggccccugaaugaggggaucauggccgucgggaucguaagcauacugcuuagcagucugcucaagaacgacgugcccuuagcggggccccugaucgccgggggaaugcucaucgccugcuaugucaucagcggguccagcgccgaccugucccuggagaaggccgcagaggugagcugggaggaggaggccgagcacuccggcgccagccacaacauccucguugagguccaggacgacgggacgaugaagaucaaggaugaggagcgggacgacaugcuuacgauccugcucaaagccacccugcuggccguguccggcguguacccccucuccauccccgcgacccuguucgucugguacuuuuggcagaagaaaaagcagaggucggggguucugugggacacccccuccccgcccgagguggagcgggccguccucgacgacggaaucuaccgcaucaugcaacggggccugcuggggcgcucccaggucggggugggugucuuccaggaaaacguguuccacacgauguggcacgugacgcggggcgccguccugauguaccaggggaagcgacucgagcccucuugggccagcgugaagaaggaccugaucagcuacggcgguggguggcggcugcagggcuccuggaacaccggggaggagguccaggugaucgcaguggaacccgggaagaaccccaagaaugugcagaccgcgcccgggacauucaaaaccagcgagggcgaagucggagccaucgcccuugacuucaagcccgggaccucaggcucacccaucgugaaccgcgaggggaaaauagugggccuguauggcaacggggucgugaccacuucaggcaccuacguguccgcgaucgcgcaggccaaggcuagccaggaggggccccugccggagaucgaggacgaggucuuccggaagcggaaccucaccaucauggaccugcacccaggcuccgggaagacccggcgcuaccugcccgccaucgugagagaggccaucaagcgcaaguugcgaacgcugauccuggcgccgacgcgcguggucgccagcgagauggccgaggcccucaagggcaugcccauccgcuaccagaccaccgccguuaaauccgaacacacgggcaaggagaucguggaccucaugugccaugcgaccuucaccaugcggcugcucagcccugucagggugcccaacuacaacaugauaaucauggacgaggcccacuucaccgacccuuccagcaucgccgcccggggcuacaucucaacgagggugggcaugggggaggcagcggccaucuucaugaccgccacaccgcccggcagcgucgaggccuucccccaguccaacgcggugauccaggacgaggagcgggacaucccggagcgcagcuggaacaguggguaugaguggaucaccgacuuccccggcaaaacggugugguucguccccucgaucaaguccggcaacgacaucgccaacugucugcggaagaacgguaagcgcgugauccagcugucucggaagaccuucgacaccgaguaccagaagaccaagaacaacgacugggacuacguggucacgacagacaucuccgagaugggcgccaauuuccgcgccgaccgggugauugacccccgccggugccuuaagccgguuauccugaaggacgggcccgagcgcgucauuuuggccggcccuaugcccguuaccgucgcgucggccgcccaacggcgcgggcggaucggccgcaaccacaacaaggagggugaccaguacaucuacauggggcagccgcucaacaacgacgaggaccacgcccacuggaccgaggccaagaugcugcuggacaacaucaacacgcccgaggggaucauacccgccuuguucgagcccgagcgggagaaguccgccgcgaucgauggggaguaccgccuucgcggcgaagccagaaagaccuucguugagcugaugcgccgcggggaccucccgguguggcuaagcuacaaggucgccagcgagggcuuccaguauuccgaccgacgguggugcuuugacggcgagcgcaacaaucaggugcuggaagagaacauggacguggagauuuggaccaaggagggggagaggaagaaacugagaccacgguggcuggacgcgcgcaccuacagcgacccccuggcccuccgggaauucaaggaauucgccgccggccgccgguccguuaguggggaccugauccuggagauaggcaagcucccccagcaccugacgcagagagcgcagaacgcccuggacaaccucgugaugcuacauaauuccgagcagggcgggcgggccuaccgccacgccauggaggagcugccggacaccaucgagacccucaugcugcucgcccucaucgcggucuugaccgggggagucacgcuguuuuuucucagcggccgggggcugggcaagaccuccaucgggcugcucugcgugauggccuccuccguacugcuguggauggcaagcgucgagccccacuggaucgccgccuccaucaucuuagaguucuuccugauggugcugcucauccccgagcccgaccgacagagaaccccgcaggacaaccagcuggcguacguggucaucgggcuccucuucaugauacugaccguggccgccaacgagaugggccugcucgagaccacgaagaaagaccuagggauaggccacguggcugucgagaaccaccaccacgcagcgaugcuggacguggaccuccaucccgccagcgccuggacccuguacgccguggccaccaccauaaucacgcccaugaugcgccacaccaucgagaacaccaccgcuaacaucucccugacggccaucgccaaccaggccgcgauccucaugggacuggauaagggcuggccgaucagcaagauggacaucggcgucccacugcucgcucuggggugcuacucccagguuaacccccugacccuaaccgccgccguccugaugcuggucgcccacuacgcgaucauaggccccgggcuccaggccaaggccacgcgggaggcccagaagcgcacggccgcgggcauaaugaagaacccgacuguggacgggaucguggccauugagcuggaccccgucguguacgacaccaaguuugaaaagcagcugggccagaucaugcuccugauccugugcaccagccagauccuccugaugcgcacgaccugggcacugugcgaguccaucacccucgcuaccggcccccugacgacccugugggaggggagccccgguaaauucuggaacaccaccaucgccgugagcauggcuaacaucuuccgggggagcuaccucgccggagccggccuggccuucagucugaugaagucccucggaggcgggcgccggggcacgggagcgcagggcgagacccugggcgagaaguggaagcgucagcugaaccagcucagcaaguccgaguucaacaccuacaaaagaagcggaaucauggaggucgaccgcuccgaggcaaaagagggacugaagcgcggggagaccacgaagcaugccgugagccgcggcaccgcaaagcugcggugguucguggaaaggaaccuggucaagccggaggggaagguaaucgaccugggcugcggucguggcgggugguccuacuacugcgcagggcugaagaaggugaccgagguuaagggguacaccaagggcgggccuggccacgaggagcccauccccauggcgacguacggguggaaucuggucaagcuccacagcggcaaggacguguucuucauuccgcccgagaagugcgacacccuucugugcgacaucggcgaguccagccccaauccaaccaucgaggagggccgcacccuccggguccugaagaugguggagccguggcuaagggggaaccaguucugcauaaagauccucaaucccuauaugcccagcguugucgagacgcuugagcagaugcaaaggaagcacggcggcaugcugguacgcaauccccucagucggaacagcacucaugagauguauugggugagcugcggcaccggaaacaucgucagcgccgugaacaugaccucccgcaugcugcugaaccgguucaccauggcccaccgcaagccgacguaugagcgcgacguggaccucggggccggcacgcggcacgucgccguggagccggagguggcgaaccuugacaucaucggccagagaauugagaacaucaagcacgagcacaaguccacuuggcacuacgaugaagacaaccccuacaagaccugggccuaccacggguccuacgaagucaagcccuccgggagcgccagcuccauggugaacggaguugugaagcuccucacgaagccgugggacgugauccccauggucacccagaucgccaugaccgacaccacuccuuucggccagcagcggguuuucaaggagaagguggacacccguacccccaaggcuaagcgggguaccgcgcagauaauggaggucaccgcgaaguggcuguggggcuuucugagccgaaacaaaaagccacggaucugcacccgugaggaauucacccggaagguacgcuccaaugccgccaucggcgcgguuuucgucgacgagaaccaguggaacagcgcaaaggaggccguggaggacgagcgguucugggaucucgugcaccgcgagcgggagcugcacaagcagggcaagugcgcgaccugcguguacaacaugaugggcaaacgcgagaaaaaacugggggaguucggcaaggcaaaaggcagccgugccaucugguacauguggcucggcgcccgcuuucuggaguuugaggccuuagguuucaugaacgaagaccacugguucagccgugagaacucccucagcgggguugagggcgagggucuacacaagcugggcuacauccugcgcgacaucuccaagauccccgggggcaacauguaugccgacgacacagccggcugggacacccggaucaccgaggacgaccugcagaacgaggcgaagaucaccgacaucauggagccggagcacgcccuacucgccaagucaaucuucaagcugacauaccagaacaagguaguccgcgugcagagaccggccaagaacgguaccguuauggacgucauuucccgccgagaccagcggggcagcggccaggugggcaccuacgggcugaacaccuucacgaacauggaggcccaacucauccgccagauggaguccgaagguaucuucagccccuccgagcuggaaacccccaaccuggcgggcagagugcuggacuggcuggagaagcacggggucgagcgccugaagcgaauggccauauccggagaugacugcguaguuaagcccaucgacgaccguuucgccaccgcccucaccgcccugaaugacauggggaagguccggaaggacaucccgcagugggagcccuccaaaggcuggaacgacuggcaacagguccccuucugcucucaccacuuccaucaacugaucaugaaggacggacgcgagaucgugguccccugcagaaaccaggacgagcucguggggcgcgcgcgggugagccagggggcuggguggucccugcgcgagacggccugccugggaaagagcuacgcccagauguggcagcucauguacuuccacaggcgcgaccugcggcuagcggccaacgccaucugcuccgccgucccgguggacugggugcccaccagccgcaccaccugguccauucacgcacaucaucaguggaugacgaccgaggacauguugagcgucuggaaccgggucuggaucgaggagaacccuuggauggaggacaagacccacaucuccagcuggggcgacgugcccuaccuaggcaaacgcgaggaccaguggugcggcucccugaucgggcucaccgcucgggcgaccugggcaaccaacauccaggucgccaucaaccaggugcgccgccugaucggcaacgagaacuaccuggacuacaugaccagcaugaagcgauucaagaacgagaucgacccggagggggccuuaugguga

SEQ ID NO: 24408 - RNA, 9879 nt, Artificial Sequence
  derived and/or modified CDS sequence (opt11) from DENV-1__GU131680__SS-prME
uccgugacuaugcugcugaugcuaaugccuacagcccuggcuuuucaccucacaacccggggcggggagccacacaugguagucagcaagcaggagcggggcaaaagccuguuguucaagaccagcgccggggucaauaugugcacgcugaucgcgauggaccugggcgaguugugcgaagacacuaugacauacaagugcccccggaucaccgaggccgagcccgacgauguggacugcuggugcaacgccaccgacaccugggugacguacgggaccugcagccagacaggcgagcaccgucgcgaaaagagaucuguggcccucgcgccgcacgugggccugggccuggagacgcggacggagacguggaugagcucggagggcgccuggaagcagauccaacggguggagacuugggcgcuccggcaccccggguucacaguuauagcccuguuccuggcgcacgcaaucggcaccagcaucacccagaaggggaucaucuuuauccuccugaugcuggucaccccaucaauggccaugcggugcguaggcauuggcucucgggacuucguggaggguuuguccggcgccacgugggucgacguugugcuggagcacgggagcugcgucaccaccauggccaaggacaagcccaccuuggacauugagcuccuaaagacagaggugaccaaccccgcgguacugagaaagcucugcaucgaggcaaagaucuccaacacgaccacugacucccgcugcccgacccaaggggaagccacccuggucgaggaacaggacgccaacuuuguaugucgacgaacuuucgucgaccgaggaugggggaacgguugugggcuuuucggcaaggggagccuccugacgugcgccaaguucaaaugcgucaccaagcuggagggaaagaucgugcaguacgagaaucucaaguacagcgugaucgucaccgugcacaccggagaucaacaucaggucggaaacgagaguacggagcacggcaccaccgcgaccaucaccccccaggcucccacgacagagauccagcuuaccgacuacggggcccuaacccucgacugcagcccccgaacaggccucgacuucaacgaaauggucuuacucaccaugaaagagaaguccuggcuggugcacaagcaaugguuccuggaucucccccugccguggaccaguggugcgucuaccucccaagagacguggaaccggcaggaccugcucgucaccuucaaaaccgcccacgcuaagaagcaggaaguggugguguuaggcagccaggagggugccaugcacacugcccucaccggggccacugagauccagaccaguggaaccacgaccaucuucgcugggcaucucaaaugccgcuugaaaauggauaagcuuacccucaaggggaugagcuacgugauguguacgggcuccuucaagcuggagaaagagguggcggagacacagcacggcaccguacuggugcagauaaaguacgagggcacugacgcgcccuguaaaauccccuucagcacccaggacgaaaagggugugacgcaaaacgggcgccugaucaccgccaacccgauugucacagacaaggagaaacccgugaacaucgaagccgaacccccguucggggaguccuacaucgugaucggcgcuggcgagaaggcccuuaagcuaagcugguuuaagaagggguccagcaucggaaagauguucgaagcuaccgcccgcggggcccggcgcauggcaauccugggcgacacggccugggacuuuggcuccaucggugggguguucacaagcguggggaaguugguucaucaaauauucggcaccgccuacgggguacuguucuccggcgugucuuggaccaugaagaucgggauuggcguguuauuaacuuggcugggccugaacucccgcagcaccucccugagcaugaccugcaucgccgucggucuggugacccuguaccucggcgugauggugcaggccgacucggggugcgugaucaacuggaagggcagggaacugaagugcgguucuggcaucuucgugacgaacgagguccacacauggaccgagcaguauaaguuccaggcggacagcccuaagcgccuguccgcugcuaucgggaaggcaugggaagaaggggugugcggcauccggagcgccaccaggcuugagaacaucauguggaagcagaucuccaaugagcugaaccacauauuacuugaaaaugacaugaaguucacugucgucgugggcgauguggcgggcauccugguccaagggaagaagaugauccggccccagccaauggaguacaaguacagcuggaaguccuggggcaaggccaagauuaucggggcggaugugcaaaacagcacguucaucaucgacgggcccaacacccccgagugccccgacgaccagcgagccuggaacaucugggagguggaggauuacggcuucggaaucuucacgaccaacauuuggcuaaaacuccgggacucuuacacgcaggucugcgaccaccggcugaugagcgcggcaaucaaggacaguaaggccguucacgccgauaugggcuauuggauugaaagcgagaaaaacgagaccuggaagcuggcgagggccuccuuuaucgaggugaagaccugcauauggcccaagagccacaccuuaugguccaacgggguccuagagagcgagaugaucauucccaaaauucacggggggccuaucucccaacacaacuaucgcccgggguacuuuacucaaaccgccggacccuggcaccuggggaagcucgaacuggauuucgaucugugcgaggggaccaccguaguggucgacgagcacuguggcaaccgggggcccucauugcgaacgaccacuguuaccggcaagaucauucaugaguggugcugucgguccuguacgcugccgccccugagauuucgcggggaggacggcugcugguacgggauggagaucaggcccguuaaggaaaaggaagagaaccucgucaaaagcauggugagcgccggcuccggcgagguggacuccuucucccuggggcugcucugcauaucgaucaugauagaggagguaaugcgcucccgcuggucgcggaagaugcugaugaccggcacgcucgccguguucuuccuacugaucauggggcaacuaacuuggaaugacuugauacgccugugcauuauggugggcgccaacgcguccgaucgcaugggaauggguaccaccuaccuggcccucauggccacguucaagaugcgaccaauguucgccgucggucuauuguuccgccgucugaccagccgagaggugcugcugcucacgaucgggcucucccuggucgccucgguggaguuacccaacucccuggaagagcugggcgacgggcuggcgaugggcauuaugauucugaagcugcucacggacuuccaguccuaccagcugugggccacacugcugucccugaccuucaucaagacuaccuucucgcugcacuaugcuuggaagacaauggcgaugguucucuccaucgucagccuguuuccacugugccucuccaccacgucacagaaaaccaccuggcugcccgugcuucucggcucccuuggauguaagccgcugaccauguuucucauugcggagaauaagaucugggggcggaagucauggccccugaacgaggguaucauggccguagguaucgucagcauccugcucucuagccugcugaagaacgacgugccgcucgccgggccccugaucgcuggcggcaugcugauagcuugcuacgugaucucaggcuccuccgcggaccucagccuggagaaggccgcggagguuagcugggaagaggaggcagagcauagcggcgccucccacaacauccuaguggagguucaggacgacggaacaaugaagauuaaagaugaggagcgggaugacacccucacgauccugcucaaggccacgcuccuggccgucagcggcguauauccgcugucaauccccgcaacacucuucgucuggcacuucuggcagaagaagaaacagcgaagcgggguccuaugggacacgcccagcccgcccgagguggagcgugccgugcuggacgauggcaucuaccggaucaugcaacgcggacugcucgggcggucccaagucggcgugggggucuuccaagagaacgucuuccauaccauguggcauguaacccgcggcgcugugcugauguaucagggcaaacggcuggagccgucgugggcgagcgucaagaaggaccuaaucuccuacggcggcggguggcgguuccagggcucauggaacaccggggaagaggugcaaguuaucgcgguugagcccgguaagaaucccaaaaacgugcagacggcccccgggacguucaagacgcccgagggggaagugggcgccaucgcacuugacuucaaacccgguaccuccggcagccccaucgucaacagagagggcaagaucgugggcuuguacgggaacggggucgucaccaccucgggcacguacgucucggcgaucgcccaggccaaggccucccaggaggggccgcuccccgaaauugaggacgaaguguuccgcaagcggaaccugaccaucauggacuuacaccccggcagugggaaaacacgccgcuaucucccggcgauaguucgggaagccaucaaacggaagcugcggacccugauacucgcgcccacacgcgucguggccagcgagauggccgaggcgcugaaggggaugcccauucgguaccagacuacggccguuaaguccgagcacacaggcaaagagaucguggaucugaugugccacgccaccuucacgaugcgccuccugagccccgugcgaguaccgaauuacaacaugaucauaauggacgaggcacacuuuaccgaccccuccucgaucgccgcucgcgguuacaucucgacccggguggggaugggggaagcugccgcuaucuuuaugaccgccacuccacccggcagcauggaggccuucccucaguccaacgccgugauucaggacgaggagcgcgacauccccgagcggagcuggaacagcggauacgaguggauaacggauuucccugggaagaccgucugguucguacccagcauuaaggccggcaacgacaucgccaauugccugaggaagaacgggaaacggguaauacaacucucacgcaagaccuucgacaccgaguaccagaagacuaagaacaacgauugggacuacgucgugaccacagacaucagcgagaugggugcgaacuuccgggccgaccgcgugaucgacccccggcgcugccugaagcccgucauccuaaaagacgggcccgagcgugugaucuuggcuggcccaaugccggucacuguggccuccgcugcacagcgccgggggcgcaucgggcggaaccacaacaaggagggcgaccaauacaucuacaugggacagccccugaacaacgacgaggaccacgcucacuggaccgaagccaagaugcuacuagacaacauaaacaccccugaagguauaauacccgcucuguucgagccggagcgcgagaagucugccgcgaucgauggggaguaccgcuugcggggcgaggcccgcaagaccuucguugagcucaugagacgcggagaucugcccgucuggcugaguuauaaaguggcgucugagggauuccaauacagcgaccgccgcuggugcuucgacggcgagcguaauaaccagguauuggaggaaaacauggacgucgagauauggacaaaggagggggaacgaaagaaguuacggccgcgauggcuggacgcccggacguauuccgacccgcucgcccuucgugaauucaaggaauucgcugcuggccggcgcucgguguccggggaccugauccucgaaaucggcaagcugccccagcaccugacccagcgcgcgcagaacgcccucgauaaucuuguuaugcugcauaauucggagcaaggcgggagagcguaccgccacgccauggaggagcucccugacacuaucgagacccugaugcugcucgcgcugaucgcaguccugacgggaggggugacccuuuucuuucuguccggcaaaggccugggcaaaacgagcauagggcuucucugcgugauggcaagcagcguccuucuauggauggccuccguggagccccacuggaucgcggccagcaucauucuggaauucuucuugauggugcuccugaucccggagcccgauagacagcggacgccccaggacaaccaacucgccuacgucgugauagggcuccuguucaugauucugacgguggccgccaaugaaaugggccuccuggagacgacuaagaaggaccugggcaucggccacguggccguggagaaccaucaccacgcagccaugcuugacguggacuuacaccccgccucggcguggacucuguacgccgucgccacgacaaucaucaccccgaugaugcgccacaccauagagaauacgacggcgaacauaagccucacugccaucgcgaaccaggccgcgauccugauggggcuggacaaaggguggcccaucuccaagauggauaucggggucccacuccuggcccuggggugcuacagccagguaaacccacucacccugaccgccgcagugcugauguuaguggcccacuacgccauuaucgggccggggcugcaagccaaggcgacgcgggaggcacaaaagcgcaccgccgccgggaucaugaaaaaccccaccaucgacgguaucguugcaaucgaucuggaucccgucguguacgacgcgaaguucgaaaagcagcucggacagaucauguuacuaauucuguguaccucccagauccugcugaugcgaacaaccugggcccugugcgagagcaucacccuggccaccggcccccugacgacacucugggagggguccccgggcaaguucuggaacacaaccauugccguguccauggccaauaucuuucgggggucuuaccuugcuggggcaggccuggccuucagccucaugaagucccuagggggcggccggcgggggacgggugcccaaggcgagacccucggugagaaauggaaaaggcagcucaaccagcugagcaagagcgaguucaacacuuacaaaagauccgggaucauggaagucgaccgcagcgaggcgaaagagggccuuaagcgaggggagaccacaaagcacgcggucucgcgcgguacugcgaagcuccggugguuuguggagcggaaccuagucaagcccgaggguaaggugaucgaccuagguugcggccgcggggguuggucuuacuacugcgccgggcugaagaaggugaccgaggugaagggcuacacuaagggcggucccggccacgaggagcccaucccaauggccacguacggauggaacuuagugaaauuacacuccggcaaggacguguuuuuuaucccucccgaaaagugugauacucuuuuaugcgauauuggggagucgucccccaacccgaccaucgaagagggacgaacccugcggguccugaagaugguagagcccuggcucagggguaaccaauucugcaucaagaucuuaaacccauacaugcccaguguugucgaaacauuggaacagaugcagcgcaagcacggcggcaugcucgugcgcaacccacugaguaggaacagcacccacgaaauguauuggguuucuugugggaccggcaacaucgucagugcggugaacaugaccucccgcaugcugcucaaccgcuuuaccauggcccacagaaagccgacguacgaacgcgacguggaccugggggccggcacgcgccacgucgccgucgagcccgaaguggccaaucuggauaucaucggccagcgcaucgagaacaucaagcacgagcacaaaagcaccuggcauuacgacgaggacaaucccuauaagacgugggcguaucaugggagcuacgaggucaaaccgagcggcuccgccagcagcauggucaacggagucguaaagcuccugacgaagcccugggacguuauacccauggucacccagaucgcgaugaccgacacgacgcccuucggccagcagcggguguuuaaagagaagguggacacccgcaccccgaaggccaagcgggggaccgcgcagaucauggagguaaccgcgcgauggcugugggguuuccucucgcggaacaagaagccccggauuugcacccgugaggaguucacucgcaaggugcguuccaacgccgccaucggcgcaguguucguggacgagaaccaguggaacuccgcaaaggaggccguggaggaugaccgcuucugggaucucgugcaucgggaacgcgaacugcacaaacaggggaagugcgcgaccugcgucuacaacaugaugggcaagcgggaaaagaagcucggcgaguucggcaaggccaaggggagccgugccaucugguacauguggcugggcgcacgauuucuggaguuugaagcucucggcuuuaugaaugaggaccacugguuuuccagagagaauagccuguccgggguggaaggcgaaggguugcauaaacucggcuacauccugcgugacauuuccaagauccccgguggcaacauguacgccgaugacacagccggcugggacacacggauuaccgaagacgaccugcaaaacgaggccaagaucaccgacaucauggagccggaacacgcgcugcuagccaaguccaucuucaaauugacguaccagaacaaagugguacgagugcagcgucccgccaagaacgguacuguaauggacgucaucagccgccgggaccagcgcggcaguggccagguugguaccuauggccucaacaccuucacgaacauggaagcccaguuaauccggcagauggagagugaggggauauuccugccuaacgagcucgagaccccgaaccuggcgggucgcguuuuagacuggcucgaaaaguacgggguagagaggcugaagcgcauggcaaucuccggugacgacuguguggucaaaccuaucgacgaccgguucgcgaccgcccuuaccgcccugaaugacauggguaaaguccgcaaggacaucccgcagugggagcccucaaaaggcuggaacgacuggcagcaggucccuuucugcucucaccacuuccaccagcugaucaugaaggacggccgggagaucguggucccgugccgcaaccaggacgagcugguugggcgugcccgcgugagccagggugcgggguggucccuucgagagacggcgugccugggcaaguccuacgcccagauguggcagcugauguacuuccaucgccgggacuuacggcuggccgccaacgccauuugcagcgccguaccaguagacugggucccgacaucccggacgaccuggagcauccaugcgcaccaccaguggaugacgaccgaggacaugcuguccgucuggaauagggucuggaucgaggaaaaccccuggauggaggacaagacccggaucagcaguugggaggacgugcccuaccucggcaaaagggaagaccaauggugcggcucccugaucggccugacggcacgcgcgacuugggccacgaacauccaggucgccauaaaucaggugaggcggcuuaucggcaacgaaaacuacuccgacuacaugaccagcaugaagcguuucaagaacgaauccgaacccgagggcgccuuaugguag

SEQ ID NO: 24409 - RNA, 9879 nt, Artificial Sequence
  derived and/or modified CDS sequence (opt11) from DENV-1__GU131681__SS-prME
ucggugacuaugcuccucaugcuaaugccgacagcccuugcguuccaccuaacaaccaggggaggcgaaccccauaugauagugacaaaacaagaacgcgguaaaucgcugcuguuuaaaacuucugccgggguaaacaugugcacccuuauugccauggaccuaggagaauugugcgaagauaccaugacauacaagugcccgaggauuacagaagcagaacccgacgacguggauugcuggugcaaugcgacugacacaugggucaccuacggaacaugcagucaaaccggcgaacaccgacgcgacaaaaggagcguggcccucgcaccccacguaggccuaggccucgaaacucguacagaaaccuggaugucuucagaaggggcguggaagcagauccagaggguagagacaugggcucuccggcacccuggcuucacugugauagcacuuuuccucgcgcacgcgauaggcaccucuauuacacaaaaggguaucauauucauccuacuaaugcucgucacgcccucuauggccaugcgguguguuggaauagggagccgagauuucguagaggggcuaaguggagcaacgugggucgacguaguacuggaacacggaucuugcgugacaacaauggcaaaagauaaaccaacccuagacauagagcuccucaagacggagguaacgaacccggccgugcuaaggaaacuuuguauagaggcaaagaucaguaacacgacaaccgacuccagauguccgacgcaaggagaggcaacccuuauggaggaacaagacgcaaacuucguguguagaaggaccuucguugaccgcggcuggggaaacggcugugguuuauucgggaagggaagucuaaucacgugugcaaaguucaaaugcgugacgaaacucgaaggaaaaaucguccaguacgaaaauuugaaauacuccgucauagucaccguccacacaggcgaccaacaucagguggggaacgagagcacggaacacgggacgaccgcuacaauuacaccccaagcgccuacaagcgaaauacaacugacagacuacggagcgcucacgcuugauugcucaccgagaaccggccucgacuuuaaugaaaugguauuguuaacgaugaaggaaaagucguggcuaguccauaagcaaugguuucucgaccuuccccucccguggacgucgggagcguccaccucacaagagaccuggaaccgccaagaccuccuggugacauucaaaacagcgcacgcaaagaaacaagaaguuguaguacuuggcagucaagagggcgccaugcacacggccuuaacaggagccaccgaaauacaaacuagcggcaccaccacaauauucgcuggucaucucaagugucgacucaaaauggacaaacugacccuaaaaggaaugucuuacgucaugugcaccgguuccuucaaacuugaaaaagaaguggcggaaacccagcacgguaccguccugguccaaaucaaauacgaagggacagacgccccaugcaaaauaccauuuagcacacaggaugaaaagggaguaacgcagaacgggcgacuuauuaccgcgaaccccaucgugacagauaaagaaaaaccggucaacauagaagcggagcccccguucggagaaagcuacauaguuauaggcgcaggagaaaaagcguuaaaguugaguugguucaagaaaggaagcaguauuggaaagauguucgaagcaacugcccgcggugcaaggaggauggcgauccuaggcgacacggcgugggacuucgguuccauaggcggagucuucaccuccgucggcaaacucguacaucagauuuucgguacagccuacgguguacucuuuucaggagucucguggaccaugaaaauuggcauuggaguacuccuaaccuggcucggccucaacucacggucaacauccuuaucaaugacuugcauagccguuggccuuguuacacucuaccugggagucauggugcaggcagacaguggaugugugauuaacuggaaaggaagagaauugaaaugcgguagcggaaucuuugugacaaaugaagugcauaccuggaccgaacaauacaaauuccaagcagacagccccaagcgccucagugcagcuaucggaaaggccugggaagaaggugugugcggaauacgaagcgcuacacgccuagaaaauaucauguggaagcaaauaaguaacgagcugaaucacauacugcucgagaaugacaugaaauucacugugguugucggcgacguaguaggcauccuagcgcaagggaagaaaaugauaaggccacagccgauggagcacaaguauagcuggaaaagcuggggaaaggcaaagauuaucggggccgacguccaaaacacaacauucauaauugauggcccuaacacaccggagugccccgacgaucagcgggccuggaacauaugggaagucgaagauuacggguucggaaucuuuacaacaaacaucugguuaaaauuaagagacucguacacucaagucugcgaccaccgacugaugucagcagccauaaaggacaguaaagcgguacacgcagacaugggguauuggaucgaaucagagaagaacgaaacauggaaacucgcgcgagcguccuuuauagagguuaagacgugcauauggccaaagagccacacccuguggaguaacggaguccuugaaagcgaaaugauuauuccgaagaucuauggagggccaaucucgcagcacaauuaccggcccggcuacuucacccaaaccgcagggcccuggcaucuaggaaaacuugaacuagacuucgaucucugcgaaggcacgaccguaguaguagaugaacacugcggcaaccgagguccgagccugcgcacaacaaccguaaccggcaagauuauacaugaguggugcugcagauccugcacccuaccaccuuugcgauucaagggggaagacggcugcugguacggcauggaaauuagaccuguaaaagaaaaagaagaaaaucuagugaaaucaauggugucggcaggaagcggagaaguagauagcuucucacuuggguuacucugcaucuccauaaugaucgaggaagugaugaggucaagauggaguaggaaaguacucaugacuggcacgcuugcaguauuccuacuacucauaaugggccaacuaacauggaacgaccucaucagacuauguaucaugguuggcgccaaugccagcgacagaaugggcauggggacuacguaccuagcguuaauggcuaccuuuaaaaugagaccaauguucgcgguuggccugcuguuccgacgacugacaagccgcgaaguuuuacucuugacgauagggcucagccuaguagccucaguagagcucccaaacucacucgaagaacuaggggacggguuggccaugggcaucaugauacucaaacuauugacagacuuccaaucucaccaacugugggcuacacugcuaucacuuaccuucauaaagacaacgcugucauuacacuacgcuuggaagacaauggcaauggugcuaucgauaguaucccuauuccccuuaugucucucgacuacuucccaaaagacaacguggcucccaguccuucuuggaucccucggaugcaagccccucacaauguuccucauagcugaaaacaaaaucuggggacggaagucauggccucucaaugagggcauaauggccgugggggucgucagcauccuccuaaguucacuuuuaaagaaugacguuccacucgcuggaccgcugauugcgggcgggaugcucaucgcaugcuacguaauaucgggguccagugcugaccuuucacuugagaaggcggcagaaguaagcugggaagaggaggccgaacacagcggagccucucauaauauccuggucgaaguccaggacgacgggacaaugaagauaaaagacgaagaaagggaugacacgcucaccaucuuacucaaggcaacacuacuggcugucucgggagucuacccacuaagcaucccagcaaccuuauucguaugguacuucuggcagaaaaagaaacagcgaagcggggugcucugggauacccccucuccacccgagguagaacgugcgguacuggacgauggcaucuaccgaaucaugcagcggggacuacuuggcaggucccaagucggcguaggcguguuccaagagaacguauuccacacgauguggcaugucacacggggagccguccuaauguaucaagguaaacgacuagaaccaucaugggccagcgucaaaaaggaccuuauaucguauggaggaggcuggaggcuacagggcagcuggaauaccggcgaagaagugcaaguuaucgccguagaaccaggcaagaaccccaaaaacguacagacagcaccagggaccuucaaaacacccgagggcgaagugggcgcuaucgcacuugauuucaaaccggguacauccgggagcccgauuguaaaucgggaggguaaaauaguaggauuauacggcaauggcgucguaacaacaucaggcacguacgucagcgcuaucgcacaggcaaaggcuucacaagaggggccacuaccggaaaucgaggacgaaguuuuccguaagaggaaccugacgaucauggaucugcaccccggaucagggaagaccagacgauaucuaccagccaucguaagagaagcgauaaaacguaaacuacguacacugauacucgccccuacccggguagucgcgucagagauggcggaagcccucaaagggaugcccauccgcuaccagacaaccgcggucaagucggaacacacgggaaaagagauaguggaccuuaugugccacgcgaccuucaccaugcgccuccuaucacccguacgcgucccuaauuacaacaugauuaucauggacgaagcccacuucacagacccaaguagcaucgcagcacgcggguacaucucaaccagaguuggcaugggugaagccgccgcaauuuuuaugacggcgaccccgccugguucaguugaagcauuuccccaauccaaugcggucauacaggacgaggagcgcgacauacccgagcgcagcuggaauagcggauacgaauggaucacugacuuccccgguaagacaguuugguucgugccaagcauuaaauccggaaacgauauagcaaauugcuugcgcaaaaacggcaaacgugugauacaacugagcagaaagacguuugacacugaguaccagaaaacgaaaaacaacgacugggacuacguagucacaacggacaucagugagaugggagccaauuucagagccgaucgcguuauagacccucgacgaugucuaaagccgguuauccucaaagacggcccagagagggugauucucgccggacccaugccggugacagucgccagcgcugcgcaacgccggggacgaaucggccgcaaccacaacaaagaaggcgaccaauacaucuacaugggccaaccauuaaacaacgacgaggaccaugcccauuggaccgaagcaaaaaugcuucuggacaacauaaauacacccgaagggauaauacccgcucucuucgaacccgaaagagaaaagagugccgcaaucgacggcgaguaucgacuacgcggagaagcccgcaaaaccuucgucgaacugaugcggagaggcgaucuaccagucuggcuuagcuauaagguagcaucagaaggcuuccaauacuccgacagacgaugguguuucgacggggagcguaacaaccaaguacuugaggaaaacauggacgucgagaucuggacgaaggaaggagagagaaagaaacuacgaccuagguggcuggaugccagaacauacucagacccucuugcccuucgggaguuuaaagaguucgcagcaggcagacgcucaguuagcggggaccuaauucuagaaauuggcaaauugccacaacaccuuacacagcgagcacaaaacgccuuggauaaccucguaaugcuucacaacagugagcaaggcggccgagccuacaggcacgcgauggaggagcuaccugauacgauugaaacucugaugcugcuagccuuaauagcaguccuuacgggcgggguaacgcuauucuuucugagcgggcgggggcucggaaaaaccucgauaggacugcucugcgucauggcaucauccguacuacuuuggauggcaucaguggaaccacacuggauagcggcaagcauaauucuggaguucuuccugauggugcuccuaauuccggagccugaucgacaacgcaccccacaggacaaccaguuagcguacguaguaaucggacuccucuucaugauccucacaguggccgccaacgaaaugggacuacuugagacaaccaagaaagaccugggaaucggacauguggcaguggagaaccaccaccaugcuacuaugcuagauguggaucuacacccggccucggcauggacucuauacgcgguagcgacaacaauaaucacaccuaugaugagacacacuauugagaauaccaccgcaaauaucagucucacagcgaucgccaaccaagcagccauauuaaugggccuggacaagggguggccuaucucgaagauggauaucggcguacccuugcuagcgcugggauguuacucccagguaaacccacuaacguuaacugcagcagugcugaugcugguagcgcacuacgccaucaucgggcccgggcuccaggcgaaagcaacgcgcgaagcgcagaagcgaacagcggccggaauaaugaaaaacccuacgguagacggcaucgucgcgauagacuuagaccccgucguguaugacgccaaguuugaaaaacaacuugggcagauaauguuguuaauacuaugcacgucucaaauacuucuuaugagaacgacgugggcguuaugugaaucaauaacacuagcgaccggcccgcucaccacccuaugggagggcucaccggggaaguucuggaacaccacaauagcagucagcauggccaacauauuucgagggucauaucuugcaggggcaggacuagcauucucacucaugaaaagucuaggaggaggacgccgagggacuggcgcccaaggagaaacccuuggagaaaaauggaaacgccaauuaaaccaguuaaguaaguccgaguucaauaucuacaagcgcucaggcauuauggagguagaccgaagugaggccaaggaaggacuaaagagaggagaaaccaccagacacgcggucucccgaggaaccgcaaagcugcguugguucguagaacgaaaucugguuaagccggaaggaaaagugaucgaucuagggugcggacggggaggauggucauauuacugcgccggucucaagaaagugaccgaggucaaaggcuacacaaaaggagguccaggccacgaggagccaaucccaauggcuacguacggauggaaucuggugaagcuccacagcggaaaagacgucuucuucacaccacccgaaaaaugcgauacguuguuaugcgacauuggagaaaguagcccaaacccgaccaucgaggaaggacgaacucuaagaguuuuaaaaauggucgaaccaugguuacggggaaaccaauucuguauaaagaucuugaauccguacaugccuucagucguagaaacgcucgagcaaaugcaacgaaagcacggcggaaugcugguccguaacccauuaucacggaacucaacacacgagauguacugggugagcugcggcacaggaaacauaguaagcgccgugaacaugacgucccgcauguuguuaaauagguuuacaauggcgcauaggaagccgacauacgaacgagauguagaucuaggagcaggcacuaggcacguggcgguggaaccugaaguugcaaaucuugauauuauagggcaacggaucgaaaacaucaaacacgaacacaaaaguacuuggcauuacgacgaagauaacccguauaaaacaugggcauaucacgguuccuaugaggugaagccaaguggauccgccaguagcaugguaaacggagugguaaaacugcugacgaaaccgugggacgugauaccgaugguaacgcaaauagcuaugaccgacacgaccccguuuggccagcaaagagucuucaaagaaaaaguagacacgcgaacuccaaaggcaaaaagaggaacagcgcagauaauggaagucacagcccgcugguuguggggguuccuuagccggaacaaaaagccucgcauaugcacgagagaagaguucacucgaaaaguccguaguaacgcggcaauaggggcaguauucguugacgagaaccaauggaacagcgcaaaagaggcgguggaggacgagcgauucugggaccuaguacaaaaagagcgugaauugcacaagcagggcaagugcgcaaccugcguauacaacaugauggggaaaagagagaagaaacugggggaguucggaaaagcgaaaggaucacgggcgaucugguacauguggcugggcgcgcgguuucuagaguucgaggcauuaggcuuuaugaacgaggaucacugguucagccgcgaaaauucccucucgggagucgaaggugaggggcuucauaagcucggcuauauucuacgagacauaagcaagaucccagggggcaauauguaugcggacgauaccgcuggcugggacacccgcauaaccgaagaugaccugcaaaacgaggccaaaauaacggacaucauggagcccgaacaugcuuuacuagcuacaagcaucuucaaacuuacauaccaaaacaaaguaguuagaguccaacggcccgcaaagaacggcacuguaauggaugucauuucgagacgggaccaacgaggcucuggacaagucgggacauauggccucaacacuuuuaccaacaugggugcucagcugauccgacaaauggagucggaagguaucuucuccccaucggagcuagaaaucccaaaucuagcggaacgagugcuggacuggcuggagaaauacgggguggagcgccugaaacgcauggcgauaagcggagacgauugcgucguaaaacccauagaugaccgcuucgcgacagcucucacggcgcugaacgacaugggaaaaguaagaaaagacgucccucaaugggagcccucuaagggauggaaugacuggcagcaggucccauucugcagucaccacuuucaccaauuaauaaugaaagacggcagagaaauuguggugccaugccgaaaccaagaugagcuagucgguagggcaagaguaagccaaggcgccggauggagucuccgagagaccgccugccuaggaaagagcuacgcacagauguggcagcuaauguauuuccaccgacgcgaucuacgccuggcugcaaacgccaucugcucggcagugccagucgacuggguaccaacaucgaggacuacauggucaauacacgcccaucaccaauggaugaccacugaagacaugcuuucgguguggaaccgcguguggaucgaagagaacccuuggauggaggauaaaacgcacguauccuccuggggcgacguaccguacuugggaaagagagaagaucaauggugcggcagccuaauuggccugaccgcacgggcaacgugggcaaguaacauacagguagcaauaaaucaagucagacggcugauaggcaaugagaauuaccucgacuacaugacaucgaugaagcguuucaagaacgaaggcgauccggagggagcccugugguaa

SEQ ID NO: 24410 - RNA, 9879 nt, Artificial Sequence
  derived and/or modified CDS sequence (opt11) from DENV-1__GU131682__SS-prME
ucugugaccaugcuucuuaugcugaugccuaccgcucuggcguuccaccugaccacccguggcggcgaaccccacaugaucguauccaagcaggagcggggcaagagcuuauuguucaagaccagugccggggugaauaugugcaccuuaaucgcgauggauuuaggcgagcugugcgaagacacaaugacguauaaguguccccggaucacugagacugagcccgacgauguggacugcuggugcaaugcaaccgacaccuggguaaccuacgggaccugcucucaaacgggggaacaccggcgggacaaacggucgguagcccucgcuccccacguugggcuggggcuggaaacucgcacugagaccuggaugagcuccgaaggcgcguggaagcagauucaacgaguugaaacgugggcccuucgucauccuggguucacugugauugcccuguuccuggcacacguaaucggcaccagcaucacccagaaggggaucaucuucaucuugcugaugcuggucacgcccucuauggcgaugcguugcgugggcaucggcucccgcgacuucgucgaaggacucuccggcgccaccuggguagaugucgucuuggaacacgguagcugugucaccaccauggccaaagauaaacccacgcuggacauugaacugcugaagaccgaggugacaaaccccgccguccuccggaaacucugcaucgaagccaagaucaguaacacgacgaccgacagccgcugcccgacccagggagaagcaacccugguagaggaacaagacgccaacuucgugugucggcgcacguucguggaucggggcugggguaacggaugugggcuauucggcaaggggucccuuaucacgugcgccaaguucaagugcgucaccaagcuggaaggcaagaucguacaguaugaaaaccugaaauacagcguaaucgugaccguacacacaggcgaucagcaccaaguaggaaacgaaagcaccgagcacggcaccacugccaccaucacgccccaggcccccaccacagagauacaacucacugauuacggggcgcugacgcuggacugcagcccacgcacuggcuuggacuuuaacgaaauggugcuguuaaccaugaaggaaaaauccuggcucgugcacaagcagugguuucuggaccugccccugcccuggaccaguggagcaagcaccucccaagaaacguggaaucggcaggaccugcuggucaccuucaagacugcccacgcuaagaaacaggaggucguuguauugggcagccaagagggcgccaugcacacagcucugaccggggccaccgagauccaaaccucugggacgaccaccaucuucgccgggcaccugaagugccgccucaagauggacaaguugacccugaagggcaugaguuacguuauguguacaggcuccuuuaagcuggagaaggaaguggcggagacccagcauggcacuguacuggugcaaaucaaguacgagggcacugacgcgcccugcaaaauuccuuuuagcacgcaggacgagaagggggugacccagaacggccggcucaucacugcgaauccgauugucaccgacaaagagaagcccgugaacaucgaggccgaaccgcccuucggagaguccuauaucauuaucggagccggggagaaagcccugaaacugagcugguuuaagaaggggagcuccaucggcaagauguucgaggcuacggccagaggggcccgacgcauggcgauccugggagauacggccugggacuucgguuccauaggcgggguuuuuacaagcguagggaagcuggugcaucagaucuucggcaccgccuacgggguacuguucuccggaguaagcuggaccaugaagaucgggauuggcgugcuguugaccugguugggacugaauucgcgcagcaccucccugagcaugacauguaucgcaguaggguuagucacacuauaucugggcgucaugguccaggccgacuccggguguguuaucaacuggaaaggcagggagcucaagugugggucaggcaucuucguaacgaacgaggugcacaccuggaccgaacaauauaaguuccaggcagacagcccgaagcgccuguccgcggccaucggcaaggccugggaggagggggucugcgguauucgaucugcaacccgccuggagaacaucauguggaagcaaaucucaaaugaguugaaccacauccugcuggagaacgauaugaaguucacgguagugguuggggauguagcaggcauccucgcucaggggaagaagaugauccggccgcaacccauggaacauaaguacagcuggaaguccuggggcaaggcgaagaucauuggcgcugaugugcagaacacgacuuucauaaucgaugggcccaauacgccagaaugcccagaugaucagcgcgcguggaacaucugggagguagaagacuacggguucggcaucuucacgaccaacauuugguugaagcugagagauagcuauacccaggucugcgaccaucgccucaugucugccgccaucaaggauagcaaggccguacacgccgacaugggcuacuggaucgagucagaaaagaacgagaccuggaagcuggcccgagcuagcuucaucgaagucaagacgugcauuuggccuaagucccauacccuauggagcaacgguguucuugaaucugaaaugaucauccccaagauuuacgggggcccgaucucacaacacaauuacagacccggguauuucacgcagaccgcaggccccuggcaccuaggcaagcuggaguuggacuucgaccugugcgagggcacuaccgugguaguggaugagcacugcggcaaucgcggucccucccuccgcaccaccacggugacggguaagaucauccacgaauggugcugucggagcugcacccugccgccccugcgcuuucgcggggaagauggcugcugguaugggauggagauccgaccugucaaggaaaaggaggaaaaccugguaaagagcauggugucagccggaagcggagaagucgauuccuucagccuggggcugcuaugcauauccaucaugaucgaggaggugaugcggagcagauggucccgaaagaugcugaugaccggcacgcuagccguuuucuuccugcugaucauggggcagcucacauggaacgaccuaaucagacuaugcauuauggucggcgcgaacgccucagaccgcauggggaugggcaccaccuaccuggcguugauggccacuuucaagaugcggccgauguucgccgucggccuccuuuuucgccggcugaccagccgggagguguuguuacuuaccaucggacucagccuggucgccuccguggagcugcccaauagcuuagaggaacucggagacggacuggcgauggguauuaugauccucaagcuacucaccgauuuucagucacaccagcucugggcgacgcugcugagccuaacauucauuaagaccaccuuuucucugcacuacgcguggaaaacgauggccauggugcugagcauugugucccucuuccccuugugccugagcacgacaucccagaagacuacguggcugccaguguuguugggcagcuuaggguguaaaccacugacuauguuccucaucgccgagaacaagauauggggcaggcgcuccuggccccucaacgaaggaaucauggcugucggcauaguaagcaucuuguuguccagcuuacugaagaacgaugugccucuggccggaccccucaucgcgggcgguauguuaauagccuguuacgugaucagcggaucuucggcggaccuguccuuagagaaagccgcggaagugagcugggaggaggaggccgagcacuccggcgcgagccacaacauccugguggaaguccaagacgacgguacuaugaaaaucaaggacgaggaacgggacgacacgcugaccauccuucuaaaagccacacugcuggcggucuccggcguguauccgcugagcauccccgcgaccuuguucgucugguacuucuggcaaaagaagaagcaacgaucaggugugcucugggacacccccagcccccccgagguagagagagccguccuggacgacggcauuuaccgcaucaugcagcggggcuugcucgggcgcucccagguggguguggggguuuuccaggagaacguguuccacaccauguggcacguaacucggggcgcgguguuaauguaccaggggaaaagguuagagcccucaugggccuccgugaagaaagaccugauaagcuacggcggaggcuggcggcuccagggcuccuggaacacuggcgaggaggugcagguaaucgcgguggagccggggaaaaacccuaagaacgugcaaaccgcacccgggaccuucaaaacgcccgagggagaggucggggcuaucgcccucgauuucaagccaggaaccuccgggucccccaucgugaaccgcgaggggaaaauugugggcuuauacggcaacggcgucgucaccacgagcggcacuuaugucagugccauagcacaagccaaggccucccaggaagggccacucccggagauagaagacgagguuuuccggaagcgcaaccugaccauuauggaucuacaccccgggagcgggaaaacacggcgcuaccucccggccaucguacgugaggccaucaagagaaaguuacgcacucugauacucgcccccacgcguguaguagccuccgagauggccgaggcccugaagggcaugcccauccgcuaucagacaaccgcggugaagagugagcauaccggcaaggaaaucguggaccucaugugccacgcuacuuucaccaugaggcuccugaguccgguccgcguaccuaacuacaacaugauaaucauggacgaggcacauuucaccgauccaagcuccauagccgcgcggggguacaucaguacacgcguggguaugggggaagcggccgccaucuucaugacggccacgcccccgggguccgucgaggcauucccgcaaagcaacgcggugauacaggaugaggaacgggacauccccgagcguuccuggaacagcggguaugaauggaucacggauuucccggguaaaaccgugugguuuguccccuccauuaagagcggcaacgacaucgccaacugucugcggaaaaacggaaagcgcguaauccaacuuucccggaagacguucgacaccgaguaccagaaaacaaagaacaacgauugggauuacguggucacgacggauaucagcgagaugggcgcaaauuuccgcgccgacagagugauagacccccgccggugcuugaagcccgucauccugaaggacgggcccgagagagucauacuggcgggccccaugccggugaccguugccuccgcagcgcaacgccgagggcggaucggccgcaaucacaacaaggagggugaccaguacaucuauauggggcagccgcugaacaacgacgaggaccaugcacauuggacagaagcgaagaugcuguuggauaacaucaacacccccgaggguaucauucccgcccuguucgagccggagcgcgagaaguccgccgccaucgacggugaguaccgccuacgcggugaggcuaggaagacguucguagagcucaugcgaagaggggaccugcccguguggcugaguuacaagguugcgagcgagggcuuccaguacagcgaccgaagguggugcuuugacggugagcgcaacaaccagguucuugaggagaacauggacguugagauuuggaccaaggagggggagcggaagaaguugcgcccccgaugguuagacgcaagaacguauagcgauccccucgccuuaagagaguucaaggaauucgccgccggccggcggagcgucagcggggaccugauauuggaaaucggaaaacugccgcagcaccugacacaacgagcgcagaacgcgcucgacaaccuggugaugcugcauaacagcgaacagggcggccgggccuaccgccacgcaauggaggagcuccccgauacgaucgagacccugaugcugcuggcacugaucgccguguugaccggcggggucacccucuucuuccuguccggccgggggcugggaaagacaagcauaggccuacugugugugauggccuccagcgugcugcucuggauggccuccguagagccgcacuggaucgccgcgagcaucauucuggaauucuuccuaauggugcuccugauccccgaaccggaucggcaacggacuccccaggacaaccagcuggccuacgucguaauugggcuacuauuuaugauccugacggucgcggcaaacgagaugggauuacuagagacaacgaagaaagaccucgggaucggccauguggccgucgaaaaucaucaccacgcggccaugcuugacguggaucugcacccggccagcgccuggacgcuauacgcaguggccaccacgaucaucaccccaaugaugagacacacgaucgagaacaccaccgcaaauauuucacucaccgccauugccaaccaggccgcgaucuuaauggggcuggauaaaggauggcccaucucaaagauggacaucggcgucccuuuacuggcucuggggugcuacagccaagugaacccgcucacgcugaccgccgccgugcugauguuagucgcgcacuacgccaucaucggaccgggccuacaggccaaggccaccagagaagcccagaagaggacggcggccggcaucaugaagaauccgacuguugacgggauuguggccaucgacuuagaucccguuguguaugacgcuaaauucgagaagcagcucggccagauaauguuguuaauccucugcaccucgcagauccugcugaugcgcacaaccugggcccucugugagagcauaacgcuggcgaccggcccccugaccacccucugggaaggguccccgggcaaguucuggaauacaaccauugccgugagcauggcgaacaucuuucggggaagcuacuuggccggcgcuggccuggccuucagcuuaaugaaaucccugggcggcgggcgccgggggacaggcgcccagggggagaccuuaggcgagaaguggaagcgccagcugaaucagcugucuaaaucagaguucaacacuuacaaaaggucuggcauuauggaggucgacaggagcgaagcuaaggaaggccucaagcguggggaaacaaccaaacacgcggugagucggggcacugcgaaacuccggugguuuguagagcgaaacuugguaaagcccgagggcaaggugaucgaccuggggugcggucgcgggggcuggucuuacuacugugcuggguugaaaaagguaacagaagucaaaggguacaccaagggcggccccggccacgaggagcccaucccgauggcuaccuacggguggaaccucgugaagcuucacuccggcaaagauguguucuucauuccacccgaaaaaugcgacacacuucucugcgacauuggagagagcucccccaacccgacgaucgaggagggccgaacccugcgggucuuaaaaaugguggagccguggcuccgcgggaaccaguuuugcaucaaaauccuuaaccccuauaugcccagcguggucgagacuuuggagcaaaugcagcguaagcauggcggcaugcucguacguaauccgcugagcaggaacagcacccaugaaauguacugggugagcugcgggaccggcaacaucgugagcgcagugaacaugacgucccgcauguuacucaaccgcuucaccauggcucacaggaagcccacuuacgagcgcgauguagauuuaggggcgggaacccggcacgucgccguggagcccgagguagccaacuuagacaucauaggacagcggaucgagaacauuaaacacgaacauaaguccacguggcacuacgacgaagacaauccguauaagaccugggcauaccacgggucguaugaggugaagccgagcggcucggcaagcagcauggugaacggugucgugaaacuccugaccaagcccugggacguaauccccauggucacgcaaauugcgaugacagacacaaccccuuuuggccagcagcgcguguucaaagagaaagucgacacgcgaaccccgaaggccaagagggggaccgcccagaucauggaggucacggccaaguggcuguggggcuuccucagccgcaacaaaaaaccccggaucugcacccgcgaggaguucacgcgaaaggugaggucgaacgcagcgauuggagccguauucguggacgagaaucaauggaacuccgccaaagaggccguggaggacgagcgguucugggaccuggugcacagggagcgagagcugcauaagcaggggaagugcgcgacuugcgucuacaauaugauggguaagcgggagaagaagcucggggaguucgggaaggccaaggggucgcgcgcuauuugguauauguggcuaggcgcccgcuuccuggaguuugaagcccucggcuucaugaacgaggaccacugguucucccgagagaauagccuguccgggguggagggcgagggucuucacaaacucggguacauccugcgagacaucagcaaaauaccugguggcaauauguacgcggacgacaccgccgggugggacaccagaaucacggaggacgaccuacagaacgaagcgcgaauaaccgacauuauggagccugagcacgcccuccuggccaaauccauauucaagcugacauaccagaacaaggucguuagaguucagcggccugcgaaaaacgguaccguuauggacguuaucucgcgccgagaccagagagggucaggacaaguggggacguacggccucaauaccuucaccaauauggaggcgcagcugaucaggcagauggaaagcgaagguaucuucucccccuccgagcucgagacccccaaucucgccgaacgcgugcuagacuggcuagagaaguauggcgucgagcgcuugaagcgcauggcuaucuccggggacgacugcgucgugaagccaaucgacgaccgguuugccacagcccugaccgcucugaacgauauggguaagguucgcaaggauauuccccagugggagcccagcaagggguggaacgauuggcagcagguccccuucugcucucaccacuuccaucagcucauaaugaaagacggccgggaaauagucgucccgugccguaaucaagacgagcuugugggucgggcccgugucagucagggugccggcuggagcuugcgggagacagccugucucgggaaguccuacgcgcagauguggcagcuaauguacuuucaccgccgggaccuccgucuugcugccaacgccaucugcagcgcuguccccguggacuggauacccacgucccgaacgaccuggagcauccacgcccaccaccaguggaugaccaccgaagacaugcuguccguguggaaccgugucuggaucgaggaaaaccccuggauggaggacaagacccacaucucauccuggggcgacguacccuaucuggguaagagagaggaccaguggugcggcucacucaucggccuuaccgccagagcuaccugggccacaaacauccagguggcgaucaaucagguccgucggcugaucgggaacgaaaacuaccucgacuacaugacuucaaugaagcgcuucaagaacgagucugaucccgagggugcccugugguga

SEQ ID NO: 24411 - RNA, 9879 nt, Artificial Sequence
  derived and/or modified CDS sequence (opt11) from DENV-1__GU131683__SS-prME
agcguuacuauguuguugaugcuuaugcccaccgcccuugccuuccaccucacgacccggggcggggaaccccacaugaucgugucgaaacaggaaaggggcaagagcuugcuuuucaagacucccgcuggggugaauaugugcacccucaucgccauggaccugggggaacucugcgaagacacuaugacauacaagugcccccggaucaccgagaccgagcccgacgauguggacugcuggugcaacgccacggacaccugggugaccuacgggaccugcagccagacgggcgagcaccggcgggacaaacgcagcguggcacucgcgccccacgucggucuggggcuggagacccgcaccgaaaccuggaugagcucagagggcgccuggaagcagauacagcgugucgagacgugggcccugcgacaccccggguuuaccgugaucgcccuguuccuggcccacgcgaucggcacuuccauaacccaaaagggaaucaucuucaucuuauuaaugcucgugacgcccagcauggccaugcggugcgucggcaucggcucccgcgacuuugucgaggggcucagcggagcuaccugggucgaugucgugcucgaacacggcucuugcgugaccaccauggccaaagauaagcccacgcucgacaucgagcuacuuaagaccgaagucaccaacccggccgugcugcggaagcucugcaucgaggcgaagaucuccaacaccacgaccgacagucgaugccccacccagggggaggccacccugguggaggagcaagacgccaauuucgucugccgucgcacguucguugaucgggggugggggaacggcugcgggcuuuucggcaaggggagccucaucacgugcgcaaaguucaagugcgugaccaagcuggagggcaaaaucgugcaguacgagaaucugaaguacuccgugaucguaaccguccacacgggggaccaacaccagguggggaacgagagcaccgagcacgggaccacagcaaccaucacgccucaagcgcccacgaccgagauucagcugacugacuacggugcguuaacucuggacugcuccccgcgcacaggccucgacuucaacgaaaugguccugcugacuaugaaggagaaguccuggcucgcacacaagcagugguuccucgaccugccccuccccuggaccuccggggccagcacgagccaggagacguggaaccggcaggaccuguuggugaccuuuaagaccgcccacgcgaaaaagcaggagguggucgugcucggaucacaggagggugccaugcauacggcgcugacuggggccaccgagauccagacgucuggcacgaccacgauuuuugccggacaccugaagugucgccucaagauggauaagcugaccuugaagggcaugagcuaugugauguguaccgggagcuucaagcucgagaaggagcuggcggagacgcagcacggcacgguccuggugcagaucaaguacgagggcaccgacgcccccugcaagaucccguuuagcacgcaggacgagaaggggguaacccagaacggacgguugaucaccgcaaaccccauugucacggacaaagagaagcccgugaacaucgaggcugaaccaccauucggggaaagcuacauugugaucggugcgggugagaaggcccucaagcugaguugguucaagaaggggagcuccaucggcaaaauguucgaagccacggcccgcggggcccggcgcauggcgauccugggugauaccgccugggacuucgggagcaucggaggcgucuuuaccucagccgggaagcuaguacaccaaaucuuuggcaccgccuaugggguacucuucucgggugucuccuggaccaugaagaucggcaucggaguacuacuaacguggcuuggcuuaaacagccgcuccaccagccucuccaugaccugcauagccguggggcugguaacguuguacuugggcguuauggugcaggcggacagugguugcgugauuaacuggaagggccgggagcugaagugugggucaggcaucuucgucaccaacgaggugcauacguggaccgagcaguacaaguuccaggccgacuccccgaagaggcugucagccgccauugggaaagccugggaggagggggucugcggcauccggagcgcgacucgccucgaaaacaucauguggaagcagauaagcaacgagcugaaccauauccugcucgagaacgacaugaaguucaccgugguggucggggacguggccgggauccuggcccaggggaagaaaaugauucggccccagccuauggaguauaaguacuccuggaaguccuggggcaaagccaagaucaucggcgccgacgugcaaaacacaaccuucauuaucgaugggccgaacacgcccgaguguccggacgaccagcgcgcauggaacaucugggagguggaggacuacggcuucggcaucuucacuaccaacaucuggcugaaguugcgggauuccuauacccaggugugcgaccaccgccugaugagcgccgccaucaaggacucgaaggccgugcacgccgacauggguuauuggauagagagcgagaaaaacgagaccuggaagcuggcccgggccuucuucaucgaggucaagaccugcauuuggccgaagucucacacgcuguggagcaacggcgugcuggagagugaaaugaucaucccgaagaucuacgggggccccauaagccaacauaacuaccgucccggguacuucacgcagaccgccgggccguggcacuugggcaagcucgagcuggacuucgaccugugugagggcacgaccguugucguugaugaacacugcggcaaccggggccccucccuccgcaccaccacggugaccggcaagaucauucacgaguggugcugccggagcugcacgcuaccgccgcugcgcuuucguggcgaagauggcugcugguacgggauggagauucggccggucaaggagaaggaggagaaccucgugaaauccauggugagcgccggcuccggcgaggucgacagcuucagccugggccugcuuugcauauccaucaugaucgaggagguuaugcguaguagguggucccggaagaugcugaugaccggcacgcuagcgguguuuuuccuccugaucauggggcagcugacauggaaugaccuaaucagacuuugcauuauggucggcgccaacgcuagcgaccgcaugggaaugggcaccaccuacuuggcccuaauggccacguucaagaugcggccaauguuugcggugggccuacuuuuccgccgccuaaccucccgcgaggucuugcugcucacuauuggacugagcuuggucgcaucgguagagcuccccaacucauuagaagaacuaggagacgggcucgccaugggcaucaugauccugaagcugcucacggauuuccagucccaccagcuuugggccacgcugcucagccugaccuucaucaagacgaccuucucacugcacuaugcguggaagacgauggccauggugcucagcaucgucucccuauuuccccugugccucagcaccacgagccagaagacgacguggcugccggugcugcucgggagccuggggugcaagccccugacuauguuccucaucgcagagaacaagaucuggggucggcgcuccuggccccugaacgaggggaucauggcugucggcauagucagcauccuucucagcagccugcugaaaaaugacguaccacucgcagggcccuuaaucgcaggcggcaugcugaucgccugcuacgucaucagcgggucuagcgccgaccucucccuggagaaagcugcugaggugagcugggaggaggaggcggagcauuccggcgccagccauaauauccuggucgaaguccaagacgacgggaccaugaagaucaaggacgaagaacgggaugacacccucaccauacuccugaaagccacucuccuggccguguccggugucuacccccugucaauucccgccacccuauucgucugguacuuuuggcagaagaagaaacagcgcucuggggugcugugggacacucccaguccacccgaaguggaacgagccguccuggaugacggcaucuauaggaucaugcagcggggucugcucgggcgcagccaggugggcguaggagucuuccaagaaaacguuuuccacaccauguggcaugugacgcggggcgcuguccuuauguaccaggggaagcgccuggagcccagcugggcuagcgugaagaaggaucucaucucauauggcgggggauggcggcugcaggguagcuggaacaccggcgaagaggugcaggucaucgccguugagcccggcaagaacccgaagaacgugcaaacugcaccggggaccuucaagacgccugagggcgaggucggcgcgaucgcucuggauuucaagcccggaaccagcggauccccgaucgugaaccgcgaggggaagaucgugggcuuauacggcaauggggucgugaccacuagcggcacguacgugagcgccaucgcacaggcaaaggccagucaggaggggccccugcccgagaucgaggacgaggucuuccgcaagcgcaaccucacgaucauggaccugcacccgggcuccgggaaaacacggcgcuaccugccugccaucgugcgggaggccaucaagcgcaaacuucgcacucuaauauuggccccaacucggguggucgcgucggagauggccgaggcgcuaaaaggcaugcccauccgcuaccaaaccaccgcggucaagucggagcacaccggcaaggaaaucguagaccucaugugccacgcgacguuuacgaugcgguuacugucccccguccgcguacccaacuacaauaugaucaucauggacgaggcacauuucaccgaucccagcuccaucgccgcccgcggguacauuaguacccgagugggcaugggcgaggccgccgcgauuuuuaugacggcuacgccacccggcuccgucgaggccuucccucaaagcaacgcggugauccaggacgaggagagggacauccccgagcgcuccuggaacuccggauaugaguggaucaccgauuuccccggcaagaccgugugguucgucccguccaucaagagcggcaacgacaucgcgaacugccuccggaagaacgggaagcgcguaauccagcugucuaggaagacuuucgauaccgaguaccagaagaccaagaacaacgacugggacuaugugguaaccacggauaucagcgagaugggcgccaacuuccgugccgaccgggugauugaccccagacggugccucaagcccgugauauugaaagacgggccugagcgcgugaucuuagccgguccgaugccugugaccguggccagcgcggcccaaaggagagggaggaucggucgcaaccacaacaaggagggagaucaauacaucuacauggggcaaccccugaacaacgacgaagaccaugcacacuggaccgaggccaaaaugcucuuggacaacaucaacacuccggagggcaucaucccggcccuguuugagccagaacgcgagaaguccgcugccaucgacggggaguaccgcuuacgaggcgaagccagaaagacguucgucgagcugaugcgccgcggagaucugccuguguggcucuccuauaaagucgccucugagggcuuccaguacuccgaccgccgguggugcuucgacggcgagcgaaacaaucagguccuggaggaaaacauggacgucgagaucuggaccaaagagggggagcguaagaagcugcgcccgagguggcucgacgcgagaaccuacagcgacccgcuugcgcugcgcgaguucaaagaguucgccgccggccgccggagcguguccggugacuuaauccuggagaucgguaaacugccccagcaccucacccaacgcgcacagaacgcgcuggacaacuuagugaugcugcacaacucggagcagggcgggcgggccuaccgccaugccauggaggagcuccccgauacgauagagacccugaugcuccuggcgcugaucgccgugcucaccggcggggucacccuguucuuccuguccggacgggggcuugggaagaccagcaucggacuccugugugugauggccuccagcgugcuccuguggauggcgagcgucgagccccacuggauugccgcgagcauaauccuggaguucuuucucaugguacugcugauuccggagccagaccgccagcggacgccgcaggacaaccaacucgcguacguggucaucggguugcuguucaugaucuuaacgguggcggcaaacgagaugggccugcuugagaccaccaaaaaggaccucgggauuggccacgucgcaguagagaaucaccaccacgccgccaugcuggacguggaccugcacccggcguccgccuggacgcucuacgccguggcaaccaccauuaucaccccaaugaugcgccacacgaucgaaaauaccaccgccaacaucagccugaccgcgaucgcuaaucaggccgccauucugaugggguuggacaagggcuggcccaucuccaagauggacauuggcgucccccugcuggcauugggcuguuauucacaagugaacccguugacgcugaccgccgcugugcucauguuggucgcucacuaugcaaucaucggccccggguugcaggcgaaggccacccgcgaggcucaaaagagaaccgccgccggcaucaugaagaaucccacgguggacggaauaguugcgaucgaccucgacccagucguuuacgacgccaaguucgagaagcagcugggccagauaaugcugcucauucuguguacgucccagauucugcucaugcgaacuaccugggcccugugcgagagcaucacacuggcaacaggcccgcucaccacauuaugggaggggucccccggaaaguuuuggaacacgaccaucgcgguaucaauggcgaacaucuuucgggggucuuaucuggcgggcgccggccucgccuuuucccuuaugaaaagucucggaggcgggcgcagagguacaggggcgcaaggagagaccuugggcgagaaguggaagcgccagcugaaucagcugagcaaaagcgaguucaacaccuauaagcgguccgguauaauggaggucgaccgcagcgaggcuaaagaaggccucaagagaggggagaccaccaaacacgccguaagucgcggcacugccaagcugcggugguuuguggaacgcaaucugguaaagcccgagggaaagguuaucgaccugggcugcggcagagguggguggagcuacuacugcgccgggcugaagaaggugacggaggucaagggguacaccaagggcggccccggccaugaggagccuauccccauggcuaccuacggguggaaccuugugaagcugcacuccggcaaggacguguuuuucaucccucccgagaagugcgacacccugcuaugcgacaucggggagagcuccccaaaccccaccaucgaggagggccgcacucugcgaguccuaaagauggucgagcccuggcugcgcgggaaccaguucugcaucaaaauucuaaaccccuacaugccgagcguagucgagacgcucgaacagaugcagcggaagcacggcggaaugcuggugcgcaacccccuguccagaaauucaacccacgagauguacuggguguccugcgggaccggaaauaucgucagcgccgugaacaugacgucacgcaugcuccugaaccgcuuuacuauggcgcaccggaagcccaccuacgagcgcgacguugaucugggggccggcacccgacacgucgccguggagccagagguggcgaaccucgacaucauuggccagcgcaucgagaacaucaagcacgaacacaagagcacguggcacuacgacgaggacaacccauacaagacaugggccuaccacggauccuacgaggucaagcccaguggcuccgcuagcaguauggugaaugggguggucaagcugcugaccaaacccugggacguuauccccauggucacccagauugccaugacggauaccaccccguucggccaacagcggguuuucaaggagaaaguggacacccgcacucccaaggccaagcgggggacggcgcagauuauggaggucaccgccaaguggcuuuggggcuuccugagccgcaacaagaaaccacguauaugcacccgcgaggaguucacccggaaggugcgcaguaacgccgccauuggcgcgguauucguggacgagaaccaguggaacuccgccaaggaggcuguggaagacgagcgcuuuugggaccugguucaccgcgaacgagagcuccacaagcaagggaagugugcgaccugcguguacaacaugaugggcaagcgggaaaagaaguugggggaguucggcaaagccaaggggucucgggcaaucugguacauguggcugggcgcccgcuucuuggaguucgaggcccugggcuucaugaacgaggaccacugguucucccgggagaacagcuuauccggcguggagggcgaggggcuccacaagcugggcuacauccuucgugacaucucaaagauccccgggggcaauauguacgccgacgacaccgcaggaugggacacucggaucacggaggaugaucuccaaaacgaggcgcgcaucacugacaucauggagcccgagcaugcgcugcuggcaaaguccaucuucaagcuaaccuaucagaacaaggugguucgcgugcagcggcccgccaagaaugggaccgugauggacgucaucagccgccgggaccagcgcggcuccggacaggugggaacguacgggcugaacacauucacgaacauggaggcgcaacucaucaggcagauggagagcgagggaaucuucucccccagcgagcucgagacuccgaaccuggcggagcgaguccucgacuggcucgagaaauauggcgucgaacgacugaagcgcauggccaucagcggggacgacugcguagugaaaccaaucgaugaucgguucgccaccgcccuaaccgcuuuaaaugacaugggcaagguccgcaaggacaucccccaaugggagcccagcaagggguggaacgauuggcaacaggucccauucugcucccaccauuuccaccaacucaucaugaaggacggucgggagauagugguccccugccgcaaccaggacgaacugguaggucgcgcgcgcgugagccagggggccggauggucacuccgggagaccgccugccuaggcaagagcuacgcccagauguggcagcugauguacuuccauagacgggaccuccgcuuagcggcaaacgcaaucugcagcgcaguccccgucgacuggaucccuaccucccggacgacauggagcauccacgcccaccaccaguggaugaccaccgaggacaugcugucaguguggaaccgcguuuggaucgaggaaaacccguggauggaagacaagacgcacaucaguuccuggggagacguuccauacuuagguaagcgcgaggaccaauggugcggcagcuuaaucggucucaccgcucgggccaccugggccacgaacauccaggucgccaucaaccagguccgacggcuaaucgggaacgagaacuaucuggacuacaugaccuccaugaagcgcuucaaaaacgagucugaccccgaaggcgcucugugguga

SEQ ID NO: 24412 - RNA, 9879 nt, Artificial Sequence
  derived and/or modified CDS sequence (opt11) from DENV-1__GU131684__SS-prME
agcgucaccaugcugcugaugcugaugcccaccgcccuggccuuccaccucacgacccgcggcggggagccgcacaugauagugagcaagcaggaacggggcaagucguuacuauucaagacuagcgcagguguuaacaugugcacccucaucgccauggaccugggugaguucugugaggacacgaugaccuacaagugcccccgcaucaccgaggccgagcccgacgacgucgacugcugguguaacgccaccgacacguggguaaccuacgggaccugcucacagacuggggagcaucggcgcgacaagcgcucggucgcgcuugcgccccaugugggccuggggcuggagacgcgcacugagacguggaugagcucggaaggcgccuggaagcaaauccagcggguggagaccugggcgcugcggcaucccggguucacgguuaucgcccucuuccuggcucacgcuaucggcaccucaaucacgcagaaagggaucaucuucauacucuugaugcuggugacucccuccauggcaaugaggugcgucggcaucggcagccgggacuucguggaggggcuguccggcgcuacguggguggacgucguucuggagcaugggucaugugugaccacgauggccaaggacaagcccacguuggacaucgagcuguuaaagacggagguaaccaacccagcugucuugcggaagcugugcaucgaggccaagaucagcaacacgaccacugacucaagaugcccgacacagggcgaggccacccucguggaggagcaggacgccaacuucgucugccgacguaccuucguggaccgcggcugggguaacggcugcgggcuauucggcaagggaucacugauuacgugcgcaaaauucaaaugugugaccaagcucgagggcaagaucguacaguacgaaaaccugaaguacagcgugaucgugaccguacacaccggugaccagcaccaggugggaaacgagucuacugagcacggcaccaccgcuaccaucacgccccaggccccaucuacugagauccagcuaaccgacuacggggcccucacccuagacugcagcccccgcaccgggcuggacuuuaacgagaugguacuccugacuaugaaggagaaaaguuggcuggugcauaagcaaugguuccucgacuugccucugccuuggaccagcggagcuagcaccagucaggagacuuggaaucggcaagaucugcuagucaccuuuaagaccgcccacgcgaagaagcaggaggucguggugcuagguucccaagagggcgccaugcauacugcgcucacaggggccacggagauacaaaccagcggcacgaccaccaucuuugccgggcaccugaagugccgccugaagauggacaagcugacccugaaggguaugucauacgucaugugcaccgggagcuucaaacuggagaaggagguugcggaaacccaacacggcacugugcucguccagaucaaauacgaggggaccgacgccccguguaagauucccuucuccacccaggacgagaaaggagugacccagaauggccggcugaucacagccaacccgaucgugacagacaaggagaagccagucaacauugaggcagaaccgcccuuuggugagagcuacauugugauuggcgcgggcgagaaagcccuaaagcuguccugguuuaagaaggggagcuccauuggcaagauguucgaggccaccgcccggggggcgcgucgcauggcgauccucggcgacacagccugggacuucgggucuaucggcggcguguuuacguccgucgguaagcucgugcaucagaucuuugguacugccuacggggugcuuuucagcggcgucucguggaccaugaagauugguaucggagugcuccugacuuggcuuggccuaaacagccgcuccacgagccucuccaugaccugcaucgccgugggcuuagucacccucuaccugggcguuauggugcaagccgacagcgguugugugauuaacuggaaggggcgggagcugaagugcgggagcggcaucuuugugacgaaugaagugcacacguggaccgagcaauacaaauuccaggcggacuccccgaagcgccucagcgccgcuaucggcaaggccugggaggagggggucugcggcauacgguccgccacccgccuggagaacauaauguggaagcagaucucuaaugagcugaaucacauacuccuggagaacgacaugaagcugaccguggucgucggggacguggcugggauccucgcccaagggaagaagaugauccggccccagcccauggaauacaaguauuccuggaagucuuggggaaaggcgaagauaaucggugcggacgugcagaauaccacguucaucaucgacggacccaacaccccggaaugucccgacgaucagcgcgcguggaacaucugggaggucgaggacuauggauucgguauuuucaccacgaacauuuggcugaagcugcgggauuccuauacccaagugugcgaccauagacucaugagugcagcuaucaaagacuccaaggccgugcacgccgacaugggcuacuggaucgaaagcgagaagaacgagaccuggaagcuagcgagggcgucauuuaucgaaguaaaaaccuguaucuggccaaagagccacacccugugguccaacggcgugcuggagagcgagaugauaauccccaagaucuacgggggcccgauaucgcagcacaauuaccgcccuggguacuucacucaaaccgccggccccuggcaucuggggaaacuagaauuggauuucgaccugugcgagggcaccaccguagucguggacgagcacugcggcaaccggggcccgagccuucgcaccaccaccgugaccggcaaaaucauccacgaauggugcugccgguccuguacgcugccgccgcuccgcuucaagggggaagacgguugcugguacgggauggagaucaggcccgucaaggagaaagaagagaaccugguuaagagcaaggugagcgccgggucaggcgaggucgacuccuucucucucgggcugcugugcaucagcaucaugauagaggaggugaugcgcucccgauggaguaggaagaugcucaugaccggcacccuggcggucuuuuuucugcucaucauggggcagcugaccuggaaugacuuaauuaggcucugcaucauggucggcgcgaacgcgagugaccgaauggggaugggcaccaccuaccuggcccugauggccaccuuuaagaugcgcccgauguucgccguagggcuccuguucaggcgcuuaaccagccgggaagugcuucugcucacgaucgggcucucccuaguagcgagcguagagcugcccaacucccucgaggagcugggcgacgggcuagccaugggaauaaugauucucaagcugcugaccgacuuccagucucaccagcucugggcuacccugcugucccucacauuuauccgcacgaccuucucccugcacuacgccuggaagaccauggcgauggugcugaguaucgugucccucuucccauuaugccuaucuaccacgagccaaaagacuaccuggcuccccgugcugcugggaagucucggcugcaagccgcuuaccauguuccugaucgcagagaacaagauuuggggccgcaagucuuggccgcucaaugagggcauuauggccgucggcaucgugagcauucugcuauccagcuugcugaagaacgacgugccccuggccgggccgcucaucgccggcggcaugcugaucgcgugcuacguuaucagugggucuuccgccgaccugagccuggagaaggccgccgucgugucuugggaggaggaggccgagcauagcggcgccucccacaacauccuggucgaagugcaggacgacggcacgaugaagaucaaggacgaggagcgcgacgacacccucacaauucuccuuaaagcaacccugcucgccgugagcggcguguacccgcucagcauucccgcgacuuuauuugugugguacuucuggcagaagaagaagcagcggaguggggugcucugggauacgccuagcccgcccgaggucgagcgcgccgugcucgacgauggcaucuaccgcaucaugcagcgcggccugcuugggcgaagucaggugggcgucggaguguuccaggagaacguauuccacacaauguggcacguaacccgcggcgcggugcucauguaccaggggaagcggcuggagcccagcugggcaagcgugaagaaggaucugaucucguaugguggcggguggcgccuccagggcagcuggaacaccggggaggagguccaggugaucgccguugagcccggcaaaaaccccaagaacguccagacggccccaggcaccuucaagaccuccgagggcgaggugggcgccaucgcgcuagauuucaagccaggcaccuccgguagcccuauugugaaccgggagggaaagaucgucggccuguacggcaacggggucguaaccaccuccggcacauacgucagcgccauagcacaggccaaggccagucaggagggaccucucccggagaucgaggaugaagucuuucgaaagcggaauuugaccauuauggaccugcacccgggcagcgggaagacucgucguuaccuuccggcuauagugcgcgaggcgaucaagcguaaacugcgcacccugauccucgccccgacacgcguuguggcguccgagauggcggaggcccugaagggcaugcccauaagauaccagacuacagccgucaaguccgagcacaccggcaaggagaucgucgaccugaugugccacgcaacguuuaccaugcgccuccucucccccgugcgggugcccaacuacaauaugaucauuauggacgaggcccacuucacagacccguccuccauagccgcccgcggguacauuagcaccagggucgguaugggggaagccgccgccaucuuuaugaccgccacgccgcccgguuccguggaggcauucccccagagcaacgccgucauacaggacgaggaacgcgacauaccugagcggaguuggaacagcggguacgaguggaucacagacuuuccgggcaagaccgucugguucgugcccuccaucaaaucagguaacgacaucgccaacugucugcgcaaaaacgggaagcgggugauccagcucucccgcaagacguucgacaccgaguaucagaagacgaagaacaaugacugggacuacguggugacgacugacaucucugagaugggcgcgaacuucagggcagaccgcguaaucgacccccgucgcugcuugaagccggugauccugaaggaugggcccgagcgggugauccucgccggucccaugcccguaaccguugcauccgcagcgcagcgccggggccgaaucggccggaaccacaauaaggagggcgaccaguacaucuacaugggacagccgcugaacaacgacgaagaccacgcccacuggacggaggcgaaaaugcuccucgacaauauuaacacuccagagggcaucauccccgcccuguucgagcccgagcgcgagaaguccgcugccaucgauggggaguaccgccugcggggagaggcccgcaagaccuuuguggagcucaugcggcgcggggaucugccggucuggcugagcuacaagguggcguccgaaggcuuucaguacagcgaccggcgcuggugcuuugacggagagcggaacaaccaggugcuugaggagaacauggauguugaaaucuggaccaaggagggggagcgcaagaagcugcggccccgcugguuggacgcccggacguauuccgacccccucgcccugcgcgaguucaaggaguucgcggccggccggcgcagcguguccggggaccugauccucgagaucggcaaacugccccagcaccugacccaacgggcccagaaugcccucgacaaccucgugaugcugcacaacucggagcaagggggacgcgcguacaggcacgccauggaggagcucccugacaccaucgagacccugaugcugcucgcccugaucgccguacuuacaggcggagugacucuguucuuucuauccggccgugggcugggcaagacuagcaucggccuccucugcgugauggcauccucaguccugcucuggauggcuucgguugagccccacuggaucgccgcuagcaucauucuggaguucuuccugaugguucuccugaucccugaacccgauagacagcgcaccccgcaggacaaccagcuggccuacgucgugaucggccuucucuucaugauccugacaguggccgcgaaugagaugggccuccuugagacgaccaagaaagaccuggggaucggccaugucgccguggagaaucaucaucacgcggccaugcucgacgucgaucuccaccccgccucggcguggacguuauacgccgucgccacuaccaucauuacccccaugaugcggcauaccaucgagaacaccacggccaacaucucauugaccgccauagcgaaucaggccgccaucuuaauggggcuggacaaggguuggccgaucucuaagauggacaucggcgucccccucuuagcccuggguugcuacagucagguuaacccccugacuuuaaccgcggccguccugaugcuaguugcacacuacgccaucaucggacccgggcugcaggcuaaggcgacgcgcgaggcgcagaaaaggaccgcugccggcaucaugaagaaccccacaguggacgggauugucgcaaucgaccuggauccggugguguaugaugcgaaguucgagaagcaguuaggccagaucaugcugcugauccucugcacaucccaaauccuuuuaaugagaacgaccugggccuuaugugagagcauuacccuggccaccggcccccugacgaccuugugggaggggucccccggcaaguucuggaauacuaccauagcagucagcauggccaauauauuccgcgggagcuaccuagccggcgccggccuggcguucucgcucaugaagucccucgguggcggucggcgggggacgggggcccagggcgagacccugggagagaaguggaagagacagcucaaccagcucucgaagagcgaguucaacacuuacaagcgcucggggaucauggagguggacagaagcgaggcgaaggagggucugaagcgcggggagaccacgaagcacgccgugagccggggcacagccaagcuccgaugguuugucgagcggaaccucgucaagccggaggguaaggugaucgacuugggaugcggccgcgggggguggagcuacuacugcgccgggcugaagaaggucaccgagguaaaaggcuacaccaagggcgggcccggccacgaggaaccuauccccauggccacguauggguggaaccucgucaagcugcauuccggcaaagacgucuucuuuaucccacccgaaaaaugcgacacccuucucugcgacauaggggaaagcucccccaacccuacaaucgaggagggccggacucugcgcgugcugaagauggucgagccguggcuccgggggaaccaguuuugcauuaagauccugaaccccuauaugccgagcgucgucgagacgcuggaacagaugcagcgcaagcacgguggcaugcucguacggaacccccuauccagaaacaguacccacgaaauguacugggucuccugcgggaccggcaacaucguuagcgcgguaaauaugaccucacgcaugcuccucaaccgauucacgauggcccaccguaagccgacguacgaacgggacguugaccugggugcaggcacacgccauguggccguagagcccgaggucgcgaaucucgacaucaucggucagcggaucgagaacaucaaacacgagcauaagucgaccuggcacuacgacgaggacaaccccuauaagaccugggcguaccacggguccuacgagguuaagcccagcgguagcgcguccucuauggucaaugggguggugaaacuccugacgaaaccgugggacgucauacccauggugacucagaucgcgaugaccgacaccacgcccuucggccagcagcgcguguucaaagaaaaaguggacacccggacaccaaaggcaaagagggggacugcccagauaauggaggugaccgcgaaguggcuguggggcuuucucucccggaacaaaaagccgcgcaucugcacccgggaggaguucacccgcaaagugcggagcaacgcggccauaggcgcaguuuucgucgacgaaaaccaguggaacucugcgaaggaggcgguggaggacgaaagauucugggaccugguccaucgggagcgcgagcuacauaagcaagggaagugcgccaccugcguauacaacaugaugggcaagcgggagaagaagcuuggcgaguucggcaaggccaaggggagccgcgccaucugguacauguggcugggcgcgcgauuccuggaguucgaagcccucgguuuuaugaaugaggaucacugguucucccgcgagaacagccuguccgggguggagggcgaggggcugcauaagcucggcuacauccugcgggauaucucaaagauccccgggggcaacauguaugcugaugauacggccgggugggacacacgcauuaccgaggacgaccuacagaaugaggccaagaucacugacaucauggagccagagcacgcgcuucucgccaaguccauuuucaagcugacuuaccagaauaaaguagugcgggugcaacgaccagccaagaaugguaccguaauggaugugaucucacgucgggaucagcgcggcuccggccaggugggcacuuacgggcucaacaccuucacgaacauggaggcccaacugauucggcagauggagucagaagggaucuucuccccuagcgagcuggagaccccaaaccucgcuggccgcguacuugacuggcuggaaaaacacgggguagagcggcucaagcgcauggccaucuccggcgaugauugcguggucaagcccaucgacgaccgcuucgccacagcacugaccgcccugaaugacauggggaaaguccgcaaggacauuccgcagugggagccuagcaagggcuggaacgauuggcagcagguuccuuucugcucucaccacuuccaccagcucaucaugaaagacggccgggaaaucguaguucccugccgcaaccaggacgaacuggugggucgagcucgcgucucccaaggcgcgggguggucccugcgggaaacggccugccucggcaagaguuacgcccaaauguggcagcugauguacuuucaccgccgugaccugagacucgccgcuaaugccaucugcagcgccgugcccguggacuggguccccacgaguagaaccacauggucgauccacgcccaccaccaguggaugacgacagaagacaugcuguccgucuggaaccgcguguggaucgaggaaaaccccuggauggaggacaagacccacaucagcucuuggggcgauguccccuaccuagggaagcgggaggaccaguggugugguagccucaucgggcucaccgcccgcgcgaccugggcuacgaacauacaaguggccaucaaccaggugcgcagacuguugggcaacgagaacuaccuggacuacaugaccuccaugaagagguucaagaacgagagcgacccugagggggcccugugguga

SEQ ID NO: 24413 - RNA, 9879 nt, Artificial Sequence
  derived and/or modified CDS sequence (opt11) from DENV-1__GU131685__SS-prME
agcgugaccaugcuguuaaugcugaugcccacggcccuggccuuccaccuuaccacacggggcggcgagccccacaugaucgucucaaagcaggagcggggcaagucccugcuguucaagaccucggccggggugaauaugugcacgcucaucgccauggaccuuggugaacugugcgaggacaccaugaccuacaagugcccucgcaucaccgagacagagcccgacgacguugacuguuggugcaacgcuacggacaccugggugacuuacgggaccugcucacagacgggcgagcaucggcgcgacaagcgguccguggcccucgcgccccacguaggccuggggcuggagacccgcaccgagaccuggaugagcuccgagggcgccuggaagcagauccagaggguagaaacgugggcccuucgucaccccgguuucacaguaaucgcucuguuccuagcccacgcgauaggcacaaguauaacccagaaggggaucaucuucauacucuugaugcuaguuacgcccuccauggccaugcggugcgugggcauagggagccgggacuucguggaggggcuuuccggggccaccuggguugacgucguguuggagcacgggaguugcgugaccaccauggccaaggacaagcccacgcuggacaucgagcuucugaagaccgaggucaccaaccccgccgugcugcggaaguuaugcauugaggcgaagaucuccaacaccacaaccgacagccgcugcccgacccagggcgaggccacgcugguugaggagcaggacgcuaacuuugucugcaggaggacuuucguugaccguggcugggguaacggcugcgggcuguuugggaaggggucgcuaaucacgugugccaaauucaagugugugacaaagcuggagggcaaaaucgugcaguacgagaaccucaaguauagugugauuguuacaguccacacgggugaccagcaccagguugggaacgaguccaccgagcacgggaccaccgcuaccaucacgccgcaggcgcccaccaccgagauccagcucaccgauuacggugcccugacgcuggacugcagcccuaggacaggccucgauuucaacgaaaugguccuacugaccaugaaagaaaagucauggcucgugcacaagcagugguuccuugaccuucccuugccauggacgagcggggcgagcacaucccaggagaccuggaaccggcaggaccuguuggugacguucaagaccgcccacgcgaagaagcaggaggucgucgugcucggcagccaggagggcgcgaugcacacggcccugaccggggccaccgagauccagaccucuggcacgacuaccaucuucgccggucaccugaagugcagauuaaagauggagaaacugacccucaaggggaugagcuacgucaugugcacggggaguuucaaacucgagaaagagguagcggagacgcagcacgguacugugcugguacagaucaaauaugaggguaccgaugcgcccugcaaaaucccguucagcacgcaggacgagaaggggguuacccaaaacggccgucugaucaccgccaacccuaucgugacagacaaggaaaaacccgucaacaucgaggcagagccgccauucggugagaguuacaucguaaucggcgccggcgaaaaggcgcucaagcucagcugguuuaagaaagguucuagcaucgggaagauguucgaagccacggcccggggagccagacgaauggccaucuugggggacacugccugggauuucggguccaucggcggcgucuucaccucagucgggaagcugauccaccagaucuucggcaccgcauacggaguccucuuuuccggcgucagcuggacgaugaaaaucgguauuggcgucuugcuuaccuggcugggucugaacucccgcagcaccagccugaguaugaccugcaucgcaguggggcuagugacccuguaccugggcguaaugguucaggccgacuccgggugcgugaucaacuggaagggccgagaacuuaaaugcggaagcggcaucuuugucaccaacgaagugcauaccuggaccgagcaguacaaguuucaggccgauagcccgaagcgccugucggcggccaucggcaaggccugggaggaggggguuugugguauccggagcgccacccgccuggaaaacaucauguggaagcagaucuccaacgagcucaaccacauccugcucgagaaugggaugaaguucacggugguggugggugacguggccgggauccuugcgcaaggcaagaagaugauccggccccagcccauggaauacaaguacagcuggaaguccuggggcaaggccaagaucaucggggccgaugugcagaacaccaccuucaucaucgacggccccaacacccccgagugcccggacgaccagcgcgccuggaacaucugggaggucgaggacuauggguuugggauauucacgaccaacaucuggcuaaagcuacgggacucauacacacaggugugcgaccauaggcucaugagcgcagccaucaaagacucaaaagcugugcacgccgacaugggcuacuggaucgagagcgagaaaaacgagaccuggaagcuggcacgggcgucauucaucgaggugaagacgugcaucuggcccaagucccacacccuguggagcaacgggguccucgaguccgagaugauuaucccgaagauuuacggcggacccaucagccagcacaacuaccgcccaggcuacuuuacccagacugcugggcccuggcaucugggcaaacuggagcuugacuucgaccuaugugaggguacgaccgugguagucgacgagcacugugguaaccggggcccgucccugcgcacuacgacggugaccgggaagaucauccaugaguggugcugccgaucgugcacccugccgccccuccgguuccggggugaagaugggugcugguacgggauggagauacgcccugucaaggagaaggaggagaaucuggucaaauccauggugagcgccgggagcggcgagguggacuccuucagccucggccuguugugcaucucaauaaugaucgaggaggucaugcgaucccgcuggucccggaagaugcucaugaccggaacgcuggccguuuucuuccugcucaucaugggccagcugacauggaacgaccugauccgccugugcaucauggugggggccaacgccagcgaccgcaugggcaugggcaccaccuaccuggcccuuauggccacguucaagaugcggccuauguucgccgucggccuccuguuccgccgguuaaccucccgcgaggugcuccuguugaccaucgggcucucucugguggcuucggucgagcugcccaauagcuuggaggaacugggcgacgguuuagcaaugggcaucaugauccucaaacugcugacggacuuccagucccaccagcucugggccacgcugcugagccucaccuucaucaaaaccaccuuuucucugcacuacgccuggaagacgauggcaauggucuugagcaucgucucccucuucccccugugccugagcaccaccagccagaagaccacguggcuccccgugcuccuggggucucucgguuguaagccucugaccauguuccugaucgcugagaacaagauuugggggcggcgcuccuggccccucaaugaaggcaucauggccguggggauagucagcauucugcugagcuccuugcugaagaacgacgugcccuuggccggcccccucaucgccggcggaaugcugaucgccugcuaugugauuagcggcuccagcgcggaccugucacucgagaaggcggccgaggucagcugggaggaggaagccgagcacucaggagccagccacaacauccugguugagguacaggacgacggaacaaugaagaucaaggaugaggagcgggacgacacccugaccauacuacugaaggcaacgcugcucgccgucagugggguguacccgcugagcauucccgcaaccuuauuuguuugguauuucuggcagaagaaaaagcagcgcuccggcguccucugggauacccccucuccgccugagguggagagagccguguuggacgacgggaucuaccggauaaugcaaagagggcugcugggccgcagccaggugggggugggcguguuucaggaaaacgucuuccacacgauguggcaugugacgagaggggccgugcucauguaccagggcaagcgccuugagcccagcugggcuuccgucaaaaaggaccugaucucauacggcggaggcuggcggcuccagggguccuggaacaccggagaggagguccaagugaucgccgucgagcccgggaaaaacccaaagaacgugcagacggcccccgggacuuucaagacgcccgagggcgaagugggugccaucgcccuggacuucaagcccgggaccagcgggucccccauagucaaucgcgagggcaagaucgugggccuguacgggaacggcguggucaccaccagcggaacguacgugagcgcgaucgcccaggccaaggccucccaggaggggccucucccugaaaucgaggacgagguguucaggaagagaaaucugacgaucauggaccuacaccccgggagcggcaagacccgccgcuaccucccggcgaucguccgggaagcuauaaagcgcaagcuacgcacccuaauccucgcccccaccagagugguggccucggaaauggccgaggcgcuuaagggcaugccuauccgcuaccaaaccacggccgugaaguccgagcacacggggaaggagauaguggaccugaugugccacgcuacuuucaccaugcgucuccugucccccguucgcgugccgaauuacaacaugaucaucauggacgaggcccacuucacagaccccucuucgaucgccgcgcggggcuacauuagcacccgcguggggaugggcgaggccgccgccaucuucaugacagccacgccgccuggguccgucgaggcuuucccgcagucaaacgccgucauccaggaugaggagagggacaucccagagcgcucuuggaauagcggcuacgaguggaucaccgacuuccccggcaagaccguaugguuugugcccuccaucaaaagcgggaacgacaucgccaauugccugcggaagaacgggaagcgcgugauccaacucucccggaagacguuugacaccgaguaccagaagaccaagaauaacgacugggauuacgucgugacgacggacaucagcgagaugggcgccaacuuccgcgcggaccgggucaucgacccgagacgaugcuugaagccugugauccuuaaggacggccccgagcgcgugauccucgcagggccgaugccgguuaccguugccuccgccgcacagcggcgcggacggaucggucggaaccacaacaaagagggggaccaguacaucuacaugggccaaccccugaacaacgacgaagaccacgcgcacuggaccgaggcaaagaugcugcuggacaacauuaacaccccagaggggaucauccccgcccucuucgagccugagagagagaaauccgccgcaauagacggcgaguauagacugcgcggggaggcgcggaagacguucguagagcuuaugcgccgcggcgaccugcccguguggcugucguacaaagucgccucagaaggcuuccaauacagcgaccgccgguggugcuucgacggugagcgcaacaaccagguccucgaggagaacauggacguggagauauggaccaaggaaggcgaaagaaagaaguugcguccacggugguuggacgcccgcaccuacuccgacccccucgcccugcgggaauuuaaagaguuugccgcugggcgccggagcguguccggugaccuaauccucgagauuggcaagcugccgcaacaccugacucagcgcgcccaaaaugcccucgacaaccugguuaugcuacacaacagcgaacagggcgggcgggccuaccgccacgccauggaagaguugcccgacaccaucgagacgcugaugcuacucgccuuaaucgccguucugaccgggggcguuacucucuuuuuccuguccgggcgcggucugggaaagaccucuaucggacuccugugcgucauggcauccucugugcugcucuggauggccucggucgaaccccacuggaucgccgccagcaucauccuggaguucuuuuugauggucuuacuuauccccgaacccgaccgacagcgaacgccccaggacaaccagcuggccuauguggugauuggccuacuguucaugauccuaaccgucgccgccaaugaaauggggcucuuagagaccaccaagaaggacuuaggcaucggucacguugcggucgagaaccaccaccacgccgcgaugcuugauguagacuugcaccccgccuccgccuggacguuguaugcgguggccaccaccaucauaaccccgaugaugagacacaccaucgaaaacacuacggcaaacaucagccucaccgccaucgccaaccaggcggccauucuuaugggcuuagacaaaggcuggccuaucuccaagauggauaucggggugccccuccuggcccugggaugcuauagccaggugaauccccucacgcugacagcugcuguacugaugcuaguggcacacuaugccaucaucgggccgggccuccaggccaaggcaacccgugaggcacagaaacggaccgccgccgggaucaugaaaaaccccacggucgacgggaucguggccaucgaccuagaccccgucgucuaugacgcuaaguucgagaaacaacugggccagaucaugcugcugauucucugcacuucucagauccuacuaaugcgcacuacgugggcgcucugugagaguaucacgcuugcgaccggaccccucaccacccucugggagggcagcccggggaaguucuggaacacgaccauugccguaagcauggcgaacauuuuccggggcuccuaucuggccggggcggggcuggccuucagccucaugaagucacugggugggggccgccgggggacaggcgcucaaggggagacccugggggaaaaauggaagcgccagcucaaucaauuaucaaagagcgaguucaacacguacaaacgguccgggauaauggagguggaccgcagcgaagccaaggaggggcugaagcggggcgagaccaccaagcacgcggucucccgcgggaccgcaaaacuccggugguucguggagcgcaaccuugugaagcccgagggaaaggucaucgaccuuggcugcgggcgcggcggguggagcuacuacugugccggcuuaaagaaagugaccgaggugaaaggguacaccaaagggggccccgggcacgaggagcccaucccgauggccacguacggcuggaaucuggugaagcugcacucugggaaggacguguucuucaucccgcccgagaagugcgacacccugcucugcgauaucggcgagagcuccccaaauccgacgaucgaggaggggcgaacccugcgggugcugaagauggucgagcccugguugcgcgguaaccaguuuugcaucaaaauacugaaccccuauaugccauccgugguggagacccuggagcagaugcagcgcaagcacggcgggaugcucguccgcaauccguuguccaggaacucaacccaugagauguacuggguguccugcgggaccgggaacaucgucagcgcugucaacaugacgucccgcaugcugcucaacagauucacaauggcucaccggaagcccacguacgaaagggacguggaucugggugccggcacccggcacguggccguugaaccugagguggccaaccuggacaucaucggucagcggaucgaaaacaucaagcacgaacacaaguccacguggcacuacgacgaggacaaucccuacaagaccugggccuaccacgguuccuacgaggugaagccgagcgggagcgcgagcaguaugguuaacggcguggucaagcuccugacuaagcccugggacgucaucccuauggugacacagaucgccaugacggauaccacccccuucgggcaacagaggguguucaaggagaagguggacacccguacgccaaaggccaagcggggcaccgcgcagaucauggaggugaccgccaaguggcucuggggcuuccucucccgcaacaagaaaccucggaucugcacccgcgaggaguucacgaggaagguccggagcaacgcggccaucggggccguguucguggaugagaaccaguggaacuccgccaaggaagccgucgaggacgagcguuucugggaucuggugcaccgcgagcgggagcugcacaagcagggcaagugcgcgacuugcguuuacaacaugauggggaaacgcgagaagaagcucggcgaguucgggaaggccaagggcagccgggccaucugguacauguggcucggcgcccgcuuccuggaauuugaagcgcucggguucaugaaugaagaccacugguuuucccgagagaacagucuguccggcguugagggggaaggucuacacaaacucggguacauccugcgugacauaucgaagauaccgggcggaaacauguacgccgacgacaccgccggaugggacacccgcauaacggaggacgaccugcagaacgaggcccgcaucaccgacaucauggagccggagcaugcccuccuggcgaggucuaucuucaaacugaccuaccagaacaaagugguccggguucagcgccccgccaagaacggcaccgucauggaugugaucagccggcgcgaccagcguggguccggccaggucggcacuuacgggcucaacaccuuuaccaauauggaggcucagcugauccgacaaauggagagcgaaggcaucuucucccccucggagcuggagacgcccaaccucgccgagcggguucuggacuggcuugagaaguauggaguagagcgccuuaagcggauggcgaucuccggcgaugacugcgucgugaagccgaucgacgacagguucgcaacggcccuuaccgcccugaaugacauggguaagguucgaaaagacaucccccagugggagccaagcaagggauggaacgacuggcagcagguccccuucugcucccaccauuuccaccaacucauuaugaaagauggccgcgaaauaguggugccgugcaggaaccaggacgagcuggucggccgcgcccgggugagccagggcgccggguggagccugagagagaccgcgugccucggcaaauccuacgcgcagauguggcagcugauguacuuucaccggcgugaucugcggcucgcggccaacgcgaucugcagcgcaguccccgucgacuggaucccaacgucucgcacgaccuggaguauccacgcccaucaccaauggaugacaaccgaggacaugcugaguguauggaaccguguguggaucgaggagaaucccuggauggaggacaagacucacaucucuuccuggggagacgucccauaccugggcaaacgggaggaccaguggugcggcagccucaucgggcugaccgcccgcgcgaccugggcgaccaacauacaaguagccaucaaccaggugagacgccugaucgguaacgagaacuaccuggauuacaugaccuccaugaagcgguucaagaacgagagcgaucccgagggagccuuaugguga

SEQ ID NO: 24414 - RNA, 9879 nt, Artificial Sequence
  derived and/or modified CDS sequence (opt11) from DENV-1__GQ868614__SS-prME
ucagugacuaugcugcuuaugcuuaugcccaccgcccuggccuuccaucucacaacccguggcggagagccacacaugauugugaccaagcaagagcggggcaagagccuacucuucaagaccagugcgggggugaauaugugcacccucaucgccauggacuuaggcgagcugugcgaggacaccaugaccuacaagugcccacggaucacagaggccgagcccgacgacguggacuguuggugcaacgcaaccgacaccugggugaccuaugggacuugcagccagacgggugaacaucggcgcgauaaacggagcguggcgcucgcgccccacgugggccuggggcuggagaccaggaccgagacauggaugagcagugagggggccuggaagcagauccaacgggucgaaacgugggcccuccgucacccuggguucaccgugaucgcccuguuccuugcccacgccaucggcaccuccaucacccagaaggggauaaucuucauccuccugaugcuggugacgcccagcauggccaugcggugcgucgggaucggcucccgcgacuucguggaggggcuuagcggcgccacguggguggacguuguccuugagcaugggucuugcguaaccaccauggccaaggacaagccgacgcuggacauagaacucuugaaaacugaggucaccaaccccgcugugcuucggaaguugugcaucgaggcuaagaucuccaauaccacaaccgacucccgaugcccgacgcagggcgaggccaccuuaauggaggagcaggacgcgaacuucguuugccgucgcaccuucguggaccgggguugggguaacggcugcgggcuguucgguaagggcucgcucaucacuugcgccaaauucaagugcgucaccaaacuagaaggcaagaucguucaguacgagaaccugaaguacucuguaaucgucaccgugcacacgggcgaccagcaccaggucgggaaugagagcaccgagcacggcaccacagcaaccaucacgccccaggcccccacguccgagauccaacucaccgauuacggggcccugacccuggacugcagcccgcgcacgggccuggacuuuaaugagaugguacugcuuaccaugaaggaaaaauccuggcuaguccacaagcagugguuccuugaccugccauuacccuggacgaguggggccagcacaucccaagagacguggaaccgacaagaccuucuggugacuuucaaaacggcccacgcgaagaagcaggagguuguagugcucggcagccaagagggcgccaugcacacggcccugacuggggcgacagaaauccagacauccggcacuacgaccaucuucgcagggcaccugaaaugccgccucaagauggacaaauugacauuaaaaggcaugagcuacgugaugugcaccgggcccuucaagcuggagaaggaaguugccgagacgcaacacgguaccgugcuggugcagauuaaguaugaggggacggaugcgcccugcaagauucccuucuccacccaagacgagaagggugucauucagaacggccggcugauuacggccaaccccauugugaccgacaaggaaaaaccagugaacaucgaggccgagcccccguucggggagagcuacaucgucaucggugugggagagaaagcucugaagcucuccugguucaagaaggggagcuccauaggcaagauguucgaggccaccgccagaggggcccggcgcauggccauucugggcgacacugcgugggacuucgggagcauuggcggcguauucacguccgucgggaagcuggugcaccagaucuucggugccgcauacgggguucuuuucaguggcgugucuuggaccaugaagauuggcaucggcguacugcugacauggcugggucugaacagccgauccaccucucuguccaugacguguauagcggugggccucgucacacucuacuugggcguuauggugcaagccgacagcgggugcguaaucaacuggaagggccgggaacucaagugcggguccggaaucuucguuacgaacgaggugcauacuuggaccgaacaauauaaguuccaggcggacagccccaagcgccugagcgccgccauaggcaaggccugggaagaggggguuugcggaauccggagcgugacccgucuagaaaacaucauguggaagcagaucagcaacgagcuuaaccacaucuuacuggaaaacgauaugaaauucaccguggucgugggggaugucgugggcauccucgcccagggcaagaagaugaucagaccccagcccauggagcacaaguauuccuggaaauccuggggcaaggcgaagaucaucggggccgacgugcaaaacaccacguucaucaucgacgggccuaacacgcccgagugcccagaugaccagagggccuggaacaucugggaaguggaagacuacggcuucgggaucuuuaccaccaauauauggcugaaacugcgggacucuuacacccaggccugcgaucaccgccucauguccgcggccaucaaggacuccaaggcgguccaugccgacaugggcuacuggaucgagucagagaaaaacgaaacauggaaacuggcacgggcguccuucaucgaaguuaagaccugcaucuggccaaagagccacaccuuguggucaaacgggguucucgagagcgagauggucaucccgaagaucuacggcgggccgaucucccagcacaacuaccgccccggguacuucacccaaacggcugggccguggcaccugggaaagcuggagcucgacuuugaccuaugcgagggcaccaccguggugguagaugagcacugcgguaaccgggggccuagccugcggaccacgaccgugaccggcaagaucauccacgaaugguguugucguagcuguacccugccuccccuccguuucaagggugaggacgguugcugguaugggauggaaauccggcccguaaaggagaaggaggagaauuuagucaagagcauggugagcgccggcagcggcgagguagacagcuuuagccucgggcuacugugcaucucuauaaugaucgaggagguaaugaggucccgcuggagccgcaagaugcucaugacaggcacacuggccguguuccuccuccuuaucauggggcagcugaccuggaacgacuuaauaagacugugcaucauggugggggccaacgccucagaccgcauggggaugggaaccacguacuuagcccucauggccaccuuuaagaugcgccccauguucgccgucggacugcuguuucgacgucucacuucgcgggagguguugcuccuaaccaucggccucucgcuugucgcuagcguggagcugcccaauucccuggaggagcuaggugacgggcucgccaugggcaucaugauccugaagcuguugacggacuuccagucgcaccaacugugggccacccuccucucccugaccuuuaucaagaccacgcuaagccuacacuaugccuggaagaccauggccauggugcuguccauugucagccuguucccccucuguuuaucaacaacgucccaaaagacgaccuggcugccgguauugcucggaucccugggcugcaagcccuugaccauguuccucaucgcggagaacaagauauggggcagaaagagcuggccccugaaugaggggaucauggccgugggaguaguguccauccuacugucuucucugcucaaaaacgacgugccacuggccgguccgcugaucgccggaggcaugcuuaucgccuguuacgucaucagugggaguuccgcggaccugucgcucgaaaaagccgccgagguguccugggaggaggaagccgagcacagcggggcgucccacaacauccuggucgagguccaagacgacgguaccaugaagaucaaggacgaagaacgggaugauacgcugacuauucuguuaaaggcuacccuucuggccgugagcggcguguauccccucucaauuccugccacccuguucguaugguacuucuggcagaagaagaagcagcgcuccggcgugcugugggacacucccagcccgcccgagguagagcgggccguccuggacgauggcaucuaucgcaucaugcagcggggccuucugggccgcagccaggugggcgugggggucuuccaagagaacgucuuucacacgauguggcacguuacacggggcgccguccugauguaccagggaaagcggcucgaaccauccugggcguccgugaagaaggaccugaucuccuacggcggaggguggcgucugcaagggagcuggaacaccggggaggaggugcaggucauugcaguagagcccggcaagaacccgaagaacgugcagaccgcccccgggacguucaaaacccccgaaggggaggucggugccaucgccuuggacuucaagcccgggacguccggcagcccgaucgucaaccgggaggggaagaucgugggccuuuacggcaacgggguagugacaacguccgguaccuaugugagcgcgauugcccaggccaaggccucucaggaggguccgcugccagagaucgaggacgaggucuuccggaaaaggaaccuaacuaucauggaccugcacccggggagcgguaaaaccaggcgcuaccugcccgcgauagugcgggaggccaucaagcgcaaguuacggacgcugauucuggcaccuacacgcguggucgccagugagauggcagaggcacucaaaggcaugcccauccgcuaccagacaacggcggugaaguccgagcacacgggaaaggagauaguggauuuaaugugccacgccaccuucacgaugcgucugcucagcccaguccgcgugcccaacuacaacaugauuaucauggacgaggcgcacuucaccgaccccuccagcauugccgcccggggguacauuuccacgcgcgucggaaugggagaggccgccgccaucuucaugacggccacgccgcccgggagcgucgaggcguucccccaguccaaugcuguaauucaggacgaggagcgggacaucccagagcgcuccuggaacuccggguacgaguggaucaccgacuucccaggaaagacggugugguucguccccagcaucaagaguggcaacgacauagccaauugucugcguaagaacggcaaacgcgugauccaacuuucgcggaagacuuucgacaccgaguaccagaagacgaagaacaacgacugggacuauguggucacaaccgacaucuccgaaaugggcgccaacuuccgggcugaccgugugaucgacccccgccggugccucaagcccguaauccugaaggacgggcccgagcgaguuaucuuagcugguccgaugcccgugaccgucgccagcgccgcccagcggcgcgggcggaucggccgcaaccacaacaaagaaggggaccaguacaucuacauggggcagcccuugaacaaugacgaagaccacgcgcacuggacggaagcaaagaugcugcuggacaauaucaacacgcccgagggcaucaucccggcccuuuucgagccggagcgagagaaguccgccgcuaucgauggggaguaccgccuccggggugaagcgaggaagacuuucguggagcugaugcgccgcggggacuugcccguguggcucucauacaaaguugccucagaggguuuccaguacagugaccgccggugguguuucgacggcgagcgcaacaaucaggugcuggaggagaacauggacgucgagauauggaccaaggagggggagcggaaaaagcuccgcccccgcugguuggacgcccggaccuacagcgacccguuagcuuugcgggaguuuaaagaguucgcggcgggccgccggagcguaagcggggaucugauccuggagaucggcaagcucccgcaacaccugacucaacgcgcccaaaacgccuuggauaaccuggugaugcugcauaacuccgagcagggcgggcgggcguaucgccacgcuauggaggaacugcccgacaccauagagaccuugaugcugcuggcccucaucgccgugcugacgggcggugucacgcuguucuuccucagcggccgcgggcuagguaagaccucaauuggcuuacugugcgugauggccagcucugugcugcuguggauggcaaguguugagccacacuggaucgcggcaaguauuauucucgaguucuuccugaugguacuccucauuccggagcccgaccgccagcggaccccucaggacaaccagcuggccuacguggucaucggccucuuguucaugauccugaccgucgccgcgaacgagaugggccugcucgaaaccacgaagaaggauuugggcaucggccacguggcagucgagaaccaucaccaugccaccaugcuugauguggaccuccacccggcuucggccuggacucuauacgccguagcgacuacaaucaucaccccuaugaugcgccacacgaucgaaaauaccacggccaacauuucccugacugcgaucgccaaccaggccgcuauccucauggggcuggauaagggcuggccaauaucuaagauggacauuggcgucccucugcuugcuuuagguugcuacucucaggugaacccucugacucugaccgccgccguacugaugcuggucgcucacuacgcgauuaucggccccgggcuccaggcuaaggccacgcgagaggcccagaaacgcaccgcggccggcauuaugaagaaccccacugucgacgggaucguagcuauagaccuggauccagucguuuaugacgccaaauucgagaagcagcugggacagaucauguugcugauccugugcacuagccagauccuucugaugagaacgaccugggcucugugcgaguccauaaccuuggcgaccggcccgcugacaacccuaugggagggcucgccgggcaaguucuggaacaccaccaucgccguguccauggcuaacaucuuccgggguagcuaccuagccggagcuggccuggcguucucacuaaugaagucccucgggggcgggcgacggggcaccggggcccagggcgagacccugggggagaaguggaaacgccagcugaaucagcucucgaaaagcgaguucaacauuuacaagcggagcgguaucauggaggucgaccgcagugaggccaaggaagggcugaaacgcggugaaacgacccgacaugccgugagccgcgggacggcaaaacugcgcugguucguggagagaaaccuggucaagcccgaagggaaggugauagaucucggcugcggccgcgggggcuggucuuauuacugcgccgggcugaagaaggucacugaggugaagggcuacacaaagggcgggcccggccacgaggaaccgaucccaauggcaaccuacggguggaaucugguaaaacuucacuccggcaaggacguguucuucacgccuccugagaagugugacacccugcugugugacaucggggaguccaguccgaaccccaccaucgaggagggccggacucuaagaguccugaagaugguugagccauggcugcgggguaaccaguucugcaucaagauccucaaucccuacaugccgagcguagucgagacgcucgagcagaugcagcgcaaacacggaggaaugcuggugcguaacccccucagccgcaauucuacgcaugaaauguacuggguaucgugcgggaccggcaacaucgucuccgccgugaacaugaccucaaggaugcuacugaaccgcuucaccauggcucaccgaaagcccacguacgagcgggacguagacuugggugcgggcacucgccacguagccguggaacccgagguugcgaaccuggacaucaucggacagcggauagagaacauuaagcaugagcacaagaguaccuggcauuacgacgaggacaacccguacaaaaccugggcguaccacggcagcuacgagguaaagccauccgggagcgcauccagcauggucaacggugucguuaagcuacucacaaagccgugggaugugauccccauggucacccagauugcgaugacugauaccacgccauucggacagcagcgcguguucaaggagaaaguggacacgcggacccccaaggccaagcgcgggaccgcccagaucauggaggucacggcccgguggcuguggggcuuucugagccgcaauaagaaaccuaggaucugcacccgcgaggaguucacacgaaaggugcgcuccaaugcagcgauuggcgccguguucgucgacgagaaucaauggaacucagcuaaggaggcaguggaggacgagagauucugggaccucguccagaaggagcgcgaacugcacaagcaggggaagugcgcgacgugcgucuauaacaugaugggcaagcgggagaagaaguugggggaguuuggcaaggccaaggguucccgcgcuaucugguacaugugguugggcgcgcgguuccuggaguucgaggcacuaggcuucaugaacgaggaccacugguucucucgcgagaacucacuuagcgggguggagggagagggcuugcacaagcugggcuacauccucagagacaucuccaagauccccggcggcaacauguacgcggacgauaccgccggcugggacacccguaucacagaggacgaccugcagaaugaggccaagaucacggacaucauggagcccgagcacgcccugcuugccacgagcaucuucaagcugaccuaucagaacaagguaguccggguccaacgccccgcgaagaauggaacuguuauggacgucaucucacgccgggaccaaagaggcagcggccaggugggcacauacggacugaauacguucaccaacauggaggcucagcucauccggcaaauggaguccgagggaauauuucugcccagcgagcuggagacaccgaaccuggccgaaagagugcuggacuggcuggagaagcacggcguugaacggcucaaacggauggcgaucucuggcgacgacuguguggugaagcccaucgacgaccgguucgccaccgcccugacggcucugaaugacauggguaagguacgcaaagacauaccucagugggagcccagcaaaggguggaaugacuggcaacaggucccguucugcucccaccacuuccaucagcugaucaugaaggacgguagagagaucgugguucccugccgcaaccaggacgagcugguagggcgagcaaggguaagccagggggcuggcuggucucugcgggagaccgccugccucggcaagucuuaugcgcagauguggcaacugauguacuuccacagacgugacuuacgccucgccgcuaaugccaucugcagcgcuguccccguugacugggugcccaccagccggacaacuuggucaauacacgcccaucaccaguggaugaccaccgaggacaugcuuuccguuuggaauagaguauggaucgaggaaaacccguggauggaggacaagacccaugucagcagcuggggcgacgucccguaccuggguaagcgggaggaccagugguguggcucacuaaucggccucacggcccgagcuacuugggcguccaacauacagguggcgaucaaccaggugcgccggcugauugggaacgaaaacuaccuagacuacaugaccagcaugaagcgcuuuaagaacgaaggagaccccgagggcgcccugugguaa

SEQ ID NO: 24415 - RNA, 9879 nt, Artificial Sequence
  derived and/or modified CDS sequence (opt11) from DENV-1__GU131688__SS-prME
agugugaccaugcuacucaugcugaugcccaccgcccuagccuuucauuuaacgacccggggcggggagccccauaugaucgugagcaaacaggagcggggcaagagccuccuguucaagacuuccgccggugugaauaugugcacccugaucgcgauggaccugggcgaguucugugaggacaccaugaccuacaagugcccccgcaucaccgaggccgagcccgaugauguugacugcuggugcaacgccaccgacacuuggguaaccuacgggaccugcagccagacaggugaacaucggcgggauaagcguagugucgcgcuggcgccccaugugggccucgggcuggaaacgcgcaccgaaaccuggauguccucggagggggcauggaagcagauccaacgggucgagaccugggcccugcgccaucccggguucacggugauugcccucuuccuugcccacgccauaggaaccagcaucacccagaaagggaucaucuucauccugcucaugcuggugacccccuccauggccaugcggugcgugggcaucgguagcagggacuucguggaagggcuguccggcgccacguggguagacguagugcucgagcacggaagcugcgugaccaccauggccaaggacaagccuacccuggauauagagcugcucaagacggaggucaccgaccccgcggugcugagaaagcugugcaucgaggccaagaucuccaacaccaccacugacagccgcugcccgacgcagggcgaggccacccucguggaagagcaggacgccaacuuugucugucggcgcaccuucguggaccggggaugggguaauggcugcgggcuuuucggcaagggcucccugaugacgugcgccaaguuuaaaugcgucaccaagcucgagggcaagaucguccaguacgaaaaccugaaguauagcgugaucgugaccgugcacacgggagaccagcaccagguggggaacgaauccacggagcacggcaccacagcaaccauaacgccacaagcccccagcacggagauccagcuaaccgauuacggggcccucacacuggacugcagccccagaaccggccuggacuucaacgagauggugcuccugacgaugaaggaaaaguccuggcugguucacaagcaaugguuccuagaccugccgcugcccuggaccagcggggccucuaccucacaagagaccuggaaucggaaggaccuccuggucacguucaagaccgcgcacgcgaagaagcaggaaguaguggugcuggggagccaggagggcgccaugcacacagcccucaccggggccacggagauccagacaagcggcacaaccacgaucuucgccggacaccugaagugcaggcugaagauggacaaauuaacacugaaggggaugucauacgucaugugcaccggguccuuuaaacuagagaaggagguggcggaaacccagcacggcacggugcuuguccaaaucaaguaugaaggcacagacgcccccugcaagauccccuucaguacccaggacgagaagggaguaacccagaacggccggcugaucacagcaaacccaaucguuacugauaaggagaagccaguuaacaucgaggccgagccacccuucggggaaagcuacaucgugauaggagcgggcgagaaggcucugaagcucucuugguucaaaaaggggagcuccaucggcaagauguucgaagccaccgcacgcggggcccggcgcauggcgauccucggggacaccgccugggacuucgggagcaucggggggguguucacgucagucggaaagcuggugcaccagaucuucgguacggccuacggggugcuuuucagcggcgucucguggaccaugaaaaucgggaucggcgugcuccugaccugguuaggacuaaauagccgcuccacgagccuguccaugaccuguaucgccguggggcugguaacccucuaccugggcguuauggugcaggccgacagcgggugcgucaucaacuggaagggccgggagcugaagugcgggagcggcaucuucgugaccaacgaggugcacacuuggaccgagcaguacaaguuucaggcggauuccccuaaacgccucagcgcagcuauaggaaaggccugggaggagggugucugcggcaucagguccgccaccaggcuggaaaacaucauguggaaacagaucucaaacgagcugaaccacauccuccuggagaacgacaugaaguucaccguaguggucggcgacguggccggcauccuggcccaagggaaaaaaaugauuaggccccagcccauggaauacaaguacuccuggaaguccuggggcaaagcaaaaauuaucggcgccgacgugcagaacacuacguucaucaucgacgggcccaacaccccugagugccccgacgaccagcgcgcauggaauaucugggaagucgaggacuacggcuucgggauuuucaccaccaacaucuggcuuaagcugcgggacaguuacacccaagugugcgaucaccgccugaugagcgccgcaauaaaggacagcaaggccgugcaugccgacauggguuacuggaucgagagcgagaagaacgagaccuggaaguuggcgagagccagcuucaucgaggucaagaccugcaucuggcccaagagccacacucuuuggagcaacggcgugcucgagagcgagaugaucauccccaagaucuacgggggcccgauaucccagcauaacuaccgccccggguacuuuacgcagaccgcaggccccuggcaucucgggaaguuagagcuggauuucgaccucugcgagggcaccaccguggucguagacgagcacugcggcaaccgggggccuagccugcgcacgaccaccgugaccggcaaaaucauccacgaguggugcugucgguccugcacgcugcccccacugagguucaagggggaggacggcugcugguacgggauggagauccggcccgucaaagagaaagaggagaaccuggucaagagcauggugagcgccggcuccggcgagguagacagcuucucccuugggcuccugugcaucagcaucaugauugaggaggugaugcgcucgcggugguccagaaagaugcugaugaccggcacacucgccguuuucuuccugcugaucauggggcagcucaccuggaacgaccugauccggcuaugcaucaugguuggcgcgaaugccagcgaucgcaugggcaugggcacgaccuaccucgcccugauggccaccuuuaagaugcgaccgauguucgccguggggcuccuguuccggcgacugaccagccgggagguccugcuccugacgaucggucugucccucguugcgagcgucgagcugcccaacucccuggaggaguugggcgaugggcuggcaaugggcaucaugauccugaagcuccugaccgacuuccaaagccaccagcugugggcgacccucuuauccuuaacuuucaucaagacgacguucagucuccacuacgccuggaaaaccauggcgaugguccuuuccaucgugagccuguucccccucugccuauccaccacgucacagaagaccaccuggcugccugugcuccugggcucccuagggugcaagccgcucaccauguuccugaucgccgaaaacaagaucuggggccgcaagagcuggccgcugaacgaggggaucauggccgucgguaucgugagcaucuuauuguccgcccugcucaagaacgacgugccccuggccgggccccugaucgcgggagggaugcucaucgccugcuaugucaucucgggcuccagcgccgaccugucccuggagaaggccgccgaggugagcugggaggaggaggccgagcacagcggcgccagccacaauauacucguggagguccaggacgacgggacgaugaagaucaaggacgaggagcgggacgauacccugacuauacugcucaaggccacucugcuggccgugucugggguguacccgcucagcauucccgccacgcuguucgucugguacuucuggcagaagaagaagcagcggucagggguucugugggacacgcccagcccgccggagguagagcgggcgguccucgacgacggaaucuaccgcaucaugcagcggggccugcugggaagaucacaggugggcgugggggucuuccaggagaacguuuuccauaccauguggcacguaaccaggggcgccgugcugauguaccaggggaagcgccuagaacccagcugggccagcgugaagaaggaccugaucagcuauggcgggggcuggagacugcagggcuccuggaacaccggggaggaggugcaggucaucgccguugaaccuggcaagaaucccaagaaugugcagacggcccccgggaccuuuaagaccagcgaaggcgaggucggggcgaucgcccuugacuucaagccugggaccucgggcagccccaucgugaaccgcgaggggaagauugugggccuguacggcaacggagucgugacgacgagcgggaccuacguguccgccaucgcucaagcgaaggccagccaggaggggcccuuaccggagaucgaggacgagguuuuccggaagcgcaaccucaccaucauggaccugcaucccggcuccggaaaaacucggcgcuaccugcccgccaucgugcgggaggccaucaagcgaaagcucaggacccugauucuggccccgacccgcgugguugcgagcgagauggcagaggcccugaaggggaugcccauccguuaccagaccacggccgugaaauccgaacacaccggcaaggaaaucguggacuugaugugucaugccacauucaccaugaggcugcuuucccccguccgcgugcccaauuacaauaugauuaucauggaugaggcgcacuucaccgacccguccagcaucgccgcccggggguacaucucaacccgcgugggcaugggggaggccgccgcgaucuucaugaccgccacgccccccggcucugucgaagccuuuccccaguccaacgccgugauccaggaugaggagcgggacauaccggagcgcagcuggaacuccggguacgaauggaucacggacuuccccggaaagaccguuugguucguccccagcaucaaguccggcaacgacaucgcuaauugccuacggaagaacgguaagcgcgugauccaacugagucguaagaccuucgacaccgaauaccagaagacgaagaacaacgacugggacuacgugguaaccaccgacauauccgagaugggcgccaacuuccgcgccgaucgggugaucgauccccgacggugccucaagccggugauccugaaggacgggcccgaaagaguuauccuggccggccccaugccugugaccgucgccagcgcggcgcagcggcgcggacggaucggccgcaaccacaacaaggagggggaccaguacauuuacauggggcagccgcuuaacaacgaugaggaccaugcccacuggacggaggcaaagaugcugcuggacaacauuaacacccccgagggcauaauccccgcccucuucgagcccgagcgggagaaguccgcggcgaucgauggggaguaccgccugaggggagaagcucggaagaccuucguggagcuuaugcgccgaggggaccucccggucuggcuguccuacaaagucgccagcgagggcuuccaguacuccgaccgccgguggugcuucgacggugagagaaacaaccaggugcuggaggaaaacauggacguagagauauggaccaaggaaggggagcguaagaagcuccgcccccgguggcuggacgcccgcacguacagcgacccccuggcgcuaagagaauucaaggaguucgccgccggccgccgguccgugaguggggaucuaaucuuagagaucggcaaauuaccucagcaccugacgcaacgcgcccagaacgcgcuugacaaccucgugaugcuccacaacagugagcaaggugggagagcauaccgccacgccauggaggaguuaccggacacgauagaaacacucaugcugcuggcccucauugccgugcuaacgggcggggugacccuguucuuucucuccggucggggguugggcaagaccuccaucggccugcuuugcgugauggcgagcaguguccugcuuuggauggccagcgucgagccccauuggaucgccgcuuccauuauccucgaguucuuccugaugguguuacucauccccgagcccgaccgccagcggaccccgcaggacaaccaacuagccuacguggucauagggcugcucuucaugauccugacgguggcggcaaaugagaugggccugcuggaaacgaccaagaaggaccuggggaucggccacguggcggucgagaaccaucaucacgccgccaugcuggacguggaccuccaccccgcgagcgccuggacacuguacgccguggccacaacgaucaucaccccaaugaugcgucauaccaucgagaacaccacggccaacaucagccugaccgcgaucgccaaccaggcugccauccucauggggcuggacaagggcuggccgauuagcaagauggacaucgggguccccuugcucgcgcugggguguuacagucaggugaaccccuugacccucacugcggccguucugaugcuagucgcacacuacgccaucaucggccccgggcuccaagcgaaggccacacgggaggcccagaaacgcaccgcggccggcauaaugaaaaacccgacgguagacgggaucguggcgaucgaccuggaccccgucguguaugacgccaaauucgagaagcagcugggccagauuaugcuccugauccuguguacuagccagaucuugcucaugcgcacuacgugggcguuaugcgaguccaucacacucgccacgggcccccugacgacccugugggagggaagccccggaaaguucuggaacaccaccaucgccguguccauggcgaacaucuuucgggggucuuaccucgccggcgccggccuggccuucagccugaugaagucacucgguggcgggcgucgcggcacgggggcucagggcgagacccugggcgagaaguggaagcgucagcugaaccaacucaguaaguccgaguucaacacauacaagcggagcgggauaauggagguagaccgcuccgaggccaaggaggggcugaaacgcggugagaccacgaagcacgccgugagccgcggcaccgccaagcugcggugguucguagagcgcaaucucgucaagccggaggggaaagugaucgaccuuggcugcggccgaggggggugguccuacuacugcgccggccugaagaagguaaccgaggucaagggguauaccaagggcggccccggccacgaagagcccauccccauggcgacguauggguggaaccuggugaaacuccauagcggaaaggacguuuucuucaucccgcccgagaagugugacacucugcuuugcgacaucggggaguccagcccuaaccccaccaucgaggagggccgcacccuccggguccugaagaugguggagccguggcugcgcggaaaccaguucugcaucaagaucuugaaccccuacaugcccagcguugucgagacacuugagcaaaugcaacggaagcauggcggcaugcuggugcgcaauccccucucucggaacuccacccacgagauguacugggugagcugcgggaccggaaacaucgucuccgccgugaacaugacuagccgcaugcugcugaaccguuucacuauggcccaccgcaaaccuacguacgagcgcgacguggaccucggggcaggcacccgucacguagcgguagagcccgagguggcgaaccuggacaucauaggucagaggauagagaacaucaagcacgagcacaagucuacguggcacuacgacgaagauaacccguacaaaacaugggccuaccacgggagcuacgaggucaagcccagcggcagcgccucuuccauggugaacggugucgugaaacugcucacgaagccgugggacgugauccccaugguaacccagaucgccaugaccgauaccacgcccuucggccagcagcggguguucaaggagaagguggacacccgcacccccaaagccaaacgggggacggcgcagaucauggaggucacggccaaguggcuguggggguuccuuucacgcaacaagaagccaagaaucugcacccgcgaggaguucacccggaaggugcgcuccaacgccgccaucggggcgguguucguugacgagaaccaauggaacagcgccaaagaggccguggaggacgaacgguucugggacuuagugcaccgcgagcgugagcugcauaagcaggggaagugcgcgaccugcgucuacaauaugaugggcaagcgcgagaagaagcugggggaguucggcaaggccaaggggucucgggccaucugguacauguggcuuggcgcccgcuuccuggaguucgaagcccugggcuuuaugaacgaggaucacugguucagcagagagaacucccucagugguguagagggcgaggggcuucauaagcuggguuauauccuccgugacaucuccaagauccccgguggcaacauguaugccgacgacacggcaggaugggacacucggaucacggaggacgaccugcagaacgaggcuaagaucaccgacaucauggagcccgagcacgcccugcucgccaagagcauuuucaagcugacguaccagaacaaggugguacgcgugcagcggccggcaaagaacgggacggugauggacgucaucucccgccgcgaccagcggggcagcgggcaggugggcaccuacggccugaauaccuucacgaacauggaggcccagcucauccgccagauggagucggaggggaucuucucccccuccgagcuggaaacccccaaccuggcgggccgggugcucgacuggcuggagaagcacggggucgagcgccugaagcggauggccaucagcggcgaugacugcguggugaagcccauugacgaccgcuuugccgccgcccucaccgcgcugaacgacauggguaagguccggaaggauaucccccagugggagcccuccaagggcuggaaugauuggcagcaagucccauucugcucacaccauuuccaucagcuaaucaugaaggacggccgggagaucgugguccccugccggaaccaagacgaguugguggggcgagcccgggugagccagggagccggguggucccugcgcgaaaccgccugccuggguaagagcuacgcgcagauguggcagcucauguauuuccaccgacgcgaccuccggcuggcggccaacgcuaucugcagcgccgugccaguggauugggugccuaccucccgcaccaccugguccauacacgcgcaccaccaguggaugacgacggaggauaugcucagcgucuggaaccgggucuggauugaggagaaucccuggauggaggacaagacccacauauccagcuggggcgauguucccuaccugggcaagagagaggaccaguggugcgguucccugaucgggcucaccgcccgggccaccugggcaacgaacauccaaguugccaucaaccaggugcgccgccugaucggcaacgagaauuaccuggacuacaugaccucgaugaagcgguucaaaaacgaguccgacccggaaggggcgcucugguga

SEQ ID NO: 24416 - RNA, 9879 nt, Artificial Sequence
  derived and/or modified CDS sequence (opt11) from DENV-1__GU131689__SS-prME
ucggugacgauguuccuaaugcucaugcccaccgcccuagcuuuucaccugaccacaagagguggagaaccgcacaugaucgugucuaagcaggaacguggcaagagccuucuguuuaagaccagcgccggggugaacaugugcacauugauagccauggaccucggggaauucugcgaggauacgaugacguacaaaugcccucggaucaccgaggccgaacccgacgacguggacugcugguguaacgccaccgacaccugggugacguacggcaccugcagucagacuggggagcaccggcgggacaaaagguccguugcccucgcgccgcacgugggccuggggcucgaaacgcgcacagagaccuggaugagcuccgagggggccuggaagcaaauccagagggucgagacaugggcccuucgccauccggguuuuacggugaucgcacuguuccuggcacaugcuauagggaccagcaucacucagaaggggauuaucuucauccugcugaugcucguaacccccagcauggccaugcgaugcguugguaucgggaguagggacuucguagaggggcugaguggcgccacguggguagacgucgugcuggagcacggcagcugcgugaccaccauggcaaaggacaagccuacccucgacaucgaacugcugaagacggagguuaccaacccggcggugcuccggaaguuaugcauagaggccaagauauccaacacgacuacggacucucgcuguccgacccagggggaggcuacgcuugucgaagagcaggaugcgaacuucgucugucggagaaccuucguggaccgcggcugggggaacggcugcggcuuguucggaaaagggucccugaucacaugcgccaaauucaagugugugacaaagcuggagggcaagaucguucaauacgagaaccucaaguacagugugaucgugaccgugcauaccggcgaucagcaccaggugggcaacgagucuacugagcacggcaccaccgcgacuaucacgccccaagcccccagcacggagauccagcuaaccgacuauggggcccugacccucgauugcucuccccggaccggacuggacuuuaaugagauggugcugcucaccaugaaagagaaauccuggcuggugcauaagcaaugguuccuggaccucccguuacccuggaccagcggggccuccaccagucaggagacguggaaccggcaggaccugcuagugacauuuaagaccgcgcacgcgaagaagcaggagguggucgugcugggcucccaggaaggcgccaugcacaccgcacugacgggggccacggagauccagaccagcggaaccaccacgauuuuugccgggcacuugaagugccgccugaagauggacaagcugacacucaagggcauguccuacgucaugugcaccggaagcuucaaacuugagaaggagguugcggagacccagcauggcacaguucugguucagaucaaguacgagggaaccgacgcuccuuguaagaucccuuucuccacccaggacgagaagggugugacucagaacggccgacucaucacugccaacccgaucgucaccgacaaagaaaaacccguuaacaucgaggccgaaccaccauucggagaaucguacauagucauaggugcaggugaaaaggcccugaagcugagcugguucaagaagggcagcuccauugggaagauguucgaggccaccgcccgcggagcccggaggauggcgauccugggcgauacagccugggauuucgggagcauaggcggaguguucacguccgucgggaagcucgugcaucagaucuucggcaccgccuacggggugcuguuuagcggcgucucuuggaccaugaaaauaggaauuggugugcugcuaacauggcugggccugaauagccgcuccacgagccuauccaugacaugcaucgccgucggguuagucacccuuuaccuaggcgugauggugcaggccgacagcggaugcgucaucaacuggaagggccgugagcuuaagugcgggagcgguaucuucgugaccaaugaggugcacacguggaccgagcaguacaaguuccaagcggauucccccaagaggcuguccgccgcgaucggaaaggcuugggaggaagggguguguggcauccguuccgccacgcgucucgagaacaucauguggaagcagauuaguaaugagcugaaccacauccugcucgaaaaugacaugaaacuaacaguaguggucggggacguggccggcauucucgcccaggggaagaaaaugauccggccccaacccauggaauacaaguacuccuggaaaaguugggggaaggcgaagaucaucggcgccgacgugcaaaacacaacauucauaaucgacgggcccaacacgccggaaugccccgacgaccaacgagcguggaacauaugggaggucgaggacuacggcuuugggaucuucacuaccaacauauggcucaaacuacgggacuccuacacccaagugugcgaccaucgacugaugagcgcagccauaaaggauuccaaagcugugcaugccgacaugggguacuggaucgagagcgaaaaaaacgagacguggaaacuggcgcgggccuccuucaucgaaguuaagacgugcguguggccaaagucccacacccucugguccaauggcgugcuggagagcgagaugaucauacccaaaauauaugggggcccaaucucacaacacaacuaccggcccggguacuucacccagaccgccggcccauggcaccuuggcaagcuggaacuggacuucgaccucugcgagggcaccaccgucguggucgacgagcauugcggcaauagggggccgagcuugcgcaccaccacggucaccggcaagauaauucacgaguggugcugucgguccugcacgcugccgccccugcguuucaagggggaggacggguguugguacggcauggagauccggcccguaaaggaaaaagaggagaaccuggucaagagcauggucagcgccggauccggugaggucgauagcuucucccugggucuccugugcaucagcaucaugauagaggaaguaaugcgcucccgguggagccgaaagaugcugaugacgggcacccuagcgguguucuuccuccugauaauggggcagcucaccuggaaugaccugauccggcuaugcaucauggugggggcgaacgccagcgaccggauggggaugggcacgacuuaccucgcccuaauggccacuuucaagaugcgaccgauguucgcgguggggcuccuauuccggcgauuaacgagccgggagguccugcugcugacgaucgggcuaucccuagucgcaagcgucgaacugcccaacucccuggaggaacuuggcgacgguuuagccaugggcaucaugauacugaagcuccucacggacuuccagagccaccagcugugggcaaccuugcugucacugaccuucauaagaacgacuuucagccuccacuacgccuggaaaacaauggcgauggugcugucuauagucagccuguucccucucugccuguccacuacgagccagaagacgaccuggcuacccguccucuuaggcagucugggguguaaaccguuaaccauguuccuuaucgccgagaauaagaucuggggccgcaaaagcuggccccugaaugaggggaucauggccgugggcauuguuucaauccuccuguccagcuuacucaagaaugacguaccccuggccgguccuuugauagccggcgguaugcucaucgcaugcuaugugaucuccggaagcuccgccgacuugagucucgagaaggccgccgaaguguccugggaggaggaggcagagcauagcggugcgucucacaauauacucguggaggugcaggacgacgggacgaugaagaucaaggaugaagaacgagacgacacacuuaccauccucuuaaaggccacccugcucgccgugagcggugucuauccucucucaauacccgcgacccuguucgugugguauuuuuggcagaagaagaagcagagguccggagugcugugggauacgccuagcccgcccgaggucgagcgcgcuguguuagacgacggcaucuaccggaucaugcagcgcggccugcuugggcgaucucaggugggcgucgggguauuccaggagaacgucuuccacaccauguggcacgucaccaggggcgcggugcuaauguaccaggggaaacgacuggaacccagcugggcaucggugaagaaggaccugaucaguuacggcggcggguggaggcugcagggcagcuggaauaccggggaggaaguacagguuaucgccguugagcccggcaagaaccccaaaaauguccaaacugcccccgggaccuucaagaccuccgagggcgagguuggggcgaucgcucucgauuucaagcccgggacaagcggaagccccauugugaaccgggaagggaagauugucggccuguacggcaacgggguagugacaaccuccggcaccuacgucagcgcaaucgcccaggcgaaggcgucccaagaggggccccugccggagaucgaagacgaggucuuccgaaagcggaaccuaacaaucauggaccugcaccccggcucugggaaaacgcgccgcuaucuacccgccauagugcgcgaagccaugaagcggcgccuccgcacccugauccuagcgccaacacgggucguggccuccgagauggcggaggcacugaaggguaugccuaucagguaccagaccacggccgucaaguccgagcauaccggcaaggagauagucgaucuuaugugccacgccacauuuaccaugaggcuccucucucccguccgcgugcccaacuacaacaugaucaucauggaugaggcccacuucacggacccuagcaguaucgcggcaagaggguacaucaguacccgcgugggcaugggggaggcugccgcgauauucaugaccgcgacgccacccggcuccguggaggccuuuccccagagcaacgccgugauccaggaugaagagcgggacauccccgagcgcucuuggaacagcggcuacgaauggauaacggacuuccccggcaagaccgucugguucgugcccuccaucaagucgggcaacgacaucgcaaauugucugcggaagaacggaaagcgcgucauccagcuaagccggaagaccuucgacaccgaguaccagaaaacgaaaaauaacgacugggauuacgucgugaccaccgacauuagcgagaugggcgcaaacuuccgcgccgaccgggugauugaccccaggcggugccucaagccggugauccugaaggacgggccggagcgcguaauccuggcagggcccaugccggugaccgucgccuccgccgcucaacggcgcgggcggaucggacgaaaccacaacaaggagggcgaucaguacaucuacaugggccagccguuaaacaaugaugaggaccacgcccacuggacggaagccaagauguuacuggauaacauaaacacccccgaaggcaucauccccgcccucuucgagcccgaacgcgaaaaaagugccgcgaucgacggugaguaccggcugcgcggcgaggcccggaagaccuucguggagcuaaugcgcagaggggacuugcccgucugguuaagcuacaagguggccuccgagggcuuccaguauagcgacagacgguggugcuucgauggcgagcgcaauaaccaggugcuggaggagaacauggacguagagaucuggacgaaggagggggagcggaagaaauugcgcccccgguggcuggaugccaggacguacuccgacccccuggcccucagggaguucaaggaguuugcggccggccgccggagcguuuccggggacuuaauccuggaaaucggcaagcucccacagcaucugacucagcgcgcccagaaugcauuggacaaccucgucauguugcauaauagcgagcaaggcgggcgggcguaccgccacgccauggaagagcuuccugacacaaucgagaccuuaaugcugcuugccuugaucgcugucuugacgggggggguuacgcuguucuuccucucaggcagagggcugggcaagaccagcaucggcuugcucugcgugauggccucgucgguccuacuguggauggcgucgguagagccccacuggauagccgccuccaucauccucgaauucuuucugauggugcugcucauccccgagccugaccgccagcgaaccccgcaggacaaccagcuggcauacgucgugaucggacuccucuucaugauacugaccguagccgccaaugaaaugggucugcucgaaacuaccaagaaggaccucgguauaggccacguagcuguagaaaaccaccaucacgcugcaaugcuggauguggacuuacaucccgcguccgcguggacuuuauacgcugucgccacgacaauuaucacccccaugaugcgacauaccaucgagaacaccacugccaacaucagccugacugccauagcgaaccaagcagcuauccucauggggcuggacaagggcuggccgauauccaaaauggacauuggugucccccugcuggcucuggggugcuacagccaagugaacccucucacucugacugcagcaguccuaaugcugguggcccacuacgccaucauugggcccggccuccaagccaaggcgacccgugaggcgcagaagcggacagccgccggaaucaugaagaacccgaccguggacgggaucgucgccaucgaccuggaccccguuguguaugacgcgaaauucgagaagcaacugggccaaaucaugcuccugaucuugugcaccucccagauccucuugaugaggacgaccugggccuugugcgaaagcaucacccucgccaccggcccccuuaccacccuuugggaggguucccccggcaaguuuuggaacacgacgaucgcggucagcauggccaacauauuccgggggaguuacuuggcgggggccggacuggccuucucucugaugaaaaguuuggggggcgggcgcaggggcacgggggcgcagggcgagacauuaggggagaaguggaagcgccagcugaaccagcucuccaagagcgaguucaacaccuacaagcguuccgggaucauggagguggaccgcagugaggcgaaagagggacugaagcgcggcgagacuacuaagcacgcagugagccgcggcacugcaaagcuacggugguucgucgaaaggaaccuggugaaaccggaggggaaagugaucgaccuaggcuguggccgcggcggauggagcuacuacugcgcugggcugaagaaggucaccgaggugaagggauacacgaagggcgggccuggccacgaggagcccauucccauggccacguacggguggaaccuaguaaaacuccacuccggcaaggaugucuuuuucaucccucccgagaagugugacacccuccuaugcgauaucggggagagcucccccaaucccaccaucgaggagggccgaacacuucgggugcugaagauggucgagccguggcugcgcgggaaccaauucugcaucaagauccucaaccccuacaugccuagcguaguggagacgcuggagcagaugcaacggaagcauggcggcaugcugguacgcaacccgcucucccggaauagcacccaugaaauguacugggucuccugcgggaccgggaacaucguaagcgcggucaauaugaccucccguaugcugcucaaccgcuuuacgauggcacauaggaagccgacguaugagcgcgacgucgaccucggggccggcacacggcacguggccguggagcccgaagaggccaaucuugacaucaucggccagcgcauagagaacaucaagcacgagcacaagagcaccuggcacuaugacgaggacaacccuuauaagaccugggcguaccacggguccuacgaggucaagcccaguggcucugcuagcagcauggugaacgggguggucaagcuccucacgaagccgugggacguaauccccauggucacccagauugccaugaccgacaccacgcccuuugggcagcagagaguguuuaaggagaaggucgauacccgcaccccuaaagccaaacgggggaccgcccagaucauggaggucacggcgaaauggcuauggggauuccugucccgaaacaagaagccgcggauuugcaccagagaggaguuuacacggaagguacgaucaaacgcggccaucggcgccguguuugucgaugagaaucaauggaauuccgcgaaggaagccguggaggacgagcgguucugggaucucguccaccgcgagagggagcugcacaagcagggcaagugcgcgaccugcgucuauaauaugaugggcaagcgugaaaagaagcugggcgaguucggcaaggcaaaggggagccgagccauuugguauaugugguuaggugcgagauuccuggaguucgaggcccugggguucaugaaugaggaccacugguucuccagggagaacucacucuccggcguugagggagagggguuacacaagcucgguuauauucuucgcgacaucagcaagaucccggggggcaacauguacgccgacgacacggcgggcugggauacaagaaucaccgaagacgaccugcagaaugaggcgaaaaucaccgauauaauggagcccgaacaugcgcuucuagcaaaguccaucuuuaagcugacguaccagaacaagguagucaggguccagcgcccggcuaagaacgggaccgugauggaugugaucagccgucgcgaccagcgcggcuccggacagguaggcaccuacggccuuaauacauucacaaacauggaggcccaacuaauccgccagauggagucggaggggaucuucucccccagcgaguuagagacgccaaaucuggcagggaggguacucgacuggcuggaaaagcacgguguugagcgccuaaagcggauggcuaucuccggugacgacugcguggugaagccuaucgacgaucgcuucgcaaccgcacucaccgccuugaacgacauggggaagguccggaaagauauaccgcagugggagccguccaagggcuggaacgauuggcagcaggucccuuuuugcagccaucacuuccaccagcugaucaugaaggacggccgcgaaaucgugguccccugccgcaaccaggacgagcuuguggggcgcgcccgugugucccagggcgcggguuggagccugagagagacggcuugccuggguaaguccuacgcucagauguggcagcucauguacuuccaucgcagagacuuacguuuggcagcgaacgccaucugcagcgccgucccgguggacugggugcccacuagccgcaccaccuggagcauccacgcccaccaccaguggaugacgaccgaggacaugcucagugucuggaacagaguguggaucgaagaaaauccauggauggaggacaagacacacgugucuuccuggggggacguccccuaccugggcaagcgagaggaccaguggugcggcagucugaucggccucacggcccgcgcgacgugggccaccaacauccagguagccaucaaccagguacgacggcugcugggcaacgaaaacuaccucgacuacaugaccuccaugaagcgguucaagaacgagagcgacccggaaggggcccugugguag

SEQ ID NO: 24417 - RNA, 9879 nt, Artificial Sequence
  derived and/or modified CDS sequence (opt11) from DENV-1__GU131690__SS-prME
agcguaaccauguugcugaugcugaugccaacggcucuugcguuccaccuaacuacccggggcggggaaccccacaugauugugagcaaacaggagcgggguaagagccugcuguucaagacaagcgccgggguuaauaugugcacccucaucgcgauggaucuaggcgaacugugcgaagacacgaugaccuacaaaugucccagaaucaccgagaccgagcccgacgacguggacuguuggugcaacgccacggacaccugggugaccuauggaaccugcagccagacgggggagcaccggagggacaagcgguccguggcucucgcgccucacgugggcuuggggcuggagacacgcacugagaccuggaugagcuccgaaggagcguggaagcagauccagcgcgucgaaacaugggcccugcgucacccugguuucaccgugauugcccuguuccuugcacacgcgaucggcaccucgaucacccagaaagguauaauauuuaucuuacuaauguuagugacgcccucgauggccaugcgcugcgucggaauugggagccgagacuucgucgagggacuauccggcgccaccuggguggacgugguccuggagcacggaagcugcgucacaaccauggccaaggacaagcccacgcuggacaucgaacuuuuaaagaccgaggucacgaaccccgccgucuugcgaaagcucugcaucgaggccaaaauuuccaacaccacgaccgacagccgcuguccaacccagggugaagccacccugguagaagaacaggacgccaacuucgucugccguagaacuuucguggacagaggcugggggaacggcugcggacuguucgguaagggcagucucauuacaugcgccaaauucaagugcguuaccaaguuagaaggcaagaucguacaguaugagaaccugaaguacuccgucaucguuacgguccacacgggcgaucagcaccagguagggaacgaaucuaccgaacacgggaccaccgccacgaucacgccccaagcgcccaccaccgagauacagcucaccgauuacggggcucuaacgcuugauugcagccccaggaccggccuagacuucaacgagauggugcuacugacaaugaaagagaagucauggcucgugcacaaacaaugguucuuggaccucccccucccauggaccagcggggcaagcacuagccaggagaccuggaaccggcaggaucuacuggugacguuuaagaccgcccaugccaagaagcaagaagucguggugcuggggucccaagagggcgcaaugcauacggcccuuaccggagcuaccgagauacagaccuccggcacaaccaccaucuucgccgggcaccuaaagugccgcuuaaaaauggacaaacugacccuaaaaggaaugagcuacgucaugugcacuggguccuuuaaacucgaaaaggagcucgcagagacgcagcacgggacagugcuggugcaaauaaaauaugagggcaccgacgcacccugcaagauccccuucagcacgcaagacgagaagggggucacacagaaugggcggcuaaucacagcgaacccuaucguaaccgacaaggagaagcccgugaauauagaggcugagccgccguucggggaaucuuauaucguuauuggagccggagagaaggcgcuuaagcugucgugguucaagaaaggguccucaaucgggaagauguucgaagccacggccaggggcgcccggaggauggccauccugggugacaccgcgugggacuucggguccaucggaggcguauuuaccagcguggguaagcucguccaccagaucuucggcacagcguauggggugcuuuucuccggagucagcuggacgaugaagaucgggaucggcguauugcucacguggcucggccugaacucccgcagcacgucccuuagcaugacaugcaucgccguaggucuggugacgcucuaccucggaguaauggugcaggccgacuccgggugcgugaucaacuggaagggccgggagcucaagugcgggagcggcaucuucgucacgaaugaggugcauaccuggacagagcaauacaaguuccaagcagacagcccgaagcgccuguccgcggccauaggcaaagcgugggaggaaggggucugcggcauccggagcgugaccagacucgaaaacauuauguggaagcaaauauccaaugaacugaaccacauacugcucgagaacgacaugaaauucacggugguugugggagauguggcggggauccuggcccagggaaagaagaugauucguccccaacccauggaacauaaguacagcuggaagucuuggggaaaggccaagauuaucggcgccgacguucagaacacaacguuuauuauugacggccccaacacaccggagugucccgacgaucagagagccuggaacaucugggaagucgaggacuauggcuucgggauauucacgaccaacaucuggcucaagcuccgugacagcuacacccagguuugcgaccaccgccucauguccgccgcgaucaaagauagcaaggccguacacgccgauaugggcuacuggaucgaauccgagaagaacgaaacauggaaacuugcgcgugcgucuuuuaucgaggucaagaccuguauuuggccgaagucccacacgcucuggaguaauggcguauuggaguccgaaaugaucauccccaagaucuauggaggcccuaucagccaacacaacuaccgccccggauauuuuacacagaccgcgggcccauggcaccuggggaaguuggagcuggacuuugacuuaugcgaaggcacgacaguggucguggacgagcacugcggcaaucggggcccgucccugcgcacuaccacggugaccggcaaaauaauccaugaguggugcugcagaagcuguacccugccgccccugagauuccgcggggaggacggaugcugguacgggauggaaauccggcccgucaaggagaaggaggaaaacuuagugaagaguaugguguccgcgggcagcggggaggucgauuccuucagccuagggcuccucugcauauccaucaugaucgaggaggugaugcgcagccgauggucucgaaagaugcuuaugacggguacgcuggccguguuuuucuugcugaucguggggcaacugaccuggaacgaccucauucgccugugcaucauggucggcgccaacgcaagcgaccguauggggaugggcacuaccuaccuggcgcucauggccacuuucaagaugcggccuauguucgccguggguuugcuguuucgccggcucacaucccgcgaaguccuacugcucaccaucgggcugucucugguggcgaguguggagcucccaaacagccuggaggagcugggagacgggcuggccaugggcaucaugaucuugaaacugcucaccgacuuccagucacaucagcuuugggcgacccugcugagcuuaacuuucaucaaaaccaccuucagccuacauuacgccuggaagaccauggcaauggugcucaguguagucucccuguucccccuuugccucucaacuaccucccagaagacaacuuggcugccugugcugcugggcagccuggggugcaaaccgcugaccauguuccuaaucgccgagaauaagaucuggggccgccgcuccuggccguuaaacgagggaauuauggcggugggcauugugucuauccuacucagcucucugcugaagaacgaugucccccucgccgggccccugaucgccggcggcaugcugauugcgugcuacgugaucucggggagcagcgcggaucucagucuggaaaaggccgcagaggucagcugggaggaagaggccgaacauucaggugccucccacaacauccugguagagguucaggacgacgggaccaugaagaucaaggacgaggagcgggaugauacccucaccauacugcugaaagcgacccuccuggcggucucuggcguguacccgcuuagcaucccggccacccucuucgugugguacuucuggcagaaaaagaaacagcgcuccgggguguugugggacacgcccagcccucccgagguggagcgggccguguuagacgacggaauauaucgcaucaugcagcggggucuguuagggcgcucgcaaguagggguggggguguuccaggagaacguauuccacacgauguggcauguuacacggggugccguucugauguaccaggggaagcgccucgagccgucgugggcguccgugaaaaaggaccugaucucguacggaggcggcuggcggcuacagggcuccuggaacaccggugaggaaguccaggucaucgcgguggagcccgggaagaaccccaagaacgugcaaacggcccccggcaccuucaagacgccagagggagaggugggugcaaucgcgcuggacuuuaagcccgguacgagcgggucgcccauugucaaccgcgaggguaagauagugggcuuguauggcaaugggguggucaccacauccgguacguacgugagcgccauagcgcaggcaaaggcgucacaagaggggccgcugcccgaaaucgaggacgagguguuccggaagagaaacuugaccaucauggaccugcacccuggcagcgggaaaaccaggagguacuuaccggcuauaguccgggaagcgaucaagcgcaagcugcgcaccuuaaucuuagcccccacgcgugucguggccuccgagauggcagaggcacugaagggcaugcccauacgcuaccagaccaccgcugucaagagcgagcacacuggcaaggagaucguggaccucaugugucacgccacauucaccaugcgucugcugucccccgugagagugccgaacuauaacaugauaaucauggacgaggcccacuucaccgacccuagcuccauagccgcacggggguacaucucaacccgugucggaaugggggaggccgcggccauuuucaugacggccaccccgcccggcuccguggaagccuuuccacagucaaacgcggugauacaagacgaggaacgagacauccccgagcgcuccuggaacagcggguaugaauggauaaccgauuuuccaggcaagaccguuugguuugugccguccauuaagagcggcaacgacaucgccaacugccuccggaagaacgggaaaagggucauucagcuuucccggaaaacguucgauaccgaauaccagaagacaaagaacaacgauugggauuacguggugaccacggacauaucagagaugggcgccaauuuccgggcagaccgggugauugacccgcgacggugcuuaaagcccgugaucuuaaaagauggcccggagagagucauucucgcggggccgaugccgguaacgguggcguccgccgcacagcggcgugggcggaucggccgcaaccauaacaaggaaggugaccaauacaucuacauggggcagccccugaacaacgacgaggaccacgcacacuggaccgaagcgaaaauguuguuagauaacaucaacacacccgaagguaucauucccgcacuguuugagcccgaacgcgaaaaauccgcugcuauugacggggaguaccgacuccgcggcgaggcacguaagacguuuguugaacugaugcgccgcggggaccugccugucuggcuuuccuacaaaguugcgagcgaaggcuuccaguacagcgacagacgguggugcuucgauggcgagagaaacaaccaggucuuagaagagaacauggacgucgagaucuggacgaaagagggggagcggaagaagcugcgcccacgauggcucgacgcgcggaccuauagcgacccacuggccuuacgggaguucaaagaauuugcagcaggccgccgaucgguguccggcgaccucauacucgagaucggcaaguugccgcagcaccucacccagcgagcgcaaaacgcccuggacaaccucgucaugcuccacaacagcgagcagggcgggcgagcuuacagacacgcuauggaggaacugcccgacacuaucgagaccuugaugcuccucgcuuuaaucgccguacugacuggcggggugacacucuucuuccuguccggccggggacuaggcaagacuagcaucggccuccugugcgugauggcauccuccgugcuacuguggauggcaucuguagaaccccauuggaucgcugcgagcaucauccuggaguucuuuuuaaugguucugcugauccccgaaccugaccgccaacggacaccccaagacaaccagcucgccuacgugguuauugggcugcuuuuuaugauccugacuguagccgccaacgagaugggcuugcuggaaaccaccaaaaaggaccucgguaucggccacguggcaguggagaaucaccaccacgcggccaugcuggaugucgacuuacaccccgccuccgccuggacucuauacgcgguagcaaccacgaucaucacgccgaugaugagacacacgaucgagaacaccaccgccaauaucagccugaccgccaucgccaaccaagcggccauccugaugggucucgacaagggcuggcccauaaguaagauggacaucggcgugccccuucuggcacuugguugcuauagccaggucaacccgcugacgcugaccgccgccgugcucaugcugguggcgcacuaugccauuauaggcccggggcuucaggcaaaggcuacccgcgaagcccagaagcggacugccgcuggcaucaugaagaacccuacggucgaugggaucguggccaucgaccucgauccggugguauacgaugccaaguucgaaaagcaacugggucaaaucaugcuacuuauucuguguacaucacagauucugcuuaugcgcaccaccugggcucugugcgagucaaucacgcuggcgaccggcccucucaccacccuuugggaggggucgccugggaaguucuggaacacuacuauagcagugucaauggcaaacaucuuccggggguccuaucuagccggcgccggccucgcguucagccugaugaagucccuaggagggggccgccgggguacaggcgcacaaggcgaaacgcucggagagaaguggaagcggcaacugaaccagcuuuccaagagcgaguucaacacguacaaacguuccgggaucauggaaguugaccgcucagaggccaaggagggccugaaacgcggggaaacgaccaagcaugccgucucgcgcgguaccgcgaagcugaggugguucguggagcgcaaccuggugaagccagaggguaaggucaucgaccugggcugcggaaggggcggguggucguauuacugcgccggacucaagaaagucacggaggugaagggcuauacaaagggcggcccaggccacgaggagcccauaccgauggcgaccuauggguggaaccuggugaagcugcacucgggcaaggacguguucuucaucccgcccgagaagugcgacacccugcugugcgacauuggggagagcucccccaacccgacgauugaggagggccgcacacugaggguucucaagauggucgaacccuggcugcgcgguaaccaguucugcauaaagauccugaacccauauaugccgagcgugguugagacccucgagcagaugcagagaaaacacggcggcaugcugguuagaaacccucugucccggaacuccacccaugaaauguacugggucucuugcgguacaggaaacauagugucugccgucaacaugacuuccaggaugcucuugaaccgcuucaccauggcccaucggaagccuaccuacgagcgcgacguggaccugggggcgggaacccggcacguggccguggagcccgaagucgccaaccucgacaucaucggacaacguauagaaaacauaaagcacgaacauaaguccacguggcacuacgacgaagacaacccauacaaaacaugggcguaucacggcucuuacgagguuaagccaucgggauccgccagcucuauggucaacggagugguaaaauuacugacaaagcccugggaugucauacccauggugacgcagauugccaugacggacacuacgcccuuuggccaacagcgagucuucaaggagaagguggacacaaggaccccgaaggcaaaacgggggaccgcccagaucauggaggugacagcgaaguggcucugggguuuccuaucuaggaacaagaaaccgcgcauuugcaccagagaggaguucacgcggaagguccgcagcaacgcagcgaucggcgcgguguuuguggacgagaaccaguggaacuccgccaaggaagccgucgaggacgaacgguucugggaucugguacaucgcgagcgcgagcuccacaagcagggaaaaugugcgacgugcguguacaacaugauggggaaaagagagaagaagcugggcgaguucggcaaggcgaaagggagccgggccaucugguacauguggcuaggcgcacgcuuccucgaguucgaggcucugggcuucaugaacgaagaucauugguuuucgcgagagaacagccuguccggugucgagggagaaggguugcauaaacugggcuacauccugcgggacauaagcaagauccccgggggcaacauguaugcggacgacaccgcuggcugggauacgaggauaacugaggacgaccugcagaacgaagcacguaucaccgacauuauggaaccggagcacgcgcugcuagccaagucaauuuucaaacuaaccuaccagaacaagguugugcgcguccagcgucccgcuaagaacgguaccgucauggacgugaucucuaggcgggaucagcgcgggagcgggcaaguuggcacuuacggucugaauaccuucaccaacauggaggcccagcugaucaggcagauggagucggaggggaucuucagucccagcgagcucgagacacccaaccuggcugaaaggguucuggauuggcuagaaaaauauggcguggagcgucuuaagcgcauggccaucuccggggacgacugcguagugaagccaauugaugaccguuucgcaacggcguuaaccgcucucaacgacaugggaaagguucgcaaggacaucccccagugggagccuagcaagggauggaacgacuggcaacaggugcccuucugcucucaccacuuccaccagcugaucaugaaggauggacgggagaucgugguacccugccgcaaucaagacgagcuaguaggccgggccagaguuagccagggggccggcuggagccuccgggagacagccugucuggguaaguccuacgcgcaaauguggcagcuuauguauuuccacagacgggaccugcgucucgccgccaacgccauuuguagcgcggucccuguagauuggaucccaacaucccggacgaccuggucuauccaugcccaccaccaguggaugacgacagaggacauguuaagcguguggaacaggguguggaucgaagagaacccauggauggaggacaaaacgcacaucucguccuggggcgacguucccuaccucggcaagcgugaggaccaguggugcgggagcuuaaucggcuuaaccgcgcgggccacuugggcuaccaacauccagguggcgaucaaccaggucaggcggcucaucgguaacgagaacuacuuggacuacaugaccuccaugaagcgcuuuaagaacgaaagcgacccggagggagcccugugguag

SEQ ID NO: 24418 - RNA, 9879 nt, Artificial Sequence
  derived and/or modified CDS sequence (opt11) from DENV-1__GU131695__SS-prME
agcgugacaaugcugcuaauguuaaugcccaccgcgcuagccuuccaccucacuaccagaggcggggagccccacaugaucgugagcaagcaggagcguggcaagucacuucuguucaagaccuccgccggagugaauaugugcacucuuaucgccauggacuugggcgagcugugcgaggacaccaugaccuacaagugcccuagaaucaccgagaccgagccugacgacguggacugcuggugcaacgccaccgacaccugggugaccuacgggaccugcagccagacgggcgagcaucggagagacaagagauccguggcccuggcgccccacguagggcuaggccuggagacacgcacugagaccuggaugagcuccgagggcgccuggaagcagauacaacgcgucgagaccugggccuugcgccacccaggguucaccguuaucgccuuauuccuggcccacgcgauaggcaccucuaucacccagaaagggauuaucuucaucuuauugaugcuggugacgccuuccauggccaugcggugcguugguaucggcucccgcgacuucguugagggacuuuccggcgcgacguggguggaugucguccuggagcauggguccugcguaaccacgauggccaaggacaagccgacgcuagacauagaacugcugaaaaccgaagucacuaaccccgccgugcuucggaaacucugcaucgaagcgaagaucuccaauaccacgaccgacagccgcugcccgacucagggcgaggcaacccugguggaggagcaagacgccaacuucgucugccggcgaacguucguugaccgcggcugggggaacggcugcggauuguucgguaaggggucccucauaacgugugccaaauucaaaugcgucaccaagcuggaggggaagaucguacaauacgagaaccugaaguacagcgugaucgugaccguccacacgggcgaccaacaccagguggguaacgagucuaccgagcacggcaccacagccacgaucacuccucaagcucccaccaccgagauccagcucaccgacuacggggcccugacgcuggauuguagcccacggaccggccucgacuucaacgaaaugguccugcugaccaugaaggagaaguccuggcucgugcacaagcagugguuccucgaccuaccccugccuuggaccagcggggccagcacaagccaggagaccuggaaccggcaggaccuccuggugaccuucaagaccgcccacgccaagaagcaggaggucguggugcucggcagccaggagggcgcgaugcacacugcccuuacgggggccaccgagauccagaccucuggcaccaccaccaucuucgccgggcaccucaagugucgccucaagauggacaagcugacccugaagggcaugagcuacgucaugugcaccggguccuucaaguuagagaaggagguugcggagacccaacacgggacugugcugguccagaucaaguacgaaggcacugacgcgcccugcaagauccccuucagcacgcaagaugaaaaaggggugacccaaaacggacggcucauuaccgccaacccgaucgugacggacaaggaaaagcccgugaacauagaggccgaaccccccuucggggaguccuacaucgugaucggcgccggggagaaagcgcugaagcucagcugguucaagaagggcuccucgaucggcaaaauguuugaagcgacggcccgcggugcccggagaauggcaauccuaggcgacacggcgugggauuuuggauccauaggcggcguguucaccuccgucgggaaguuagugcaucagaucuuuggcaccgccuacgggguccucuucuccggggucucuuggacgaugaagaucgggaucggcgugcuccugaccuggcucggucucaauucccgcagcaccucacuguccaugaccugcaucgccgucgggcucgucaccuuauaccucggugugaugguacaggccgauagcgggugcgucauuaacuggaaaggccgggagcucaaaugcgggagcgguauuuucguaaccaacgagguccacaccuggaccgagcaguacaaauuccaggcggauagcccgaagcgccuuuccgcggccaucggcaaagccugggaggagggggucuguggcauucggagcgccacccgccuggagaacauuauguggaagcagaucuccaacgagcucaaucacauucugcuggagaacgggaugaaguucacggugguaguaggcgacguggccgggauccucgcgcagggcaagaagaugauacguccccagcccauggaauacaaguacagcuggaaguccuggggcaaggccaagauaaucggggccgacgugcagaacaccacguuuaucaucgacggccccaacaccccggagugccccgacgaccagcgcgccuggaauaucugggaagucgaggacuauggguuuggcaucuucacuaccaacauaugguuaaagcugcgggauuccuauacccagguuugugaucaucgccucauguccgcggcgaucaaggacagcaaagccgugcacgcggacaugggcuacuggauugaguccgagaagaaugagaccuggaagcuggcacgggcgagcuuuauagagguuaagacguguaucuggccuaagagucacacccucuggagcaaugggguacucgaguccgaaaugaucauucccaagaucuacggggggccgaucucacagcacaacuacagacccggcuacuuuacccagaccgccgggcccuggcaccugggcaagcuggagcucgacuucgaccucugcgagggcaccacugucguaguggaugaacacugcggcaaccgggguccuucccugcgcaccaccacggugaccgggaagauuauccacgagugguguugccggacgugcacgcuuccgccccuccgcuucagaggcgaagacggaugcugguauggcauggagauccgacccguuaaagagaaggaggagaaucucgucaagucaaugguguccgcgggcagcggggagguugacagcuucucccuuggccugcugugcaucuccauaaugaucgaggaggugaugcggucccgcuggagccggaagaugcucaugacggggacucuugcaguguucuuucugcucaucaugggccagcucacuuggaacgaccugauacgucucuguaucauggucggcgccaacgcguccgaccgcaugggcauggguaccacuuaccuggcccugauggccacuuucaagaugagaccuauguucgccguaggccuccuguuucgccggcugaccagccgagaaguguugcugcugacuaucgggcucucacuggucgccagcguggagcuucccaacagucuggaagagcucggggauggccuggcgaugggcaucaugauucucaagcugcugacagauuuccagagucaccagcucugggccacccugcuaaguuugaccuuuaucaagaccacguucagccugcauuacgccuggaagaccauggccaugguccugaguaucgugagccucuuuccccugugccuguccaccaccagccagaagacgaccuggcuucccgugcugcuggggucccucggcuguaagccacuaaccauguuuuuaaucgcagagaacaagaucuggggacggcgcagcuggccccucaacgaggggauaauggcaguagggaucgugucaauccugcugucuagccuccucaagaacgacgugccccuggcuggcccccucaucgccggcgguaugcucaucgcuuguuacgucauuaguggcagcuccgccgaccugagccuggagaaggcugccgagguuuccugggaagaagaggccgagcacaguggggcgucucacaauauccuaguggagguacaggacgacggcacgaugaagaucaaggacgaggagcgggacgacacccugacgaucuuacugaaggcgacccuccuggcggugagcgguguauacccgcugaguaucccggccacccuguucgucugguacuucuggcaaaagaagaagcagcggagcggcgugcucugggacacccccagcccgccagaaguggagcgggccguccucgacgacggcaucuaucgcauuaugcaacgcgggcugcugggccgcagccagguagggguuggcgucuuccaggagaacguguuccacacgauguggcacguuacccgcggcgcuguccucauguaccagggcaagagguuagagcccuccugggcgucggugaaaaaggaccuuaucagcuacgggggaggcuggcggcuccagggaagcuggaacaccggcgaggaggugcaagucaucgccguggaacccgggaagaaccccaaaaacgugcagaccgcccccggcacguucaagacccccgagggcgaagucggggcgaucgcccuggacuucaagcccggcaccuccgggagccccaucguuaaccgcgagggcaagaucgugggccuguacgggaacggcgucgugaccacgucggggaccuacgugagcgcgaucgcgcaggccaaggcaucacaggagggaccgcucccugaaauagaagacgagguguucagaaagcgaaaccugaccaucauggauuuacaucccgguuccggcaagacccggcguuaccucccggcuaucgugagagaggcuauaaagcgcaagcugcgcacgcugauccuugcccccacccgggugguugcaagcgagauggccgaggcgcugaagggcaugcccauccgcuaccagaccaccgccgucaaguccgagcacaccgggaaggagaucguggaccugaugugucaugcaaccuucacgaugcguuugcugucgcccguacgcgugccgaacuacaacaugauuaucauggacgaggcccacuuuaccgauccgucaagcaucgcugcgaggggcuacaucuccacucgcguugggaugggagaggccgccgccaucuucaugaccgccacaccgcccggaagcgucgaggcguucccgcaguccaacgccguuauccaggacgaggaacgggauaucccagagcgcagcuggaauucuggcuacgaguggaucaccgacuuccccggcaagacggugugguucguccccagcaucaagagcgguaacgacauagccaacugccugcggaagaacggcaagcgcguaauccagcucagccggaagaccuuugacaccgaguaccagaagaccaaaaauaacgacugggacuacguggucacaaccgacaucagugaaaugggggccaauuuucgcgcggaccgggugaucgacccgcggcggugccuuaagccggugauucugaaggacggcccggagcgcgucauccucgccggucccaugccggugaccguggccagcgccgcccagcggagaggccggaucggccgcaaucacaauaaggagggagaccaguacauuuacaugggccagccccugaacaacgaugaggaccacgcgcacuggaccgaggccaagaugcugcucgacaauaucaauacgcccgaggguaucauccccgcccuguucgagccggagcgcgagaaguccgccgccaucgacggggaguaccguuuacgcggggaggcgagaaaaacauucguggagcucaugcgccguggcgaucugcccgugugguuaaguuauaaggucgccagcgagggcuuccaguauucagacagacgguggugcuucgauggggaaaggaacaaccaggugcucgaggagaacauggacguugaaaucuggaccaaagagggugagcgaaagaagcugcgcccaagauggcuggaugcccgcaccuacagugauccuuuagcgcugcgagaguucaaggaguucgccgcgggacgcagguccguaagcggcgaccugauccuugagaucggcaagcugccgcagcaccugacgcagcgcgcccagaacgcguuagacaaccucguaaugcugcauaacagcgagcagggcgggcgggccuaccgccaugccauggaagagcuccccgacaccaucgagacccuaauguugcuggcccugaucgccgugcucaccgggggcgucacccuguucuuccugaguggucggggacugggcaagacguccaucggccucuugugcgugauggccaguagcgugcugcucuggauggccagcgucgagccccacuggaucgcggccuccaucauccucgaguucuuccuuauggugcuccucauacccgagccagauagacagcggacgccccaggacaaccagcuugccuacguggugaucggccugcuguucaugauccugaccguggccgccaaugagauggggcuccucgagaccacaaagaaggaccuuggaauagggcacguggcggucgagaaccaccaccacgcggccaugcucgacguggaccugcacccugccucggcuuggacgcuguacgccguggccaccaccaucaucacaccgaugaugcgccauacgauagagaacaccaccgcaaacaucucccucacggccauagccaaccaggcggccaucuugaugggccuggauaagggcuggcccaucagcaagauggacaucggugucccccuccuggcccugggcuguuacucccagguuaacccccucacccugaccgccgcggugcuaaugcuugucgcccacuacgccauuaucgggccgggccugcaggcaaaggccacccgggaggcgcagaagaggacugccgccgggaucaugaagaacccaacgguggauggaaucgucgccaucgaccucgaucccguaguguacgacgccaaauucgagaagcaguugggccagaucauguugcugauccucuguaccagucagauccuucugaugcgcaccacgugggcgcucugcgaguccauuacccuggcgacagggccccugaccacacucugggaaggcagcccggggaaguucuggaacaccaccaucgccgucuccauggccaacaucuuccggggcuccuaucuggcuggcgcagggcuugccuucuccuuaaugaagucccugggcggaggccgccggggcaccggcgcccagggugagacacugggugaaaaguggaagcgccaauugaaccaacugagcaaguccgaguuuaauaccuacaagcggagcggcaucauggagguagaccgaucugaggccaaggaggggcugaagcggggcgagacgaccaagcacgcgguaucccgcgggacggccaaguugcggugguucguggagagaaaccuugucaagcccgagggcaaagucaucgaccugggcugcgggcggggcggguggucauacuacugcgcaggacugaagaaggugaccgaggugaagggguacaccaagggcggccccgggcacgaggagcccauuccaauggccaccuacggcuggaaucucgugaaauugcacagcgggaaggacguuuucuucaucccgcccgagaagugcgacacgcugcucugugacauaggcgagucuucgccuaacccgaccaucgaggaaggucgcacccuucguguacugaagaugguugaacccuggcuccguggcaaccaguucugcaucaagauccugaacccauacaugcccuccguggucgaaacccuggagcaaaugcagcggaagcacgggggcaugcucguacgcaacccuuuaagccgaaauuccacccacgagauguauugggugagcuguggaacggggaacaucgucuccgccgugaacaugaccagccgcaugcucuuaaaucgcuucacuauggcgcaucgcaagcccaccuacgagagggacguggaccugggugccggcacgcggcacguggccguggaacccgagguggccaaccuggacaucaucgggcagcgcauagagaacauuaagcacgagcacaaguccaccuggcacuaugacgaggacaacccuuacaagaccugggcguaccacggaaguuacgagguaaagccguccggguccgcgucuagcauggugaauggcgucguuaagcuucugacuaagccaugggacgugauaccaauggucacucagaucgccaugaccgacaccacacccuuugggcagcaacggguguucaaggagaagguggacacgagaacccccaaggccaaacggggcaccgcccagaucauggaggucaccgccaaguggcuguggggcuuccucucaagaaacaaaaagcccagaaucugcaccagggaagaguucacccggaagguucgcuccaacgcggccaucggugccgucuuugucgaugagaaccaguggaauagcgccaaggaagcaguggaggacgaacgguucugggaccuggugcacagggagcgagagcugcacaagcaggggaagugcgccacuugcguauauaacaugaugggaaagcgcgagaagaagcugggcgaauucgggaaggccaagggaagcagagccaucugguacauguggcugggcgcccgcuuccuggaauucgaggcgcuuggguucaugaacgaagaccauugguuuagccgagagaauucccuaagcggcguggagggugagggccugcacaagcucgguuacauauuacgcgauauuuccaagaucccgggcgggaacauguacgccgacgacaccgccggcugggacacgagaaucaccgaggacgaccugcagaaugaggcccgcaucaccgauaucauggagccggaacaugcccuucuugcacgcagcaucuucaagcugaccuaucagaacaaggucguccgggugcaacgccccgccaagaauggcacgguuauggacgucaucucccgaagagaucagcggggcagcggacaggugggcacauaugggcucaacaccuucaccaacauggaagcgcagcugauacgccagauggagucggagggcauauucagcccguccgagcuggagacucccaacuuggcugaacgggugcuggacuggcucgaaaaauacggggucgaacggcuuaagcgaauggccaucuccggcgaugacugcguagugaagccuaucgacgaucgcuuugcgaccgcccugaccgcccugaaugacauggggaaggucaggaaagacauuccccagugggagccuuccaagggauggaaugacuggcaacaggucccuuucugcagccaccacuuccaccagcucaucaugaaagacgggagagagauagucgucccgugccggaaucaagacgagcugguggggcgcgccagaguaucccaaggcgccggcuggagcuugcgcgagaccgcgugccucggcaagagcuacgcccaaauguggcagcugauguacuuccauagacgcgaccugcggcucgccgccaacgcgauuugcuccgccguccccguggacuggauccccacuagccguacuaccugguccauccacgcccaccaccaguggaugaccacagaggacaugcugagcguguggaacagaguguggaucgaggagaaccccuggauggaagacaagacccauauuucaucguggggggacgugccauaccuggguaagcgggaggaucaauggugcggcucgcuuauuggguugaccgcccgggccaccugggcgacaaacauccagguagccaucaaucagguccggagguuaaucggcaacgaaaauuaccucgacuacaugacgucaaugaaacgguucaagaaugaguccgaccccgagggggcucugugguga

SEQ ID NO: 24419 - RNA, 9879 nt, Artificial Sequence
  derived and/or modified CDS sequence (opt11) from DENV-1__GU131697__SS-prME
uccgugaccaugcuccucaugcugaugccaaccgcccuagcguuccaccucaccacgcggggcggcgagccccauaugaucgugucuaagcaggagcggggcaaaagccugcuguucaaaacguccgcggggguuaacaugugcacccugaucgcuauggaccugggcgaacugugcgaagacacgaugaccuauaaaugcccccgcaucacugaggccgagccagacgacguggauugcuggugcaacgccacugacacuugggugaccuacgggacuugcagccaaaccggcgagcaccggcgggauaagagguccguugcccucgcuccccacgugggccugggccuggagacgcgcaccgagaccuggaugagcucggagggagccuggaagcagauucagcgggucgagaccugggcccuccgccaucccggcuuuaccgugaucgcccuguuccuggcccacgcuaucggcaccagcaucacucagaaggggaucaucuuuauccuccucaugcuaguaacccccaguauggccaugcggugugucggcauuggcagucgugacuucguggaagggcucuccggcgccaccuggguggaugucguucuggagcacgggagcugcgugaccacaauggccaaggauaagcccacccuggacauugagcucuugaagacggaggucaccaacccugcgguccugcgaaagcucugcauugaagccaagaucuccaacacuacgacggacagccgcugcccgacccagggcgaggccaccuugguggaggaacaggacgccaacuucgucugccgacgcacuuucguggaccgggggugggggaacggcugcgggcuguucgguaaggggucccucauaacaugcgccaaauucaagugcguuaccaagcuggagggcaagaucguccaauaugaaaaccugaaauacagugugauugugaccguacacacgggugaccaguaccaggugggcaacgagucuacugagcauggcacaaccgcgaccaucacgccccaagccccaaccacggaaauccagcucacggacuacggugcccugacccuggacugcagcccccgcacgggacucgacuucaacgaaaugguucugcugaccaugaaagagaaguccuggcuagugcacaagcagugguuccuggacuuaccccuccccuggaccagcggggcgagcacuagccaggagaccuggaacaagcaggaccugcugguaaccuucaaaacggcgcacgcgaagaagcaggaagucguuguucucggcagucaggagggggccaugcauaccgcccuuaccggagccacggaaauccagaccuccggcaccacgacuaucuucgccgggcacuuaaaguguagacugaaaauggacaaauugacacucaaaggcaugucauacgucaugugcaccggcuccuucaagcucgagaaggagguggcagagacgcagcacggcaccguucugguccagaucaaguacgagggcaccgacgcccccugcaagauaccauucaguacccaagacgagaagggggugacccagaacggccgccucaucaccgccaacccgaucgugacugauaaagagaagccagucaacaucgaggccgagccaccuuucggggaauccuacaucgucaucggcgccggagagaaggcccugaaacucucuugguucaagaagggguccucaaucggcaagauguucgaggccaccgcccgcggagcucgucggauggcgauccuaggagacacggccugggacuuuggguccaucggcggcguguucacuagugucgggaagcugauucaccagaucuucggcaccgccuacgggguucuguucuccggcgugagcuggaccaugaagaucgggauaggcguccugcugacgugguugggacuaaacucccgcagcaccucccugucgaugaccugcauagccgugggccucgugacccuguaccugggcgucauggugcaggccgacuccgggugcgugaucaacuggaagggucgagagcucaagugcggguccggcaucuucgucacuaacgaagugcauaccuggaccgagcaauacaaguuccaggcugauaguccgaagcggcuguccgccgccaucggcaaggccugggaggagggggucugcggaauccggagcgcgacccgguuagagaacaucauguggaagcagaucuccaacgaguuaaaccacauccugcuggagaacgacaugaaguugaccgucguugugggagacgucgccggcauucugggccagggcaaaaagaugauccguccccagcccauggaguacaaguacagcuggaaguccuggggcaaggcgaagaucauaggcgccgacgcgcagaacacgaccuucaucauagacggccccaacacuccggaaugccccgacgaucagcgggcguggaauaucugggagguggaggacuacggcuuuggcauuuucaccacgaacaucuggcugaagcuccgagauucauacacccaggugugcgaccaccggcugaugagugccgccaucaaggauagcaaggccguccacgcugacauggguuacuggauagagucggagaaaaaugaaacguggaaacuggcccgcgccagcuucaucgagguaaaaaccugcaucuggcccaagagccacacgcucuggagcaacggagugcuggaguccgagaugaucauccccaagaucuacgggggcccuauuagccagcacaacuaccggcccggguauuuuacccagaccgcugggccguggcaccugggcaaauuggagcuggacuuugaccugugcgagggcaccacggucgugguggacgagcauugugggaaccggggcccgucauuacggacaaccaccgucacggggaaaauaauccaugaguggugcugccggagcuguacucucccgccguugagauuccguggggaggauggguguugguacggcauggagauccggcccguuaaggagaaggaggagaaccucgucaaauccauggucagcgccggcagcggugagguggacuccuucagccugggcuugcucugcaucuccauuaugaucgaggaggugaugcgcucucgguggucccguaagaugcugaugaccgggacccuggccguauucuuccuccugaucaugggucaguuaacuuggaacgacuugauccggcugugcaucauggugggggccaacgcuuucgaucgcaugggcauggggacgacauaccuagcccucauggcuaccuucaagaugcgcccgauguucgcuguggggcugcuguuccggagacucacaagccgggagguacugcugcucaccaucggccuaucccuagucgcgagcguagagcuccccaauucccuggaggagcugggggacggccucgcaaugggcaucaugauccugaagcugcucaccgacuuccagagccaccaacugugggcuacucuucuaucccugacguuuaucaagacaaccuucagcuuacauuacgcguggaagaccauggcgaugguguuauccaucgugagccuguuccccuuaugccucuccaccaccucacagaagaccaccuggcugcccgugcuguuggguuccuuagggugcaagccacugacgauguuccugaucgccgagaauaagaucugggggaggaagagcuggccccugaacgaaggcaucauggccguggggaucguguccauacugcucagcagccugcugaaaaacgacgucccgcuagccggcccccucauagcuggcgggaugcugaucgcaugcuacgugaucuccggcagcucugccgaccucagccuggagaaagccgccgaggugucuugggaggaggaggccgagcacucgggugcgucccacaacauccuggucgaggugcaggacgacggcaccaugaagaucaaggacgaggaacgggacgauacccucaccaucuugcucaaggccacccuccuggccgugucugggguguauccgcucucgauucccgccacccucuuugugugguacuucuggcagaagaagaagcagcgcagcggugugcuuugggauacccccagcccccccgaggucgagcgugccgugcuggacgacgguaucuaccgcaucaugcagcgggggcugcucggccgcagccaggucgggguagggguguuccaggagaacgucuuccacaccauguggcaugucacccgcggagccgugcugauguaccaaggcaagagacuggagcccucgugggcaucagugaagaaggaccucauaucguacggcgggggcuggcggcugcgcggcuccuggaacacuggagaggagguccaggugaucgccguggaacccgggaagaaccccaagaacguacagacagcccccggaaccuucaagacgcccgagggcgagguaggggcuaucgcgcuggacuucaagcccggcacuuccgggucucccaucgugaaccgggagggaaagauugucggucuuuacgguaauggcguggugaccacguccgggaccuacgucagcgccaucgcgcaggcgaaggcgagccaggagggcccgcuaccggagauagaggacgagguguuccgcaaacggaaccugacgaucauggaccuccaccccggguccggaaagacccgccgcuaccugccagccaucguccgagaggccaucaaacggaagcugcgcacucucauccuugccccgacgcgcguuguggccagcgagauggcggaagcccugaagggcaugcccauucgguaccagacgaccgccgugaaauccgagcacacagggaaggagaucguagaccucaugugccacgccaccuucacaaugcgccugcucagccccgugcgaguaccgaacuacaacaugaucauuauggaugaggcccauuucaccgaccccuccucaaucgcugccaggggcuacaucucuacaagaguggggaugggcgaggcugccgcuaucuucaugacagcgacgccgccugggagcguggaggccuucccgcaguccaacgcagugauccaggacgaggagcgagacauuccggagcgaucauggaacagcggccacgaguggaucaccgacuuccccggcaagaccgucugguucgugcccagcaucaaauccgggaaugauaucgccaacugcuugcggaagaacggaaagagagugauccagcugagccgcaagacuuuugacaccgaguaccagaagaccaagaacaacgacugggacuacguaguaacuaccgacaucuccgagaugggagcaaauuuccgggccgaccgcgugaucgacccgcggcgcugccugaagcccgucaucuugaaggacggcccagagcgggugauccuggccgguccaaugccuguuaccgucgcgucugccgcgcagcgccggggccgcaucggccggaaucacaacaaggagggggaccaguacaucuacaugggacagccccugaacaacgacgaggaccacgcgcacuggaccgaggccaagaugcuauuggacaacaucaacacgccggaggggaucauccccgccuuguucgagccggagcgcgagaaaucggccgcgguagacggggaauaccgccuccguggggaggcccggaagaccuucgucgagcuuaugcgucgcggagaccuucccguguggcucagcuacaagguggccucagaaggguuccaguacucggaccggcgcuggugcuucgacggggagcggaacaaccagguacuggaggagaauauggauguggagaucuggacgaaggaaggugagcgcaagaagcugcggcccagauggcucgaugcccggaccuauagcgacccccuggcccugagggaguucaaggaauucgcggccgggcggcguuccguuagcggagacuugauacucgaaaucggcaagcugccgcagcaccuuacccagagagcccaaaacgcacuggacaaccugguuaugcuccacaacucagagcagggagggagggcguaccgacacgccauggaggaguugcccgacaccaucgagacgcugaugcucuuagcacugaucgcgguacucaccggaggcgugacccuguucuuccugagcgggcguggccucggcaagaccuccauuggacugcugugugucauggccagcucagugcuccuguggauggcauccguggagccccacuggauagccgcgucuaucauacuggaauucuuccucaugguccugcugauccccgagccggaccggcaacgcacgccucaagacaaccagcucgccuacgugguaauaggccugcuguuuaugauccucacaguugcggcuaaugaaaugggguuguuagagaccaccaagaaggacuuaggcaucgggcacguggccguugagaaccaucaccacgcggcaaugcuggacguggaccugcaccccgccagugcguggaccuuauacgccguggccacgaccaucauuacgccgaugaugcggcacaccaucgagaauacgaccgccaauaucucccugaccgccaucgcgaaccaggccgccauccuaaugggccucgacaagggcuggcccaucaguaagauggacaucggggugccccugcuggcccugggcugcuacucccaagucaacccucugacgcucacugcggccguguuaaugcugguggcccauuacgccauaaucgggccggggcuccaggccaaggcaacccgggaggcccagaagcgcaccgccgccgggauaaugaagaaccccacagucgauggcauaguagccaucgaucuagaccccguugucuaugacgcgaaauucgagaagcaacuggggcagaucaugcugcucauacuaugcacgagccagaucuugcucaugcgaaccacgugggcccucugcgaguccaucacccucgccacggggcccuugaccacacucugggaaggcagcccggggaaguuuuggaacaccacgaucgccguguccauggccaacaucuuuagaggcagcuaccuggcgggcgccgggcucgcauucucucucaugaagucccugggcggaggcaggcgcgggaccggagcccagggcgaaacgcucggggagaaauggaaacggcagcugaaccagcugucgaaguccgaguucaacaccuacaagcgcagcggcaucauggaaguggaccguuccgaggcgaaggaggggcucaagcguggcgagacgaccaaacacgccgucucccgggggacggccaagcugcgcugguucguggagcggaaccuggugaagcccgaggggaaggucaucgaccucggcugcgggcgcggcgguugguccuacuauugcgccggccucaagaaggugaccgaggugaagggguacacgaaaggcgguccaggucacgaggagccgaucccgauggcuaccuaugguuggaaccuggucaaauuacacagcgguaaggacguuuucuucaucccuccggaaaagugcgacacccuacugugugacaucggcgaguccucccccaauccgacgauagaggagggacggacgcugcgcgugcucaagauggucgagccuuggcugcgaggcaaucaguuuugcauuaagaucuuaaaccccuacaugcccucagugguggaaacgcucgagcagaugcagcgcaagcauggcgggaugcugguccggaauccgcugucccgcaacuccacgcacgagauguacugggugagcuguggaacagggaacaucguguccgcggucaacaugacgagucggaugcuccugaaccgcuuuacuauggcccaccgcaaaccuacuuaugagcgggauguggaccugggaacgggcaccaggcacguagcgguggagcccgagguggccaaccuagacauuauugggcaacggaucgagaacaucaagcacgagcacaaaagcacguggcacuacgacgaggacaaccccuauaaaacgugggccuaccacggcagcuacgaggugaagccauccgggucugcaaguagcauggucaacggcguggucaagcuguugaccaagcccugggacgugauucccauggucacccagaucgcaaugacggacacgacacccuucgggcagcagcgcgucuucaaggagaaaguggacacucggacgccgaaggccaagaggggcaccgcccagaucauggaggugaccgcccggugguuauggggcuuccugagccgcaacaagaagccccggaucugcacaagggaagaguucacucguaagguccgcaguaacgcggcuauaggggccguguucguggacgagaaccaguggaacagcgccaaagaggcgguagaggacgaacgguucugggauuuggugcaccgcgagcgugagcuccauaagcaaggcaagugcgcgacuuguguguacaauaugauggggaagcgcgagaagaagcugggcgaguucggcaaggccaaagguucccgggccauaugguauauguggcuaggugcccgcuuccucgaguucgaggcgcugggguucaugaacgaggaucacugguucagccgggagaauagcuuaagcggcguggagggggagggccuccacaaacugggguacauccugcgcgacaucuccaagauccccgggggcaacauguacgccgacgauacagccgggugggacacccgaaucacggaggacgaccuccagaacgaggccaagaucaccgacaucauggagccggaacacgcccugcuggcgaaggccauuuucaagcuuaccuaccagaacaagguggugcgcguucagcgccccgcgaagaauggcaccgugauggacguaauaagcagacgugaccaaagggggaguggccaggucggcacuuaugggcugaauaccuucaccaauauggaagcccagcuuauccgccagauggaaagcgagggcaucuucuccccuagcgagcucgagacacccaaccuugcggagagggcgcuggacuggcucgagaaguaugguguagaacgccugaagcggauggcuaucuccggcgaugauugcguggucaagcccaucgacgacagauucgccacggcgcugaccgcacucaacgacauggggaaggugcggaaggacaucccccaaugggagcccagcaagggcuggaacgacuggcagcagguucccuucugcagccaccacuuccaccagcugaucaugaaagacgggcgcgaaauugucgugccgugccggaaucaagacgagcugguggggcgcgcgcgggucagccaaggcgccgggugguccuugcgcgagaccgcaugccuaggcaagagcuacgcucagauguggcaguuaauguacuuccaccgccgcgacuugcggcuggccgcaaacgccaucugcuccgcagugccuguggacuggguuccuaccaguagaacgaccuggagcauccacgcgcaccaucaauggaugacaacggaggacaugcuguccguguggaacaggguguggauugaggagaaccccuggauggaggauaagacccauauaagcuccugggaggacguuccguaccucgguaagcgcgaagaccaguggugcggaagccucaucggccuuaccgcgcgcgccacuugggccaccaacauccagguagccaucaaccaaguccggcgcuuaaucgggaacgagaauuaccuggacuauaugacauccaugaagcgguuuaagaaugagagcgacccagagggcgcgcugugguaa

SEQ ID NO: 24420 - RNA, 9879 nt, Artificial Sequence
  derived and/or modified CDS sequence (opt11) from DENV-1__GU131700__SS-prME
agcgugaccaugcuucuuaugcugaugcccaccgcccuggccuuucaccuaacuacccgaggcggagaaccgcauaugaucguguccaagcaggagcggggcaagagccuguuauuuaagaccucagccgggguaaacaugugcacccucaucgccauggaucugggcgaguucugugaggauacgaugaccuauaaaugcccccgcaucacggaagccgagccugaugacguggacugcugguguaacgccaccgauacgugggugacguacggaacgugcagccagacaggcgagcaccgccgggauaagcgguccguggcccuggcgccccacgugggccucgggcuggaaacgcgcaccgaaaccuggaugagcagugaaggcgcuuggaagcaaauccagcggguggagaccugggcccuucgccaccccgguuuuaccgugaucgcccucuuucuggcgcacgccaucggcaccagcaucacccaaaaaggaaucaucuucauccuucucaugcuuguaacacccuccauggccaugcgcugcgucgguauaggcucccgcgacuucgucgagggacuguccggugccacuuggguagacgucgucuuagagcacgggagcugugugacuaccauggccaaggacaagcccaccuuggacaucgagcugcuuaagacggaggucaccaaccccgcgguauugcggaagcugugcaucgaggccaagaucucuaacaccaccacggacucccguugcccgacccaaggcgaagccacgcucguggaagaacaggacgccaacuucgucugcaggcgcacguucguggaucguggcugggggaacggcugcggccuuuucgggaaaggguccuuaaucacgugugccaaguuuaaaugcguuaccaagcuugagggcaagaccguacaguacgagaaccugaaauacuccgugauuguuaccguucauacgggcgaccagcaccagguugguaaugaguccaccgaacacggcaccacugcgaccaucacuccccaggcccccagcacggaaauacaacugaccgauuacggggccuuaacgcuggauugcagccccaggacaggccuggacuucaaugagaugguccuccugacuaugaaggaaaaguccuggcugguacacaaacagugguuccuugaccugccucugcccuggaccaguggcgcguccaccagccaagaaacuuggaaccggaaggaccuacuagugacuuucaagacugcccaugcgaagaagcaggaggucguugugcuggggucccaggagggcgcgaugcacacggcccuuacgggggccacugaaauccagaccucugguaccacgaccauauucgccgggcaccugaagugccgccugaagauggacaagcuaacccugaaaggcaugucauacgucaugugcaccgggagcuucaagcuggagaaggaaguggcggagacgcaacacggcacaguccucguccaaaucaaguacgaggggacugacgcccccugcaagauaccuuucagcacacaggaugaaaaggggguuacgcagaacggccggcuaaucaccgccaacccgaucgugaccgacaaggagaagccuguaaacaucgaagccgagccgcccuuuggggagagcuauauaguuauuggugcaggcgaaaaggcccugaaauugaguugguucaagaaaggcagcuccaucggcaagauguuugaggccaccgcccgcggggcucguaggauggcuauccucggugauacagccugggacuucggcaguaucggcggcguguucaccuccguuggaaagcuugugcaucaaauauucgggaccgcauacgggguacuguucagcggcgucucuuggaccaugaagauugguaucggcguucuccugacguggcugggccuuaauagucgcuccaccagccugucgaugaccugcaucgccgugggccuggucacccucuaccugggcgugauggugcaggccgacuccggaugcgucaucaacuggaagggccgagaacucaagugcgggucuggcaucuucguuacgaacgaggugcacaccuggaccgagcaguauaaguuccaagcugacuccccgaagcgccucagugccgccauaggcaaggccugggaagaggggguaugcggaauucgguccgcuacccgcuuagagaacauaauguggaagcagaucucaaacgagcugaaccacauccuacuggagaaugacaugaaguuuacugucguggucggggacgucgcgggcauccuggcccaagggaagaagaugauccgaccccaaccaauggaauacaaguacaguuggaaguccuggggcaaggccaagauuaucggagccgacgugcaaaacacgaccuucauaaucgacgggcccaacaccccugagugucccgaugaccagcgugccuggaacauuugggaagucgaggacuauggcuucggaauauucaccaccaacauaugguugaaacuccgggacucccacacccaggugugcgaucaccggcugaugagcgccgcgaucaaggacuccaaggcaguucaugccgacaugggcuacuggaucgagagcgagaagaaugaaaccuggaagcucgcgcgggcaucuuucaucgaagucaagaccugcaucuggcccaagagccacacccugugguccaauggcgugcuggagagcgagaugaucauacccaagaucuacgggggcccgaucucccaacauaacuaccgccccggguacuucacccagaccgccggccccuggcaccucgggaagcuggagcuggacuucgaucuuugcgagggcaccacgguggucguggacgaacacugcggaaaccgggguccgucacuucgcacuaccaccgugacuggcaagaucauccaugaguggugcugccgguccugcacgcugccgccccugcgcuuuaagggggaggauggauguugguacgggauggagauccggcccgugaaggagaaagaggagaaccugguuaagagcauggugucagccgguucaggcgaggucgacagcuuuagucuggggcuccugugcauuagcauaaugaucgaagaggugaugcgcucccgguggucucgcaagaugcucaugaccggaacccuggcaguguucuuccuucugaucauggggcaacuuacguggaacgaccugauccggcugugcauuaugguaggcgccaacgcgucagacaggauggggauggggaccaccuaccuagcgcugauggcuacuuucaagaugcggccaauguucgccgugggcuugcuguuucggcgcuuaacgucgcgggaggugcugcuccuuacuauaggccugucccucgucgcgucuguggagcugcccaauucccuggaggaguugggcgacgggcuggcuaugggcaucaugauucucaagcuccugaccgacuuccaaagccaccaguuaugggccaccuugcuauccuugacguuuauaaagacaacauuuagccuccacuacgccuggaagaccauggcgaugguccuguccauugugucacuguucccacucugccugagcacuaccucgcagaagaccacauggcugcccgugcuccuggguucccuggguugcaagccauuaacgauguucuugaucgccgaaaacaagauauggggcaggaaauccuggccucugaacgaggggaucauggccgucgggauaguguccauccuccuguccagccugcucaaaaacgacgugcccuuagcugggccccugauugcggguggcaugcucaucgcauguuaugucaucuccggguccuccgcugaccugagccuggagaaggccgcggaaguguccugggaagaggaggcagaacauagcggagcgucccacaacaucuugguggaagugcaagacgacgggaccaugaagaucaaggaugaggagcgcgaugacacccugaccauccugcucaaggccacuuugcugacaguaagcggcguguauccgcucuccauucccgccacccuguuugugugguacuucuggcaaaagaagaagcaacgcagcggggugcugugggacacacccagcccgcccaagguggaacgggcuguccucgaugaugguaucuaccgcaucaugcagcggggacugcuagggcgcucucaagugggcgugggggucuuccaggagaacguguuccacaccauguggcacgugacucggggcgccgugcugauguaucaggggaagcgccuugagccauccugggcgagcgugaagaaggaccuuaucuccuaugggggaggguggagacugcaaggcagcuggaacaccggggaggaggugcaagucaucgccguggaacccggcaagaacccuaagaacgugcagacggcccccgggaccuucaaaaccuccgagggggaggugggcgcuaucgcucucgacuucaagcccgggacgucgggaucacccauuguaaaccgcgaggggaagauugucggacuguacggcaacgggguagugaccacgucaggaaccuacguuagugcgaucgcccaggccaaagcgucccaggagggcccccugccggagaucgaggacgagguguuccggaagcgcaaccucaccaucauggaccugcacccagguagcgggaagacaaggagguaccuacccgcgaucgugcgggaggccaucaagcggaaacuccguacucugauucuagccccuacccgcgugguagcguccgagauggccgaggcguugaagggaaugccuaucagguaucaaaccacugccgucaagucugagcacaccggcaaagagaucguggacuugaugugucacgccacauucaccaugcgguugcucucccccguccgcgugccuaauuacaauaugauuauuauggaugaagcccacuuuaccgacccgaguagcauugccgcgcggggauacauuaguacccgagugggcaugggggaggccgccgccaucuuuaugaccgcgacgccgcccggcuccgucgaagcguucccccaaaguaacgccgugauccaggacgaggagcgcgacauaccagaacgcuccuggaacagcggguacgaauggaucaccgacuucccaggcaagaccgugugguucgucccgucuaucaagagcggaaacgacaucgccaacugccugcggaagaacggcaaacgcgugauccaauuaucgcguaagacuuucgacaccgaguaucaaaagacaaaaaacaacgauugggacuauguggucaccacggacaucucagagaugggcgccaacuuccgcgcggaucgggugaucgacccccgcaggugccuaaagccggugauccugaaagacggucccgagcgcgucauacuggcaggccccaugcccgugacagucgcauccgccgcccagcggcgcgggcguaucggccgcaaucacaacaaagaaggcgaucaguacauauauauggggcagccgcuaaacaacgacgaagaccacgcgcacuggaccgaggccaagaugcuuuuagacaacaucaacaccccggagggcaucaucccugcccucuucgagcccgagcgggagaaguccgccgccaucgacggggaguaccgacugcgcggcgaggcgagaaagacguucguggagcugaugcgcaggggggaccuaccuguguggcugagcuauaaagucgcauccgagggcuuucaguauagcgaccgccgguggugcuuugauggcgagcgaaauaaccaaguacuggaggagaauauggacguggagauauggacaaaggaaggggagcgcaagaagcuucgaccccgguggcuggacgcccgcacuuacagcgacccgcuggcccuccgggaguuuaaggaguucgccgcgggccgccggucugugaguggggaccugauccuggagaucgggaagcucccccagcacuugacccagcgcgcccaaaacgcauuggauaaucucgugauguuacacaacucggagcaaggcggccgagcuuaucgccacgcuauggaggaacuuccggauacgauugagaccaugaugcuccuugcacuuaucgccgugcuuaccggcggggucacccucuucuuucuguccggccgggggcugggcaagaccaguaucgggcugcugugcgugauggcauccaguguguugcuguggauggccuccgucgaaccgcacuggaucgcagcgagcaucauccuagaguucuuccucaugguacuucuuaucccggagcccgaccgccaacggacgccacaagauaaccagcuggccuauguggucauaggccugcuuuucaugauacuuacgguugccgcgaacgagaugggccugcucgagaccaccaagaaggaccucgggaucggacacguggccgucgagaaucaccaccacgccgccaugcuggauguugaucugcaccccgcguccgccuggacacucuacgcgguggccacaaccauaaucacgcccaugaugcgccacacuaucgaaaacaccaccgccaauauaucucugacggcaaucgccaaucaagcagcaauccugaugggguuggauaagggguggccgaucuccaagauggacauaggcguaccccugcuggcccucgguugcuacucacaggugaacccacuuacgcugaccgcugcaguccucaugcuggucgcccauuacgcaaucauuggacccggguuacaggcaaaggcgacgcgggaggcgcaaaagagaaccgccgccggcauuaugaagaacccgacgguggacgggaucguggcaaucgaccucgaccccguaguguacgacgccaaguucgaaaagcagcugggccagauaaugcuguuaaucuuaugcaccucccagauacugcucaugcguacuaccugggcucugugcgagucuaucacgcuggcuaccggccccuuaacaacccugugggaaggauccccaggcaaguucuggaauacgaccaucgccgugagcauggccaauaucuuccgggguagcuacuuggccggcgcgggccucgccuucucgcugaugaagucccucgguggcgggcgccgggggacuggggcccagggcgagaccuuaggggagaaguggaagcgccagcuuaaucagcucucgaagagcgaguucaacacuuacaagcgcuccgggauaauggaggucgaucgcagcgaggccaaggagggucucaagcgcggggagacgacaaagcacgcggucucccgcggcacagcaaaguugcgcugguucguggagcguaaccuggucaagccggaggguaaaguuaucgaccucggcuguggccgcggugguuggucguacuacugcgcagggcugaagaaagugacggaggucaagggguacacuaaaggcgggcccggccaugaagagcccauccccauggccaccuacggcuggaaccuuguuaagcugcacaguggaaaggacguguucuucaucccgcccgaaaaaugcgacacccuccugugcgacauaggagagagcuccccgaacccuacgaucgaggagggccgcacguuacggguccuuaagaugguggagccguggcuccgcggaaaucaguucugcauaaagauccuaaauccauacaugccaaguguugucgaaacucuugagcagaugcaacggaagcacggcgguaugcuggugcgcaacccgcugucgcggaauagcacccacgagauguacuggguguccugcggaacuggcaauaucguuagcgcaguaaauaugacuucgcgcaugcuccucaaccgguucaccauggcgcaccguaaaccaacguacgaacgggacguggaucugggggccggcaccaggcacgucgccguggagccggagguggccaaccucgacaucaucggccagcgaauugagaacaucaaacacgagcacaagagcacguggcacuaugaugaagacaaccccuacaagaccugggccuaccacggguccuaugagguaaagccuagcggcucagcguccagcauggugaacgggguagugaagcuguugaccaaacccugggacgugaucccgauggucacccaaaucgcaaugacggacacaacccccuucgggcagcagaggguguucaaagagaagguggauacccguacgccaaaggccaaacgugggacagcccagaucauggaggucaccgcaaagugguuauggggcuuccugagccguaacaagaagccgagaauauguacucgggaggaauucacccggaaggugcgcagcaacgcugcgauaggagccguguucguugacgagaaccaauggaacucagccaaagaggcaguggaagacgaaagauucugggaccucgugcaccgugagcgugagcuccacaaacaggggaagugugcgaccugcgucuacaacaugauggggaaacgggagaaaaagcugggagaguucggcaaagccaaggggagccgggccaucugguacauguggcugggugcacgcuuccucgaauucgaggcgcugggcuucaugaacgaggaucacugguuuucccgugaaaauagccuguccgggguggagggcgaggggcuucacaagcugggcuauauccugcgagacaucagcaagauccccgggggcaauauguacgccgacgauacggcggguugggacacgcggaucacggaggacgaucuccagaacgaagcaaagauuaccgacaucauggagcccgagcacgcccugcuugcgaaguccaucuucaagcucacauaucagaacaagguggucagggugcagcggccggccaagaacgggaccgugauggacgucaucagcagacgcgaccaacggggcucgggacaggucggcacguacggauugaauacguucacgaacauggaggcccagcugauccgccagauggagagcgaggggaucuuuagucccagcgagcuggagaccccgaaccuggcccggcgaguucuagacugguuggagaaacacggagucgagagacugaagcgcauggccauauccggggacgacuguguaguaaagccgaucgacgaucgcuucgcuacagcacuuacugcccucaacgacaugggcaagguccgcaaggacauaccgcagugggagcccagcaagggguggaacgacuggcagcaaguccccuucuguucccaccauuuccaccagcugaucaugaaggacggccgggaaaucgugguccccugcaggaaucaggacgagcugguugggcgagcgcgcgugucgcagggugcaggcuggagccuccgggagacugcgugccuagggaaguccuacgcccaaauguggcagcugauguacuuccaccgccgggaccuccgccuagcagcgaacgccauuugcagcgccgucccgguggacugggugcccaccucccggacgaccuggagcauacacgcccaccaccaguggaugaccacugaggauaugcugucaguguggaaccgcguuuggaucgaggaaaaucccuggauggaggacaaaacacacaucagcucuuggggagaugugcccuaccucgguaagcgugaggaucaauggugcggcucgcuuaucggacugaccgcgcgcgccaccugggcgaccaacauacaggucgccaucaaccaggugcgccggcucauagggaacgagaauuaccuggauuacaugaccuccaugaagcgcuucaaaaaugaaucugacccugagggcgcguugugguag

SEQ ID NO: 24421 - RNA, 9879 nt, Artificial Sequence
  derived and/or modified CDS sequence (opt11) from DENV-1__GU131701__SS-prME
uccgucaccaugcugcucaugcugaugcccaccgccuuggccuuccacuugacuacccggggcggggaaccccauaugaucgugagcaagcaggaacgggguaagagccuguuauuuaagacuucggccggagugaauaugugcacccucaucgccauggacuugggugaacucugcgaagacaccaugacguacaagugcccccggaucaccgaaacagagcccgacgacguagauugcuggugcaaugccacagacaccugggucaccuaugggacaugcucccagacgggcgagcaccgacgggauaagcgguccguugccuuagcgccccaugugggccuggggcuggagacccguaccgagacuuggaugagcucugagggugcguggaagcagauucagcgaguugagacuugggcccuacggcaccccggguucacgguuaccgcccucuuucuggcacacgugaucggcaccagcaucacucagaagggcauuaucuuuauccucuuaaugcuggucacgccguccauggccaugagaugcguagguauaggcagccgcgacuuuguagaggggcuauccggggccacauggguagacguaguucuggagcacgggucaugugucaccacgauggcuaaggacaagccaacccucgauaucgagcuccuuaagacugaaguaaccaacccugcgguacuccggaaacucugcauugaggccaagauuuccaacacgacaaccgacagccgcugcccgacccagggcgaggcgacgcuuguggaggagcaggacgccaacuucgucugccggcgcacuuucguagacagaggaugggggaacggcugcggucuuuuugguaaggggucccuaauaacgugcgccaaguucaagugcguuaccaagcuggagggaaaaaucgugcaauacgaaaaucugaaguacagcguuauugucacuguccacacuggcgaccagcaccaggucgggaacgaguccacagagcauggcaccaccgcuacuaucacuccccaggcacccaccaccgagauacagcucacggacuauggggcgcucacccuggacugcagcccccgcaccggccucgacuucaacgagauggugcugcugacuaugaaggaaaagagcuggcucgugcacaagcagugguuccucgaucugccguugccauggacgagcggggcaagcaccucgcaggagacauggaaccggcaggaccugcuagucaccuuuaaaacugcccacgcuaagaaacaagaggugguggucuuaggcagccaagagggcgcaaugcacacagcacuaacuggggcaaccgagauccagacuuccggcaccaccaccaucuucgccgggcaccuuaagugcaggcucaagauggauaaauuaacgcuuaaaggcaugagcuacgugaugugcaccggcuccuuuaagcucgagaaggaggucgccgaaacccagcacggaacgguucugguucagauaaaguacgagggcacggacgcucccugcaagauacccuucagcacucaggacgaaaagggggugacccagaacggccggcugaucaccgcgaauccgacggucaccgacaaggagaagcccgugaacaucgaagcagagccacccuucggggaguccuauaucaucaucggcgccggcgagaaagcguugaaacuuucuugguucaagaagggguccagcauugguaaaauguucgaggcgaccgcccgcggggcccggcgcauggccauccugggugacacggccugggacuuugguuccaucgggggcguauucacguccguagggaaguuggugcaccagaucuucggcacugcguauggcguguuguuuucuggcgucagcuggaccaugaagaucgggaucggcguccuacugaccuggcuuggccuaaacucccgcaguacgucccugagcaugaccugcaucgccgugggauuggucacccuguaccugggcguuauggugcaggccgacagugguugcguuaucaacuggaagggccgggagcucaagugcggaagcggcaucuuugugaccaacgaagugcacaccuggaccgagcaauacaaguuccaggccgauagcccgaagcgccucuccgccgcgauagggaaggccugggaagagggagucugcggcauacguagcgccacccgucuggagaacaucauguggaagcagaucucaaacgaauuaaaucauauacuguuagagaacgacaugaaguucaccguggugguaggcgacguggccggaauccuagcacaaggcaaaaagaugauccggccccagccgauggaauacaaauauagcuggaaguccuggggcaaggccaagaucaucggcgcggacguccagaacaccacguuuaucauagacggccccaacacgccggagugccccgacgaccagcgcgcguggaacaucugggagguugaggacuauggauucgggaucuucaccaccaauaucuggcugaaauuacgggacagcuauacccaggugugcgaccacagacuuaugagugccgcgauaaaggauagcaaggccgugcacgcugacaugggauauuggaucgaguccgagaagaacgaaacuuggaaacuugcucgagccagcuucaucgaagucaaaaccugcaucuggcccaagucacacacucuguggagcaacggcgugcucgaguccgagaugaucaucccuaagaucuauggaggcccgaucagccagcauaaccauaggcccggguacuucacgcaaaccgcgggaccauggcaccuugggaagcuggagcucgacuuugaccugugugagggcacuaccguggucguggaugaacacugcggcaaccgggggcccucccuucgcacuacgaccguuaccggcaagaucauccacgaguggugcugccggucuugcacucugccgccccuccgauuccgcggggaggacggaugcugguacggcauggagaucaggccagucaaagaaaaggaagagaaccuggucaaguccauggucuccgccggcucuggagagguagacuccuucagcuuagggcuguugugcaucucgaucaugaucgaggaggugaugcguagccgcuggucccgaaagauguugaugaccggcacccuugcgguguucuuccugcucauuauggggcagcugaccuggaacgaucugauccgacucugcaucauggugggugccaacgccagcgaccgcauggggaugggcacgaccuaccuggcgcugauggccacuuucaagaugcggccuauguucgccgugggccuauuauuccgccggcugaccucucgcgagguccuccuguugacgauagggcucagccuggucgccucuguugagcugcccaacucgcucgaggagcugggagacggauuggcaaugggcaucaugauccucaagcuguuaaccgauuuccaaccucaccagcuaugggccacccuacucucacugacuuucaucaagacgaccuucucuuuacauuacgccuggaaaacaauggccaugguccuguccauagugagccuguuuccccugugucuauccaccacgagucagaaaaccaccuggcuaccgguucuguugggaucauuaggaugcaagccccugaccauguuccugaucgcagagaacaagaucugggggcggagaagcuggcccuuaaaugaggguaucauggcggucggcaucgugaguaucuuacucagcucacuccugaagaacgacgugcccuuagccggaccgcucauugccggcggcauguugaucgcaugcuacgucaucuccgggucguccgccgaccugagccuggagaaagcggcagaggugucuugggaggaggaagccgagcauucaggcgccucccacaacauacugguggaggugcaagacgauggcaccaugaaaaucaaggacgaagaacgggacgacacauuaaccauacuccugaaagccaccuugcucgcggugagcggaguguacccccugucaaucccagcgacccuguucguaugguacuucuggcagaagaagaaacagcgcagcgggguucucugggacacuccgagucccccugagguggagcgggccguccucgacgacggcaucuaucgcaucaugcagagaggccugcucgggcggagccaggugggcguuggggucuuccaggagaaugucuuccacaccauguggcacgugacccgaggcgcaguccuuauguaccagggaaagcgcuuggagccaagcugggcaagcgugaagaaggaccugaucuccuauggcggcggguggcggcuccagggcagcuggaauaccggggaggaaguucaagucaucgcgguggagcccggcaaaaauccaaagaacgugcagacugcccccgggaccuucaagaccccugagggcgaggucggagccaucgccuuggacuucaagcccgggacuuccggcagcccgaucgugaaucgugaggggaagauugugggacuguauggcaacgguguugugacgacaagcggcaccuaugugagcgccaucgcgcaggcgaaggccagccaagaggguccccuccccgagauugaggaugaggucuuccggaagcgcaaccugacuaucauggaccugcacccgggcuccgggaagacgagacgguacuugccagccaucgugcgggaggcgauuaagcgcaagcugcgcacccucauccucgcucccacccgggugguggcuagcgagauggccgaggccuuaaagggaaugcccauacgcuaucaaaccacagcagugaaauccgagcacaccggcaaggagaucguggaccugaugugccacgcuacuuucaccaugcggcucuuaucaccgguccgcgugccgaacuauaacaugauuaucauggaugaggcccacuucacggauccguccagcauagcagcgcggggguacaucucgacucgcguuggaaugggggaggcagccgccauauuuaugaccgcaacgccgccagggaguguagaagccuucccgcagucaaaugcggugauacaggaugaggagcgggacauccccgaaaggagcuggaacuccggguaugaguggaucacggauuucccuggaaagaccgugugguucgugcccucgaucaaguccggcaacgacaucgccaacugccugcggaagaacggaaagcgcguaauccagcucagcagaaagaccuuugacaccgaguaucagaagacgaagaacaacgauugggacuacguggucacuacagauaucuccgagaugggggccaacuuccgcgcggaccgggugaucgacccccgccggugucugaagcccgucauccucaaggacggccccgagcgaguaauucucgcggguccgaugccugugacugucgccagcgccgcccagcggagggggcggaucggccgcaaucacaacaaggagggcgaccaguauauuuacauggggcagccccugaacaacgacgaggaccacgcccacuggacggaggcuaagaugcugcucgacaacaucaacacccccgagggaauuauuccggcccuguucgagccggagcgcgaaaaguccgcagcaaucgacggggaguaccggcugcggggcgaggcccgcaagaccuucguggagcuuaugcggagaggggaccugcccguguggcugagcuacaaggucgcgucagagggcuuccaguauagcgaccgcagauggugcuucgacggcgagcggaacaaccaggugcucgaggagaacauggacguggagauauggaccaaggagggggaacggaagaagcugcggccccgguggcuugaugcccgcacguacagcgacccgcucgcgcuacgugaguucaaggaguuugcggccggcaggcgguccguaagcggcgaccuaauacuggagaucgguaaguuaccacagcaccugacccaacgagcucagaacgcacucgacaaucuggugaugcugcacaacucagagcagggcgggcgcgccuacagacacgccauggaggaacuucccgauaccaucgagacccugaugcuacucgcccuuaucgccguguuaaccggaggggucacccucuucuuccucaguggccggggauuaggaaagaccuccaucggucuccugugcgugauggccuccagcgugcuacucuggauggcuuccgucgagccccacuggauagccgcgucuauuauccuggaguucuuccuaaugguguuacugaucccggagcccgacaggcagcggacgccccaggacaaccagcuggcuuacguggucauugggcuauuguucaugauccugacuguggcggcaaacgaaaugggauuacuagagacgaccaaaaaggaucuggggauuggccacguugccguugagaaccaucaccacgcggccauguuggacguggaccugcacccugcaagcgccuggacgcuguacgcaguggcgaccacgaucaucacgccuaugaugaggcacaccaucgagaacaccaccgccaacauaucccucaccgccauagcgaaccaagccgcgauccuaaugggacuggacaagggauggcccaucagcaagauggacauuggcgucccguuauuagcgcuggggugcuacucccaggugaacccucucaccuuaaccgccgccgugcugaugcuagucgcgcacuacgccaucaucggccccgggcugcaagccaaggccacgcgcgaggcgcaaaagcggacagcagccggcaucaugaagaaccccaccgucgaugggauaguggccauagaucuggaccccgucguauacgaugccaaguucgagaagcagcucggccagaucaugcugcuaauacucuguaccagccaaauccugcugaugagaacgacuugggcccucugugaauccaucacccuggcgacgggcccguugaccacgcucugggaggggagccccggcaaguuuuggaacaccacuaucgccguguccauggccaacauuuuccgggggagcuaucuagccggugccggucuggcauucucccucaugaaaagccuagggggcgggcgucgugggacuggggcacaaggcgagacccugggcgagaaguggaagaggcagcucaaccagcugagcaaguccgaguucaacaccuacaagcggucggguauuauggaagucgaccgcuccgaggcgaaggagggcuuaaagcgcggagagaccacgaagcaugccgugagccgcggaacugcgaagcuccggugguucguagagagaaaccuggucaagcccgaggggaaggugaucgaccucgggugcggccgaggcggguggagcuacuacugcgccgggcugaagaaggugaccgaggucaaaggguacaccaaaggcggcccuggacacgaagaaccgauccccauggcgacguacggauggaaccucgugaagcugcacagcggcaaggacgccuucuucaucccucccgagaagugcgacacccugcuaugcgacauuggugaguccucgccgaaucccacgaucgaagaggggcgcacccuccggguucugaaaauggucgagcccuggcuccgcgguaaucaguuuugcaucaaaauccugaaccccuauaugccguccgugguggagacccuggaacaaaugcaacggaaacacggcgggaugcucguccguaauccuuugagccguaacuccacgcacgagauguacuggguuucgugcgggaccggcaacaucguguccgccaucaacaugaccagccgcaugcuguugaaccgcuucaccauggcgcauagaaagcccacguacgagcgcgacgucgacuuaggggccgggacccgucacguggcuguggagcccgaagucgccaaccuggacauuaucggccaacgcaucgagaauaucaagcacgagcacaaguccacguggcacuacgacgaggacaacccguacaaaaccugggccuaccacgggagcuacgaggugaagccaucuggcagcgcuuccagcauggugaacggagucguaaaacucuugacgaagcccugggacgucauuccaauggugacgcagaucgcuaugaccgacaccaccccguucggccagcagcgaguguucaaggaaaaggucgacacaaggacaccuaaggccaagcggggaacagcccagaucauggaggugaccgccaaguggcuguggggcuuccuaagccgcaacaagaagccccguauaugcacccgcgaggaguucacgcgcaagguccgguccaaugcggccaucggcgccgucuucguggaugagaaccaguggaacagcgccaaggaggccguagaagacgagcgguucugggaccuggugcaccgggagagggaacugcacaagcaggggaagugugcuaccugcguuuacaacaugaugggcaaaagagagaaaaaguugggggaguucgggaaggccaaggggagucgggccaucugguacauguggcugggcgcucgcuuccuggaguucgaagcgcuaggguucaugaacgaggaccacugguucucuagagaaaacucccuaagcggaguggagggcgagggccugcaccgucucggguacauccugcgggacauauccaagauccccggcggcaauauguacgcggaugacacggcggggugggacaccaggaucaccgaggacgaucugcagaaugaggcacguaucacagacaucauggagcccgagcaugcgcuccuggcaaagagcaucuucaagcugacguaccagaacaaggucgugcggguucagcgcccuggaaagaauggaacagucauggacgugaucagccguagggaccagcgggguagcggccaggugggcacguacgggcuaaauaccuucacgaacauggaagcccagcuaaucagacagauggaguccgaaggcaucuucagccccagcgaacuggagaccccgaaccucgccgagcggguccuggacuggcuugagaaguacgggguagagcgucucaagcgaauggccauuagcggcgacgacugcguugucaaacccaucgacgaccgcuuugcgacggcgcuaaccgcccuuaaugacauggggaagguacggaaggacaucccacagugggagcccucgaagggguggaacgacuggcaacaggucccguucugcagccaccauuuucaucagcugaucaugaaggacggacgggagaucgucguucccugccggaaccaagaugagcuggugggcagggcccgggucucccagggagccggguggagccuucgcgagacugcaugucucgguaagagcuaugcacagauguggcagcuaauguacuuccacagacgugacuuacggcucgcggccaacgccauuugcucagcggugcccguggacuggauaccuaccagccgcaccacaugguccauccacgcgcaccaccaguggaugacgaccgaggacaugcugagcgucuggaaccgcguguggauugaggaaaacccuuggauggaggacaaaacacacaucuccaguuggggcgacgugccuuaucuggguaagcgggaggaccaauggugugguucccucaucggguugaccgccagagccaccugggccacgaacauacaggucgcgaucaaccaggugcggcgccugaucggcaaugagaacuaccucgacuacaugaccagcaugaagcgguuuaaaaacgaguccgaccccgagggagccuugugguga

SEQ ID NO: 24422 - RNA, 9879 nt, Artificial Sequence
  derived and/or modified CDS sequence (opt11) from DENV-1__GU131703__SS-prME
agcgugaccaugcugcuaaugcucaugcccaccgcacuggccuuccaccucaccacucggggcggggaaccccauaugaucgugagcaagcaagaacggggcaagagccuucuauucaagacguccgccggggugaauaugugcacccucaucgccauggaccugggggaacuaugcgaagauacaaugacguacaaaugcccccggaucaccgaaacagagccugacgacguggacugcugguguaaugccacugacacgugggugacguaugggaccuguagccaaaccggggagcaccggagggacaagcgguccguagcucucgcgccccacgugggccucggacuugagacucgaaccgaaacuuggaugaguagugagggcgcguggaagcagauacaacgggucgagacgugggcguugcgccacccaggcuucacuguuaucgcgcuguuccucgcccaugcgaucggcacuagcaucacucagaaggggaucauauucauacuucugaugcuugugacgccauccauggcgaugcgcugcgucggcauuggcagccgugacuuuguggaggggcuuucuggggcaaccuggguagaugucgugcuggagcacgggagcugcgugaccacaauggccaaggacaaacccacgcuggacaucgagcuauuaaagaccgaagucacaaauccagccauuuuacggaaacuuugcaucgaggcaaagaucaguaacaccacgaccgacuccagaugcccuacccaaggcgaagcgacccuaguggaggagcaggacgccaacuucgugugccggcgcacguuuguugaccguggaugggggaacgggugcggguuguuugguaagggauccuugaucacgugcgcaaaguucaagugcguuaccaaacuagaggguaagaucgugcaauacgagaacuugaaauauagcgugauugugaccgugcacacuggcgaccagcaccagguugguaacgagucuacagagcacggaaccaccgcuacgaucacgccccaagcuccaaccaccgaaauccaacugacugauuacggggcccuuacgcuggacuguaguccgcgcaccggucuagacuucaaugagauggugcuccuuacuaugaaggaaaaguccuggcucguccauaagcaaugguuuuuggaucugccccuccccuggaccagcggggccagcacuucccaggagaccuggaaucggcaagaccuuuuaguaaccuuuaagaccgcccaugcaaagaagcaggagguggucguauuaggcucacaggagggcgccaugcacacggcccugaccggggcgaccgagauacagaccuccggcacuaccaccaucuucgccgggcaccugaaaugucgcuuaaagauggacaagcugacccugaaggggaugagcuacguuaugugcaccgggucguucaaauuagagaaggaagucgccgagacacaacacgggacagugcuugugcagaucaaguacgaggguaccgaugcgcccugcaaaaucccguuuagcacucaggacgaaaaaggggugacccagaacggucggcugaucacagccaacccgaucgugacggacaaggaaaagcccgugaacaucgaggccgaaccgccguuuggugaguccuacaucgucaucggugccggcgaaaaggcgcuaaaguugucgugguuuaagaaagggucuagcaucgggaagauguucgaggccacggcucgcggcgcccggcgcauggccauacugggugacaccgcaugggacuucggcuccaucggaggcguguucaccagcguggggaagcugguccaccagauauucggaaccgcauacggaguccucuucuccggcgugagcuggacgaugaagaucgggaucggggugcugcuuacgugguuaggccuuaauucucgcagcaccagucugagcaugaccugcauugccguugguuuagugacccuguaccugggcgucauggugcaagccgacagcggaugcgugaucaacuggaaggggcgggagcucaagugcggcagcggcaucuucgucaccaacgagguucacaccuggacugaacaguacaaguuccaggccgauagccccaagcgccuguccgcagcgaucgguaaggcuugggaggaaggcguuuguggcauccgcagcgcaacgcgucuagagaacaucauguggaagcagaucuccaacgagcucaaccacauacugcuugagaacgacaugaaguucacugugguggugggugacguagccgggauccucgcgcaggggaagaagaugauucggccccagcccauggaauauaaauacagcuggaaguccugggggaaagccaagauaaucggagcagacgugcaaaauaccaccuucauaauagacggccccaacaccccggagugccccgaugaccagcgcgccuggaauaucugggagguagaagacuacggcuucggcaucuucacaaccaacaucugguugaaacuucgagacaguuacacccagguuugugaucaccgccucaugagugcggccaucaaggacagcaaggccgugcacgccgauaugggcuacuggaucgagucggagaagaacgagaccuggaagcuggcccgggcgagcuucauugaaguaaagacgugcauuuggcccaagucccacacccuguggaguaacggcgucuuggaguccgagaugauuaucccaaaaaucuacgggggcccgaucagccagcacaacuacagaccaggguauuucacccagaccgccggcccguggcaucuugggaaguuagaacucgacuucgaccugugcgaaggcacgacugugguugucgaugagcacugcgggaaccgggggccgucacugcgcaccacuacgguaacggguaagaucauacacgaguggugcugccgaagcugcacccuuccgccccugcguuuccguggggaggaugguugcugguacgggauggagauucgccccguuaaggagaaggaggagaaccuggucaaguccauggucagcgccgguuccggugagguggauucuuucagucucgggcuacugugcaucuccauuaugaucgaggaggucaugcggagccgcuggucccgaaagauguuaaugacaggcacccuagccguguuccugcucuugaucauggggcaacugaccuggaacgaccucaucaggcucugcaucauggugggcgccaacgcgagcgaccgcauggguaugggcaccacuuaucuggcccucauggccacuuuuaagaugcggccgauguucgcuguagguuugcuguuucggcggcucaccucccgcgaaguucugcugcuaacaaucggacugagucugguagccuccgucgaacuccccaacucacuggaggagcugggcgaugggcuugcgaugggcaucaugauccuuaaacugcucacugacuuccagucucaccaacucugggccacgcugcucagccugacuuucauaaagaccaccuuuucccuccacuacgccuggaagacgauggccaugguacucaguauuguaucccuguucccccugugccucagcaccaccucccagaaaaccaccuggcugcccgugcuccuagggucguuaggaugcaagccguuaaccauguuccucauugcggagaacaagaucugggggcgucguuccuggccccugaaugaagggaucauggcaguaggcaucgucagcauccuacuguccagcuuacugaagaacgacgugccucucgccgggccccugauugccgggggcaugcugauugccugcuacgugauuagcggguccagcgcagaccucucccuggagaaagccgcggaggucucgugggaggaggaggcggaacacuccggcgccagccacaacauucugguggaagugcaggacgacggaacgaugaagaucaaggacgaggagcgagacgacacgcugacuauccugcugaaagcgacguuacuagccgucaguggcguguacccgcucagcaucccugccacccucuucgugugguacuucuggcaaaagaagaagcagcgcuccgguguucugugggacacgcccagcccucccgaaguggagcgugcuguauuagacgaugggauauaccgcaucaugcagcgcggccugcuuggccguucccagguuggggucgguguguuucaggagaacguguuccacaccauguggcacguuaccagaggggccgugcugauguaucaggggaaaaggcuggaaccuagcugggcguccguuaagaaagaccucauaucuuacggcggcggauggcggcuucagggauccuggaacaccggggaggagguacagguuaucgccguggaacccgggaagaaccccaaaaacgugcagaccaccccggggacuuucaaaacaccagagggcgaggugggcgccaucgcccuggauuuuaagcccggcaccagcgguaguccaauuguaaaccgggaagguaagaucgugggccucuacggcaacgggguggucaccacgagcggcacauacgugagcgccaucgcgcaagccaaagccucccaagagggaccgcugcccgagaucgaggacgagguguuccggaaacgcaaccugaccaucauggaccuccaucccggcagcggaaaaacacggcgcuaccucccggcuaucguccgggaggcuaucaagaggaaacugcgcacgcugauacuggcccccacccgggugguagccuccgagauggccgaggcacugaagggcaugcccauccgcuaccaaaccaccgcugucaaaagcgagcacacggguaaggagauuguugaccucaugugccacgccaccuucaccaugcgcuuauuguccccaguccgcgucccuaacuacaacaugauaaucauggacgaggcccacuucaccgaucccaguucuaucgcggcccggggcuacaucuccacacgcguuggcaugggggaggcagccgcgauuuucaugacugccacgccgccuggcuccguggaggccuucccccagucgaaugcggugauccaagacgaagaacgggacauacccgaacgcagcuggaacucggguuacgaguggaucaccgauuuccccggcaagacggugugguuugugcccucgaucaagagugggaaugauaucgccaacugccuccggaagaacggaaagcgcgugauucagcugucgcgcaagaccuucgacacggaguaccagaagaccaagaacaacgauugggacuacguggugacgaccgauaucagcgaaaugggugcgaacuuucgggccgaccgggucaucgacccaaggcgcugccuuaaacccguuauccucaaggauggccccgaaagagugauuuuggccggccccaugccugucacgguggccuccgccgcccagcggcgcgggcggaucgggagaaaccacaacaaggagggcgaucaguauaucuauauggggcagccacuuaacaacgacgaagaccaugcccacuggacggaggccaagaugcuccuggauaacauuaacacacccgaggguaucaucccggcguuguucgagccggagcgcgagaaaagcgccgccauagauggcgaguaccgucugcgcggggaggcuagaaaaacauucgucgaacugaugcgccgcggggaccugccgguuuggcucaguuacaagguggcgagcgaaggcuuccaauacucugaccgccgguggugcuuugacggggagcgcaacaaucaagugcucgaagagaacauggacguggagaucuggaccaaggaaggggagcguaagaagcugcguccccggugguuagacgcgcgcaccuacuccgaccccuuagccuuacgggaguuuaaggaguucgcggcuggccgccgaagcgucuccggggacuuaauccuggagaucgggaagcugccgcagcaccuuacccagcgcgcccagaacgcgcuggauaaccuggugaugcuccacaauagcgaacagggcggacgugccuaccgccacgcaauggaggaguugccagacaccaucgagacccugaugcuccuggcacuuauagccgugcucacagguggugugacuuuguucuuccuguccggccgcggcuugggcaagacgagcaucggccuguugugugucauggccagcucagugcuacucuggauggcuuccguggagccccauuggauagcggcguccaucauuuuggaguuuuucuuaaugguucuccugauacccgaacccgaccgacagcguacaccccaagacaaccagcucgccuacgugguaaucggacugcuguuuaugauccucaccgucgccgcgaaugaaaugggccuccuggagaccacgaagaaagaccucgguauuggccauguagccgucggcaaccaccaccacgcagccaugcuugaugucgaccugcacccagccuccgcuuggacucuuuacgccgucgcgacgaccaucaucacgccuaugaugcgccauaccauagagaacaccacugccaacaucagccuuacagcaaucgcaaaccaggcugcgauacucaugggccuagacaagggcuggcccaucuccaagauggacauaggagugccccugcucgcccucggcugcuacagccaagucaacccccugacgcugacugccgccgugcuaaugcugguggcgcacuaugcgaucaucggcccgggccugcaggccaaggccacccgugaagcucaaaagcguaccgcugcagggaucaugaagaaucccacuguagacggcaucguggcgaucgacuuagaccccguggucuacgacgccaaguucgaaaagcagcugggccaaaucaugcugcugauccugugcaccucccagauccugcugaugcgcaccaccugggcccugugcgagagcauuacccuggcgacgggaccucucaccacauuaugggagggaucgccggggaaguucuggaacaccacaaucgcugugaguauggccaacauauuccgaggcaguuaccuggccggagccgggcucgccuuuagccuuaugaaaucacuaggaggugggcgccgggggaccggcgcgcagggcgaaacgcugggggaaaaguggaagcgccagcucaaccagcuguccaagucggaguucaacaccuacaaacgauccggcaucauggagguggacaggagcgaggccaaagagggccugaagcggggagagaccaccaagcacgcggucucucgaggaacggcgaagcugcgaugguucguggagcgcaaucuggugaaacccgaagguaaggucaucgaccugggcugcgggcguggcggguggagcuauuacugcgccggacuuaagaaagugaccgaggucaagggcuacaccaaagguggcccugggcaugaggagcccauaccgauggcaaccuacgguuggaaccuggucaagcugcauucugggaaggauguauucuuuauaccgcccgaaaagugcgacacgcuccugugcgauaucggcgagucuucgccaaacccgaccaucgaggaggggcgcacccugcggguucucaagauggucgagccgugguuacgugguaaccaguucugcaucaagauccugaaccccuauaugcccucagugguggaaacucucgagcaaaugcagcggaagcauggcgggaugcugguccgcaacccgcuuagccggaacagcacucacgaaauguauugggucuccugcggcacaggcaauauaguguccgccgucaauaugaccucuaggauguuacuuaaccgcuucaccauggcacaccggaagccuaccuaugaacgcgacguggaccugggcgcggguacucggcauguggcagucgagccugagguggccaaccucgacauaauugggcaacgcauugagaacaucaaacacgagcacaaaagcacguggcacuacgacgaagauaaccccuacaagacgugggccuaccacgguagcuaugaggugaagccgagugggagugccucuagcauggucaacggcguggucaaacuccugaccaagcccugggaugugauccccauggucacucaaaucgcgaugacagacacaacgcccuucgggcagcagcguguguucaaggaaaagguggauacccgcaccccgaaggccaaaagaggcaccgcgcaaaucauggaaguuaccgccaaguggcucuggggcuuccuaucccgcaacaagaagccucgaauaugcacgcgcgaggaguucacuagaaaggugcgcagcaaugccgcgauuggugccguguucguugaugagaaccaauggaacuccgccaaagaggccguugaagacgaacgguucugggaucuagugcaucgcgaacgcgagcuccauaagcaagguaagugcgcuaccugcgucuauaauaugauggggaaacgcgagaagaagcugggcgaguucgggaaggccaagggcagccgggccauaugguauauguggcugggagcacgcuuccucgaguucgaagccuuaggguucaugaacgaggaccauugguucucccgggagaacagccugucaggcgucgagggggagggguuacauaaguugggguacauucugcgcgauauaagcaagauuccaggagggaacauguacgccgacgacaccgccggcugggacacgcggaucaccgaagacgaucuccagaacgaggcccgaaucaccgacaucauggaaccagagcacgcccugcuggcgaaguccaucuucaaacucaccuaccagaacaaaguggugcgaguucagcggcccgcgaagaacggcacgguaauggauguaauuagccgccgggaccagcgagggucuggacaggucggcaccuacggccugaacacuuucaccaacauggaggcacagcugaucaggcaaauggaaagcgaagggaucuuuuccccuagcgagcuggagacgccuaaucuggccgagcgcgugcuggauuggcucgagaaguacggagucgagcgucucaagcgaauggcuaucucuggagaugacugcgucgugaaaccgaucgacgaccguuucgcgaccgcgcugaccgcacuaaacgacauggggaaggugcgaaaggacauuccgcagugggagcccaguaagggauggaacgacuggcagcagguuccuuuuugcucccaucauuuucaccagcugauaaugaaagacggccgggagaucguggugccuugcagaaaucaagacgagcuggucggccgcgcucgcguaagccagggcgccggguggagccuuagagagaccgccugcuugggcaagagcuaugcgcaaauguggcaacugauguacuuccacaggagagaccuccgccucgccgccaacgccaucugcagugcggugcccgucgacuggauucccacuucccggacgaccugguccauccacgcgcaccaccaguggaugaccacggaggacaugcuguccguguggaaccgcguuuggaucgaagagaaccccuggauggaggauaaaacacacauaucuuccuggggagauguccccuaccuuggcaagcgcgaggaccaguggugcggcagccugauaggccugaccgcgagagccaccugggcaacaaacauacaaguggcaaucaaccagguccgcagacucauugggaacgagaacuacuuagacuacaugacgucuaugaagcgcuucaaaaacgagagcgaccccgaaggggcccugugguag

SEQ ID NO: 24423 - RNA, 9879 nt, Artificial Sequence
  derived and/or modified CDS sequence (opt11) from DENV-1__GU131706__SS-prME
agugugaccauguugcucaugcugaugcccaccgcccuggccuuccaccucacgacacggggaggagaaccccacaugaucgugucgaagcaggagagagguaaaagcuuacucuuuaagaccagcgccggggugaauaugugcacccucauugccauggaccugggcgagcugugcgaggauacgaugaccuauaagugcccccgaaucaccgaaaccgagcccgacgacguugacuguuggugcaacgcgaccgacaccugggugaccuacgggaccuguucgcaaacgggggagcacagacgcgauaagcguuccguggcccucgcgccccacguaggccuggggcuggagacccggaccgagaccuggaugagcuccgagggcgcguggaagcagauccagcgggucgagacgugggcccucagacaccccggguucaccgucaucgcccuguuccuggcccaugcgaucggcaccagcaucacacaaaagggcaucaucuucauacuccugaugcuggugacgcccucuauggccaugcggugcgucggcaucggcucacgcgacuucguggaaggguuauccggcgccacuuggguggacgucgugcuggagcacgguucaugcgugacaaccauggcgaaggacaagcccaccuuggacaucgaauugcuuaagaccgaggucacuaaccccgccguccuacggaagcucugcaucgaggcgaagauauccaacacaaccaccgauagccgcugcccgacucagggugaggccacguugguggaggagcaagacgccaacuuugucugccggcgcacguucguggaucggggcugggggaacggcugcggauuguucggcaaggguucccucaucacgugcgccaaauuuaagugcgugaccaaguuagaggguaagauuguccaguacgagaaccuuaaguacagcguuauuguuacuguccacacaggcgaccaacaccagguggggaacgagaguaccgagcacgguaccaccgccacuaucacgccccaggcccccacgacggagauccagcucacugacuacggugcccugacacuggacugcagcccccgcaccggccucgacuucaacgagauggugcuacugaccaugaaagagaaguccuggcucguacacaagcagugguuccuugaccuaccgcugcccuggaccagcggggcaagcacgucgcaggaaaccuggaaucgucaggaccugcugguuaccuucaagaccgcccacgccaagaaacaggaggucguggugcucggcagccaggagggcgcuaugcacacggccuuaaccggggccacggaaauccagaccuccggcacaaccacaaucuucgccgggcacuugaagugccgccucaagauggacaagcuaacccugaaaggaaugaguuacguuaugugcacggggucuuuuaagcuagagaaggaggucgccgagacucagcacggcacugugcucguccagaucaaguacgaaggcaccgacgcgcccugcaagauccccuucagcacgcaggacgaaaagggggugacccagaacggccggcugauaaccgccaacccgauuguaacugacaaggaaaagccagucaacaucgaagcggaaccgccuuucggggaguccuauauaguaaucggagccggcgagaaggcacucaagcucagcugguuccgcaagggguccagcaucgguaagauguucgaggccacugcccgaggggcucgacgcauggccauccugggcgacaccgcgugggacuucgguucgaucggcgguguguucacgucuguagguaagcucguucaucagaucuucggaacugccuacgggguccuguucagcggcguaaguuggacgaugaaaauagggaucgggguccuguugaccuggcucggccugaacucccggagcaccuccuuaucgaugacaugcaucgcggucgggcucgucacgcuguaucugggagugauggugcaggccgacuccggcugugucaucaacuggaagggccgcgaacucaagugcgggagcggcaucuucgugaccaaugaaguccacacauggaccgagcaguauaaguuccaggccgacucccccaagcgguuguccgcggccaucggcaaggccugggaggaggggguuugcggcauccgcuccgccacccgccuggagaacaucauguggaagcaaauuucaaacgaguuaaaccacauccuucuggagaacgauaugaaguuuacggugguggucggggacguggccggcauccucgcucaggggaagaagaugauucgcccgcagcccauggaguauaaguacagcuggaagaguuggggcaaggccaagaucauuggcgccgacguccagaacaccaccuuuaucaucgaugggcccaacacccccgagugcccggacgaccaaagggccuggaacauaugggaagucgaggacuauggcuucgggauauucacuacgaauauuuggcugaagcugcgagacagcuacacccaagucugcgaccaccggcuaaugucugcggcaaucaaagacagcaaagccgugcaugccgacaugggcuacuggaucgaguccgaaaagaacgagaccuggaaacuggccagggcgaguuucaucgagguaaagacaugcauuuggccaaagucgcauaccuuguggucuaacggcgugcuggaguccgagaugaucaucccgaagauauacggaggccccaucagccaacacaauuaccgacccggguacuuuacccagacggccggccccuggcaccuggggaaauuggagcuugacuucgaucugugcgaaggcacgacaguggucgucgacgagcauugcggaaaccgcgggccgucacugcggacgaccacggugaccggcaagauaauccacgaguggugcuguagaagcugcacccugccgccucuucgguuccgcggugaggacggcuguugguacgggauggagauucggcccguaaaggaaaaggaggagaaucuugugaaguccauggugucagccggaagcggggagguugauuccuucucgcucggguugcuguguauuuccaucaugaucgaggaggugaugcgcagccgguggucccgcaagaugcucaugacuggaacgcuggcuguguucuuccugcucauaauggggcagcugaccuggaaugaucugauccgacucugcaucaugguuggggcaaacgcaucugaccggaugggcaugggcaugaccuaccuggcccugauggcaaccuucaagaugcgcccgauguucgccgucggccuacuguuccggcgccugacgucucgggagguuuugcugcugacgaucggacucucucuggucgcguccguggaacugccgaacucgcucgaggagcucggcgauggucuggccaugggcaucaugauccucaaacugcuaacugacuuccaaucgcaccagcucugggcaacccugcuuucgcucacguucauuaagaccaccuucucccuacacuaugccuggaagacaauggccaugguccuguccauuguauccuuguucccccucugccugaguacgaccucccagaagaccaccuggcucccagugcugcugggaagcuuaggguguaagccccugacgauguuccuaaucgcggagaauaagauauggggccgucgguccuggccccucaacgaaggcaucauggccgucgguaucguaagcauccugcuguccucccuccugaagaaugacgugccccuggccgggccgcucaucgccggaggcaugcucauugccugcuacgucaucagcggcuccuccgcggaccugucccuugagaaagccgccgagguaagcugggaggaggaagcggagcacuccggcgcaagccacaacauccugguugagguccaggacgacgggaccaugaagauuaaggacgaggagcgcgacgacacccugaccauccuuuuaaaagcaaccuuacucgcgguauccggcguguauccgcugagcauccccgccacgcuguuugucugguacuucuggcagaaaaagaagcagcgauccggggugcucugggacacacccagcccaccggagguagaaagagccguccuggacgacggcaucuaccgcauaaugcagcgcggccugcuggggcggucccagguaggcgugggagucuuccaggagaacguguuccacaccauguggcacgugacucgcggugccguccucauguaccaggggaaacggcuggagcccagcugggcgucugugaaaaaggaccugaucagcuacgggggcggauggcgccuccaggggaguuggaacacgggagaggaaguccaggucaucgccgucgagcccggcaagaaccccaagaaugugcagaccgcgccggggaccuucaagacccccgagggcgaagugggcgccaucgcccuggacuucaagccggggacaagcggcuccccuaucgugaaccgggaggggaagaucguuggacuguacggcaacgggguagucaccaccagcgguaccuacgugagcgcaaucgcacaggccaaggccagccaggaggggccgcucccugagauugaggacgagguguuccguaaacggaacuugacgaucauggaccugcauccgggcagcgggaagacccgacgguauuugcccgcgaucguacgcgaggccaucaagcgcaagcugcggacccugaucuuagcacccacccguguggucgccuccgagauggccgaggcgcugaaggguaugccuauacgcuaucagacgaccgcugucaagagcgagcauacgggcaaggagaucguggaucugaugugccacgcuacguuuaccaugcgccuccugucccccguacggguuccgaauuacaauaugaucauaauggacgaggcucacuucaccgacccaagcuccaucgcagccagaggauacaucagcacucgggugggcaugggggaggccgcugccauuuucaugaccgccacgccacccggcuccgucgaggcguucccucagagcaacgcagugauccaggacgaggagcgcgacauccccgaaaggaguuggaacagcggguacgaguggaucaccgacuuccccgggaagaccgugugguucgucccguccaucaagagcgggaacgacauagccaacugccugaggaagaacgggaagcgggugauccaguuaucccgcaagacauucgacacagaauaccaaaagacgaagaacaacgauugggacuacguagucacuaccgauaucagcgagaugggcgccaacuuccgugcggaccgcgugaucgauccgcggcgcugucugaaacccgugaucuuaaaggacgggcccgaacgcgucauccuugcaggcccuaugccagugacggucgcguccgccgcccagcgccgggggcgcaucgggcgcaaccacaauaaggagggcgaucaauacauauacaugggucagccccugaacaaugacgaggaccacgcgcacuggacugaggccaagaugcugcucgacaacaucaacacccccgagggcaucaucccugcccuguucgagccggagcgggaaaaauccgcugccaucgacggggaguaccgccugcgcggcgaggcgcgcaagaccuucguggagcucaugcggaggggggaccugccaguguggcucagcuauaaggucgccagcgaaggcuuccaguacucagaccggcguuggugcuucgacggagagcguaacaaccaagugcuggaggaaaacauggacguggagaucuggacgaaggagggcgagaggaagaaacucagaccccgcuggcuggacgcucggacguauuccgacccucucgcgcugcgggaguucaaagaauucgccgcgggccggcgcagcgucagcggugaucugauccuggaaaucggcaagcucccucaacaucugacucaacgugcccagaaugcccucgauaaccuggugaugcugcacaacuccgagcagggaggucgcgcuuaccggcacgccauggaagagcuccccgacacgauagagacucugaugcuguuggcccugaucgccguucucaccggcggggucacccucuucuuccucaguggccgcggccucggaaagaccaguauaggccuccuuugcgugauggccuccucugugcugcucuggauggcaucaguagagccccacuggaucgcggcuagcaucauccucgaauucuuccucauggucuugcuuaucccagaaccugaucggcaacguacgccucaggacaaccagcuggccuacguggucauuggccucuuauuuaugaucuuaaccguugccgcuaacgagaugggccucuuagagacuaccaagaaggaccuggguaucggccacguggcggucgagaaccaccaccacgcggccaugcucgauguggaccugcaccccgccuccgccuggacgcuguacgcuguggccacgaccauuaucacgccgaugaugcgccacacuauugagaacacgaccgccaacaucagccucaccgccaucgccaaucaggcggccauccuaauggggcuggacaagggcuggcccaucucaaagauggacauaggugucccgcugcuugccuuggggugcuacucccaggugaacccccucacauugacggccgcggugcugaugcucguagcccacuacgcaaucaucggcccggggcugcaggccaaagcuacccgggaagcgcagaagcgcaccgccgccggcauaaugaagaacccaaccguggaugggaucguggccaucgaccuggaccccgugguguacgaugccaaguucgagaagcagcucgggcagauuaugcugcuaauccucugcacgucacagauccuguuaaugcggaccaccugggcgcucugcgagagcaucacccuggccacgggucccuuaacuacccucugggagggcuccccgggcaaguucuggaacaccacgaucgccguguccauggcaaacauuuuccgcggcuccuaccuggccggcgcgggccuggccuucagccucaugaaaucacucgggggcggccggcgggguaccggggcccagggcgagacccugggcgagaaauggaagcgacagcucaaccagcuguccaagagcgaguucaacaccuauaagcguuccgggaucauggaggucgaccguagcgaggccaaggagggcuuaaagcgcggggagacgaccaaacacgcugucucccgagguaccgcaaagcuccggugguucguggagaggaaccuggucaagccggaagggaagguaaucgaccuggggugcggccgcggaggcuggagcuacuacugcgccgggcugaaaaaggugaccgaggugaagggcuacacuaagggugggcccggccacgaggagcccaucccgauggcuaccuauggguggaacuuaguuaaacugcacuccgguaaagacguguucuucauaccuccagagaagugcgacacccuacucugcgauauuggggagucaucccccaacccaacaaucgaggaaggccgcacgcugcgcguccugaagaugguggagcccuggcuccgggggaaccaguucuguauuaaaauacugaacccguacaugcccagcgucgucgagacgcuggaacagaugcagcgcaagcacggcgguaugcucguacggaacccgcuguccaggaacucgacccacgagauguacuggguguccugcggaaccggcaacaucgucagcgcuguaaacaugacgucccggaugcugcuaaaccgguucacgauggcgcaccgcaagcccaccuacgagcgcgacguggaccugggcgccggcacccgccacgucgccguagaacccgagguggccaaccuggacaucauaggacagcggaucgagaacaucaagcacgagcacaaaagcaccuggcacuacgaugaggacaaccccuacaagacuugggcauaccacgguuccuaugaggucaaaccgagcggcuccgcuagcagcauggugaauggggucguaaagcucuugacuaagcccugggacgugauccccauggucacacagaucgccaugaccgauacuacccccuucggccagcagcgaguguucaaagagaagguggauacccggaccccgaaggccaagcgcgggaccgcgcagaucauggaagucacagccaaauggcuguggggcuuucucucccggaauaagaagccccgaaucugcacaagggaagaguuuacccgcaagguacggagcaacgcggccaucggcgccguguucguggaugagaaccaguggaacuccgccaaggaagcgguggaggaugagcgcuucugggaccuggugcacagggagcgcgagcugcacaagcaggggaaaugcgccacgugcgucuauaacaugaugggcaagcgggagaagaaacucggggaguuuggcaaggccaagggaucacgcgccaucugguacauguggcugggcgcucgguuccuggaguucgaggccuugggcuucaugaaugaggaccauugguucucccgugagaacagccuguccgggguggagggcgaggggcugcacaaguugggauacauccugcgggacaucucuaagauccccggggguaacauguacgcugacgauaccgccggcugggacaccagaaucaccgaggacgaccugcaaaacgaagcccggaucacggacaucauggagccggagcaugcacuccucgcaaaguccaucuucaagcugaccuaccagaacaagguggucagggugcagcgccccgccaaaaacgggacagugauggaugucauaagccggcgcgaucaacggggguccggccagguggggaccuacgggcuaaacacguucaccaacauggaggcccagcugauacgccaaauggagagcgaggggaucuuuucgcccagcgagcuggagacccccaaccucgccgaacgggugcuggacuggcucgagaaguacggcgucgagagacucaaacggauggccauauccggggacgacugcguggucaagccgaucgacgaccgcuuugcaaccgcccuaacggcccugaacgacauggggaagguccggaaggacauuccacaaugggagcccuccaaaggguggaacgacuggcagcaggugcccuucugcucccaccacuuccaucagcucaucaugaaggacggccgcgagaucgugguuccgugcagaaaccaggacgagcugguaggccgcgcccgggugagccagggggccggcuggucacugcgagagaccgccugccucgguaaguccuaugcucaaauguggcagcugauguacuuccaccggcgcgacuuacggcucgccgccaacgccaucugcagcgcaguucccguggacuggauccccaccucgcgcaccacguggagcauccacgcccaccaccaauggaugaccaccgaggauaugcugucuguguggaaccgcguguggaucgaggagaaccccuggauggaggacaagacccauaucucuuccuggggugacgugccguaccuggggaagcgggaagaccagugguguggcucgcucaucggccugacggcccgcgccacgugggcuaccaauauccagguggccauaaaucagguccggcgccugaucgggaacgaaaacuaccucgacuacaugaccuccaugaagcgguucaagaaugaguccgaucccgagggcgcuuugugguga

SEQ ID NO: 24424 - RNA, 9879 nt, Artificial Sequence
  derived and/or modified CDS sequence (opt11) from DENV-1__GU131708__SS-prME
agcguaacaauguuacuaaugcuaaugccaacagcacucgcuuuccaucuaacuacgagaggcggcgaaccgcacaugguagugucaaaacaagaaaggggcaaaagccuucuauucaaaacaucagcuggcguaaauaugugcacgcuaauagcgauggaccucggcgaacucugcgaagacaccaugaccuauaaauguccccggaucacugaagcagaaccagacgacguggacugcuggugcaacgcuaccgacacgugggugaccuacgggacaugcucccaaacaggggaacacagacgcgacaagaggucuguggcacucgcaccgcacgucggccucgggcuagaaacccgaaccgaaacauggaugucaucugaaggcgcauggaagcaaauacaacgaguugaaaccugggcacugcgccaccccggcuucacggucauagcacucuuccuagcacaugccauaggcaccuccauaacacaaaaaggcauaauauucauucugcugaugcuggugacgcccucuauggcaaugagaugcguggggauagggagucgugacuuugucgaggggcuauccggagcaacaugggucgacguaguucucgaacacggcucaugugugacgacaauggcaaaggacaagccgacuuuagacaucgaacuccucaaaacagagguaaccaacccagccauacuccgcaagcuaugcauagaagccaaaauaagcaacacaacaacggacagucgcugcccaacccaaggcgaggcgacgcugguagaagaacaggacgccaauuucgugugucgacgaacauucguugaucgaggcugggguaacggaugcggucuuuuuggcaaggggucccugauaacgugugcuaaauucaaauguguaaccaaacuagaggggaagaucguccaguacgaaaaucuaaaauacagcguuauagucacggugcauacgggagaccaacaucaaguaggaaacgaauccacggaacacggcacaaccgcuacaaucacuccacaagcaccuacaacagagauacagcucacggacuacggagcccucacgcuggauugcaguccacggacggguuuggacuucaacgagaugguccuccugacaaugaaggagaaaagcuggcucgugcauaagcagugguuccucgaccucccacuucccuggacaagcggugcgucaaccucccaagaaacuuggaacagacaggaccuauugguaacauucaaaacugcccacgcgaagaagcaagaaguagugguucucggaagucaggaaggagccaugcauacagcgcuaacuggggcuacggaaauacaaacgagcgggacaaccacgauauucgcaggacaccuaaaaugcagacuaaagauggauaaauugacgcuaaaggggaugaguuauguuauguguacaucgucguucaaacucgaaaaagaaguggcugaaacgcaacaugggacaguccuaguacaaauaaaauacgaggggacagacgcgcccuguaaaauuccauuuucaacacaagacgagaaaggaguuacgcaaaacgggcgacuaaucacugcgaacccgauaguaaccgauaaagagaagccuguaaauauagaagccgagccgcccuucggcgagucuuacauagucauaggcgcgggcgaaaaagcccuaaagcugucaugguuuaagaaagggucgaguaucgggaagauguucgaagccacagcacgcggcgcaaggcggauggcgauccucggagacacagcaugggacuuugggucaaucggaggggucuucaccagugucgguaaacucgugcaucaaaucuucggcacagcauacggaguucuuuucucuggagucaguuggacaaugaaaauaggccucggcgugcuccucaccugguuagggcugaacucacgcucaaccagucuaucuaugacuuguaucgcgguagggcuaguaacccuguaccucggugucaugguccaggcagauucaggcugcguaaucaauuggaaggguagagaguuaaaauguggaagcggaaucuuugucaccaacgaggugcacacguggacggaacaauacaaauuccaggccgauucacccaagcggcugucggcagcaauuggaaaggccugggaggaaggugugugcggaauccgcuccgcaacgagacucgaaaacgugauguggaaacagaucagcaaugaacugaaccacaucuuacuggaaaacgacaugaaauucaccguaguaguaggagacguggcuggaaucuuagcccaaggcaaaaagaugauucgaccgcagcccauggaguacaaauauaguuggaagaguuggggaaaagcgaaaauuaugggcgcagacguacagaacacaacauuuaucauagacggucccaacaccccggaaugcccggacgaccagcgcgcuuggaauauuugggaaguugaagacuacggcuucggaauuuucaccacaaacauauggcuaaaguugagggauagcuacacccaaguaugugaccacaggcuuaugucagcggcaaucaaggacucaaaagccguccacgcggacaugggcuauuggaucgagagcgagaagaacgaaacauggaaacucgcacgggccagcuucauagaaguaaaaacaugcauuuggcccaagagccacacguuguggagcaacggggugcucgaaagcgaaaugauaauaccaaagauauacggcggcccgauuucacaacauaacuaucggccaggcuacuucacacaaacggccgggccguggcaucucggcaaacuagaacuggacuucgaccuaugcgagggaaccaccgugguggucgaugaacacugcgguaaccguggaccaucccuccguacgaccacagucaccgggaaaaucauucacgaguggugcugccguagcuguaccuuaccaccgcucagguuccgaggagaggauggcugcugguacggaauggagauacgcccaguaaaagaaaaagaagaaaaccucguaaaaucgaugguauccgcgggcaguggcgagguugacagcuuuucgcugggacuucuuugcauaucuaucaugauagaagaagugaugcguagccgguggagccgcaaaaugcugaugaccggaacacucgcagucuuccuccucuuaaucaugggucagcuaacauggaacgacuugauccgccucuguauaaugguaggagccaaugcuagcgacagaaugggaauggggaccaccuaccuagcacuaauggcgacauucaagaugaggccgauguucgcaguaggucuucucuuucgccgguugacaucgagagaaguucuccuccugacgaucggacucagcuugguggcuagcguagaacuuccaaacagccuugaggaacucggcgauggccucgcaaugggaauaaugauacuaaaacugcuaacagacuuccaaagccaucaauuaugggccacacuccuuagucucacauuuauaaaaacuaccuucucucuucacuacgccuggaaaaccauggccauggugcuaucaaucguaucacucuuccccuugugccuguccaccacaagccagaaaaccaccuggcuucccgugcuauuaggaucgcucggcugcaaaccguugacgauguuccugaucgccgagaacaaaaucugggggcgccgcucguggccacuuaaugaggguauuauggcggugggcaucgucaguauuuugcucuccagcuugcucaaaaacgacgucccgcucgcgggaccccuaauagccggcggcaugcuaaucgcaugcuacguaaucagcggcagcagcgcugaucuaucccuagagaaagcagcagagguaagcugggaagaagaagcagagcacucgggggcgagccacaacauccugguugagguccaagacgaugguacuaugaagauaaaagacgaggagcgugacgacacccuuacaauccuucucaaggcaaccuuacuugcagucucuggcgucuacccucugucuauaccggcaacguuguucgucugguacuucuggcagaaaaagaaacaacgauccgguguauugugggauaccccuucaccacccgagguugaacgagcuguacuagacgacgggauuuacaggaucaugcaaagaggccuucuaggacgaagccaggucggagucggcgucuuccaagagaacguguuccacacgauguggcacgugacucgaggagccgucuuaauguaucaaggaaaacgccuggagccuagcugggccuccguaaagaaagacuuaauuucauauggugguggguggagacugcagggcagcuggaauacgggcgaagaagugcaagucauagcagucgagccggguaaaaaccccaagaacguccagaccgcccccggaacauucaagaccccagaaggggagguaggagcgauagcccuagacuucaaacccggcacaucuggaucgccaauagugaaccgcgagggcaagaucgugggacuauacggcaacggagucguuaccacaagcgguacauacgucagcgcaaucgcgcaagcuaaagcaagucaagagggcccgcuaccagaaauagaagacgaaguauuucggaagaggaaccucacaauaauggacuugcacccugggagcggcaagacgcgccgguaccuuccugcgauagugagagaagccaucaagcgcaaacuucgaacacucauacuagccccaaccaggguggucgcgucagaaauggcugaagcccuuaaaggcaugccgaucagauaucagaccaccgcaguaaaaagcgagcacacagguaaagaaaucguugaccucaugugccacgcaacuuuuaccaugcgccuacuaagccccguacgagugccgaacuacaacaugaucauuauggacgaggcccacuucacggacccgaguagcaucgcggcgcguggauacaucuccacgcgggugggaaugggagaggccgcggcaauauuuaugaccgcaaccccuccggggaguguggaagcguucccacaaagcaacgccguaauccaagaugaggaacgggacauuccggagcgcagcuggaacucgggcuacgaauggaucacggacuucccggggaagacggugugguucguacccagcauaaagucaggaaaugacauagccaacugccuacggaaaaaugggaaacgugugauccagcucucccgcaaaacauucgacacggaauaucagaaaaccaaaaauaacgacugggacuacgucgucacaaccgauaucucugagaugggcgcgaacuuucgagcagaccgggugaucgauccgcgacgaugccuaaaacccguaauacugaaagacgggccggaacgcgugauacucgccggaccuaugccagucacgguugcuuccgccgcccagcgcaggggcagaaucggaagaaaccauaacaaagaaggggaccaauacaucuacaugggccaaccacuaaacaacgaugaagaccacgcgcacuggacggaagcaaaaaugcuccuggacaacauaaauacgccggaggggaucauaccggcacuuuucgagccggaacgcgagaaaucggccgccauagacggugaauaccgauuacguggagaggcacgcaaaaccuucgucgaauuaaugcgcagaggagaccuucccgucuggcucagcuauaaaguagcaucagaaggcuuccaauacagcgacaggcgguggugcuucgacggcgagcgaaacaaccagguccuggaagaaaacauggacgucgagauauggacaaaggagggcgagaggaagaaacugcgaccaagauggcucgaugcacgcacauacucugacccacuggcccuaagggaguucaaggaguuugccgcgggccgacgcagcguaucuggagaucuaaucuuagaaauagguaaguuaccacagcaccuaacucaaagggcacaaaaugcccucgacaaccugguaaugcuccacaacucagagcaaggagggcgcgccuaucgccacgccauggaggagcugccggauaccauagagacacuuaugcuucuagcccucaucgcagugcuaacuggagggguuacucuuuucuuccucagcggucguggguuagggaaaacuuccaucggacuauuaugcgucauggcaucuuccguguuacucuggauggccuccgucgaaccacacuggauagcugcaagcauuauccuagaguucuuccuaaugguccuccuaauccccgaaccagaucgacagagaacaccccaggacaaccagcucgcuuacgucgucaucggucuacuguucaugauccucacgguagcugcaaacgaaaugggccuacuggaaacuaccaagaaagaucucggaauaggccacgcugcgguuggaaaccaccaucacgcagccauguuggauguagauuuacacccagcuuccgcguggacgcuauaugccgucgcaaccacgauaaucacacccaugaugcgccauaccauagaaaacaccacagcuaacauuagccuaaccgccaucgcgaaucaagccgcuauacuaaugggguuggacaagggcuggccaauaagcaagauggacauagguguaccacuacucgcccucggcuguuacucgcaaguaaacccacuuacgcuuacggccgccguccugaugcucgucgcacacuacgccaucauaggaccgggacuccaagcaaaagcaacgcgggaggcgcagaaaagaacagcggcgggcaucaugaaaaacccaaccgucgaugggauugucgccauugauuuagaccccguggucuaugacgcuaaguucgaaaaacaacugggccaaaucaugcugcucauacucugcacgucacaaauacugcugaugcgaaccacaugggcccucugcgagucgaucacccuugcaacaggcccccugacaaccuuaugggaggggucgcccggaaaguucuggaauacaaccauagcuguuagcauggcaaacaucuuucgaggaucguaccuggcaggcgcaggucuggcauucucacucaugaaaucacucggagggggcaggagggguaccggggcacaaggagaaacucucggagagaaguggaaaaggcaacucaaccagcuaagcaaaucagaguucaacacauauaagcggagugggauaauggaaguggaccggagcgaagcgaaggagggauuaaaaagaggggaaacuacgaagcacgcaguaucacgcggaacggcuaaacuaaggugguucgucgagcgcaaccuugucaagccggagggcaagguuauagaccuuggguguggacgaggcggcuggucauauuauugugccgggcugaagaaagucaccgaaguaaaaggcuauacaaaaggcggaccgggacaugaagaaccaauacccauggcaacguacggcuggaaccuagucaagcuacacaguggaaaagaugucuucuucaucccacccgagaaaugugacacccugcucugcgacaucggagaaucaucaccuaaucccacgauugaagaaggccgaacacuccgcguacuaaagauggucgaacccuggcuacggggaaaccaguuuugcauaaagauccugaacccauauaugccaagcguggucgagaccuuagaacagaugcagagaaaacacggugggaugcuggucagaaacccccuaucacgaaacagcacccaugaaauguacuggguaucgugcgggacuggaaacauugucagcgcaguaaacaugaccagucgaaugcucuuaaaccguuuuacaauggcccaccggaagccuacguacgagcgcgacguggaccucggggcaggcacacggcacguggcaguggagccagaagucgccaaccucgacaucaucgggcagcgcauagaaaauaucaagcacgaacauaaaucaacguggcacuacgacgaggacaaccccuauaaaaccugggccuaccacggcucuuaugaggugaaacccuccgggucagcuucuaguauggucaacggugucguaaaacuguugacgaaaccgugggaugugaucccuaugguaacccagauagcaaugaccgacaccacuccauuuggacaacaacgcguauucaaagagaaaguggacacacgaacgccaaaggcgaagaggggcaccgcgcagaucauggaaguaacagcaaaguggcuuuggggguuccuaucgcggaauaagaaaccgcggauauguacaagagaggaguucacucgaaaagugagaucaaacgccgcgauaggggcagucuuugucgacgaaaaccaauggaacuccgcaaaagaggcaguggaggacgagcgauucugggacuuaguacaccgggaacgagaacuccacaaacaaggcaagugcgccaccugugucuacaacaugaugggcaaaagggagaagaaauugggugaguucgggaaagccaagggaucccgagcuaucugguacauguggcuuggugcgagauucuuagaguucgaagcauuaggguuuaugaacgaagaccacugguucuccagagagaacagucuuuccggagucgaaggcgaaggccuacacaagcuaggcuacauacuucgcgacaucucuaagauuccagguggcaauauguacgcggacgacacugcgggaugggacacaagaaucacagaggaugaccuccagaacgaagcccgaaucacagauaucauggaaccugaacacgcacugcucgcgaaaagcauauuuaaguuaacguaucaaaacaaagucguacgaguccaacgcccagcgaaaaacggcaccguaauggauguaauuucacgcagagaucaaaggggcagcggacaggucgguacguauggacuaaacaccuuuacuaacauggaggcgcaacucaucagacaaauggagagcgagggcauauuuagcccaucagaacuugagaccccaaaccucgcagagcgaguacuagacugguuggaaaaauauggggucgaacgacugaagcggauggccaucucgggagacgacugcgucgugaagcccauagacgauagguucgcgacugcacuuaccgcauugaacgacaugggcaagguaagaaaggacauuccacagugggaacccaguaaaggcuggaacgauuggcaacaggucccguuuugcagucaccacuuucaucaacucauuaugaaagacggaagagaaauugugguccccuguaggaaccaagaugagcuaguagggagagcucgcgucagccaaggcgccgguuggucacuuagagaaaccgcgugucucggaaaauccuaugcccaaauguggcaacugauguacuuucaccggcgcgaccucagguuagccgcaaacgcaauuuguuccgcaguucccguugacuggauaccgaccagccgcaccacguggagcauccacgcccaccaccaauggaugaccaccgaggacauguuauccguauggaauagaguguggaucgaagagaacccguggauggaagacaaaacacacauaagcagcuggggcgacgucccauaccuggggaaacgcgaggaccagugguguggcucguugaucggacugaccgcgcgggcuacgugggccaccaacauccagguagcuaucaaccagguaaggcgccucauugggaaugaaaacuaucucgacuacaugaccagcaugaaacgcuucaagaacgaaagcgauccagaaggcgcccuaugguag

SEQ ID NO: 24425 - RNA, 9879 nt, Artificial Sequence
  derived and/or modified CDS sequence (opt11) from DENV-1__GU131710__SS-prME
ucugugacgaugcugcucauguugaugcccaccgccuuggccuuccaccuaacgacgcggggcggagagccccacaugauugcgagcaagcaggagcgcggcaagagcuugcuguucaagacgagcgccggggucaauaugugcaccuuaaucgccauggaccugggugagcugugugaggauaccaugaccuacaagugcccucggaucaccgagaccgaacccgacgacguugacugcugguguaacgcgacggauaccugggugacguacgggaccugcucacagacgggcgagcaccggagagacaagagguccguggcucuugcuccccacgugggccuggggcuggaaacccgcacagagaccuggaugagcagcgagggcgcguggaagcaaauccagcgcguggagacgugggcccuccggcauccaggguucacggucaucgccuuauuccuggcucaugccaucggcaccucuauuacucagaaggggaucauuuucauccuccugaugcuggugacgccauccauggccaugcggugcgugggcaucggcagcagggauuucguagaggggcucuccggggccaccuggguggacgugguccuggagcauggaagcugcgugaccaccauggccaaggacaagcccacgcuggacauugaguuacugaagaccgaggugacgaacccugccguccugcggaagcucugcaucgaggccaagauaucgaacaccacgaccgacagccgcuguccgacccaaggcgaagccacccugguugaggagcaggacgccaauuucguaugcagaaggacguucguagauagggguugggggaacgguugugggcuuuucggcaaggggucgcucaucaccugugcaaaguucaagugugugaccaagcuggagggcaagaucgugcaguacgaaaaccuuaaguauagcguaauugucaccgugcacacgggggaccagcaccaggucgggaacgaguccacagagcacggcacaaccgcgaccaucacuccgcaagcccccaccacugagauccaauugaccgacuacggggcucuaacgcuggacuguucaccccguaccggucucgacuucaacgaaauggugcuccucacaaugaaggagaaguccuggcuaguccauaaacaaugguuccuggauuugccccuccccuggacgucaggggccucaacgucccaggagaccuggaaccggcaggauuuguugguuaccuucaagacugcccacgcuaagaaacaggaaguggucgugcuaggaagucaggagggcgccaugcacaccgcccuuacaggggccaccgaaauacagaccaguggcacgaccacuaucuucgccgggcaccugaagugccgccucaagauggacaaguugacguuaaagggcaugagcuacguaaugugcacaggguccuuuaaguuggagaaggaggucgcagagacccagcacggaacgguguuagugcagaucaaguacgaagggaccgaugcccccugcaaaauacccuucuccacgcaggacgaaaaaggggucacccagaacggacgguugaucaccgccaacccgaucgugaccgacaaggagaaacccgugaacaucgaggccgaaccacccuucggcgaguccuacaucgucaucggagcgggugaaaaagcccugaaacucagcugguucaaaaaggguaguaguaucggcaaaauguucgaggcgacugcccgcggggcccggcguauggcuauccuuggagacaccgcgugggacuucgguucaaucggcggcguguucaccagcguggggaaacugguccaccagaucuuuggcacugccuacgggguacuguuuucaggcguuagcuggacgaugaagauaggcaucggcguacugcugaccuggcucggccugaacucuaggagcaccucccugagcaugaccugcaucgccguggggcucaucacccuguacuugggugucauggugcaggccgacucggggugcgugaucaacuggaaaggccgggaguuaaagugcgggagcggcaucuucgugacgaacgagguacacacguggaccgagcaguacaaguuccaggcggauagcccgaagcgccuguccgccgcaauuggaaaggcaugggaggagggggucugcgguauccgaagcgccacucgccuggagaacauaauguggaaacagaucuccaacgaacugaaccacauacugcuggagaacgacaugaaauucacgguggucguuggggacguagcuggcauccucgcccaagguaagaaaaugauccguccccagcccauggaguacaaguauucguggaaaagcuggggcaaggccaagaucaucggggcagacguccagaacacaaccuucaucauagaugggccgaauacacccgaaugcccagacgaccagcgcgcauggaauaucugggagguggaggacuacgguuuugggaucuucaccaccaauaucuggcuaaagcugcgggacuccuauacccaggugugugaccaccgauugaugucagccgcgaucaaggacagcaaagcgguucacgcugauaugggcuacuggaucgagagcgagaagaacgagaccuggaagcuggcgcgggcgagcuucaucgaggugaaaacgugcaucuggcccaaaucccauacccugugguccaacggcguucucgagagcgagaugaucauccccaagaucuacggcggaccgauaagccagcauaacuaccgcccgggguacuucacccaggccgccggccccuggcaccuggggaaacuugagcuugacuuugaccugugugagggcacuacggugguagucgaugagcacuguggcaaccgcggaccgucccugcgcaccaccaccguuaccgguaaaaucauccacgaguggugcugcaggagcugcacccugccaccccuacgcuuccgcggggaggacggcugcugguaugguauggaaauccgccccgugaaagagaaggaggagaaucuugugaagucuauggugucugcggggagcggggagguagacucguucagccucgggcugcugugcaucuccaucaugauagaggaagugaugcggagucgcuggucccgccggaugcucaugaccggaacccuggcggucuucuuccuucugaucaugggacagcugacguggaaugaccugaucagacugugcaucauggugggagccaacgcgagcgaccggauggggaugggcacaaccuaccuggcccugauggccaccuucaagaugcgcccgauguucgcggucggacuccuguuccgucgccuaacguccagggagguccuccugcugacgauugggcucagucuaguagcguccguggaguugcccaacagccucgaggagcugggagacggccuggcaaugggcaucaugauccugaaacuucugacggacuuccagucccaccagcucugggcuaccuuacugucgcucacguuuaucaagaccacauucucccugcacuaugccuggaaaaccauggcgauggugcugagcaucgugucccucuucccucugugucugagcacgaccucccagaaaaccacguggcuccccguacugcuuggcagccucggaugcaagccucugacgauguuccugauagcagaaaacaagaucuggggucgacgguccuggccccuuaaugaggggaucauggcgguaggcauagugagcauccuguugucgucccuccucaagaaugacgucccucuggcagggccucuaaucgcgggcggcauguuaauugccugcuacgugauuagcggguccagcgccgaucugucauuggagaaagccgccgagguuucuugggaggaggaggcggagcacuccggcgccagccacaacauccuggucgagguccaggaugacgggacaaugaagaucaaggacgaagaacgcgaugauacccugacuauccucuuaaaggccaccuuacuugccguaucgggcgucuacccguuaucgaucccagccacgcuguuugucugguacuucuggcagcggaagaagcagcgcucuggggugcucugggacacccccaguccgcccgaggucgagagagcggugcuggacgacggcauauaccgcaucaugcagcggggccugcucgggcgcagucaggugggcgucgggguguuccaggagaacguguuucacacaauguggcacgugacccggggcgccgugcucauguaccagggaaagcgccuggagcccagcugggcguccgugaagaaagaccucaucagcuacggcggaggguggcggcuucaggguuccuggaacacgggggaggaaguacaggugaucgccguugagcccggcaagaaucccaaaaacguccagaccgcccccgggaccuuuaaaacgccggagggggagguaggggcgaucgcccuggacuucaagccggggacgucuggcucccccaucguaaaccgcgaagggaaaaucguaggucucuacggcaacgguguggugaccaccagcggcaccuacgucagcgcuaucgcccaggcgaaagcaucacaggaggggccgcuccccgagaucgaggacgagguauucaggaaaaggaaucugacgaucauggaucugcaccccggaucggggaagacgagacgguaccucccggccaucguucgagaagccauaaaacgcaaguuacgcacccugauccucgcacccacccggguaguugcguccgagauggccgaggcccugaagggcaugccaauacgcuaccagacaaccgcugucaagagugagcauaccgguaaagagaucgucgaccugaugugucacgccaccuuuacgaugagacucuugucccccgugcggguuccgaauuauaacaugauuaucauggacgaggcgcacuucacagacccgucaucaaucgccgcccggggguacaucagcacccgcguugggaugggggaggccgccgcgaucuucaugaccgcgacgccgcccggcucgguggaggccuucccgcagagcaacgcugugauccaggacgaggaacgagacauccccgagcgcuccuggaacuccggguacgaguggauaaccgacuuccccggcaagaccgucugguucgugccauccaucaagagcggcaacgacaucgcgaacugucugcggaagaacggaaagagggugauccaacucucgcggaagaccuucgacacagaguaccagaagacuaagaacaacgauugggacuaugucgugaccacagacaucagcgagaugggcgcgaacuuccgcgccgaucgggugauugacccgcgcagaugccucaagcccgucauccugaaggacgggccagagcgcguaaucuuagcagggccaaugccggugacaguugccuccgcggcccaacggcgagggcgcaucggcagaaaccauaauaaggagggcgaccaguacaucuacaugggucagccgcuuaacaacgaugaggaccacgcccacuggaccgaggccaaaaugcugcucgauaacauuaacacccccgagggcauaauacccgcccuauucgagccggagcgcgagaagucggccgccaucgauggcgaauacagauugcgcggggaggcccggaagacguucguugaacucaugagacgcggggaccucccagucuggcuguccuacaagguggcgagcgagggcuuccaguauagcgacaggagauggugcuucgacggcgagcgcaacaaccagguguuggaggagaacauggacgucgagaucuggacgaaggaaggggagcggaagaagcugcgaccccgguggcuggacgcccgaaccuauuccgacccucucgcguuacgggaguucaaggaguucgccgccggccgccggagcguguccggggaccugauccucgaaaucggcaaacuuccgcaacaccugacacagagggcucaaaacgcccucgacaaccucguuaugcugcauaacuccgaacagggcgggcgggcguaccgacacgccauggaggagcucccugacacuaucgaaacgcugaugcuguuagcccugaucgccguccucaccgggggaguaacccuuuucuuccuguccggccgcgggcuggguaagaccagcauuggucuccugugcguuauggccuccagcguccugcucuggauggccuccguggagccucauuggauugcugccucgauuauucuggaguucuuccugauggugcuauugauacccgagccggaccgccaacgcacgccccaggacaaucaacuggcauauguugucaucgggcucuuauucaugaucuugacuguagcugccaacgagaugggccugcuggagaccaccaagaaggaccugggaauaggccacgucgccguggagaaccaccaccacgccgcgaugcucgacgucgaccuucacccggcguccgccuggacacucuacgccgucgcuacgaccaucaucacaccgaugaugcgacacaccaucgagaauacgaccgcuaauaucagccucaccgcgaucgccaaucaggccgcaauccugaugggguuagacaaggguuggccaaucuccaagauggacauaggcgugccccuccuggcgcucgggugcuacagccaggugaacccccucacccugacagccgcagucuuaaugcucguggcccacuacgccauuaucgggccaggccugcaggccaaggcaacccgcgaggcacaaaagcggaccgccgcgggcauuaugaaaaaccccacuguggacgggaucgucgcgaucgaucucgacccagugguguaugacgccaaauucgagaaacagcucggccagauuaugcugcugauacuguguacgagccagauacuccugaugcggaccaccugggcccuuugcgagucaaucaccuuggccaccggcccccugacgaccuuaugggaaggguccccgggcaaguucuggaauaccacgaucgccguauccauggcgaacauauuccggggguccuaucuugcaggcgcgggccuagccuucagucucaugaagucccucgggggcgggcguagggguaccggagcgcagggcgagacccugggcgaaaaguggaaaagacaguuaaaccaacuaagcaagagcgaguucaacacauacaaacggucugguaucauggagguggaccgcucugaggccaaggagggccugaaacgcggggagaccacaaagcacgcgguaucccggggcaccgccaagcucaggugguuugucgaaagaaaccuggugaagcccgagggcaaggugaucgaccugggcugcggcagaggaggcuggucguacuacugcgccggguugaagaaagugaccgaggugaaaggcuacacgaagggagggcccggccacgaggaacccaucccgauggcgaccuacggguggaauuuggugaaguugcacaguggcaaggacgucuucuucauaccgcccgagaagugcgacacacugcucugcgacauuggggagagcucccccaacccgaccauugaggaaggcaggacucugcggguauugaaaaugguggagcccuggcugcgagggaaucaguucugcaucaaaaucuugaaccccuauaugcccagcgucguggagacucuagagcagaugcagaggaagcacggcggcaugcuggugaggaacccgcuguccagaaacuccacccacgagauguacuggguaagcugcgggaccggcaacaucgugagugcaguaaacaugaccuccaggauguugcuuaacagauucacgauggcccaucguaagcccacguacgagagggacguggaccugggugccggcacccggcacguggccguggagcccgaaguggccaaccuggacaucaucggccaacguaucgagaacauaaagcacgagcacaagagcaccuggcacuacgacgaggacaaccccuauaagaccugggccuaccacggguccuacgaagugaagccuucuggcucggcuagcagcauggugaauggaguugugaagcuccugacaaaacccugggacgucaucccgauggugacccaaauugcuaugacggauacgaccccguuuggccagcaacggguguucaaggagaaagucgacacacgcacuccgaaggccaagcggggcacggcgcaaauaauggaggugaccgccaaauggcuauggggcuuccucucuaggaacaagaagccacggauuugcacgcgcgaggaguucacgcggaaggugaggagcaacgccgccauaggugcgguguucguggaugaaaaccaguggaacucugcuaaggaggccguggaagaugaacgcuucugggaccugguccacagagagagagaguugcacaagcaggggaagugugcuacgugcguguauaacaugaugggcaagcgggagaagaaguugggcgaguucggcaaggcuaaaggcagccgggcuaucugguacauguggcugggcgcccguuuccuggaguucgaagcccucggcuuuaugaacgaagaccauugguucucccgggagaacuccuugucaggaguggagggagaggggcuccacaaguuaggguacauucuacgcgacaucagcaaaauccccggcggcaacauguacgcggaugauaccgccggcugggacacgcgcaucaccgaggacgaccuucaaaacgaggcaagaaucacagauaucauggagccggagcacgcccuccuggccaaguccaucuucaagcugacguaucagaacaaggucguucgcgugcagcggcccgccaaaaacgguaccgugauggacgugaucagucgccgggaccagcgcggcucgggccagguggggacguacggccucaacaccuuuaccaacauggaggcucagcugauccggcagauggaaagcgaggggauauucucccccagcgaauuagaaacacccaacuuagccgaacgagugcuggacuggcuggagaaguacggcguagaacggcuaaagcgcauggccauauccggggacgacuguguggucaagccgauagacgaccgcuucgccacugcccugacggccuugaacgacaugggaaaggugcgcaaggauauuccccagugggaacccagcaagggauggaacgauuggcagcagguucccuucugcucccaccacuuccaccaguugaucaugaaggacggcagggagaucgucgugcccugccgcaaucaggacgagcuagugggccgcgcgcgcguaagccagggggccggcuggucguugcgggaaacagcuugccucgggaagucuuacgcgcagauguggcagcuaauguacuuccaccgccgggaucugcgccuagcggcaaacgccaucuguagcgccguaccaguggacuggauccccacgucccgcaccacguggagcauccacgcccaccaccaguggaugaccaccgaggacauguuaucggucuggaacagaguauggaucgaggagaacccuuggauggaggacaaaacccacauaagcuccuggggugacgucccguaucuggggaagcgcgaagaccagugguguggcucacucaucggccugacugcgcgggccaccugggccacuaacauccaagucgccaucaaccaggugcgacggcuuaucgggaacgagaacuaucucgacuauaugacuuccaugaagcgguucaagaacgagagcgaccccgagggcgcccugugguaa

SEQ ID NO: 24426 - RNA, 9879 nt, Artificial Sequence
  derived and/or modified CDS sequence (opt11) from DENV-1__GU131717__SS-prME
agcgucaccaugcugcucaugcuaaugcccacggcccuggccuuccaccucaccacacgggggggggaaccccacaugaucgucagcaagcaggagcggggcaagagccuucuguucaagacauccgcgggggugaacaugugcaccuuaaucgcuauggaccugggcgaguucugcgaggacacaaugaccuacaagugcccccgcaucaccgaggccgagcccgacgacguggacugcuggugcaacgccacagacacgugggucaccuacggaaccugcagccagacuggagagcaccggcgggacaaacgguccguggcccuggcgccccacguuggccucggacuggagacgcgcaccgagaccuggaugagcuccgagggugcguggaagcagauucagcggguugagaccugggcccugcgccaccccggguucacggugaucgcccucuuccuggcgcacgcaaucggcaccagcaucacccagaagggaaucaucuuuauccuguugaugcuggugacccccucgauggcgaugcggugcgucggcaucggcagccgagacuucguggaggggcuguccggcgcaacguggguggacgucgugcucgagcacgggagcugugugaccaccauggccaaggacaagcccacccuggacaucgagcugcucaagacggaggucaccgaccccgcuguucugcggaaguuaugcauagaggccaaaaucuccaacaccaccacagacagccgcugcccaacccagggcgaggccacccucguggaggaacaggacgccaauuucgucugccggcgcaccuucguggaccggggcuggggaaacggaugcggccuguucggaaaagggucccugaugacgugcgccaaguucaagugcgugaccaagcucgagggcaaaaucguucaguacgagaaccugaaguacucugugaucgugaccguccacacaggcgaccagcaccagguagggaacgaguccacggagcacggcacgaccgcgaccaucaccccacaagcccccagcacggagauccagcugacugacuacggggcccugacccuagacugcagcccccggaccggccuggacuucaacgagaugguccugcugacgaugaaggagaaguccuggcuaguccacaaacagugguuucucgaccugccccugcccuggaccagcggugccuccaccagccaggagacauggaaccggaaggaucuccugguuaccuucaaaaccgcccaugcuaagaagcaggaggucgucgugcugggcucgcaggagggugccaugcacaccgcccucacgggggccacggagauccagaccagugguaccaccacgaucuucgcugggcaccugaagugccgccugaagauggauaagcucacccugaagggaauguccuaugucaugugcaccgggagcuucaagcuggagaaggagguugccgagacccagcacggcacggugcucguccagaucaaguacgagggcaccgacgcccccugcaaaauccccuuuagcacccaggacgagaagggggugacccagaacggccggcugaucacggccaauccuaucgugaccgacaaggagaagcccguaaauaucgaggccgagccccccuucggagagagcuacaucgugaucggcgccggugagaagacccugaagcuguccugguucaagaaggggagcuccaucggcaagauguucgaggccaccgcccgcggggcccggcgcauggcgauccucggugacacggcgugggacuucgggagcaucggcggcguguucaccuccguggggaagcucguucaccagauauucggcaccgccuacgggguguuguucagcggggucuccuggaccaugaagaucgggaucggcgugcugcuaacgugguugggccucaacagccgguccaccagccuguccaugaccugcaucgccgucgggcuggucacccucuaccugggcgugauggugcaggccgacagcgguugcgugaucaacuggaagggccgggagcuuaaaugcgggagcggcaucuucgugacaaacgaagugcacaccuggacggagcaguacaaguuucaggccgacagcccgaagagacucagcgcggccauaggaaaggccugggaggagggggucugcggcauccgguccgccacccgccuggagaacaucauguggaagcagaucagcaacgagcugaaucacaucuugcuggagaacgacaugaaguucaccgugguggucggggacguggccggcauccuggcgcaggguaagaagaugauccggccccagcccauggaguacaaguacucauggaaaaguuggggcaaggccaagauuaucggagccgacguucagaacaccaccuucaucaucgacgggcccaacaccccggaguguccugacgaccagcgcgcauggaacauaugggaggucgaggauuacggcuucgggaucuucaccacuaacaucuggcuuaagcugcgggacuccuacacccagguuugcgaccaccgccugaugagcgcggccaucaaggacucuaaagccgugcacgccgauaugggcuacuggaucgagagcgagaagaacgagaccuggaagcucgcacgggcguccuucauagagguuaagaccugcaucuggcccaagucacacacgcugugguccaacggcgugcuagagagcgagaugaucauccccaagaucuauggggggccgaucucccagcacaacuaccgccccggguacuucacccagaccgccggccccuggcacuuagggaagcuggagcuggacuucgaccucugcgagggcaccacgguggucguagaugagcacugcggcaaccgggggccgagccugcgcaccaccaccgugaccggcaaaaucauacacgaguggugcugcagauccugcacucugccgccccugcgcuucaaaggggaggauggcuguugguacgggauggaaauccggccugucaaggagaaggaagagaaccuggucaaaagcauggugagcgccggcuccggcgagguagacagcuuuagucuggggcuccuguguaucagcaucaugaucgaggaggugaugcgcuccagauggagccgcaagauguugaugacaggcacccucgccguguucuuccugcugaucauggggcagcucacguggaacgaccugauccggcugugcaucauggucggcgccaacgcguccgaccgcaugggaaugggcaccaccuaccucgcccugauggccaccuucaagaugcgcccgauguucgccguggggcuauuauuccggcgccuaacgagccgggagguccugcuccugaccaucgggcugucccucguagccuccguggagcugcccaacucccuggaggagcucggcgacgggcuggcuaugggcaucaugauccugaagcuacugacagacuuccagucacaccagcugugggccacccuccuaucccugacguucauuaagaccaccuucagccuccacuacgcauggaagaccauggccaugguccugaguaucgucagccuguucccccucugcuuauccacuaccucgcagaagaccaccuggcugcccgugcuccugggcucccugggcuguaagccccucacaauguuccuaaucgcggagaacaagaucuggggccgcaaguccuggcccuuaaacgaggggaucauggccguaggcaucguaagcauuuuauugucggcgcugcucaagaacgacgugccccuggcugggccucugaucgccggcggcaugcucaucgcgugcuaugucaucagcggguccagcgcggaucugucccuggagaaggccgccgaggugagcugggaggaggaggccgaacacuccggcgcgagccacaacauccucguggagguccaggaugauggcaccaugaagaucaaggaugaagagcgggacgacacgcugacaauccugcucaaagccacccugcucgccgucagcggcguguacccccucagcaucccugccacgcuguucgucugguauuucuggcaaaagaagaagcagcgcuccggggugcugugggacacccccagcccgcccgagguugagcgagccguccucgacgacggcaucuaccgcaucaugcaacggggucugcuggggcgcucccaggugggcgugggggucuuccaggagaacguguuccacaccauguggcauguaacccggggcgcgguccugaugcaccagggcaagcgccucgaacccagcugggccuccgugaaaaaggaccugaucagcuacgguggcggguggcgacugcaggguucauggaacacgggggaagaaguacagguaauagccguggagcccgggaagaacccgaagaacgugcagaccgcccccgggacguucaagaccagcgagggcgaggucggcgccaucgcgcucgacuucaaacccgggacguccggcaguccuaucgucaaccgcgaggggaagaucgugggccuguacgggaauggggucgugaccacaagcggcacuuacgugagcgcgaucgcucaggccaaggcgagccaggaggggccccugccggagaucgaggacgaggucuuucgcaagcgcaaucucaccaucauggaccugcaucccgguucagggaagacacggcgcuaccugcccgccaucgugagagaggccaucaaacgcaagcuccggacccugauccuggccccgacgcgcgugguagccagcgagauggcggaggcccucaaagguaugcccauccgcuaccagacgaccgccgugaagagugaacauaccggcaaggagaucguggaccugaugugccacgccaccuuuaccaugcggcugcucagccccguucgcgugcccaacuacaacaugauuaucauggacgaagcccacuucacugacccgagcagcaucgcggcccggggguacaucuccacucgcgugggcaugggggaagccgccgccaucuucaugaccgcgacgccgcccggcagcguugaagccuucccccagaguaacgccgugauccaagacgaggagagagacaucccggagcggagcuggaacuccggguacgaguggaucaccgacuucccugguaagaccgugugguucgugcccaguaucaaguccggcaacgacaucgccaacugccugcggaagaacgggaagagaguuauccagcugagccggaagaccuucgacacggaguaccagaaaaccaagaacaaugacugggacuacguggucacgaccgacaucuccgagaugggcgccaacuuccgcgccgaccgggucauagacccccgccgaugccucaagccggugauccugaaggacgggcccgagcgcgucauccuggcuggccccaugcccgugacggucgccagcgcugcgcagcggcgcgggcggaucggccgcaaccacaacaaggagggcgaccaguacauuuacaugggucagccgcucaacaacgacgaggaccacgcccacuggaccgaagcuaaaaugcuacuggacaacaucaacacccccgagggcauaauccccgcgcucuucgagcccgagcgggagaagagcgcggcgaucgacggggaguaccgccuacgcggagaagcgaggaagaccuucguggagcugaugcgacgcggggacuuaccuguguggcuaagcuacaagguugcgucggaggguuuccaguauuccgaucgccgguggugcuucgacggcgagcgcaacaaccagguucuggaagaaaacauggacguggagauauggacgaaggagggggagcgcaagaagcuccgcccccggugguuagaugcccgcaccuauagcgaccccuuggcguugcgggaguucaaagaauucgcggcaggccgacggucugucagcggggaccugauccuggagaucgggaagcucccccagcaccugacccagcgcgcccagaacgcccuggacaaccuagugaugcuccauaauuccgagcagggcgggcgggcauaccgccacgccauggaggagcuuccggacaccaucgagacccucaugcugcuagcccucauagccguucugaccggcggggucacccuguucuuccuaagcggccgggggcugggcaagaccucuaucggauuacucugcgugauggccucauccgugcuacucuggauggcguccgucgaaccccacuggauagccgccuccaucauacuagaguucuuccugaugguacugcucauucccgagccggaccgccagcggaccccgcaggacaaucagcuggcauauguagucaucgggcuccucuuuaugauccugacgguggccgcaaacgagaugggccugcucgagaccaccaagaaggaccuggggaucggccacgucgccgucgaaaaucaccaccacgccgcuauguuagacguggaccuccaccccgccucggcguggacccuguacgccguggccacgaccauaaucacccccaugaugcgccacaccauagagaauacgaccgccaacaucucccugaccgcuaucgcgaaccaggccgccauccucauggggcuggacaagggcuggccgauaagcaagauggacaucggcguaccccugcucgcgcugggcuguuacucccaagugaacccccugaccuugacggcggccgugcugaugcuugucgcacacuacgccaucaucggacccgggcuccaggccaaggcaacccgggaggcccagaagcgcaccgcagccggcaucaugaagaacccgaccguggacgggaucguggccaucgaucuggaccccgucguguacgacgcgaaguucgagaagcagcuaggccagaucaugcuccugauccugugcacgagccagauacuccugaugaggaccaccugggcccugugugaguccauaacccucgccacgggcccgcugaccacccugugggaggggucacccggcaaauucuggaacaccacgaucgcuguguccauggccaacaucuuccgagggagcuaucucgcgggcgccgggcuggccuucucucugaugaagucccuugggggcgggcgccggggcaccggcgcgcagggcgagacccugggcgagaaguggaaacgccagcugaaucagcuaagcaaauccgaguucaacaccuacaagcgaucuggcaucauggagguagauagaucagaggcgaaggagggacugaagcggggggagacaaccaagcacgccgugucccgcgguaccgccaaacugcggugguucguagaacgcaaccuagucaagccggaggggaaggugauugaucucggcugcggccgcggcgggugguccuacuacugcgccgggcugaagaaggugaccgaggucaagggguacacaaagggcgggcccggacacgaggagcccauucccauggccaccuacggguggaaccuggugaagcuccacagcggcaaggauguuuucuucaucccgcccgagaagugcgacacccugcugugcgacaucggggagucuagccccaaccccaccaucgaggagggccguacguuacggguccugaagaugguagagccguggcuacgcgggaaucaauuuugcauaaagauccucaaucccuacaugccauccgugguggagacccuggagcagaugcagcgcaagcacgggggaauguuggugcgcaacccccucagccggaacuccacccacgagauguacuggguuagcugugggaccggcaacaucgucuccgcggugaacaugacuagccgcaugcuucuuaaccgguucaccauggcccaccgaaagccgaccuacgagcgcgacguugaccucggggccggcacucggcacgucgccguggagcccgaaguggcgaaccucgacaucaucggucagcgcaucgagaacauaaagcacgagcacaaguccaccuggcacuaugacgaggauaaucccuacaagacgugggcguaccacgggagcuacgaggucaagccauccggcagcgccagcuccauggugaacggggucgugaagcuucucaccaagccgugggacguuaucccuauggucacccagaucgcuaugaccgacacgacccccuuuggccaacagcgggucuucaaggaaaagguggacacccgcacccccaaggccaagcgggguacugcccagaucauggaggucaccgcgaaguggcucuggggcuuccuaagccgaaacaagaagccgcgcaucugcaccagggaggaguucacccggaaggugcgcuccaacgccgcgaucggcgccguguucgucgacgagaaccaguggaacagcgcgaaggaggcuguggaggacgagagguucugggaccucgugcaccgcgagagggagcuucacaagcaagggaagugcgccacgugcgucuacaacaugaugggcaagcgcgagaagaagcugggugaguucggcaaggccaaaggaucccgggccaucugguacauguggcucggcgcgcgcuuucuggaguucgaggcgcugggcuuuaugaacgaggaccauugguuuagucgggaaaacucccugagcgggguggagggcgaaggccugcacaagcugggcuauauccuccgcgacauuuccaagauccccggggggaacauguaugccgacgacaccgccggcugggacacccgcaucaccgaggacgaccuucagaacgaggccaagaucacggauauuauggagcccgagcacgcgcucuuggcuaagagcaucuucaagcugaccuaccaaaacaaggugguccgcgugcagcggccggccaagaacgggaccgugauggacgucaucucccgcagggaccagcggggcagcggucaggucggcaccuacggccugaauacguucaccaauauggaggcccagcucauacgccagauggaguccgagggaaucuuuagccccuccgagcuggagacccccaaccuggccggccgggugcucgacuggcuggagaagcacggggucgagcgccugaagcggauggcgaucagcggcgacgacugcguggugaagcccaucgacgaccgcuucgccgccgcccucaccgcccugaaugacaugggcaaggugaggaaggacauaccucagugggagccguccaagggcuggaacgacuggcagcagguacccuucugcagccaccauuuccaccagcugauaaugaaggacggccgcgagaucguggucccuugccggaaccaggacgagcuaguggggcgcgcgcgggugagccagggcgccggguggucccugcgcgagacggccugccuuggcaagagcuacgcccagauguggcaacucauguacuuccaccggcgcgaccuuaggcuggcggcuaacgcaaucugcuccgcggucccgguagacugggugcccaccucgcgcaccaccuggucgauccacgcccaccaucaguggaugacgaccgaggacaugcugagcgucuggaaccggguguggaucgaggagaaccccuggauggaggacaagacccacaucagcagcuggggcgacgugcccuaccugggcaagcgcgaggaccaguggugugguucccugaucgggcucaccgcgcgugccacgugggcuaccaacauccagguagcgaucaaccaggugcgccgccugaucggcaacgagaacuaccuggacuacaugaccagcaugaagcgguucaagaacgagagcgacccggagggggcccucugguag

SEQ ID NO: 24427 - RNA, 9879 nt, Artificial Sequence
  derived and/or modified CDS sequence (opt11) from DENV-1__GU131718__SS-prME
agugugaccaugcugcucaugcugaugcccacagcccuggcauuccaucucaccacccggggcggagagccccacaugaucgugacaaagcaggagagaggcaagucccugcuguucaagaccucugccggggugaacaugugcacucucaucgccauggauuuaggcgagcugugugaggacaccaugaccuacaaaugcccucguaucacugaagcugagcccgacgacguagacugcuggugcaaugccacggacacuuggguaacauacgggaccuguagccagaccggggaacaccggcgcgacaagcggagcguagcccucgcgccgcacgucggcuuagggcucgagacccgcaccgaaaccuggauguccagcgagggcgcguggaagcagauccagcgggucgagaccugggccuuacgccaccccggguucacggugaucgcccuuuuuuuggcgcacgccauuggcaccuccaucacccaaaaggguaucaucuucauccuacugauguuaguaacucccagcauggcuaugcggugugucggcaucggaucccgagacuucguugagggucucagcggcgccaccuggguggacguagugcuggagcauggguccugcgugacaaccauggccaaggauaagccuacgcuagacauagaacuccugaagaccgagguuaccaaccccgcggugcugaggaaguuaugcaucgaggccaagauuaguaacaccacgaccgauucccgcugccccacccagggcgaggccacacugauggaagagcaggacgccaauuuugugugcaggcgcacguucgucgaccggggcugggggaaugggugcgggcuuuucggcaaggguagccucauaacgugcgccaaguucaaaugcgugacuaaguuagagggcaagaucgugcaguacgaaaaccuuaaguacuccgucaucgugaccgugcauacaggcgaccagcaccaaguugggaacgagagcaucgagcacgggaccaccgcaacaaucacgccucaggcccccacguccgaaauccagcucaccgacuacggggccuuaacccuggauugcagcccccgcacuggauuggauuucaacgagauggugcugcugacaaugaaggagaaguccuggcucgugcauaagcagugguuucuggacuuaccacucccguggaccagcggggcgagcacuagucaggaaaccuggaaccggcaggaccugcuggugacguucaagaccgcccacgcgaagaagcaggagguaguggugcucgggagccaggagggugccaugcauaccgcucucaccggggccacggaaauccagaccuccggcaccaccacgauuuucgccgggcaccugaaaugccgccucaagauggacaagcugacccugaaggguaugagcuacgugauguguaccggguccuucaagcucgaaaaagaggucgcggagacccaacacggaacgguccugguccagauuaaauaugagggcaccgacgcccccugcaagauccccuucagcacccaggacgagaaggguguuacccagaacgggcgguugaucacggccaauccgaucgugaucgacaaggagaagcccgugaauauagaagcggagccgccuuucggggaguccuauauagucaucggcgcgggcgagaaagcccugaagcucagcugguuuaagaaggggucgagcauuggcaagauguucgaggccaccgcgcgcggggcccggagaauggcaauucugggcgacaccgcgugggacuucggguccauuggcgguguguucacgucgaucgggaagcuggugcaccagaucuuuggcacggcauacgggguccucuucucugguguaagcuggacuaugaagaucgggauuggcguccugcugaccuggcucggucugaacucccgcagcacuucccugucgaugacgugcaucgcugucggccucgugacccuguaucugggcguuaugguccaggccgauucagguugcgugaucaauuggaagggucgggagcugaagugcggcagcggcaucuuugucaccaaugagguccacaccuggacggagcaguacaaguuccaggcugacuccccuaagcgccuguccgccgcgauagggaaggccugggaggaggggguaugcgggauccgcagcgcgacccgucuggagaauaucauguggaagcagaucuccaacgagcuuaaccacauccuucuggaaaacgacaugaaguucaccguggucgugggagacguggucggcauccucgcgcagggaaagaagaugauccggccacagcccauggagcacaaguacagcuggaagucuuggggcaaggccaagaucaucggcgccgacgugcaaaacacaaccuuuauuaucgaugggcccaacaccccggagugccccgacgaccagcgcgccuggaacaucugggagguggaagacuaugguuucgguaucuuuacuaccaacaucugguuaaagaugcgggacagcuauacccaagucugcgaccaccggcucauguccgcggcgaucaaggacucaaaggccguucacgccgacaugggguacuggauugagucggagaagaacgagacguggaagcucgcccgggcgucguucaucgaggucaaaaccugcaucuggcccaagucccacacccuguggagcaacgguguccuagagagcgaaaugauaaucccaaagaucuacgggggcccaaucagccaacacaacuaucgcccgggcuacuucacucaaacugccggcccguggcaccuagggaagcuggagcuggacuucgaccucugcgagggcaccaccguggucgucgacgaacacugcgguaaccgggggccgucccugcgcaccacaaccgugaccgggaagauaauccacgaauggugcugccggagcugcacguuaccgccccugcgcuucaagggggaggacgguugcugguacgggauggagauccggcccgugaaagagaaggaggagaacuuggucaaguccauggucagcgccgguaguggcgaggucgauuccuucagccuggggcuccugugcaucucaauuaugauugaagaggugaugcguagcagauggucccggaagaugcugaugacggggacccuggcuguuuuccuguuacucaucauggggcaacugaccuggaacgaccugauccggcucugcauuaugguuggcgccaaugcgagcgaucgcauggggaugggcaccacguaccucgcacugauggcuaccuucaagaugcgcccaauguuugccguugggcuccuuuuccggcgccugaccucccgcgaggugcucuuguuaaccauugggcucagccugguagccuccguugagcugcccaacagccucgaggagcugggagaugggcucgcaauggggauuaugauccucaagcugcugacggacuuccagucacaccagcucugggcuaccuuacugagccuuacuuucaucaagaccacccuaucucuucacuacgcauggaagaccauggccauggugcuuagcaucgucagucugauuccccugugccucagcaccaccucgcaaaagacaacguggcuccccgugcugcuaggaagccuugggugcaagccucugaccauguuccucaucgcggaaaacaaaaucuggggccgcaaauccuggccccugaacgagggcaucauggcugugggcgucgugagcauccugcuuagcagucugcugaagaacgacgugccccucgccgggccccugaucgccggcggcaugcugaucgccugcuacgucaucagcggguccagcgcggaccucucccuugagaaggccgccgaggugagcugggaggaggaggccgagcacuccggggccagccacaauauccugguggagguccaggaugaugggacgaugaagauuaaggacgaggagcgggaugauacguuaacuaucuuacugaaggcgacccuccuggccguguccggcguauacccguugagcauccccgccacccucuucgucugguacuucuggcagaagaaaaaacaacgcuccggagugcuaugggacacccccucgccgccugagguggagcgggcagucuuagacgacggaauuuaccgcaucaugcagaggggccucuuggggcguucacaggugggcguggggguauuccaggaaaacguguuccacacgauguggcacgugacccggggcgccgugcugauguaucaggguaagcgccuagagcccagcugggcgagcgugaagaaggaccucaucagcuacggcggaggguggcggcugcagggcucauggaacaccggagaggaggugcaagucaucgccguggaacccgggaagaauccuaagaacgugcaaaccgccccggguacguucaagacgcccgagggugagguuggugccaucgcccuggauuuuaagcccgggaccagcggcagccccaucgugaacagggagggaaagaucgugggccucuacggcaaugggguagucaccacuucugggacuuacgugagcgcgaucgcccaggccaaagcaucccaggaggggccgcuucccgagaucgaggacgaggucuuccggaaacgcaaccugaccaucauggaccuccacccgggcagcggcaagacacgucgcuaucugccagcgaucguacgggaggccaucaagcgcaagcuacgaacgcucauccuggcaccaacccgggucgucgcguccgagauggcugaggcgcugaagggcaugccaauccgauaccagaccacggccgucaagagcgagcacacggguaaggagaucguggaccucaugugccacgccaccuucacaaugcgguuauuaucacccguccgcgugccgaacuacaacaugauaaucauggacgaagcccauuuuaccgaucccagcuccauugccgcgcggggguacaucuccacucgcguaggcaugggggaagccgcugccaucuucaugaccgccacgccacccggcuccguggaagccuucccgcaaucuaacgccguuauccaagacgaggaacgggacauccccgaacgcuccuggaacagcggguacgaguggaucaccgacuuccccggcaagacggugugguuuguccccuccaucaagagcgguaacgacauugcaaacugcuugcgaaagaacgggaagcgcgucauccagcuaucccggaagaccuucgacacugaguaccaaaagaccaagaacaacgacugggacuacguggucacgaccgauaucagcgagaugggcgccaacuuccgagcagacagagugauugauccgcgccggugccugaaacccguuauccucaaagacgggcccgagcgcguaauccuggcuggcccaaugcccgugaccguagccucggccgcccagcggcgugggcggauuggucgcaaccauaauaaggaaggagaccaguauaucuacaugggccagccccugaacaaugacgaggaccacgcucacuggaccgaggccaagaugcuccuggacaauaucaacacgcccgagggcaucauccccgcucuguucgagccagagagggagaagucggccgccauugacggggaauaccgccucaggggcgaggcgcgaaaaaccuucguggagcugaugcgccgcggagacuuacccgucuggcuuuccuacaaggucgcuuccgagggcuuccaguacucugacaggcgguggugcuuugacggggaaaggaacaaccaggugcuagaggagaacauggacguggagaucuggaccaaggagggggagcggaagaagcugcgccccagaugguuagacgcucgcacauacuccgauccccuggcucuucgggaguucaaggaauucgcagcgggccggcggagcgucaguggagaccucaucuuggagaucgguaagcugccucaacauuuaacgcaacgagcgcaaaacgccuuggauaaccuggugauguuacacaacucggagcagggcggccgggcauaccgccacgcgauggaggagcugcccgacaccaucgagacccugaugcugcuggcccugauagccguuuuaaccggcggcgucacgcuguucuuucugucgggccgggggcucggcaaaaccagcauuggccugcugugcgugauggcguccagcguucuacuguggauggccuccguugagccccauuggaucgcggccagcauuauccuggaguucuuccuuauggugcugcugauccccgagccugacagacagcgaacgccgcaagacaaccagcucgccuacgucgucaucggguugcuauucaugauccucaccguggccgccaaugaaaugggccugcuggagaccacgaagaaagaccucgggaucggccacguggcaguugagaaccaucaucacgcuacgauguuagacguugaccugcaucccgcauccgccuggacccucuaugcuguggcgaccacgaucaucacccccaugaugcgccauaccaucgagaacaccacggcuaacaucagccugaccgcgaucgcaaaucaagccgcgauccugauggggcuggauaagggcuggcccaucuccaagauggacauaggugucccucugcuagcccucggguguuauagccagguuaacccccugacccugaccgccgccguguugauguuagucgcgcacuacgccaucaucgggccggggcugcaggccaaggcuacucgggaggcgcagaagcgcaccgcggccgguauuaugaagaacccuaccguggacgguaucgucgcuaucgaccuugacccugucguuuaugacgccaaguucgagaagcagcuggggcagaucaugcuccucauacuaugcaccagucagauccugcuaaugcgcacgacgugggcccuuugugagagcaucacccuggcgaccggcccucucacgacucugugggagggguccccggggaaauucuggaacaccaccaucgcagugagcauggccaacaucuuccgcggguccuaccuggccggggccggccucgccuucucgcugaugaagucccuagggggcggacgccgggguacgggggcccaaggcgagacccucggagaaaaauggaagcgccaacugaaccagcuguccaagagcgaguucaacaucuacaagcgcucugguauaauggaggucgaccgcagcgaggccaaggagggccucaaacggggggaaaccacucgccacgccgugucccggggaacugccaagcugcgcugguucgucgagcggaauuugguaaagcccgaggggaaggugaucgaccugggguguggccguggggguuggagcuacuacugcgccggguugaagaaggugaccgaggucaaaggcuacaccaaggguggacccggccaugaggagccaauuccuauggcaaccuacggguggaaccuggugaaacuucauucaggcaaggacguguucuucacgccaccagagaagugugacacccuccugugcgauaucggggaaucuucgcccaacccgaccauugaggaaggccggacacugcgcguccugaagaugguggagccauggcugcgagggaaccaguucugcaucaaaauccugaacccauacaugccuagcgucguagagacgcucgagcagaugcagcgcaagcacggcggaaugcuggugcggaacccguugucacgcaacucaacucacgaaauguacuggguguccugcgggacugggaacaucgucagcgccguuaacaugacuucccggaugcuccugaacagguucacgauggcccaccgcaagcccacguacgagaaggacguugaccugggagcggggaccagacaugucgcuguagagccagaaguggcaaaucuggacaucaucggccagcgcauugagaacaucaagcacgagcacaaaagcaccuggcauuacgacgaagacaaucccuacaagaccugggccuaccauggguccuacgaggucaagccgagcggcuccgccagcagcauggugaacgggguugugaaacuguugaccaagccgugggacgugauccccauggucacccagaucgccaugaccgacaccacacccuuuggccaacagaggguguucaaggagaagguggacacccgcaccccgaaggccaaacgugggaccguccaaaucauggaagugacggcccgcuggcucuggggcuuccugucccggaacaagaaaccacgcaucugcacccgggaggaguuuacccgcaaggugcggagcaaugccgccauuggcgcgguuuuuguggaugagaaccaguggaacuccgccaaggaggccguggaggaugagcgcuucugggaucugguaaagaaggaacgggaacuccauaagcaggggaaaugcgcgaccugcgucuacaacaugaugggcaagagagagaagaaacugggggaguuuggcaaagcuaaggggagccgggcuaucugguacauguggcuuggggcucgcuuccucgaguucgaggcccugggcuucaugaacgaggaucacugguucucccgagagaacagccuguccgguguggagggugagggccuccacaagcugggcuauauccugcgcgacauaucuaaaauucccgguggcaacauguaugccgacgacacggcuggcugggauacccggauuaccgaggacgaccugcagaaugaggccaagauuaccgacaucauggagccggaacacgcccugcuagccacguccaucuucaagcucaccuaccagaauaaagucgugcgcgugcaacgcccagccaagaacgggacggucauggacgugauaagccgaagagaccagcgaggcucgggccaagucggaaccuaugggcugaauacguucaccaacauggaggcgcagcugaucaggcagauggagagcgaagggaucuuccuccccagugaacuggagacgcccaaccuugcggagcggguccucgacuggcuggagaaguacggcguggagcgccugaagaggauggcuaucagcggggacgacugcguggucaaaccgauagacgaccgguucgccacugcacucacggcccugaacgacaugggcaaggugcgcaaggacaucccccagugggagccaucuaagggguggaacgacuggcagcaaguacccuucugcagccaccacuuccaccaguuaauaaugaaggacggcagggagaucgucgugcccugccggaaucaggacgagcuagugggccgcgcccgggucucccagggggccgguuggagccuaagagagacugcaugucugggcaaaagcuaugcccagauguggcagcucauguacuuccaccgucgcgacuuacgguuagcggccaacgccaucugcagcgccgugcccguugacugggucccgaccagccggaccacgugguccauccacgcgcaccaccaguggaugaccaccgaggacaugcugagcguguggaaccggguguggauagaggagaacccuuggauggaggacaagacccacgugagcagcuggggcgacguacccuaccugggaaaaagggaagaccaaugguguggaucacugaucggccucacggcccgggccacgugggccagcaacauccaaguggcuaucaaccaggucagaaggcugaucgguaacgagaauuaccuggacuacaugacgucuaugaaacgguucaagaacgagggcgacccggagggggcgcucugguag

SEQ ID NO: 24428 - RNA, 9879 nt, Artificial Sequence
  derived and/or modified CDS sequence (opt11) from DENV-1__GU131720__SS-prME
agcgucaccaugcuguugaugcugaugcccaccgcucuagccuuucaccucaccacccggggcggggagccccacaugaucgugacaaagcaggagcguggcaagucacugcuguucaagaccagcgccggugugaauaugugcacgcucaucgccauggaccuuggcgagcugugcgaggacaccaugaccuacaagugcccccggaucaccgaagccgagcccgacgacguggacuguuggugcaacgccacggacaccugggucaccuacgggaccugcucccagaccggugagcaccgacgcgacaagcgaagcguggcccucgcgccgcaugugggucugggacuggaaacccguaccgagaccuggaugaguagcgaaggcgccuggaaacagauccagaggguggagacgugggcccuccgucaccccggguucaccgugaucgcccuguucuuggcccacgccaucggcaccucgauuacgcagaaggggaucaucuucauccuccugaugcuggugacuccaagcauggccaugcggugcgucggcaucggaucccgcgacuucguggaggggcugagcggagccaccugggucgaugucgugcuggagcacgggucgugcgugaccaccauggccaaggacaagcccacccuggacaucgagcuucugaagaccgaagucaccaaccccgcggugcugcggaagcucugcaucgaggccaagauuagcaacacuacuaccgauucccgcuguccaacccagggcgaggccacccugauggaggagcaggacgccaacuucguaugccggcgaacguucgucgaucggggcugggggaacggcugcggucuauucgguaaggguagccucaucacgugcgccaaguucaagugcgugaccaagcuggagggcaagaucgugcaguacgaaaaccugaaguauuccgucaucgugaccgugcacacgggagaccaacaccaagucgggaacgagagcaccgagcacggaacaaccgcgaccauaacgccccaggcccccaccagcgaaauccagcucaccgacuacggggccuugacacuggacugcucgccccgcacggggcuagacuucaacgagaugguacugcugacuaugaaggagaaguccuggcucguccacaagcaaugguuucuggaccucccgcuccccuggacuagcggggccagcaccucccaggagacguggaaccggcaagacuugcuggucacguucaaaaccgcccacgcgaagaagcaggaggugguggugcucggcagccaggagggcgccaugcacacggcacuaacgggagccacggaaauccagaccuccggcaccacgacgaucuucgccgggcaccugaagugccgccuaaaaauggacaagcugacauuaaagggaaugagcuacguuaugugcaccggguccuucaagcucgagaaggaagucgcggagacucagcacggcacagugcugguucagaucaaauacgagggcaccgacgcgcccuguaagauccccuucagcacacaagacgagaagggggucacgcagaacggccggcugaucacugccaacccgaucgugaccgauaaggagaagcccguaaauaucgaggccgagccgcccuuuggggaguccuauauagucaucggggcgggcgagaaagcccugaaacucuccugguucaagaagggcuccucaaucggcaagauguucgaagccaccgcccgcggggcccgacgcauggcaauccugggagacacggccugggacuucggguccguuggcggcguguucacuagcgucgguaagcuagugcaccagaucuucggaaccgcauacggggugcuauucuccggugucagcuggacuaugaagaucgggaucggaguacugcuaacguggcucggccuaaauucccgcucaaccucccugucuaugaccugcaucgccguggggcucgugacccucuaccugggcgucauggugcaggccgacucagguugcgucauuaauuggaagggccgggagcuuaagugcgguuccgggaucuucgugacgaaugaggugcacaccuggaccgaacaguacaaauuccaggcggacucaccgaaacgccuguccgccgccaucggcaaggcaugggaggagggggucugcggcauccggagcgcuacccgccuggagaacaucauguggaaacagaucuccaacgaacucaaccacauauuacuugagaacgacaugaaguucacagugguugucggggacguggugggaauccucgcgcaagggaagaagaugauacggccucagcccauggaacacaaguauagcuggaaguccuggggcaaggcgaagauuaucggcgcugacguccagaacacaacauucauuaucgaugggcccaacaccccggagugccccgacgaccagcgcgccuggaacaucugggaaguggaggacuacggcuucgggauauucgcgaccaauaucuggcugaagcugcgggacucguacacacagguuugcgaucacagguugaugagugcagccauaaaggacagcaaggcgguccacgccgauaugggcuacuggaucgaguccgagaagaacgagaccuggaagcuggcucgggcgagcuucaucgagguaaagaccugcauuuggcccaagagccacacgcuauggagcaacggugugcucgagucggagaugauaauccccaagaucuacgggggcccgauuagccaacacaacuaccgcccaggauacuucacgcaaacggcuggcccuuggcaccuggggaaguuggagcucgacuucgaccugugcgaggguaccaccgucgugguugacgaacacugcggcaaccgggggccaucccugcgcacaaccaccgucaccggcaagaucauccacgaauggugcugccggaguugcacgcugcccccccuccgauucaaaggagaggacggcugcugguacgggauggagauccggcccgugaaggagaaggaggagaaccuggugaaguccauggucagugcgggcucaggcgagguggacagcuucagccucggccugcugugcaucuccauaaugaucgaggaggugaugagaagccguuggucccgcaagauguuaaugaccggcacccuugccgucuuccuguugcugaucaugggacagcugacauggaacgacuugauccggcugugcaucauggugggcgcgaacgcaagcgaccgcaugggcaugggcacaaccuaccuggcgcucauggccacguuuaagaugcgcccgauguucgccgugggcuuguuauucaggcgcuugaccucccgggagguccugcuccugacgaucgggcuaagucugguggccuccgucgagcucccaaacagcuuagaggagcugggcgacgggcucgcuaugggcauuaugauccugaagcuguugaccgacuuccagucccaccagcuaugggccacccugcucagccugaccuucaucaagacgacccugagucuccauuacgccuggaagaccauggcgaugguccugucgaucguaucccuguuuccccucugccugaguaccaccucccagaagacuaccuggcugccuguccuccuaggcagcuucgggugcaaaccgcugacaauguuuuugaucacggagaauaagaucuggggccgaaaauccuggccgcugaacgaggggauaauggccgugggaguugucucaauccugcucagcagccugcugaagaacgacgugccccucgccgggccccugaucgccggcggcaugcugaucgccugcuacgugauuagcggguccagcgcggaccucucccuggagaaagccgccgaagucagcugggaggaggaggcggagcacuccggcgccagccauaacauacugguggagguccaagaugacggaacaaugaaaaucaaggacgaggagcgcgaugacacccucaccauccugcugaaggcgacccuccuggcagucuccggcgucuacccgcugucgaucccggccacccucuucgugugguacuucuggcaaaagaagaagcagcgcuccgggguccugugggacaccccaucgcccccugagguagaacgugccgugcuggacgacggcaucuacaggaucaugcagagaggccugcucgggcgcucccaggucggcgugggggucuuccaggagaacgucuuccauaccauguggcacgugacccggggcgcagugcugauguaccaggggaagcgccuggagcccuccugggcguccgucaagaaggacuuaaucagcuacgguggcggguggagacugcagggcuccuggaacacgggggaggaggugcaggugaucgccgucgagcccggcaagaaccccaagaacgugcaaaccgccccugggaccuucaaaacgcccgagggcgaggugggcgccaucgcccuggacuuuaagcccgggacgagcggcucgcccaucgucaaccgcgaggggaagaucgugggccucuacggcaacgggguggucaccacaagcggcacuuacgugagcgcgaucgcccaggccaaagcaagucaggaggggccgcugcccgagaucgaggacgagguguucaggaaacgcaaccugacaaucauggaccugcauccaggcagcgggaagacacgacgauaccugccggcgaucguccgggaggccaucaagagaaagcugaggacccucauccuggcccccacccgcgugguggccuccgagauggccgaggcgcugaaggguaugcccauccguuaccagacgaccgcagugaagucggagcacaccggcaaagagaucguggaccucaugugccacgccacauuuacgaugcggcugcugucccccgugcgcgucccaaacuauaacaugaucaucauggacgaagcccauuucacugaucccaguucgauagcggcucggggcuacaucagcaccagggugggcaugggcgaagccgccgccauauuuaugacagccacgccgcccggcuccguugaggcguucccgcagagcaaugccgucauccaggacgaggagcgggacauccccgagcguaguuggaauagcggguacgaguggaucaccgacuucccaggcaagaccgugugguucguuccguccauaaagagcggcaaugacaucgccaacugccuccggaagaaugggaaacgcgucauccagcugucucggaagacuuucgacacggaguaccagaagaccaagaacaaugacugggauuacguggugaccaccgacaucagcgagaugggcgccaacuuccgcgcggaccgggucaucgauccgcgccggugccuuaagcccgugauccucaaggacgggcccgagcgcgucauacuggccggccccaugccagugacggucgccuccgccgcccagcggcgcggucguaucggccgcaaucacaacaaggagggcgaccaguacaucuacauggggcagccgcugaacaacgaugaggaccacgcgcacuggacagaggccaagaugcuccuggacaacaucaauacccccgaaggcaucauucccgcccuguucgagccggagcgggagaaauccgcugcgaucgacggggaguaccgacuccgcggggaggcgagaaagaccuucgucgagcugaugagacgcggagaccugcccguguggcucuccuauaagguggccagcgagggauuccaguacagcgacaggcgguggugcuucgacggcgagcgaaacaaccagguucuggaggagaacauggacguggagaucuggacgaaggagggggagcgcaaaaagcugcgcccccgguggcucgacgccaggacguacuccgacccacuggcacuacgggaguuuaaggaauucgccgcgggucgccggagcguguccggggacuuaauccuggagaucggcaagcugccgcagcaccucacccaaagggcucagaacgcccuugauaaccugguuaugcuccacaacagcgagcaaggcggccgggccuacagacaugcaauggaggagcuucccgacacuaucgagacgcugaugcuccuggcccugaucgcugugcucaccggcggggugacccuguucuuccuauccggccgggggcucggcaagacgagcaucggccugcugugcgucauggccuccagcguucuccuguggauggccuccguugaaccccacuggaucgcggcaagcaucauccuggaguuuuuccucaugguccugcugauccccgagccggaucgccagcggacgccccaggacaaccaguuggccuacguggugaucgggcugcuguucaugauacucacggucgccgccaaugagaugggccucuuggagacaaccaagaaagacuugggaauuggccacguugcggucgagaaccaccaccacgccaccaugcuggaugucgaucugcacccugcaucugccuggacgcucuaugccguggcgaccaccaucauaaccccgaugaugagacacacgaucgagaauaccaccgccaacauuagcuuaaccgccaucgcuaaccaggcugcaauccugauggggcucgacaagggcuggcccauuagcaagauggauaucggcgugccccugcuggcgcucgggugcuauagccaggucaacccccugacgcugacggccgccgugcucaugcugguggcgcacuacgccaucauuggaccggggcuucaggcaaaggccacccgggaggcccagaagcgcaccgcggccggcaucaugaagaaccccacggucgacgggauuguggccaucgaccucgacccaguggucuacgacgccaaguucgagaagcagcuggggcaaaucaugcugcucauucugugcaccucccagauccugcucaugcgcaccaccugggcccugugcgagagcauuacgcuggcgaccgguccccuuacaacccucugggagggguccccgggcaaauucuggaacacgacaaucgcggugagcauggcuaacauuuuccggggcuccuaccuggccggcgccggccucgcguucucccugaugaaguccuuggggggcggacgccgugggacuggggcacagggagagaccuugggagagaaguggaagcgccaacucaaccagcuauccaagagcgaguucaacaucuacaagcgguccgggauaauggaggucgaccgcagcgaggccaaagagggcuugaagcgcggugaaacgaccagacacgccguuucacggggcacggcgaagcugcgcugguucguggagcggaaccuggugaagccggaaggaaaggucaucgaccugggaugcggccgcggcggcuggucuuacuacugcgccggucucaagaaggugacggaggugaaggguuauacgaagggagggcccggccacgaggagccgaucccgauggccaccuaugguuggaaucuggucaaacugcauuccggcaaagacguauuuuucacuccgcccgaaaagugcgauacccuccugugcgacaucggggagagcucuccuaacccgacgaucgaggagggaagaacccuccgcgugcucaagauggucgagcccuggcugagagggaaucaguucugcaucaagauccugaaccccuacaugcccagcgugguggaaacccuagagcaaaugcagcgcaaacacggcggcaugcugguccggaacccucugucucgcaacagcacccacgagauguacuggguuuccugugggaccggcaauauugugucggcugucaacaugacgucccgaaugcuucugaaccgcuucaccauggcacaucgcaaacccaccuaugaaagggacguggaccugggggcgggcacucgccaugucgccgucgaacccgagguggccaaccucgauauuauaggccagcggaucgagaacaucaagcaugagcauaagagcacguggcacuacgaugaggacaacccuuacaagaccugggcuuaccacggguccuacgaggucaagccgagcggcagugccagcucaauggugaacgggguggucaagcugcugaccaagcccugggacgugauccccauggugacccagaucgcgaugacugacacuacccccuucggccagcagcgcgucuuuaaagagaagguagacacccggacgccgaaggcgaagcgcgggaccgcgcagaucauggaagugaccgcccgguggcucuggggguuucugucccgcaacaagaaaccccggaucugcacccgcgaggaguucacucggaagguccgcagcaacgccgcgaucggcgccguguucguggacgagaaccaauggaauuccgccaaggaggccguggaggacgaacgguucugggaucuggugcagaaggagcgcgagcuccacaagcaggggaagugugcuaccugcguauacaauaugauggggaaacgggagaagaagcugggggaauucggcaaggcgaaggggagccgggccauuugguacauguggcugggcgcgcgguuucucgaguucgaggcacugggauucaugaaugaggaccacugguucucucgagagaacagccuguccggggucgagggagagggccuccacaagcugggcuacaucuuacgggauaucagcaagauccccgggggcaacauguacgcggacgacaccgccggcugggacacucgcaucacggaagacgaccuccagaaugaggccaagaucaccgacaucaugaagccggaacacgcccugcucgccaccucuaucuucaagcucaccuaccagaauaagguggugcggguccagcgccccgcgaagaacgguacggugauggacgugaucucacgccgggaccagagggggucggggcaggucggcaccuauggcuuaaauaccuucaccaacauggaggcucaacuaauccggcagauggagagcgaggggaucuuccuccccuccgaacuggagacgccuaaccuagccgagcgcguacucgacuggcuggagaaguacggcguggagcggcugaagcgcauggcgaucagcggggacgacugcgucgucaagccgaucgacgaccguuucgcgacagcgcuuaccgcccugaacgacaugggcaaggucagaaaggacaucccacagugggagcccaguaagggguggaacgacuggcagcagguccccuucugcagccaccacuuccaucaacugauuaugaaggacgggcgagagauuguugugccuugccgcaaccaggaugaguuaguaggccgggcccgcgugucccagggcgcaggcuggagcuuacgggagaccgccugcuuaggcaagucguacgcgcagauguggcaauuaauguacuuccaccgccgggaccugagacuggccgccaaugccaucugcagcgcggugcccauugacuggguccccacuagccgcaccaccuggucgauccacgcccaccaucaguggaugaccacggaagacaugcuaagcguguggaaccgcguguggaucgaggagaaccccuggauggaagacaagacccaugucuccagcuggggcgacgugccguaccuggggaagagggaggaccaguggugcggcucccugaucggccucaccgcucgcgccacaugggcuaguaacauccagguggcgaucaaccagguccgucggcugauugggaaugagaacuaccucgauuacaugaccuccaugaagagauucaagaacgagggggaccccgagggugcccugugguga

SEQ ID NO: 24429 - RNA, 9879 nt, Artificial Sequence
  derived and/or modified CDS sequence (opt11) from DENV-1__HM181960__SS-prME
uccgugaccauguuguuaaugcugaugccgacggcacuggcauuucaccucaccacccggggcggggaaccccacaugaucgugagcaagcaggagaggggcaagagccugcuguucaagaccagcgccggggucaacaugugcacccuaauugccauggaccugggggagcugugcgaggauacgaugaccuacaaguguccccggaucaccgagaccgagcccgacgauguggacugcuggugcaacgccacggauaccugggugaccuacgggaccugcagccagacgggcgagcaccggcgggacaagcgguccguugcgcucgcgccccacgugggccuggggcucgaaacccggaccgagaccuggaugagcuccgagggcgccuggaagcaaauccagcgcguugaaacgugggcccucaggcaucccggguucaccgugauugcccuguuccuggcccacgcgaucggcaccagcaucacccagaagggaaucauauucauccuccuuaugcuggugacgcccuccauggcaaugcgaugcgugggcaucggcagcagggauuucguagaggggcucaguggcgccaccuggguggacgucgugcuggagcacggguccuguguaaccaccauggccaaggacaagcccacgcuggauauugagcuccuuaaaaccgaagucacuaaucccgccgugcugcggaagcuaugcaucgaggccaagaucuccaacaccacgacagauucccgcugcccgacccagggcgaggccacccugguagaggaacaggacgcaaacuucgucugccggcgcacguucguggaccggggcugggggaacggcugcgguuuguuugggaaggggucccucaucacgugcgccaaguuuaaaugcgugacuaagcuggaaggcaaaaucguccaguacgaaaaccugaaguacagcguaaucgugaccguccacacgggcgaucagcaccaggugggaaacgaauccaccgagcauggcacgaccgcaacgaucacaccccaggcgcccacaaccgagauccaacuuacggauuacggggccuuaacgcuagauugcagcccaaggaccgggcucgauuucaacgagauggucuugcugaccaugaaagagaagaguuggcucgugcacaagcagugguuccuggaccugccauuacccuggacuagcggggccagcacaucccaggagaccuggaaccggcaggaccugcuggugaccuuuaagaccgcccacgccaagaagcaggaggucguggugcucggcagccaagagggcgcgaugcacacggcucugaccggggcuaccgaaauccagaccaguggcacgaccaccaucuucgccggccaccugaagugucgccucaaaauggacaagcugacccuaaagggaaugucguacgucauguguacgggguccuuuaagcucgagaaggagguggccgaaacgcagcacggcaccguccugguccaaaucaaguacgagggcacagacgcacccuguaaaauccccuuuagcacgcaggacgagaaggggguaacccagaacggccggcugaucacagccaacccgaucguaaccgauaaggagaagcccgugaacaucgaggccgaaccaccauuuggcgagucguacaucguaaucggcgccggcgagaaggccuuaaagcucagcugguuuaaaaaggggaguagcauuggcaagauguucgaggccacggcccguggggcccggcgcauggccauccugggugacaccgcgugggacuucggguccaucggaggcguguucaccagcgucgggaaacuugugcaccagaucuuuggcaccgcuuacgggguccucuucuccggcgucucauggacgaugaagaucgggauugggguacugcugacgugguuaggccuuaacuccaggaguacgucccucucgaugaccuguaucgccguugggcucgucacgcuguaccuggguguaaugguacaggccgacucggggugcgucaucaacuggaaggggcgggaacucaagugugggagcggcaucuucgugacaaacgaggugcacaccuggacagagcaguacaaguuccaggccgacucuccgaagcgccugucagcugccaucggcaaggcaugggaggagggggucugcggcauccgguccgccacaagauuggaaaacaucauguggaaacagaucuccaacgagcucaaccacauccugcuggaaaaugacaugaaguucacggugguagucggggacguggccggcauacucgcgcaggggaagaagaugauucggccccagcccauggaguacaaguauagcuggaaguccuggggcaaggcgaagauaaucggggccgacguccagaauaccacuuucauaaucgacgggccgaacacaccggagugccccgacgaccagcgcgccuggaacaucugggaagucgaggacuacggguucgggauuuucacgaccaacauauggcugaagcugcgggacagcuacacucaggugugcgaccaccgucucauguccgcggccaucaaggacagcaaggccguacacgccgacaugggcuacuggaucgaaagcgaaaagaacgaaaccuggaagcuggcgcgggcaucuuucauugaggucaagacgugcauuuggcccaagucacacaccuuauggagcaacggcgugcucgaguccgagaugaucauccccaagaucuacgggggcccgaucagccaacacaacuaccgccccggguacuucacccaaaccgccggccccuggcaccugggcaagcuggaguuagacuucgaucuaugugaagggacuaccguggucguggacgagcauugcggcaaccggggaccgucgcugcgcaccaccacggugacagggaaaaucauccacgaguggugcugccggagcuguacccugccuccccuacgcuuccgcggggaggacggcugcugguacgggauggaaauccgccccgucaaggaaaaggaggagaaccuggugaagaguaugguaagcgccggcagcggcgaggucgacucguucagccuggggcugcuguguaucuccaucaugaucgaggaggugaugcggucacgaugguccaggaaaauguugaugaccggcacguuagccgucuucuuucugcucaucaugggccaauugaccuggaacgaccugauucgccucuguaucauggucggcgccaaugcguccgaccgcauggguaugggcaccaccuaccuugcucugauggccaccuucaagaugagaccgauguuugccgugggguugcuguuucguaggcugaccucccgcgaggugcuccuuuugaccauagggcucagccugguagccaguguggagcugccaaacagccucgaggaacugggugacggguuagcgauggguaucaugauccucaagcuguugaccgacuuccaaucgcaccagcucugggccacgcuacugagccucaccuuuaucaagaccaccuucucccuucacuacgccuggaagacgauggccaugguccuuucgaucguuagucucuucccccugugcuuaagcaccaccucccagaagaccacguggcugcccgugcugcugggcagccuuggaugcaagccgcugaccauguucuugauagccgagaacaagauuuggggccggcgcuccuggccccucaacgaagggauuauggccguaggcaucguguccauccuacugagcucccuccugaagaacgacgugccccuggccggcccccucaucgccggcggcaugcugaucgccugcuacgucaucuccggguccagcgccgaccugucccucgaaaaggccgccgaggugagcugggaggaggaggcagagcauucaggcgccagccacaacauccugguggaaguccaggacgacgggaccaugaagaucaaagaugaggaacgggacgacacccugaccauccucuugaaggcgacguuacucgcgguguccggcguguacccgcuguccauacccgccacccuguucgucugguauuucuggcagaagaaaaagcagcgcuccggggugcucugggacacccccagcccacccgaggugggccgggccguccuggacgacgguauuuaccgcaucaugcagcggggacuucuuggccgcucccaggugggggugggcgucuuccaggagaacguguuccacaccauguggcacgugacgagaggggccguccucauguaccagggcaagcgccuggagcccagcugggcguccgugaagaaggaccugauuagcuacggcggaggguggcggcugcagggcuccuggaacaccggggaggaggugcaggucaucgccguggagcccgggaagaacccgaagaacgugcagaccgcucccggcaccuuuaagacgcccgaaggcgaggucggcgccaucgcccuggacuucaagcccggcaccagcgggucccccaucgucaaccgcgagggcaaaauagugggccuauacgggaacgggguugugacuacgagcgggacauaugucucggcgaucgcccaagcgaaggcuucccaggagggcccgcuccccgagaucgaggacgaggucuuccggaagcgcaaccucacgaucauggacuugcacccaggaagcggcaagacucggcgcuaccucccagcgauaguucgugaggccaucaagcgcaaacuccgcacccugauccucgcacccacgcgggugguugccuccgaaauggccgaagcgcuuaagggaaugcccauccgcuaccagacaacagccgucaagagcgagcauacgggaaaggagaucguagaccugaugugccacgccacguucaccaugagacuccugucacccguucgcgugccgaacuacaacaugaucaucauggacgaggcacacuucaccgaccccagcuccauagccgcgcggggcuacauauccacacgcguggggaugggagaggcggccgccaucuucaugacggccacgccgcccggguccgucgaggcguucccgcagagcaacgccgugauccaggacgaggaacgcgacauccccgagcgcuccuggaacuccggcuacgaguggauuaccgacuuccccggcaagaccgugugguuugucccauccaucaagucagggaacgacaucgcgaacugccuucggaagaauggcaagcgcgugauccagcucucccgcaagacguuugacaccgaguaccagaagacgaagaacaacgauugggacuacguggucaccacggacaucagcgagaugggggccaacuuccgcgcggaccgggugaucgacccgcgccgaugccuuaagccugugauucugaaggacgggcccgagagggucauccucgcagggccgaugccggugacggucgccuccgcggcccagcggcgcggccggaucggccgcaaccacaacaaagagggggaccaguacaucuauaugggccaaccgcugaacaacgacgaggaccaugcgcacuggacagaagccaagaugcugcucgacaacauuaacaccccugaggggauaauccccgcccuguucgagccagagcgcgagaaguccgcugccaucgacggugaguaccggcugcgcggggaagcgcggaagaccuucguggagcugaugcggcggggugaccugccuguguggcuguccuacaagguagcaagcgaaggcuuccaguacagcgaccgccgaugguguuucgacggugagcgcaacaaccaagugcucgaggagaacauggacguagagaucuggaccaaggagggcgagcggaagaaacugcguccccgguggcucgacgcucgcaccuacagugacccccucgcccugcgggaguuuaaggaguucgccgcagggcgcagaucggucuccggcgaccugauccucgagauuggcaagcugccgcagcaccugacccagcgcgcacagaacgcccucgacaaccuggugaugcugcacaacuccgagcagggcggucgggccuaccgccacgcgauggaggaguugcccgacacgaucgagacucugaugcugcuugcgcugaucgcggugcuuaccgggggcgugacccucuucuuucucucagggcggggccugggcaaaaccucaaucggucuccugugcgugauggcuuccagcgugcuccucuggauggccuccguggagccccauuggauagcggccucaaucauccuggaguucuuccuuauggugcucuugauccccgagccggaccgccagcggacaccccaggacaaccaacuggccuacgugguaaucggcuugcuguucaugauccugacgguggccgcuaacgaaauggggcuccuugagaccaccaagaaagaccuaggcaucgggcacguggcagucgagaaccaucaccacgccgccaugcucgacguggaccugcaccccgcauccgccuggacgcuguacgcgguggccaccaccaucaucaccccgaugaugcgccacacgaucgagaacaccacagccaacaucucucucaccgcaaucgccaaccaggcggccauccuuaugggccuugacaaaggcuggcccaucuccaagauggacaucgggguccccuuacuggcccucggcugcuacagccaggugaacccccucacgcugacugccgcuguauuaaugcucgucgcucacuacgccaucaucgggccuggacuacaggcuaaggccacucgcgaggcacagaagcggaccgccgccgggaucaugaagaaucccacgguggacgguaucguggccaucgacuuagaccccgucguuuacgacgccaaguucgagaagcagcucggacagaucaugcugcugauacucugcaccucccaaauccugcugaugaggaccaccugggcucucugcgagagcaucacacuugcaaccggaccucugaccacccucugggagggaucccccgggaaguucuggaacacgaccaucgccgugagcauggccaauaucuuucguggcagcuaccuggcaggcgcggggcuggcauucagccucaugaaaagccugggcggagggaggcgggggacgggcgcccagggcgagacacuaggggagaaguggaagcgccagcucaaccagcucuccaaaagcgaguucaacacguauaagagaucgggcaucauggaggucgaccgcagcgaggccaaggaggggcucaagcggggcgagaccaccaagcacgcggucucccgcgggacagccaagcuccggugguucguggagcgcaaccucguaaagcccgagggccgggugaucgacuuaggcugcgggcgcggcggguggagcuacuauugcgccggauugaagaaggucacggaaguuaagggguacaccaaaggcggcccggggcaugaggagccuaucccaauggcuaccuacggcuggaaccucgugaaacugcacuccgggaaggacguguucuucaucccgcccgagaagugcgacacauugcucugcgacauaggcgagagcucccccaacccgaccaucgaggaggggcgcacucugaggguccugaagaugguggagcccuggcuccggggcaaccaguuuugcaucaaaauccugaaccccuacaugcccagcguggucgagacccuggagcaaaugcaacgcaagcacggcgggaugcucgugcggaauccgcugucccgcaacaguacccacgagauguauuggguguccugugggacgggaaacaucgucagcgcagugaacaugacgucccgcaugcugcucaaccgguucaccauggcccaccgcaagcccaccuaugagcgggacguggaccugggagccggcacccgacacguagccguggagcccgaggucgcgaaccuugacauuaucgggcagcggaucgagaauaucaagcacgagcacaaguccacguggcacuacgacgaagauaaccccuacaaaacuugggccuaccacggguccuacgaagucaagccuagcgguuccgcuagcagcaugguuaacggcgucgugaaacugcugaccaagccaugggacgugauaccuauggucacccagaucgcaaugacugacaccacccccuucgggcagcagcgcguguucaaggaaaaaguggacacccggaccccgaaggccaagcgcggcaccgcacagaucauggaggucaccgcuaaguggcuguggggcuuccucucgcggaacaagaaaccaaggaucugcacccgggaggaguuuacgcgcaaggugcggagcaacgcggccaucggugccgucuucguugaugagaaccaauggaacuccgcaaaggaggcgguggaggacgagcgcuucugggaucuuguccaccgggagcgcgagcuacacaaacaaggcaagugcgcgacgugcgucuacaacaugauggggaaaagagagaagaagcucggagaguucgggaaggccaagggcagccgcgccauaugguacauguggcugggcgccagauuccuugaguuugaagcgcucggguucaugaacgaagaccacugguucuccagagagaacucuuuaucgggcguggaaggagagggacuccacaagcucggguacauccugcgggacaucagcaaaauccccggcggcaacauguacgccgacgacaccgccggaugggacacccgcaucacggaggacgaccugcaaaacgaggcccgcauuacggauauaauggagccggagcaugcccuccuggcgaaauccaucuucaaguuaaccuaccagaacaaagucguacgagugcagcgcccagccaagaacggcaccgugauggacgucaucagccggcgcgaccagcggggauccggccaaguuggcacguacgggcucaacaccuucaccaauauggaggcccagcugauccggcagauggagagcgagggaauuuucaguccaagcgaacuggaaaccccuaaccucgcugagcggguacuggacuggcuggagaaguauggggucgagcgcuugaagcggauggccauuucuggcgaugacuguguggugaagccaaucgacgaccgcuuugcgacggcgcugaccgcgcugaacgauauggguaagguucggaaggauaucccccaaugggagcccucgaagggcuggaaugacuggcagcaggucccuuucugcucacaccacuuccaccagcucaucaugaaggacggccgggagauugucgucccgugccggaaccaggacgagcuggugggaagggcccgggugucucaaggcgccggguggagccugagggagaccgcgugccuggggaaguccuacgcucagauguggcagcugauguacuuccacagacgcgaccugcggcucgccgccaacgcgauuugcagcgcggugcccguggacuggaucccaacaucccgcacgaccuggagcauccaugcccaccaccaguggaugaccacugaggacaugcuuuccguguggaaccgagucuggauagaggagaaccccuggauggaggacaagacucacaucagcuccuggggagacgugccguaccugggcaagcgggaggaccaguggugcggcagcuuaauuggucugacagcccgcgccaccugggcgaccaacauccagguggccaucaaccagguccgucgcuugauuggcaacgaaaauuaccucgacuacaugaccucuaugaagcguuucaagaacgaaucagacccugagggagcccugugguaa

SEQ ID NO: 24430 - RNA, 9879 nt, Artificial Sequence
  derived and/or modified CDS sequence (opt11) from DENV-1__HM181963__SS-prME
ucgguaacaaugcuacugaugcuaaugcccaccgcacuggccuuccaccuaacaacacgcggcggcgaaccacacaugauaguaagcaaacaagaacggggcaaaucacuucuauucaaaaccucagcaggaguaaacauguguacccuaauugcuauggaccuaggagaauuuugcgaagauacaaugaccuauaaaugcccacggauaacggaagccgaaccagaugauguggauugcuggugcaaugcaacagacaccuggguaacguacggaaccugcucucaaauaggggagcaucgccgugauaaacgaucggucgcucuggccccucacgugggccucgggcucgagacuagaacagagaccuggaugaguagugagggcgcauggaaacaaauccaaaggguggaaacaugggcacugcgacacccaggcuucacugucauagcccuuuuccucgcacaugcaaucggaacaucgauaacacaaaagggcauaauuuucauccucuugaugcucguuacacccagcauggcaaugcgcuguguugggaucggcagcagggacuucguggagggccuguccggggcaacgugggucgacgucguccuggagcacgggaguugugugacaacgauggcgaaagauaaacccaccuuagacauagagcuacuaaaaacugaaguaaccaacccugccguccucaggaaauuauguaucgaggcgaaaauaagcaauaccaccacagauagucgcugcccgacgcaaggggaagcgacuuuggucgaagaacaagaugcaaacuucguaugccggagaaccuucguagaccgggguuggggaaacggcugcggcuuauucggcaaaggaucucuuaucacgugcgcgaaauucaaaugcguuacgaaauuggaagggaaaaucguacaauacgaaaaucuuaaguacucagucaucguaacaguacacacgggcgaccaacaucaaguagggaacgaauccacagagcacgguacaaccgccaccauaacaccgcaggcaccaagcaccgagauccaacuaacggacuacggggcccuaacccucgacuguaguccgcgaacgggacucgacuucaacgagaugguccuccucaccaugaaggagaaaucauggcucguccauaaacaaugguuccucgaccuaccccuccccuggaccagcggggcguccacaagccaagaaacauggaaucgacaagaccuccucgucaccuucaaaacagcacacgcgaagaaacaagaggugguaguacuaggaucccaagagggugcgaugcauacagcgcugacaggcgcaaccgaaauacaaacgagcgguacaaccacgauauucgccggccaccuaaagugccgccugaaaauggacaaacucacccugaaaggcauguccuacgugaugugcacggggucauucaaauuagaaaaagaggucgcggaaacccaacacgggaccguacucguacagaucaaauaugagggcacggacgcaccauguaaaaucccauucagcacacaggacgaaaagggcguaacacaaaacggacggcucaucacagccaaccccauuguaaccgauaaagaaaagcccgugaacauagaagcagagccaccuuucggagaaucauacauagucauaggugucggggaaaaggcgcucaaauugaguugguucaaaaaggggaguagcauagguaaaauguuugaggcaacggccagaggggccaggcguauggccauacuaggcgacacagcgugggacuucgggaguauaggaggcgucuucaccucgguaggaaaacucguccaccaaauauucggaaccgcguacggggugcuauucuccggagugagcuggacaaugaaaauaggaauuggagucuuauuaacaugguuaggacuaaacagcaggucaaccagccuaucaaugacaugcaucgcuguuggauuaguuaccuuauaucuggggguuaugguacaagcagacuccgggugcgucaucaauuggaaagggcgcgaacucaagugcggcagcgguaucuuugugacgaacgagguacauacguggacggagcaguacaaguuucaggcagauagcccgaaacgucucagugcagcaaucggaaaggcgugggaggagggugucugcggcauuaggagcgcuacacgacuagaaaacauaauguggaagcagaucagcaaugaacuuaaccacauacuccuagaaaacgacaugaagcucacagugguagucggggacguggcaggaauccuggcacagggcaagaaaaugauaagaccccagccaauggaauacaaguacagcuggaaaucguggggcaaagccaagaucauuggcgcagauguacaaaacacuaccuuuaucaucgacggcccuaacaccccggaguguccggacgaucaaagagcguggaacauaugggagguagaagacuacggguucggcaucuucacgaccaauaucuggcucaaacuacgugacagcuauacgcaagucugcgaccaccgccuaaugagcgcugcgaucaaagacuccaaagcaguacaugcagacaugggauauuggaucgaaucggagaaaaacgagaccuggaaacuugcgcgcgcgagcuucaucgaagugaaaacuugcauauggcccaaaagccacacacuguggagcaacggagucuuagaaucugaaaugaucaucccaaagaucuacgguggcccaaucucucagcacaacuaccgcccuggcuacuuuacgcaaacagcuggccccuggcaucucgggaagcucgagcuagauuuugaccugugugagggaacuacaguagucguagaugaacacugcggaaaccggggcccaucacuuaggacgacuaccguaaccggcaaaaucauacaugaauggugcugccgcagcugcacccuuccgccacuuagguuuaagggcgaggacggcugcugguauggaauggaaauacggccagugaaagagaaggaagagaaccucgugaagucgaugguuagcgccggauccggcgagguagacuccuuuucucuuggcuugcugugcauaagcaucaugaucgaagagguaaugaggucacguuggucacgaaaaaugcuaaugacggguacucuggcuguguucuucuuacugaucauggggcagcuaacauggaacgaccugauccgcuugugcauaaugguuggggcgaacgcgucagaccgaaugggaaugggcaccacauaucuggcguuaauggcaaccuucaagaugcgaccgauguucgcaguagggcugcuauuccgucgauugaccucccgcgagguucugcuacuuacaauuggcuugucauugguagcaagcguggaauugccuaacucguuggaagaguuaggagacggucuggcuaugggaaucaugauccucaaauuacucacagacuuccaaucacaucaacucugggcgacauuacucucuaugaccuucauaagaacaaccuuuucgcuacauuacgccuggaaaacuauggcaaugguucuaaguauagugagccuauucccucuuugccuaagcacaacaucccaaaagaccacguggcuccccguguuauuagggagccugggaugcaaaccacuaacaauguuccuaauugcggaaaauaagauaugggggagaaagucauggccauuaaacgaaggaauaauggccgugggaaucguguccauucugcuaucguccuuacucaaaaaugacguaccacuagcaggaccguuaaucgcaggaggaaugcuuaucgcauguuacgugauuagcggauccucggcggaccuuucacuugagaaggcagcggucguaagcugggaggaagaggcggaacacaguggagcgucacacaacauccuaguggaggugcaagacgauggaacgaugaaaauaaaagacgaagaacgcgacgacacccugacgauccuucucaaagcaacacuucuagccgucuccggaguauauccccuguccauuccagcgacacucuucgucugguauuuuuggcagaagaagaaacaaagauccggcguccugugggacacaccguccccuccggagguggagagggcagucuuagacgacgggauauacaggauaaugcaaaggggacuucuaggaaggucccaaguagguguugggguauuucaagaaaauguauuucacacgauguggcacgucacacgaggcgccguccuuauguaccagggaaaacgccuggagcccucgugggccuccgucaagaaagaucuuauaagcuacggaggcggguggaggcuccagggauccuggaacacaggggaagaaguccagguaaucgccguagagccggggaaaaaccccaaaaauguacagacggcacccggaacguucaagacaucagaaggcgaagucggagcgauagcccuagauuucaaacccgguaccucagguuccccaaucgugaaccgggagggcaaagucgugggccucuauggaaacggaguaguaacuacaagcggaaccuauguaucggccauagcgcaagcgaaggcaucccaagaaggcccccuccccgagaucgaagaugaggucuuucgcaagaggaaccugaccaucauggauuuacacccagggagcggcaaaacucgacgauaccuaccagccauaguacgcgaggcaauaaaacguaaacuuaggacucugauacuggcaccuaccagagugguggcaucagaaauggccgaggcucugaaagggaugcccauaagauaucagacgacugcagucaagagugaacacaccggaaaagaaaucgucgaccuaaugugucacgcuacauucacuaugcgucugcugucgcccguucgaguaccgaacuacaacaugauaauuauggacgaagcccacuucacagacccaucaucgauagccgcgcgagguuacauaaguacacgaguuggcaugggagaagccgcagcaauauuuaugacggcgacgccucccgggucuguggaggccuuuccacaaagcaacgcaguuauacaggacgaagagagagacaucccggagagaagcuggaacucuggguacgaguggauaaccgauuucccgggcaagacagucugguuuguaccgagcauaaagucgggcaaugacauagccaacugccuaagaaagaaugggaagcgcguaauccaacuaucacgaaaaaccuucgacacggaguaccagaagaccaaaaacaacgacugggauuacgucgugaccacugacaucagcgaaaugggcgcgaauuucagagccgauagggucauugauccacggcggugcuuaaaaccgguaauacuuaaggacgggccagaacgagugauuuuagcaggacccaugcccgucacuguggcuucggccgcgcagcgaagaggacgaauaggacgaaaccauaauaaggaaggcgaccaauauaucuacaugggccaaccgcuaaauaacgacgaagaucacgcacauuggacggaggcaaagaugcuccuagauaacauaaauacaccagaaggaaucauucccgcacuguucgaaccggaacgagaaaagagugcggcaauagauggcgaguacaggcuacggggcgaggcucggaaaaccuucguagaacucaugagacggggcgaccuuccuguauggcucagcuacaagguggcaagcgaaggauuucaguacucagacagacgcuggugcuucgacggagagcgcaauaaucagguacuggaagaaaacauggacguggaaauauggaccaaagaaggggaaagaaagaaauuacguccucgcugguuagacgcaagaacauauagcgacccacuagcacugcgagaguucaaggaguucgccgcuggaagaagaagcgucuccggggauuuaauccuugagaucggcaagcuaccucaacaccucacccagagagcacaaaaugcgcucgacaaucuagugaugcugcacaacucggagcaaggaggacgcgccuauagacacgccauggaggaauugcccgacacgauagaaacgcugaugcugcucgcccucaucgcagugcugacaggcggcgucacacuguucuuccucagcggacggggacuggggaagaccagcaucggccuacugugcgucauggccucaagcguauugcuguggauggccagcguagaaccgcacuggauagcggcuucuaucauacucgaguucuuucugaugguacuguuaauacccgaacccgaccgucagcgaacgccccaagacaaccaacuggcauacguaguaaucggucuacucuucaugauccucacaguggcggccaaugagaugggacuucucgagacaacuaagaaagaccuaggaauaggccacguagcaguggaaaaucaccaccacgcggcaaugcuggacguagaccuacacccagcauccgccuggaccuuguacgcaguggccacaacgauaaucacacccaugaugcgacacacaauugagaacaccaccgcaaauauuucgcuaacggccauugccaaccaagcagcuauacucaugggccuagauaagggcuggcccaucuccaagauggacauaggcgucccuuugcuggcccuaggaugcuacucgcaaguuaaccccuugacacuaacggcggcaguccugaugcugguggcacacuaugcaauaauaggcccaggccugcaagccaaagcaacgcgagaagcacagaaaagaacagccgcaggaaucaugaaaaaccccacaguugaugggaucgucgcaauugaccucgaccccguaguguacgacgcaaaauucgagaagcaacuaggccaaauaauguugcucauucucugcacaucacaaauccugcugaugagaacaacuugggcacucugcgaauccaucacccucgcgaccgguccauugacgacauuaugggaaggcagucccggcaaguuuuggaacacaacaaucgcggucucuauggccaacauauucagggggagcuaccuagcuggggcaggccucgccuuuucccuuaugaaaagccugggaggaggcaggcgaggaaccggagcgcagggcgagaccuugggagagaaauggaagcgucagcucaaccagcuauccaaauccgaguuuaacacguauaagcgaucaggcaucauggagguggacagaagcgaggccaaggagggucuuaaaagaggagaaacgacgaagcaugcggugucccgggggaccgccaagcuacggugguuuguggaacgcaaucucgugaaaccugaagggaaagucauagaucuaggauguggccgagguggcuggaguuacuauugugcuggccucaagaaagucaccgaaguaaagggcuauacaaaaggcgggccuggccacgaagaaccaauacccauggcgaccuauggguggaaucuagugaaguugcacagcggcaaagauguguuuuucaucccgcccgagaaaugugacacccuacuaugcgacaucggggaaucgucccccaacccaacgauagaagaaggaagaacgcugcgcgugcuuaagaugguggagccguggcuacguggcaaccaauucugcauuaaaauauugaacccauacaugccaagcgugguggagacacuagagcagaugcagaggaagcauggaggaaugcugguccgcaauccccuaagcaggaacucgacacacgagauguauuggguguccugcggaacaggaaacaucgucagcgcagucaacaugacaucucgaaugcuacugaacagauucaccauggcccaccgcaagcccaccuacgaacgggacgucgaccugggugccgggacucgccacguggcuguagagccugaaguagcgaaccucgacauuauagggcaacgaauagagaacaucaaacaugagcacaaaucgaccuggcacuaugaugaagacaauccuuacaaaacgugggcauaccacggaucauaugagguaaagccauccggaagugccagcuccaugguaaauggugucgugaaacuacucacgaagcccugggacgugauucccaugguaacgcaaauagcgaugacagacacaacgccuuucggccaacagcgcguauuuaaggaaaagguggacacgcgcacaccaaaagcgaaaagggggacagcacaaauaauggagguaaccgccaaauggcucuggggcuuccuaucgcggaacaagaagccgagaaucuguacgagggaggaguucacuaggaaagugagauccaaugccgcaauaggugcuguguucguggacgagaaucaguggaacagcgcaaaagaagcagucgaagaugagagauucugggaccuaguccacagagaacgagaacugcacaagcagggaaaaugcgcaacaugcguauauaauaugaugggcaagagggagaagaaacuaggcgaguuuggcaaagcgaagggaucccgcgcaaucugguacaugugguugggcgcgagauuccucgaauuugaagccuugggcuucaugaacgaagaccacugguucagcagggagaauagcuugucaggugucgagggggaaggcuuacacaaacuuggguacauauuacgugacauaucaaaaauacccggaggaaacauguacgcggaugauacggccggaugggauacucggauuaccgaagacgaccuacaaaacgaagcuaaaaucacagacaucauggaacccgaacaugcucuccuugcaaaauccauauucaaacucaccuaccagaacaaagucguaagaguccaacgacccgcgaagaauggaaccguaauggacgugauaaguagacgggaccaacguggaagcggccaaguggggacguacgggcuaaacacguucaccaacauggaagcgcaacuaauucgacagauggaaucagagggaauauucucaccuucugaauuggaaacaccgaaccuagcaggacgggcauuagacuggcuagagaaacacggaguggagcggcucaagagaauggccaucuccggcgacgauugugucgucaaaccaauugacgaccgcuuugcaaccgcacuaacugcguuaaacgacaugggaaagguaaggaaagauauuccacaaugggaaccgagcaaaggcuggaaugauuggcaacagguaccauuuugcucgcaucacuuccaccaguugaucaugaaagacggccgagagauuguaguaccgugcagaaaccaagacgaauuaguugggagagcccgugugucccaaggagcgggauggucccuccgagaaacagcgugccuaggaaagaguuaugcacagauguggcaacucauguauuuccaccggcgugaccugcggcuggcggcgaacgcgauaugcagugcgguccccguggauugggucccgacaucgcgcacaacguggagcauacacgcacaccaccaguggaugacuaccgaggacaugcuaagcguauggaaccggguguggauagaggagaaccccuggauggaggacaaaacccacauaagcagcuggggagacgucccguaccucggaaaacgugaggaccaauggugcgggucauuaaucggacuaaccgccagggccaccugggcgacuaauauccaggucgccauaaaucagguacgccggcugcucgguaacgaaaauuauuuagacuacaugaccuccaugaagcgauucaagaaugaaagcgacccggaaggggcacugugguag

SEQ ID NO: 24431 - RNA, 9879 nt, Artificial Sequence
  derived and/or modified CDS sequence (opt11) from DENV-1__HM181964__SS-prME
agcguaaccaugcugcuaaugcucaugccuaccgcacucgcuuuccaccuaacgacacgugggggcgaaccgcacaugauagugucgaaacaagaacggggcaaaagccuacuauuuaaaacgucugccggggugaacauguguacccucauugcaauggaucuaggugaacucugugaagacaccaugacauacaaaugcccccgaaucacugaaaccgaaccagacgacguugacuguugguguaaugcgacugauacaugggucacauauggaacuuguucccaaaccggggaacaccgccgagacaaaaggagcguggcauuggcgccccacgucggccuuggucucgaaaccaggacagaaacuuggaugagcucggaaggagcauggaaacaaauacaacgagucgaaaccugggcauuacgccacccaggguuuacuguaaucgcccuuuucuuagcacacgcaaucggcacgaguauaacacaaaaagguauaaucuucauucucuuaaugcucguaacaccaucaauggccaugagaugcguaggcauagggucacgugacuucguagaaggacuauccggagccacauggguagacguaguccuggaacacggaucguguguaaccacaauggcuaaagacaaacccacccucgauaucgaauuacugaagacggagguuacgaauccagcggugcuccggaaacucuguauagaagcaaagauuucaaauacaacaacugacagccgaugcccaacccaaggggaagcaacgcucguggaggagcaagaugcaaacuuuguuugccggcgaacuuucgucgacagaggauggggcaacggcugcggccuauuuggaaagggaagccucauaacgugugcaaaguucaaaugugugacgaaauuggaaggaaaaauaguccaauacgaaaaccuaaaauacagcgucauuguuacuguacauaccggggaccaacaccaagucgggaacgaauccacagagcauggcacaaccgccaccaucacuccccaagcucccaccacagaaauucaauuaacggacuauggagcacuaacccuggacugcuccccacggaccggucuggacuucaacgagaugguauugcucaccaugaaggagaaaucgugguuggugcacaagcaaugguuccuugaccugccacuaccuuggacuucuggagccucgacaucgcaggagacauggaaccgacaagaccucuuagugaccuucaaaacagcccaugcgaagaaacaagaagucguaguacucgggucacaggaaggagcaaugcacaccgcccucacuggggcaacggaaauccaaaccuccggcaccacaacgaucuucgccggacaccugaagugucggcugaaaauggauaagcucacacugcgaggcaugucuuacgucaugugcaccggcucauucaagcuagaaaaggaagucgccgagacgcaacaugguacaguccucguacaaauaaaauacgagggcaccgacgcccccugcaaaaucccauuuagcacccaggaugagaaaggcgucacgcaaaacgggcgacugaucaccgccaaccccaucgucacagacaaagagaaaccagucaacauagaagcugaaccaccguucggagagucauacaucgucaucggcgcuggagaaaaggccuuaaaacuguccugguucaagaaaggaucgagcauaggcaaaauguuugaggccacggcacggggagccagaaggauggccauacuaggggacacagccugggacuuuggcagcauuggaggaguguucacuagcgugggcaaacugguccaccagauauucggcacagcguaugggguccuuuuuaguggcguaagcuggacgaugaaaaucggaauagggguacugcuaacuuggcuaggccugaauagccguucuacaucccuaaguaugaccugcaucgcagucggccuagucacccucuaccuaggugugaugguucaggcagacucaggcuguguaaucaacuggaaaggaagggaauugaagugcggaagcggaaucuucguuaccaaugaaguccacacauggacggagcaauacaaauuucaggcggauucgcccaaacgacuaagcgccgcaaucgguaaagcgugggaggaaggcgucugcggcauccguucagcgaccaggcucgagaacauaauguggaaacaaauaagcaaugaacuaaaccauauacuccuggaaaaugacaugaaguucacgguaguaguuggagauguggcaggcauccuggcgcaagggaagaaaaugauacgaccgcaaccgauggaauacaaauacaguuggaaaagcuggggcaaagcaaaaaucaucggcgcggacguacagaauaccaccuucauaaucgacgggccaaauacuccggaauguccggaugaccagcgagcauggaacauaugggaaguugaggacuacggauucggaauauucacgaccaauauauggcuaaaacuccgagacagcuacacccagguaugcgaccaccggcuaaugagugcggcaauaaaagacaguaaggcgguacaugcagacaugggauacuggauugagagcgagaagaacgagaccuggaaacuagccagggcguccuuuauagaagugaaaaccugcaucuggccaaaaagccacacccuauggucuaacggggugcuagagagcgaaaugauaauacccaagauauauggaggcccaaucagccaacacaacuaccggccgggcuacuuuacccaaacagcaggcccauggcaccuggggaaauuagaacucgauuuugacuugugcgaaggaaccacugucguuguagacgagcauuguggcaaccgaggccccagccuacgcacaaccacagugaccgggaagauaauccacgaguggugcugucgaagcuguaccuuaccaccgcuaagauuccgaggcgaagaugggugcugguacgguauggagauucgucccgucaaggaaaaagaagagaaccugguaaaaagcauggucucggcagguagcggcgagguagacaguuucagccucgggcuacuguguauaucgauaaugaucgaagagguaaugcgcucgcgauggucccguaagaugcuuaugacaggaacgcuagcaguauucuuccucuugaucaugggccaacuaacuuggaacgaccuaauacgauuaugcauaaugguaggagcaaacgcaagcgacagaaugggcaugggcaccacguaccuagcucuuauggcaaccuucaaaaugcgccccauguucgcggucggcuuacuguuucggagacugaccagucgggaaguucuauuauuaaccaucggucugucgcuagucgcaucaguugaacucccgaacagccuagaagaacugggcgauggccuugcuauggggaucaugauacuaaaguugcucacagacuuccagucacaccaacucugggccacccuacucagucuaacguuuauaaagacgacauuuucucugcacugcgcauggaagacuauggcaauggucuugagcauagucagucucuuccccuuguguuuguccaccacgagccagaaaacgacaugguuaccagugcuucucggaucgcugggaugcaaaccauuaaccauguuccugauagcagaaaacaaaauaugggggcgcagauccuggccgcugaaugaaggcaucauggcaguuggcauagucaguauacuccuaucgucauuacucaaaaacgacgucccucucgcgggaccgcugauagcaggaggaaugcucauagccugcuaugugaucagcggaagcucggcagaccuaagccucgagaaagccgccgaaguaucaugggaagaagaagcggagcacagcggcgcaagucacaacauccugguagaagugcaagacgacgggaccaugaagaucaaggaugaagaacgugacgauacacucaccauacuacugaaagcaacuuuauuggcaguguccggcgucuacccguugaguaucccagcgacgcuauucgucugguacuucuggcagaagaagaaacaacgcuccgggguguuaugggauacgccaagcccgcccgaaguagaacgagcuguacuugacgacgguaucuaucgcauaaugcaacguggccuacucgggagaucgcaagugggaguagguguauuccaggaaaacguuuuucacaccauguggcacguuacgcguggggcaguucuaauguaccaagggaaaagacuggaaccgucuugggcaagcguaaagaaagaccugaucucauauggagggggcuggaggcuacaagguucguggaacacaggugaagagguacaaguuauagccgucgaaccugggaaaaacccuaaaaauguacaaacggcaccuggaacguucaagacgccagaaggagaaguaggagcgauagcucuggauuucaaaccgggaaccagcggaucaccgauagugaaccgcgagggcaagauaguagggcuauauggcaacggaguaguaacaacgucggggaccuacgucucagcuauagcacaagcaaaagcaagccaagaaggaccacuucccgaaauagaagaugaagucuuccguaagcgaaaccucacgaucauggaccuacacccaggauccgggaagacacgaagguaccuaccugccaucgugcgggaggcaaucaaacgaaaacuacgaacccuaauuuuagcaccgacacgagugguagcauccgagauggccgaggcccucaaaggaaugccaauaagguaccagacgaccgcaguaaaguccgaacacacgggcaaagaaauaguggaccugaugugccacgcuacauuuacuaugcggcuacugagcccagugcggguaccgaauuacaacaugauuauaauggaugaagcgcacuucacggauccaagcagcaucgccgcacggggguacaucaguacacgcguaggcaugggagaagcggccgccauauuuaugaccgccacacccccagggagcguggaagcguucccucuaucaaacgcaguaauacaggaugaagaaagggauauaccagaacgaagcuggaacuccggauacgaauggauaacagacuuccccgggaaaacugucugguucgugccaucgaucaaaucagguaacgacauagcuaacugcuuaagaaagaacgggaagcgcguaauucaacuaucacgaaagacauucgacacugaauaccagaaaaccaagaacaacgacugggacuacguugucaccacagauaucucagaaaugggagcgaacuuccgagcggaccggguaaucgauccgcgucgaugucuuaaaccaguaauauugaaagacggcccagagagggugauacuggccgggccuaugcccgucaccguagcuucggcagcacagcgcagggguaggauaggcagaaaccacaacaaggaaggcgaccaguauaucuacauggggcaaccguugaacaacgaugaggaucaugcccacuggacggaagccaaaaugcuccuagacaacaucaacacgccagaggggaucauccccgcucuauucgagccugaacgcgaaaagagcgcggcaauagacggcgaguaccggcuucggggagaggcacguaaaacguucguagagcuuaugagacggggcgaccugccgguguggcuaagcuacaaaguugcuagcgaaggcuuccaauacucggaccggagauggugcuucgacggugagagaaauaaucaagugcuagaggaaaacauggauguggagauuuggaccaaagaaggcgagcgcaagaaacugcguccaagauggcuagacgcgaggacuuacucggauccucucgcgcugagggaauuuaaggaguucgcagcagggagacgaucagugucaggcgacuugauauuagagaucgggaagcugccccaacacuuaacgcagagagcacagaaugcgcucgacaaccuggugaugcuacauaacagcgagcaaggagguagagcauaccgacacgcaauggaagaacuaccagacaccaucgaaacauugaugcuauuagcgcugaucgcuguccuuacggguggaguaacacuauucuuuuuaucaggccggggacucggcaaaaccagcaucggccuguugugcgucauggccucguccguccuccuauggauggcuucaguggagccacacuggaucgcggcgaguauuaucuuagaguucuucuuaaugguucuauugaucccagagccggacaaacagagaacgccucaggacaaccaacuggcauacgucgucauaggacuccucuucaugauccucacaguggccgcgaacgaaaugggccuacuugagaccacgaagaaggaccuaggcaucgggcacguagcggucgaaaaccaccaccacgcugccaugcuagauguugacuuacacccagcguccgcauggacguuauacgccgucgcgacaacgauaauaacaccaaugaugagacauacaauagagaacaccacagcaaacaucagccuaacggcgaucgcaaaccaggccgcaauccucaugggacuagacaagggcuggccgaucuccaaaauggacaucgggguaccguugcucgcacuagggugcuacucccaaguaaacccacucaccuugacagcagcuguccuuaugcuaguagcccacuacgcgaucauaggaccgggcuuacaggccaaagcuacccgagaggcacaaaaacggacggcggcgggaaucaugaaaaaccccacaguagacggcauaguagcaauagacuuggacccgguagucuacgacgcgaaauucgagaaacaguugggacagaucaugcuccuaauccuaugcaccagccaaauccuguuaaugagaacgacuugggcacugugcgaauccaucacccuugcgacaggcccucuaacaacccucugggaaggcuccccaggcaaauucuggaauacgacaauugccguaucaauggcaaacauauuuaggggaucauaucuggccggagcgggcuuagcguucucucucaugaagagucucggcggaggccgacgagggacaggggcacaaggggagacguuaggagaaaaauggaaaagacaacuuaaucaacucagcaagagugaguucaacaccuacaaacguagcggcauaauggaggucgacaggucggaagccaaagagggguuaaaacggggagaaaccaccaaacacgcagucagccguggaaccgccaagcucaggugguuuguggaacgcaaccuaguaaagccagaagggaaaguuauagaccucgggugcgguagaggaggguggagcuauuacugugcuggacuaaagaaaguaacagaaguaaagggguauaccaaaggcggaccaggccaugaagaacccauccccauggcaaccuacggauggaauuuagucaaacuccacucaggaaaagauguauuuuucauuccacccgaaaagugcgacacguugcuuugugauaucggggaaagcucccccaauccaacaauugaagaaggucggacccuccgagugcugaaaaugguagaaccaugguuacgcgggaaccaauucugcaucaaaauacuaaacccauacaugcccucaguaguagaaacauuagaacaaaugcaacgaaaacacggaggcaugcugguuagaaauccacuuagccgcaauuccacacacgagauguacugggucagcugcggcaccgggaacauaguaucagcgguaaacaugacgagcaggauguuacuaaaccgguuuacgauggcccauagaaagccaaccuacgagcgcgacguggaccuaggagcuggaacgaggcacguagcagucgaacccgagguugcuaaccucgacauaaucggucaaaggaucgaaaauauaaaacacgagcauaaaucgacauggcauuacgacgaagacaacccguacaaaacaugggcuuaccacggcucauacgagguaaaaccaagcggcagcgcaagcucgauggucaacggagucgugaaacugcuaacaaaaccaugggaugugaucccaauggucacacaaauagccaugaccgacacgacgcccuucggacagcaaagagucuuuaaggagaagguagauacccgaaccccaaaggccaaaagagguacugcccaaauuauggagguaaccgcuaaguggcuauggggauuccuuaguagaaacaaaaagccgaggauaugcacccgcgaagaguucacgcggaaagucagaagcaacgcugcaauaggagcaguauuugucgacgaaaaccaauggaacagcgcaaaagaagccgucgaagacgaacgcuucugggaccugguacacagggaacgggaacuacacaaacaaggaaaaugcgcaaccugcguguacaacaugaugggcaaaagggagaagaaacuaggagaguucgguaaagcaaaaggcucaagggcgaucugguauauguggcuaggggcucgcuucuuggaguucgaagcacuugguuucaugaaugaagaccacugguucaguagagaaaauagucugagcggcguggagggcgagggcuuacacaaacuugguuauauccuccgcgacauaagcaagauccccggagggaacauguacgccgacgacacagccggcugggacacuaggauaacagaagacgaccuacaaaacgaagcgcgaauuacggacaucauggaaccagagcacgcacuguuggccaaaucgaucuuuaaacucaccuaucagaauaaaguaguacguguccaacgacccgcgaagaacggaacgguaauggacgucauuucucgccgugaccagcgaggcagcggccaaguggguacauacgggcucaauacguuuaccaacauggaagcccagcuaauccgccagauggaaagcgaaggcauuuucucgccaucggaacuagaaacgccaaaccuagcagagcgaguacuugauuggcuugagaaauacggaguggagcgacuaaagcgaauggcaauaucgggagacgacugugugguaaaaccuaucgaugaccgcuuugcgacggccuugacggccuugaaugacauggggaaaguacgcaaagacaucccccaaugggaacccucaaaaggguggaacgacuggcaacaagucccuuuuugcagucaccacuuucaccaacuuauuaugaaggacgggcgagagaucguaguccccugucgcaaucaagaugaauuggucggcagggcucgaguaucccagggcgcuggcuggucgcuuagagaaacugcauguuuagggaaauccuaugcacagauguggcagcucauguacuuucaccgcagagaccuaaggcuagcagcaaacgccauauguucggccguacccguagauuggauccccacgucccgcacgaccuggagcauacacgcgcaccaccaauggaugacuaccgaggacauguuaagcguguggaaccgugucuggauagaagaaaaucccuggauggaggacaaaacgcacaucucuucuuggggcgacguucccuacuuggggaagagggaggaccaauggugcgggucacucauuggacugaccgcgagagcaacaugggcgaccaacauccagguagcgaucaaucaaguaaggcgacucaucggcaaugaaaacuaccuggacuacaugaccaguaugaagagguucaaaaacgagagcgauccagaaggagcccuaugguga

SEQ ID NO: 24432 - RNA, 9879 nt, Artificial Sequence
  derived and/or modified CDS sequence (opt11) from DENV-1__HM181966__SS-prME
agcgugaccaugcugcucaugcugaugcccaccgcccuagcauuccaccuaacaacgcggggcggggagccccacaugaucguaaccaagcaggagcgggggaagagucugcuguucaagacgagcgugggggugaacauguguacucucaucgccauggaucucggcgaacuaugcgaggacaccaugaccuacaagugcccccgcaucaccgaggccgagcccgacgacguggauugcuggugcaacgccacagacacgugggugacguacgggaccugcucccagaccggggagcaucggagagacaagcggagcguggcgcucgcgccccacguuggccugggguuagagacccgcaccgaaaccuggauguccucugagggcgcguggaagcagauccaacggguggagacgugggccuugaggcaccccggguucaccgugaucgccuuauuccuggcccacgccaucggcaccaguaucacgcagaaagggaucaucuucaucuuauuaaugcuggucacgcccagcauggccaugcggugcgugggcaucggcucucgcgacuuuguggaggggcucagcggugccaccugggucgacgucgugcuggaacacggcucgugcguaaccaccauggccaaggacaagcccacguuggacaucgaacuccugaagaccgaagugaccaaccccgccgugcugcgaaaacuuugcaucgaagccaagauaagcaauaccacuaccgauuccagaugcccgacccaaggugaggccacccugauggaagaacaggacgccaacuucgucugccggcgcacguucgucgauagaggcuggggaaacggcugugggcuguucggcaaggggagccucaucacgugcgccaaguuuaagugcgucaccaagcuggaggggaagaucguccaguacgaaaaccucaaguacuccguaaucgugacgguccacacgggugaccagcaccagguggggaacgagagcaccgagcacggcaccaccgccaccaucacgccgcaagcgcccaccuccgagauccagcucacugacuacggggcccugacccuggacugcagcccucgcacgggccucgacuucaaugagaugguucugcuuaccaugaaggagaaauccugguuggugcacaagcagugguucuuagacuugccgcucccguggaccucaggggccagcacgucccaggagacguggaaccgacaggaccugcucgugaccuucaagacugcgcacgccaagaagcaggaggucgucgugcucggcagccaggaaggggcgaugcauacugcccugacaggggccaccgagauccagaccuccggcacaacgaccaucuucgccgggcaccugaagugccgccucaagauggacaagcuaacgcugaagggcauguccuacgucaugugcacaggguccuucaagcucgagaaggagguggccgagacgcagcacgggaccgugcugguccagauuaaguacgagggcaccgacgcgcccugcaagauccccuuuagcacccuggacgagaagggcgucacgcaaaauggccggcugauaaccgcaaacccgaucguaaccgacaaggagaaaccugucaacaucgaggcggagccacccuucggcgaauccuauauugugaucggggccggggagaaggcgcuuaagcugagcugguucaaaaagggcuccucaaucggcaagauguucgaggcaacagcccgcggagcacggcgcauggccauacugggcgacacggcgugggacuuuggguccaucggcggcguuuucacaagcgucggcaagcucguccaucagaucuuuggcaccgccuacggcgugcuguucuccggcgucaguuggaccaugaagaucgggauugggguccugcucacguggcugggccugaacagccgcagcacuucccucagcaugaccugcauagcaguggggcuggucacucuguaccucggcguaauggugcaggccgacuccgggugcgucaucaacuggaagggccgagagcugaaaugugguagcggcaucuucgugacgaaugaggugcauaccuggacagagcaguauaaguuucaggccgacagcccgaagcgccuguccgcggccaucggcaaggcgugggaagaggggguaugcgggauucggagcgcuacccgcuuggaaaacauuauguggaagcagaucuccaacgagcugaaccacauccugcucgagaacgacaugaaguucaccgugguggucggagacguuguggggaucuuggcccaaggcaagaagaugauccgaccucaacccauggagcacaaauacagcuggaaauccugggguaaggcgaaaaucauuggcgccgacguccaaaacacgaccuucaucaucgauggacccaacacuccggaaugccccgacgaccaacgcgccuggaacaucugggagguggaggacuacggcuuugggaucuucaccacgaacaucuggcugaaacuccgggacagcuacacccaggugugcgaccaccgccugauguccgccgcgaucaaggacuccaaggcggugcacgccgacaugggcuacuggaucgaauccgagaaaaacgagacguggaaguuggcucgggccucguucaucgagguaaagacuuguauuuggcccaagagccacacccucuggagcaacggcguccuagagagugaaaugaucauccccaaaaucuacgggggccccaucagccagcacaacuaccgccccggguacuucacccagaccgcgggccccuggcaccuagggaagcucgaguuggacuucgaccugugugagggcaccaccgucgugguggacgagcacugcgggaauagagggccgucccuccgcacgaccaccgucacgggcaagauaauccacgagugguguugccggagcugcacauuaccgccgcugcgcuucaagggggaggacggaugcugguacgggauggaaauacggccggugaaagagaaagaggaaaaccucguaaagucuauggucagcgccggcucuggcgaggucgacuccuucucucuaggcuuacuuuguauuucuaucaugaucgaggaggugaugcguagccgcuggucccgcaagaugcugaugaccggcacacuggccgucuucuugcugcugaucaugggucagcucacguggaacgaucugauccggcugugcaucauggugggcgcaaaugccagcgacaggauggggaugggcaccaccuaccucgcgcugaucgccaccuucaagaugcgccccauguucgccgugggccuccuguuccggcgccugacgucccgggagguacugcuucucacuauagggcucucccucguggccuccgucgagcugcccaacagccuggaggaguugggcgacgggcuggccaugggcaucaugauccugaagcuccuaaccgacuuccagucccaccagcugugggcgacacugcugucguucacguucaucaaaacgaccuuaucccuucacuaugcuuggaagaccauggccaugguguuaagcaucgugucacuguucccccucugcuuaagcacgacaucccaaaagaccaccuggcugcccguccuccugggcucucucgggugcaagccgcuaacaauguuccucaucgcggagaacaagaucuggggccgcaaauccuggccgcugaaugaggggaucauggcggucggcguggucagcauacuccugagcucacugcucaagaacgacguuccccuagccgggccccugaucgccggcgggaugcugauugccugcuacgugaucucaggguccagcgccgaccugucccuggagaaggccgccgagguaucaugggaggaggaggccgagcacuccggcgccagccacaacauccucguggaggugcaggaugacgggaccaugaagauuaaagacgaggaacgggacgacacccugaccauccugcucaaggccacccugcuggcgguuuccggcguguacccgcuaagcaucccggcuacguuguuugugugguacuucuggcagaagaagaagcagcgcuccgggguccugugggacacccccagcccgcccaaaguggagcgggccgugcuggacgacggaauuuaccguaucaugcagcggggucuccuggggcgaucacaaguuggcgugggcguguuccaggagaacgucuuucacacgauguggcacgugacgcgaggcgccgugcucauguaccaggggaagcgccuggaacccagcugggccucagucaagaaggaucugauuagcuacggaggcggauggaggcugcagggcuccuggaacacgggggaggagguccaggugaucgcuguagagcccggcaagaaccccaagaacgugcagaccgcccccgggaccuucaagaccagcgagggcgaggugggcgccaucgcccucgacuucaagcccgggacguccggcagccccaucgucaaccgcgaagggaagaucgucggccuguacggcaacgggguuguaaccacuagcggcaccuacgugagugcuauagcgcaggccaaggccucucaggaggggccccugccggagaucgaggacgaggucuuccggaagcgcaaucucacgaucauggaccugcaccccggcucugggaagacccggcgcuaucugcccgccaucguccgggaggcgaucaagcgcaagcuccggacacugauccuggccccgaccagggugguggcuagcgaaauggccgaggcucucaagggcaugccaauccgcuaccagacgacugcggucaaguccgagcauaccggcaaggagaucguggacuugaugugccaugcuacguucacgaugcggcugcucagccccgugcgcguucccaacuacaacaugauaaucauggacgaggcucacuuuaccgauccguccagcaucgccgcccggggguacauuuccacgcgcgugggaaugggggaggcggcugcuaucuucaugaccgcgacgccgcccggcaguguggaggccuucccccaguccaacgcggugauccaggacgaggagcgggacaucccggaacgaagcuggaacuccggguacgaguggauaaccgacuucccgggcaaaaccgugugguuugugcccagcaucaaguccggcaacgacaucgccaacugccugcggaagaacgggaagcgcgucauccagcugagccggaagaccuucgacacagaguaccagaagaccaaaaacaacgacugggacuacguggugaccaccgacaucuccgagaugggagccaacuucagagccgaccgggucaucgacccgcgccggugccucaagccggucauacugaaggacgggcccgaacgcgucaucuuagcaggcccaaugcccgugacgguggcgagcgccgcccagcggcgcgggcggaucggccgcaaccacaacaaggagggagaccaguacaucuacaugggucagccgcucaacaacgacgaggaccacgcccacuggaccgaggcgaagaugcuacuggacaauaucaacaccccggagggcaucauccccgcccucuucgaacccgagcgggagaaguccgccgccauugacggggaguaccguuuacgcggagaggcgcggaaaaccuucguggagcugaugcgucgcggagaccucccgguguggcugagcuacaagguggcgagcgagggcuuucaguacucugaucgccggugguguuucgacggcgagcgcaauaaccagguccuggaggagaacauggacguagagaucuggacuaaggagggggaacguaagaagcuccguccccgguggcuagacgcccgcacguacagcgacccccuggcacuccgugaguucaaggaguuugcggccggccgacggaguguguccggggaucugauccuggaaaucggcaagcucccacagcaccugacacagcgcgcgcaaaacgcccuggacaaccucgucaugcugcauaauucggagcagggcgggcgggccuaccgccaugcaauggaggagcugcccgacacgauugagacgcucaugcugcuggcacucauagccguccugaccggaggggugacccuguucuuccucucuggccgggggcugggcaagaccuccaucggccugcuaugcgucauggccagcucagcacugcucuggauggccagcguggagccccacuggaucgcggccuccaucauccucgaguucuuccugauggugcugcucauccccgagcccgaucgucagcggaccccgcaggacaaccagcuggccuaugucgucauagggcucuuguucaugauucuaacgguggccgccaacgaaaugggacugcucgagaccaccaaaaaggaccuggggauagggcacgucgcgguggagaaccaccaucacgccaccaugcuggacguagaccuccacccagccagcgccuggacguuguacgcugucgcgaccaccaucaucaccccgaugaugcgccacacgaucgagaacaccacugccaacaucucacuaaccgccaucgccaaccaggccgcgauccucauggggcuggauaagggcuggccgauaucaaaaauggacaucggcgugccauuacuagcccugggguguuauucccaagugaauccccugacucucaccgccgcaguccucaugcugguggcgcacuacgcuaucaucggcccuggcuuacaggccaaggccacacgggaggcccagaagagaaccgcggccggcaucaugaagaacccgacagucgaugggaucgucgccaucgaccuggaccccgugguguacgacgccaaguucgagaagcaacugggucagaucaugcuccugauacugugcaccagccagauccuccugaugcgaaccaccugggcccugugcgaguccaucacccucgcgaccggcccccugacgacccugugggagggguccccagggaaguucuggaacacuaccaucgccguguccauggccaauaucuuccgggggagcuaccucgccggcgccggccuagcguuuagccugaugaagucccucgggggcgguagacgggguaccggagcccagggugagacccugggcgagaaguggaagcgccagcugaaccagcucagcaaguccgaguucaauaucuauaagcggagcgggaucauggagguggaccgauccgaggccaaagagggccugaagcgcggggagacgacaaggcacgccgugagccguggcacggcaaagcugcgcugguuugucgagaggaacuuggugaagccggaggggaaggugauagaccugggcugcgggcgggguggcuggucauacuacugugccgggcugaagaaggucaccgaagugaagggauacacgaagggcgggcccggccacgaggagcccaucccaauggccaccuacggguggaaccucguaaaguugcacagcggcaaagacgucuucuucaccccgccugagaagugcgacacccugcugugcgacaucggggaguccagucccaaccccacgaucgaagagggccggacacuccgaguccugaagaugguggagccguggcuccgggggaaccaguucugcauaaaaauccucaaccccuacaugccauccgucguggagacccuggagcagaugcagcgcaaacacggaggcaugcuggugcggaacccccucagccggaacucgacccacgaaauguacugggucagcugugggaccggcaacaucguguccgccgucaacaugacgagccggaugcuguuaaaccgauucacuauggcccaccgcaagccgaccuacgagcgagacgucgaccucggcgcgggcacgcgccacguggccguugaacccgaagucgcaaaccuugacauuaucggccagcggaucgagaacaucaagcacgaacacaagagcacguggcacuaugacgaagacaaccccuacaagaccugggccuaucacgggagcuacgaagugaagcccuccggcagcgccagcuccauggucaacgggguagugaagcugcuaaccaagccgugggacgucauccccauggugacccagaucgccaugacggacaccacccccuucggacagcagcgcguguucaaggaaaagguggacacccggacccccaaggcaaagcgagggaccgcacagaucauggaggugaccgcccggugguuguggggcuuccugagccgcaacaaaaagccgcggaucugcacccgcgaggaguucacgcggaagguacgcuccaacgccgcgauaggcgcggucuucguggacgagaaccaguggaauagcgccaaggaggccguggaggacgagcguuucugggaccucguccaaaaggagcgcgaguuacacaaacaggggaagugcgcaaccugcguguacaacaugauggggaagcgggagaagaagcugggcgaguucggaaaggccaaggggucccgcgcaaucugguacauguggcucggugcccgauuccuggaguucgaagcccugggcuucaugaacgaagaccacugguucagccgagagaacucccucagcgggguggagggcgaggggcugcauaagcuaggcuacauccucagggacauuuccaagaucccugggggaaacauguacgcggaugauaccgccgggugggacacccgcaucacggaagacgauuuacagaacgaggcuaagauuaccgacaucauggagcccgagcacgcgcugcuggcuaccagcaucuuuaaguugaccuaccagaacaaggucguuagggugcagcgcccggcgaagaacgggacagucauggacgucaucucccgccgggaccagcgcgggagcggacaggugggaacguacggacugaacacuuucaccaacauggaggcccagcucauuaggcagauggaguccgaggggauuuuccugccaagcgagcuggagacgcccaaucucgcugagcgcgucuuggacuggcuggagaaguacggcguggagcgguugaagcggauggccauauccggggacgacuguguggucaagcccaucgacgaccgguucgccaccgcgcucaccgcccugaacgauaugggcaaggugcgcaaggauaucccacagugggagcccucaaagggguggaacgauuggcagcagguccccuuuugcagucaccauuuccaccagcucgucaugaaggacggccgggagaucgugguucccugccgcaaccaagacgagcugguuggccgcgcucgcgugucacagggggcaggcuggagccugcgggagacagccugccucgggaaguccuacgcucagauguggcagcugauguacuuccaccgccgggaccugcgucucgccgccaacgccaucugcagcgcugugccagucgacugggugcccacgucccggaccaccuggucuauccacgcucaccaccaguggaugacaaccgaggacaugcucuccguguggaaccgcguguggaucgaggagaaccccuggauggaggacaagacccaugugagcuccuggggcgaugugcccuaccuggggaagcgggaggaccaguggugcggcagccucaucggccugaccgcacgagccaccugggccuccaacauccaggucgcgaucaaccagguccgccggcugaucgggaacgagaauuaccuugacuacaugaccuccaugaagcgcuucaagaacgagggcgacccggagggggcccugugguga

SEQ ID NO: 24433 - RNA, 9879 nt, Artificial Sequence
  derived and/or modified CDS sequence (opt11) from DENV-1__GU131721__SS-prME
agcgugaccauguuacugaugcugaugcccaccgcccuugccuuccaccucaccacccgggguggggagccucacaugauugugucuaaacaagaacgaggcaaaagccuucuguucaagacguccgcuggggugaauaugugcacccucauagccauggaccugggggagcugugcgaggacaccaugaccuacaaguguccccggaucacggagaccgagccggacgauguggacuguugguguaaugcuacggacaccuggguuaccuacgggacgugcucccagacgggcgagcaccgccgcgauaagcgguccguagcccucgcgccccacgugggccuggggcuggagacgaggaccgagaccuggaugagcagugagggggccuggaaacagauccagcggguggaaacgugggcccuccgccaccccggguucaccgugauagcccucuuccuggcccaugcgaucgggaccagcaucacccagaaggggaucauuuucaucuuauuaaugcuggugacccccuccauggcaaugcgcugugucggcaucggcagccgcgacuuuguggaggggcuaucuggcgccaccuggguagacguugugcuggagcacgggucgugcgugaccacaauggcgaaagacaagcccacgcuugacaucgaacuccugaagaccgaagugaccaacccugcagugcugcggaaacucuguaucgaagcgaagauauccaacaccacgaccgacagucgcugcccgacacagggcgaagcgacgcugguggaggagcaggacgccaacuucgugugccgucgaacguucguagaccggggcugggggaacggcugcgggcuguucggcaaggguucccucauaacuugugccaaguucaaaugcgugacaaagcuggagggcaagaucguccaguacgagaaccugaaguacagcgugauugucacuguccauacaggagaccaacaucaaguggggaacgaguccaccgagcacggaacuaccgccaccaucacgccccaggcacccacaacagaaauacagcuuacggacuauggggcccugacgcuagacugcagccccagaacagggcucgacuucaacgagauggugcugcugaccaugaaggagaaauccuggcucguucacaaacagugguuccucgaccucccccuccccuggaccaguggggccagcacaucccaggagaccuggaaccggcaggaccugcuagugacuuucaagaccgcccacgccaagaagcaggaggucguggugcucggcagccaggagggcgcgaugcacacggcccugaccggugcgaccgagauucagacauccggcacgacgaccaucuucgccggacaucugaaaugccgccucaagauggacaagcugacccucaagggcauguccuaugucaugugcacugggucauucaagcucgagaaggaggucgccgagacccagcauggcaccgugcugguccaaaucaaauacgaaggcacugaugcaccaugcaagauccccuuucugacgcaagacgagaagggggugacacagaacggccggcuuauuaccgcaaauccgaucguuaccgacaaagagaagcccgucaacaucgaggccgagccgcccuucggggagagcuacauuaucaucggcgccggggaaaaggcgcucaagcuguccugguucaagaagggaagcaguaucggcaaaauguucgaagccacagccaggggcgcgcguagaauggcaauccugggcgacacagcuugggacuucggaucaaucggggguguguuuaccucggccgggaaguuagugcaucagaucuucggcaccgccuacggggucuuguuuaguggcguguccuggacaaugaagaucgguauaggcguacugcucaccuggcugggucugaauagccgcucaaccucccucucaaugacgugcauagcugucgggcugguaacgcucuaccucggaguaaugguccaggccgacagcgguugcgugaucaacuggaaaggcagggagcugaagugcgggucuggcaucuucguaaccaaugagguccauacauggaccgaacaauacaaguuccaggcggacucgccgaagcguuuaagcgccgccauuggcaaggccugggaagagggggugugcggcauccggucagccacucgccucgaaaacaucauguggaagcagauaaguaaugagcuuaaccacauuuuacucgaaaacgacaugaaguucacaguggucgugggggacguggcggggauccuggcccaggggaagaaaaugauacggccgcagccgauggaauauaaguacagcuggaaguccuggggcaaggcuaagaucaucggcgccgacguccaaaauaccaccuuuaucauugacgggcccaauacuccggagugccccgacgaccagcgggcguggaacaucugggaggucgaggacuacggcuucgggaucuucacuacuaacauuuggcugaaacugagagacucauacacgcaagugugcgaccaccgccugaugagcgcagcaauuaaagacuccaaggcggugcacgcagacaugggcuauuggauagagucggagaagaacgaaacguggaaacuugcgcgggcauccuucauugaagugaagacguguaucuggcccaagucucacacccucugguccaacggagugcuggagagcgagaugaucgugcccaagaucuacgggggcccgauuucccagcauaacuaucgcccgggguacuucacccagacggccggaccuuggcaccucgggaagcucgaguuggacuucgaccugugugaggguacaaccgugguggucgaugagcauuguggcaaccgcgggccgagccucagaacgaccaccguaaccggcaagauuauacacgaguggugcuguagaagcugcacccugccuccccugagguuccgcggggaggacggaugcugguacgggauggagauccgucccgugaaggagaaggaggagaaucuagucaagagcaugguauccgccgguagcggcgaagucgacagcuucagucuugggcuguugugcaucucaaucaucaucgaggaagugaugcggucccgcuggucucggaagaugcugaugaccgggacgcuggccguguuuuuccuccuaaucauggggcagcugacuuggaacgaccuuauucgccuguguauuaugguuggcgcaaacgccucugaccgcauggggaugggcaccaccuaccuggcccuaauggccacguucaagaugcggcccauguucgcagucggccuucuguuccgccgucugaccucucgcgaggugcuucugcucacgaucgggcugucccugguggcgagcguagaacuccccaauucccuggaggagcugggcgauggccucgccauggggaucaugauccugaagcugcucaccgacuuccagucgcaccagcugugggccacucugcucagccugaccuucauuaagacaacguucagccugcacuacgccuggaagacgauggcuaugguauuguccaucguaucccuguucccuuuaugccuaaguaccaccagccaaaagacaacguggcugcccgugcuucucggcagccuggggugcaagccgcugaccauguuucucaucgcagagaauaagaucugggguagaagaagcuggccccugaacgaagggaucauggccgugggaaucguauccaucuugcucagcucgcugcugaagaaugacgucccacucgcugguccucugauagcuggcggcaugcuaaucgcgugcuaugugaucuccgggagcuccgcugacuuaucgcuugagaaggcugccgaggucucaugggaggaggaggccgaacauagcggcgcgucgcacaauauccugguugaggugcaagacgacgggaccaugaaaaucaaggacgaggaacgggaugacacacucaccauccugcugaaggccacgcuucuggccgucagcggcguuuacccgcugucgauaccggccacgcuuuucgugugguacuuuuggcagaagaagaaacagcgcagcggggucuuaugggauacgcccucaccgccugagguggagcgcgccgugcuagacgaugguaucuaccguaucaugcaacggggucuguuagggcgcagccaggucggcgugggaguguuccaggaaaacguauuucauaccauguggcaugugacgcggggugcagugcuaauguaccaagggaagcgcuuagagccaucaugggcuagcgucaaaaaggacuuaaucuccuacggcggggguuggcgucugcagggcagcuggaacaccggggaggagguucaggugaucgcagucgagcccggcaaaaaucccaagaacgugcagaccgcucccgguaccuucaagacgcccgagggcgaggugggcgcgauugcgcuggacuucaagccagggaccuccggcuccccuauugucaacagggaggguaagaucgugggccucuauggcaacgggguugucaccaccuccggaacguaugucagugcaauagcacaggccaaggcgagccaggagggaccccugcccgagaucgaagacgagguguuccggaagcggaaccugacuauaauggaucuccauccaggcucagggaagaccaggagguaccugccggccaucguccgcgaggcaauaaagaggaagcugcgcacucucauccuggcccccacacggguaguggccucugaaauggcggaggcacugaagggcaugcccauccgcuaccagaccaccgccgucaagagugagcacacuggcaaggagaucguagaucucaugugccacgccacuuucaccaugcggcugcuaucgcccgugagagugccgaacuacaacaugauuaucauggacgaggcccacuuuacugacccaaguucaaucgcggcucgaggauauaucagcacucggguggggaugggggaggcugccgcgauauucaugaccgcgacuccacccggcagcguggaggccuucccgcaauccaacgccgugauccaagacgaggagcgggauauucccgagcgcagcuggaacuccggguacgaauggaucaccgacuuccccgggaagaccgugugguucgugccguccaucaaguccggcaacgacaucgcuaacugccucagaaagaacgggaaacgagucauucagcugagucgcaagacguucgacaccgaauaccaaaagaccaagaacaacgacugggacuacgucgugaccacggacaucuccgagaugggcgcgaacuuucgagccgaucgggugauugacccgcgccggugccucaagccagugauccucaaggacggaccagagcgcguaaucuuggccgggccaaugccggucaccguggcuagcgcugcgcaacggcgcgggcggaucggccgcaaucacaacaaagagggggaccaguacaucuauauggggcaaccucugaacaacgacgaggaccacgcgcauuggacagaggccaagaugcuucuugacaacaucaacaccccugagggcauaaucccagcccuguuugagccugagagagagaaguccgcugcgauagacggcgaguaccggcuccgcggcgaggcccggaagacguucgucgagcuaaugcgccgcggugaucugcccguuuggcucagcuacaagguugccucugagggauuucaguacucagaucgccgguggugcuucgacggcgagagaaacaaccagguccuagaggagaacauggacguggaaaucuggacaaaggagggggaacguaaaaagcugcgcccccgcuggcucgacgcccgcacuuacagcgaccccuuagcccugagggaguuuaaggaguucgcggcggggcgccgcucuguguccggcgacuuaauccuagagaucggcaaacuuccgcaacaccucacccagagggcucagaaugcacuggacaacuuagucaugcuccacaacagcgagcaaggugggagagcguaucgucaugcaauggaggagcugcccgauacgauagagacgcugaugcuccuggcccugauagccgugcuaaccggcggggugaccuuauucuuccuuagcggccggggguuggggaagacauccauuggccuguugugcguuauggcaagcuccgugcuccuguggauggcgucuguagagccccauuggauagcugccuccaucaucuuggaguucuuccuuaugguccuccuaauuccugagccggaccggcagcggacgccucaggacaaccagcucgccuacguagugaucgggcuacucuucaugauccucaccgucgccgcaaacgagaugggccuucuggagaccacuaagaaggaccuagggaucgggcacguggccguugaaaaccaccaccacgcggccaugcucgacguugacuugcgccccgccagcgcguggaccuuauacgccguagccaccaccaucaucaccccgaugaugcgccacacgauagagaacacuacggccaacaucuccuugaccgccauagcgaaccaagcggccauccuuaugggccuagacaagggcuggccgaucagcaaaauggauauuggcgugccgcugcuggcccucggauguuacagucaagugaacccccugacgcuaacggcggccgugcucaugcugguggcacacuacgcaauuaucggccccggguuacaggcaaaggcuacccgggaggcacagaagcgaaccgcagccggcaucaugaagaaucccacgguagacgggauuguggcuauugaucucgacccuguaguuuacgaugccaaguucgagaagcagcugggccaaaucaugcugcugauacuguguaccagccagauccugcucaugcggacgaccugggcccugugugaguccauaacgcuggccaccggcccccucaccacgcugugggaggggagcccggguaaguucuggaauacuacgaucgcuguguccauggccaacaucuuccgcgggucuuaccuggcaggagcaggcuuagccuuuucgcucaugaaaucgcucgggggcgggcgcagagggaccggggcacagggcgagaccuuaggugagaaauggaagcggcaguuaaaucagcuaagcaaguccgaguucaacaccuacaagagauccgggaucauggagguggaccgauccgaagcgaaggaaggucucaagcgcggggagaccacuaagcacgccgucucgcggggcaccgccaagcugcgcugguuuguagagcgcaaccuggugaaacccgagggaaaggucaucgaccugggcugcgggcgugggggcugguccuacuauugcgccgggcucaaaaaggucaccgaggugaagggcuacaccaagggcggaccgggacacgaggagcccaucccuauggcuacauacggguggaacuuggucaagcuacacagcggcaaggauguguucuuuauaccacccgagaagugcgacacccuccugugcgacauuggggaauccucccccaacccgacgaucgaggaaggccgcacccugcguguacucaagauggucgagccuuggcuucgggggaaccaguucugcaucaagauccugaacccauacaugccaucgguaguugaaacucucgaacagaugcagcgcaagcacggcggcaugcugguccggaacccguuaagccgcaacaguacgcacgagauguauugggugucgugugggaccggaaacaucguauccgcagucaacaugacgagccggauguuacugaaccgguucaccauggcccaucgcaagccaaccuacgaaagggacguugaucuuggggccggcacucgucacguggccgucgagccugaaguggcgaaccucgacauaauaggucagcggauagagaauaucaagcacgaacacaaguccacauggcacuacgacgaggacaaccccuacaaaacaugggcguaccacggaucguacgagguuaaaccgucuggcuccgcuaguucuaugguaaacgggguggucaagcugcugaccaagccaugggacgugauccccauggugacucagaucgccaugaccgacacaacgccguucggccaacaacgaguauucaaggagaagguggacacucguacuccaaaggcaaagcgcgggacggcccaaaucauggaggugaccgcgaaauggcucuggggcuuccugagccggaauaagaagccccgcaucugcacgcgggaggaguucacgcgcaagguccgguccaacgcggccaucggagcuguguucguggacgagaaccaguggaauagcgcaaaggaggccgucgaagacgagcgcuucugggacuuaguacaccgggagagggagcuccacaaacaggggaagugcgcgaccugcguuuacaauaugaugggcaagcgggagaagaaacugggggaguuuggcaaggcaaagggcucccgcgccaucugguauauguggcugggcgcgcgguuccucgaguucgaggccuugggcuucaugaacgaggaccacugguucucgcgcgaaaauucccuuagcggcguagagggagagggucugcauaagcuggguuauauccuccgggacaucucaaagauacccggugguaacauguaugcggacgauaccgccggcugggacacgcgcauaacagaggacgaucugcaaaacgaggcccgcaucaccgacaucauggaacccgagcacgcauugcuggcuaagucuaucuucaagcucaccuaccagaacaaaguggugcggguucaaaggcccgcgaagaacggaacgguuauggacgugauaucccgcagagaucaacguggaagcggucaggucggaacguacggccugaacacguucaccaacauggaggcccaacucauucgccagauggaauccgaaggcauuuucagcccgucggagcucgagacccccaaccuggcggagcgcguucuggacuggcuagagaaauacggaguggagcgucugaagcggauggcgaucagcggcgacgauugcgucgucaagccgaucgaugaccgcuucgccacugcccugaccgcucugaacgacaugggcaaggugcgcaaggacaucccccaaugggagcccuccaagggguggaacgacuggcagcagguccccuucuguagccaccauuuucaucagcugaucaugaaggacggccgcgagauaguggugcccugucguaaccaagacgagcuggucggucgugcaagagugucccaaggggcggguuggucucugagagaaaccgccugucugggcaagagcuacgcccagauguggcagcugauguacuuccaccggcgcgaccucagacuugccgcgaaugccaucugcucagccgugcccgucgacuggauccccaccagccgcacgaccugguccauccacgcacaccaccaauggaugaccaccgaagacauguugagcguguggaacagaguguggaucgaagagaacccuuggauggaggacaaaacgcacaucucuucguggggagacgucccguaccucgggaagcgggaggaucaguggugcggaucccugauuggccugaccgcccgcgcgacaugggcuaccaacauccaaguggcuaucaaccaggugcggcgccucaucgggaacgaaaacuaccuggauuacaugaccagcaugaagcgguuuaaaaaugagggcgagccggagggugcccuuugguga

SEQ ID NO: 24434 - RNA, 9879 nt, Artificial Sequence
  derived and/or modified CDS sequence (opt11) from DENV-1__GU131723__SS-prME
uccgugaccaugcuguuaaugcugaugccuaccgcgcuggcauuccaccuuacuacucggggaggggagccccacaugauagugagcaagcaggagcggggcaaaagccugcuauucaagaccagcgcaggcgucaacaugugcacgcucaucgccauggaccugggcgaacugugcgaggacaccaugaccuauaaaugcccgcggaucaccgagaccgagcccgacgacguggacugcuggugcaacgccacggauacaugggucaccuacgggacuugcagccagacuggcgaacaucggcgcgacaagagauccguugcucucgcgccccaugucggccugggauuagaaacccggaccgaaaccuggaugagcuccgagggagccuggaagcagauccagcggguugaaacgugggcacuccggcacccgggguucaccgugaucgcccuguuuuuagcccaugcgaucggaaccucuauuacccagaaggggauuaucuucauucugcugaugcugguuacaccuuccauggcaaugcggugcguuggcaucggcagucgcgacuucguggagggguugucuggggcuacauggguggauguugugcuggagcaugggucgugcgugaccacaauggccaaggacaagccgacgcucgacauugagcucuuaaagaccgagguuaccaauccugccgugcuacguaagcucugcaucgaggcgaaaaucagcaacaccacgacggacucccgcugcccgacccagggcgaggccacacugguggaggaacaggacgccaauuucgucugucguagaacguucguggaccguggcugggggaacggcugcggacuguucggcaagggcucccucaucacgugcgcuaaauuuaagugcgugaccaagcuggagggaaagaucguccaauacgagaaccuaaaguacagcguaauagucacaguacauacgggagaccagcaccagguggggaacgaguccaccgaacacggcaccaccgccacaaucacaccccaggccccgaccaccgagauacagcucacagacuacggggcccugaccuuagacugcucaccccgcacuggucuugauuuuaacgagaugguacugcuaaccaugaaggaaaaauccuggcucguucacaagcagugguuccuggaccugccucugccguggacuagcggggccucuacgucccaggagaccuggaaucggcaggaucuccuagugacauucaagaccgcacacgccaagaagcaggaggucguggugcucggcucacaggagggugccaugcacaccgcccugacaggggccaccgagauccagaccuccggaacaaccaccaucuuugcugggcaucugaagugccgccucaaaauggacaagcugaccuugaaaggaaugagcuacgucaugugcacagguucguuuaaacuagagaaggagcuggccgagacucagcauggcacgguccuggugcagauuaaguacgagggcaccgacgcgcccugcaagauaccauuuucgacgcaagaugagaagggggucacccagaacggucggcugaucaccgcuaacccgaucgugaccgacaaagagaagccugugaacauugaggcugagccuccauuuggggagucguauauugucauaggugcaggcgaaaaggcgcucaagcugagcugguucaagaagggauccucaauuggaaaaauguucgaggcuacggccaggggggcccgacguauggcaauccuaggcgacaccgccugggauuucgguucgauugggggcguuuucacuagcguaggcaagcucguacaccagaucuuugguacugccuacgguguacuguucucgggcgugucuuggacaaugaagauagggauuggcguccugcucacauggcugggcuugaacucccgaucgaccagucucucuaugacuuguauagcaguggggcuaguuacgcuuuaccucggggucauggugcaggcagacuccggguguguaaucaacuggaaaggacgggaauugaagugugggucuggcauauuugucacaaacgaagugcacaccuggacagaacaguacaaguuccaagcugacagcccgaaacgccuguccgcggcgaucggcaaggccugggaagaggggguguguggcauccggucagcuacacgccuagagaacaucauguggaagcagaucucuaacgaguugaaccacaucuuacucgagaacgauaugaaguucacgguuguaguaggggacguugccggcauccuggcgcaggggaagaaaaugauccggccucagcccauggagcacaaguauagcuggaaguccuggggaaaggcgaagauaaucggcgccgaugugcagaacaccaccuucauuaucgacgggcccaacacgccggagugucccgacgaccagcgugccuggaacaucugggaagucgaagacuauggauucggcauauucacgaccaauauuugguuaaaacucagggacucauacacccaggugugugaucaccgccugauguccgcggccaucaaggauagcaaagccgugcacgccgauaugggauauuggaucgaguccgagaagaacgagaccuggaagcuggcccgcgcgagcuucaucgaggugaaaacgugcauauggccuaagucccauacccucuggagcaacggcguccuggaguccgagaugaucauacccaagaucuacggcggcccaaucagccagcacaacuaccgcccaggguacuucacccagaccgccggcccguggcacuugggaaagcucgaacuggacuucgaucugugcgagggcacgaccguggugguggacgagcacugcggcaaccgggguccgucccuccgcaccacaacggugaccggcaaaaucauacacgaguggugcugccggaguugcacccuuccgccguugcgcuuccgcggggaggacgggugcugguacggaauggagaucaggcccgugaaggaaaaggaagaaaaccucguaaaguccaugguaucugcuggcagcggcgagguagacuccuuuagccugggccugcucugcauuucuauaaugaucgaagaggucaugcggagccgcuggucccguaagaugcugaugaccggcacacuagccguguuuuuccuccugaucguggggcagcugaccuggaacgaucucaucagacugugcaucauggugggcgccaaugccuccgaccguauggggaugggcacuacguaccuagcgcucauggccacauucaagaugcggccgauguuugccgugggccugcuguuccgccggcucacuucgagagaggugcuguuacugaccauugggcugagccugguggcauccguggaauuacccaacucacuggaggaacugggagacgggcucgcaauggguaucaugauccucaagcugcucacugacuuccaaucccaucaguugugggccacgcugcucagucugacguucaucaagacgacuuucucgcugcauuacgcguggaagacgauggcgaugguccuuagcgugguaucccuauucccucuaugucucucaaccaccagccagaagaccacguggcuacccguccugcucggcagccugggaugcaagccgcugacaauguuucucauagcagagaauaagaucugggggcggcgcuccuggccccugaacgaagggauaauggcggugggaaucgugagcauccugcucagcucccuguugaagaacgacgucccucuugccgggcccuugaucgccggcggcaugcugaucgcguguuacgucauaucagggucuagcgccgaccucucauuggagaaggcagccgaaguuagcugggaggaagaggccgagcauucuggcgccagccacaacauccucgucgaggugcaggacgacgguaccaugaagauaaaggacgaggaaagagacgauacccucaccauacugcugaaggcgacucuccuugcaguuagcggcgucuacccgcugagcauaccugccacacucuucguuugguacuucuggcagaagaaaaagcaaagguccgguguguugugggacaccccaagcccgccagaggucgaacgggccgugcuggacgauggcauauaccgcaucaugcagcggggccugcucggccgcucccagguaggcgucggcguuuuccaagagaacguguuccacaccauguggcacgucacgcggggcgcggugcuuauguaccaggguaagcgccuggagccuagcugggcgucgguuaaaaaggaucuuaucaguuacggcgguggauggcggcuccagggcucuuggaauaccggggaagagguccaggugauugcuguggaacccggcaagaaccccaagaacguccaaaccgccccggggaccuucaagacgcccgaaggggaggugggcgccaucgcucuggacuuuaagcccggaaccagcggaucccccaucgugaaccgcgaggggaagauagucggacucuacggcaacgggguggugacaaccagcggcacguaugucagcgccauagcgcaggcuaaggcuucgcaagaggggccucugccugagaucgaggacgagguguuccgcaagcgcaaucugaccauuauggaccuccaccccggauccggaaaaacccggcgcuaccugccggcgaucguccgcgaggccauaaagcgcaaacugcguacccucauccuagcucccacacgggucguggccuccgagauggccgaggcgcugaagggcaugccuauacgcuaucagacaaccgccgucaaaagcgaacacaccggcaaggaaaucgucgaccugaugugccacgccacguucaccaugcggcugcugagccccgugcgagugccgaacuauaacaugaucauaauggacgaagcccacuucaccgaucccagcucuaucgccgcucggggguacauaagcacccgcgucggcaugggggaggccgccgccaucuucaugacggcuacgccgcccggauccguagaggcguuuccgcagagcaacgccgugauccaggacgaggaacgggacauucccgagcgcuccuggaauagcggauacgaguggaucacugacuuccccgguaagaccgucugguuuguucccuccaucaaauccggcaacgacaucgccaacugcuuacggaaaaaugggaagagagugauccagcugucccggaagacuuucgacacugaguaccaaaagaccaaaaacaacgauugggacuacgucgugaccacggacauuagcgagaugggagccaacuuccgcgccgaucgagucaucgacccucgcagaugucugaaacccgugauccucaaggacgggcccgagagggugauucucgccggcccuaugccugucaccgucgcauccgccgcccagcgaaggggucguguuggacgcaaccacaacaaagaaggggaucaguauaucuacauggggcagccacugaacaacgacgaggaccacgcgcauuggaccgaggcuaagaugcuccucgacaacaucaacacgcccgagggcaucauucccgcucuguucgaaccugaacgugagaaauccgccgccaucgacggggaguaccggcuccgcggcgaggcgcggaagacguuugucgaguugaugcgcaggggggaccugccgguguggcuuagcuauaagguggccagugaaggauuucaauacagcgaccgccgauggugcuucgauggcgagcgcaacaaucagguacuggaggagaauauggauguggagaucuggaccaaggaaggggaacggaagaaguuacgcccccgguggcuggacgcacgaacguacagcgacccacucgcccugcgcgaguuuaaggaauucgcggcgggccgaaggagcguguccggggaccucauccuggagaucgggaagcucccgcagcaccucacccagagagcccagaaugcccuggacaaccuugucaugcuccacaauagcgagcagggugggcgggccuaccgucaugcgauggaggagcuccccgacacgaucgagacccugaugcuccuggcauugaucgcuguccugacuggaggggugacccuguuuuuucuuuccggucggggccucgggaagaccucaauuggccugcuaugcguuauggccucgucuguacuccucuggauggcguccguggagccccauuggaucgcggcaagcauaauuuuggaguucuuucuaauggucuugcugauccccgagccggaccggcagcggacgccacaggacaaccagcuugcuuacguggugaucggguuacuuuucaugauccucacaguagcagccaaugagaugggccuacuagagaccaccaagaaggaccucggaaucggccacguggcgguggagaaccaccaccacgccgccaugcuggacguagacuuacaccccgcuagugccuggacgcucuacgcgguagcuacuaccauaauaaccccaaugaugaggcauacaauugagaacacgaccgccaacaucagccugacugccaucgcgaaucaagcggcaauucugaugggccucgacaagggcuggcccaucuccaagauggacauaggcgugccacuucuggcuuuggggugcuacagccaagucaaccccuugacucugaccgcugccgugcucaugcugguggcucacuacgccauaauaggcccggggcuucaggccaaggccacccgcgaggcacaaaaacggaccgcggccggcaucaugaaaaaucccacggucgacgggaucguggcuaucgacuuggaucccgugguauacgaugcgaaguucgaaaagcagcuaggccagauaaugcugcucauacuuugcacaucccagaucuugcuuaugagaaccaccugggcuuugugcgagagcaucacguuggccacuggaccuuuaaccacuuugugggaaggcucccccgggaaguucuggaauacgaccauagccgugucaauggccaacaucuuccggggguccuaucuggccggcgcggggcucgccuucagucugaugaagucccucgggggcgggcgucggggaaccggggcccagggcgagacccugggagagaaguggaagcgccaacucaaccagcugucuaaaagcgaguuuaacacguauaagcgauccgggaucauggagguggaccgcagcgaggcgaaggagggcuugaagcgcggcgaaacgaccaagcacgccguuucccgcggaacggccaaacugcgcugguucguggagagaaaccuaguaaagccagaggggaaggucaucgaccugggcugcggccgagguggauggucauacuacugcgccgggcuaaagaaggugacugagguuaagggcuacaccaagggcggccccggucaugaggagcccaucccgauggccaccuacgguuggaaccuggucaaguugcacucgggaaaggacguguucuuuauuccgcccgagaagugugacacccucuuaugcgacaucggggagagcucccccaacccgacgaucgaggaggggcgcacccugcgagugcucaaaauggucgaacccuggcuccgaggaaaucaguucugcaucaagauccucaacccuuauaugcccagcgugguggagacccucgagcaaaugcagcggaagcacggaggcaugcugguccgcaacccgcuguccagaaacucaacccaugagauguauuggguguccugcggcaccgggaauauagugucggcuguaaacaugacaagucgcaugcuccugaacagguucacgauggcgcaccgcaagcccacuuacgagcgugacguggaucugggggcgggcacccggcauguggccgucgagcccgagguagccaacuuagacaucaucggacagcgcauugagaacauuaagcacgagcauaagagcacguggcacuaugaugaagacaaucccuacaagaccugggccuaccacgguuccuacgaggucaagccgagcggguccgcuagcagcaugguaaacgggguggucaagcugcugaccaagcccugggacgugauccccauggugacacagaucgccaugacggacacgacccccuuuggccagcagcgggucuucaaagagaagguggacacccgcaccccaaaggcgaaacgcgggaccgcccagaucauggaggugacggccaaauggcuauggggcuuccucucccgcaacaagaagccacgcaucugcacccgagaggaguucacgcggaaaguucggagcaacgcggccaucggagccguguucguggacgagaaccaguggaacagcgcgaaagaggcugucgaggaugagcgguucugggaccucgugcacagggaacgugagcuacacaagcaggggaaaugcgcgacaugcgucuauaacaugaugggcaagcgugagaagaagcugggugaguucggcaaggccaaagguagccgagccaucugguacauguggcugggugcacgcuuccucgaguucgaggcgcugggcuucaugaaugaggaucacugguucucacgggaaaauucgcugucuggugucgagggugaggggcuccauaagcuuggcuacauucuucgcgauauuagcaagauacccgguggcaacauguacgccgacgacaccgccgggugggacacccgcaucacggaagacgaccugcaaaaugaagcccgcauaacagacauuauggaaccugaacacgcccuauuggcgaagucaauuuucaagcuuaccuaccagaacaagguggugcggguacaacgacccgcgaagaauggaaccgugauggaugugaucagccgccgggaucagcgcggguccgggcagguaggcacguacggccugaacaccuucaccaacauggaggcccagcugauacggcagauggaaucugaggggaucuucuccccaagcgagcuggagaccccaaaucuggccgaacgcgucuuagauuggcucgaaaaauacgguguggagcgccugaaacgaauggcgauuuccggggacgauugugucgugaagccgauugaugacagauucgccacggcccugaccgcccugaacgauauggggaaggugcgcaaagacaucccccagugggagccaagcaaaggcuggaacgacuggcagcagguacccuucuguucccaccacuuccaccagcugauaaugaaggacggacgggagaucguugugccguguaggaaccaagacgagcuugucggucgcgcccgcgugagucagggagccggcuggucgcuccgggaaaccgcaugucuggggaagaguuacgcccagauguggcagcugauguacuuucaccgccgggaccugaggcuggccgcaaacgccaucugcucugccgugcccgucgauuggauccccacuucccggacgacuugguccauccacgcgcaccaccaguggaugacgaccgaagacaugcugucgguguggaaccgcguguggaucgaggagaacccuuggauggaagacaagacgcacaucagcucuuggggcgacgucccuuaucuugggaagagggaggaccagugguguggaagcuugaucggucugaccgcucgggccaccugggcaacgaauauccagguggccaucaaccagguucgccggcucaucgguaacgaaaacuaccuggauuacaugacuucuaugaagcgcuuuaagaacgagucggaccccgaaggcgcccugugguga

SEQ ID NO: 24435 - RNA, 9879 nt, Artificial Sequence
  derived and/or modified CDS sequence (opt11) from DENV-1__GU131725__SS-prME
agcguuaccaugcugcuaaugcugaugccuacggcccuggccuuccaucucaccacacggggcggggagccacacaugaucgugucgaagcaggaacggggaaagagccuacuguucaaaacaagcgcggggguaaacaugugcacccucaucgccauggaccugggcgagcuuugugaagacaccaugaccuacaagugccccagaaucaccgaggccgaacccgacgacguugacugcugguguaaugccacagacacgugggucacauacggaaccuguucccaaaccggcgaacaccggcgggacaagcgguccguggcguuggcgccccacgugggccugggacuagagacucgaaccgagacauggaugagcagcgaaggcgccuggaaacaaauccaacgggucgagaccugggcccuuagacaccccggguucacgguaaucgcccuuuuccuggcgcacgccaucggaacaagcauaacgcagaaggggaucauauuuauccuguugaugcugguuacccccuccauggccaugaggugcguugguauugguucacgcgacuucguggaggggcuaaguggcgccaccuggguggacguuguucucgaacacgguucgugcguaaccaccauggcgaaggacaagcccacccuggauauugaacugcugaagacugaggucaccaaccccgcggugcugcggaagcucugcauagaggccaaaauaucuaacaccaccacugacagcagguguccuacccagggcgaagccacccuagucgaggagcaggaugccaacuucgucugucggcgcaccuucgucgaccggggcugggggaacggcugcgguuuauucggcaaggguucccucauaacaugcgccaaguucaagugcgucaccaagcucgagggcaaaaucguucaguaugaaaaucugaaguacagcguuaucgugacaguccacaccggcgaccagcaccagguugggaacgaguccacggagcacggaacuaccgcuaccaucacgccucaggccccaacuaccgagauccagcucaccgacuacggggcccugacccuggacugcagcccccgcacgggacucgacuucagcgagaugguccugcugaccaugaaggaaaaguccugguuggugcacaagcagugguuucuggaccucccauuaccguggaccucuggugccuccaccucgcaggagacguggaaccgccaggaucugcuggugacauucaaaaccgcccacgcaaagaagcaggaaguugugguacucggaucccaagagggcgccaugcacaccgcgcugacgggagcaacugagauccagaccagcggcaccacgacuaucuucgcggggcaucugaagugccgccucaaaauggauaagcugacacugaagggaauguccuaugucaugugcacgggcucuuuuaagcucgagaaggaggucgcggagacgcagcacggcaccgugcugguccagauaaaguacgagggcaccgacgcgccaugcaagaucccguuuaguacccaagaugagaagggggugacgcagaauggccgauuaaucaccgccaacccgaucguaacugacaaagagaaaccugucaacaucgaggcagagccgcccuuuggggagagcuacauagugaucggcgcgggcgagaaggcccuuaagcuauccugguucaagaaggguuccuccauaggcaaaauguuugaggccacagcccgcggggcacggcgcauggcaauccugggcgacacagcaugggacuucggcucuauuggcggaguguucaccuccgucgggaagcuggugcaucaaaucuucgggaccgcuuacgggguucuguucuccggcguuuccuggaccaugaagaucgggaucggugugcugcuaacguggcucggccuaaacagccgcuccaccagcuuauccaugaccugcauugccgucgggcucgugacccuuuaccuugggguuaugguucaggcggacagcgggugcguaaucaacuggaagggccgggagcugaaaugcgggucugggaucuucgugacgaacgagguccacaccuggaccgaacaguacaaauuccaggcggauuccccgaaacgccugucagccgcgaucggcaaggcgugggaggaaggugucugcggaauccggucugccacgcguuuggagaauauuauguggaagcagauaagcaacgagcucaaccauauauuacuggagaacgacaugaagcuaaccgucguggucggugacgucgcaggcauauuagggcaggggaagaagaugauacguccccagccuauggaguacaaguacuccuggaaguccuggggcaaggccaaaaucauaggggccgacgcccagaacacgaccuucaucauagacggcccuaacaccccagaauguccugacgaccaacgcgcguggaacaucugggaggucgaagauuacggcuucggcauauucacaacgaacaucuggcuaaagcuccgggacuccuacacccaggucugcgaccaccgccucaugagcgccgccaucaaggacucgaaagcaguccaugccgacaugggcuacuggauugagagcgagaagaaugagaccuggaaacuggcccgggcuuccuucaucgaggugaagacuugcaucuggcccaagucgcacaccuugugguccaaugggguauuagagagcgagaugauuauccccaagauauacggcgggccgaucucucagcacaacuaccgaccuggguauuucacgcaaaccgccggccccuggcaccuaggcaaacucgagcuagacuucgaucugugcgagggaaccacggugguggucgacgagcacugcgggaaccggggcccgagccuccgcaccaccacugugacggggaagaucauacacgaguggugcugccgguccugcaccuuaccgccucuucgcuuuaggggcgaggacggaugcugguacgguauggagauacgccccgugaaggagaaggaggagaaccuagucaagucaaugguuagcgcaggguccggggagguagacucauucucccuggggcugcugugcauaagcaucaugaucgaggagguuaugcgaucccgcuggucgcggaagaugcugaugaccgggacgcuggcgguguucuuccugcucaucaugggccagcugacguggaacgaccucauccgccugugcaucauggugggagcgaacgcauccgaccgcaugggcauggguaccacuuaucuggcccucauggccaccuuuaagaugcggccuauguuugccgucggguuacuguuucgccggcucacgagccgcgaagugcugcugcucacuauaggccugucccugguggcaagcgucgaacuccccaacucccuggaggagcugggagacggccucgcuaugggcaucaugauccugaaacuccuuacugauuuucagagcuaccagcuaugggcaacccuucucucccugacguuuauuaagaccacuuucagccugcauuacgccuggaaaaccauggcgaugguacuuagcaucgucucucuuuucccccugugccuguccaccacaagccagaagaccaccuggcugccuguacuguuagguuccuuaggcugcaaaccgcugacgauguuccucaucgccgagaacaagaucugggggcggaagagcuggccgcugaacgagggcaucauggcagugggaaucgucagcauucuguuaaguagccuccugaaaaacgacgugccccucgccggcccccucauagccggcgggaugcuuaucgcaugcuacguaaucuccgggagcuccgccgaccucagccuggaaaaagcggcagaagugagcugggaagaggaagccgagcacagcggggcgucacacaacauccuggucgagguccaggacgacggcacuaugaaaauaaaggacgaggagcgcgacgacacccuuaccauccugcugaaggcgacccuacuggcugucucugggguguauccgcucucaaucccggccacccuauucgucugguacuuuuggcagaagaagaagcaacggagcggugugcugugggacaccccuucaccgccugaggucgagcgcgccgugcuggacgacggaaucuacagaaucaugcagcgcggacugcuggguaggagccaaguaggugugggcguauuccaagagaacgucuuccauacgauguggcaugugacgaggggggcagugcugauguaucagggcaaacgucuggagccgucuugggccucugucaagaaagaccucaucuccuacggcggcggcuggcgccugcgugguagcuggaacaccggugaagaaguccagguaaucgccgucgagcccgggaagaaccccaagaacgugcaaaccgcccccgggaccuucaagacucccgagggcgagguuggggccaucgcucuggauuucaagcccgggacguccgggagccccaucgucaacagggagggaaaaaucgucggccucuacggcaauggcguggucaccaccagcgggaccuacguguccgccaucgcccaagcuaaggcgucucaagagggcccgcugcccgagaucgaggacgagguguuccgcaagcgcaaucugaccaucauggacuugcaccccggauccggcaagacuagacgauaucugcccgccauuguccgugaggcuauaaagaggaagcugcgcacgcucauacuggcccccacccgcguggucgccagcgaaauggcggaggcgcugaagggaaugcccauccgcuaccagacgaccgcggucaaaggugaacacaccggcaaggagaucguggaccucaugugucacgccaccuuuaccaugcgucuccugucucccgugcgcguucccaacuacaauaugaucauaauggaugaggcacacuucacugacccaagcuccaucgcggcccgggguuauaucagcacccgcguggggaugggugaagccgccgccaucuucaugacagcgacgccucccggcuccguugaggcauuuccgcagagcaacgccgucauccaggacgaggaacgagacauucccgagagguccuggaauagcggauacgaauggaucaccgacuuucccgggaagaccgugugguucgugcccuccauuaagucugguaacgacauugcgaacugccuucggaagaacggaaagcgcgucauccagcugucccggaagacuuucgacacugaauaccaaaaaaccaagaacaacgauugggacuacgugguuaccaccgacauuucggagaugggcgcuaacuuccgcgccgaccgggucaucgacccucgccgaugcuugaagcccgugauucugaaggaugggcccgagcgcgugauccuggcaggcccuaugccggugacaguggccuccgcagcgcaacggcgcggccggaucggucgcaaccacaacaaggagggcgaccaguauaucuacauggggcagccccugaacaacgacgaggaccacgcccacuggaccgaggcaaagaugcuguuggacaacaucaacacccccgagggcaucauccccgcuuuauucgagccggagcgcgaaaagagugcggccguggacggggaguaccggcuccggggagaggcccgaaagacguuuguugagcugaugcgccgaggcgaccugcccguuuggcuuuccuauaagguugccagcgagggguuccaguacucugacaggcguugguguuucgauggcgagagaaauaaccaaguccuggaggagaacauggacgucgaaauauggaccaaggagggugagaggaagaagcuccgcccgcgguggcucgacgcuagaaccuacuccgaucccuuagcucugcgggaguucaaggaauucgcggccgggcgccgcagcgucuccggugaucucauccuggagaucggcaagcugccgcagcaccucacccagagggcccagaacgcccuggacaacuugguaaugcugcauaacagugaacagggagggagagcguaccgccacgccauggaagagcuaccagacaccaucgagacacugaugcugcuggcccucaucgccguccucaccggcggggucacccuguucuuccugucgggacgggggcuggggaaaaccagcaucggcuuacugugcgugauggccucgagcgugcuccuuuggauggcguccgucgagccccacuggaucgccgccagcaucaucuuagaguucuuccucaugguccugcugaucccugaaccggacagacagagaacaccucaggacaaucagcucgccuauguggucaucggacugcuguucaugauacucacgguugccgcgaaugagaugggacuucuggagaccacaaaaaaggacuuagggaucggccacguggcagucgaaaaccaucaccacgcagccaugcucgacguggaucugcaccccgccuccgcguggacccucuacgccguggcgacgaccaucaucaccccgaugaugcgacauacuaucgagaacacgaccgccaacaucucauuaaccgccaucgccaaucaggccgcgauccugaugggguuggacaagggcuggcccaucuccaagauggacauaggugucccccuucuggcccucggcugcuacagccaagugaacccccugacccugacggcggccgugcucaugcucguagcccacuaugcaaucauaggcccgggccugcaggcuaaagcgacccgcgaagcgcagaaacggacggccgccgguaucaugaaaaaccccaccguagauggcaucguggcaaucgaccucgaucccgugguguacgaugcgaaauucgaaaagcaacuggggcaaauaaugcuguuaauccugugcacgucucaaauuuugcucaugaggaccacgugggcccuuugcgagagcaucacgcuggccacgggcccacuaaccacccugugggaaggcucccccggcaaauucuggaauaccacuaucgccguguccauggccaacaucuuucggggguccuaccuugcgggugcuggccucgcauucagucugaugaaaucccucgggggagggcgccgagggaccggcgcucagggggaaacccucggugagaaauggaagagacagcucaaccagcugucgaagagcgaguucaacacauacaagcgguccgggauaauggaggucgaucgcagcgaggcgaaggaaggacucaagcguggggagaccaccaagcacgccgugagucgcggcaccgccaagcuccggugguucguugagcgcaacuuggucaagcccgagggcaaggugaucgauuuagggugcggccgcgggggcuggagcuacuacugcgcugggcucaagaaggugacggagguuaaaggcuacaccaaaggcggcccgggccacgaggagcccauccccauggccaccuacggguggaaccucgucaagcugcacuccgguaaggacguguucuucaucccgcccgagaagugcgacacuuuacugugcgacaucggagaaagcuccccgaauccgaccaucgaggaggggcgcacgcugcggguccuuaagaugguggagcccuggcuucggggaaaccaguuuugcaucaagauauugaacccuuacaugcccagcguuguggagacgcuugagcagaugcagcggaagcacgggggcauguugguucguaacccgcugucccgaaacucgacacacgagauguauugggucucuugcgggaccggcaacaucgucagcgcggugaacaugaccucgcgcauguugcuuaaccgcuuuacgauggcccaccggaagcccacauacgaaagggacguggacuuaggaaccgggacccggcacgucgcgguagagcccgagguggccaaccuggacauuaucggccagcgcaucgagaacaucaaacacgagcauaagagcacguggcacuacgacgaggacaaccccuauaaaacuugggcuuaccauggguccuacgaggucaagccgagcggaucggcgucaucaauggucaacggcgucguaaagcugcugaccaagcccugggacguuauccccauggucacacaaaucgccaugacggacaccacccccuucggucaacagcggguguuuaaggaaaaaguugacaccaggaccccgaaggccaagcgggguaccgcccagaucauggaggucacugcccgcuggcucuggggauuccugucccgaaacaagaaaccccgcaucuguacccgggaggaguucacacgaaaggugagaagcaacgcugcaaucggcgcuguguucguggaugagaaccaguggaacucugccaaggaggcgguggaggacgagagauucugggaccuggugcacagagagagagagcuccacaaacaggggaagugcgccaccugcgucuacaacaugaugggcaagcgggagaagaagcugggggaguuugggaaggccaagggcagccgcgccauuugguacaugugguugggggcacgcuucuuggaguucgaggcccugggcuucaugaacgaggaccacugguucucccgcgagaauagccucuccgggguugagggcgagggucuucacaaacugggauacauacugagagauauuagcaagauccccggcgggaacauguacgcggacgacaccgccggcugggacacccgcaucacggaggacgaccuccagaaugaagccaaaaucacggauaucauggagccggagcacgccuugcuggcgaaagccaucuucaagcucacuuaccagaacaaggucguaagggugcagcgaccggccaagaacgggaccgugauggacgucaucucccgccgggaccagcggggcagugggcagguugggaccuacggcuuaaauaccuucacgaacauggaggcgcagcugauccggcagauggagucagagggcaucuucagccccuccgagcuagagacuccgaaccucgcggagcgcgcgcuggauuggcucgagaaguacgggguggagaggcucaagcgcauggccauuuccggggacgacugcguuguaaagccgaucgacgacagauuugccacggcucugaccgcccuuaacgacaugggcaagguccgaaaggacaucccccagugggaacccuccaggggcuggaaugacuggcaacagguccccuucugcucgcaccacuuccaccagcugaucaugaaggacgggcgcgagaucguggucccaugccggaaccaggacgaacuuguuggccgcgcgcgggugucccagggugccgguugguccuugcgugagaccgccugcuugggaaaaagcuacgcucagauguggcagcuaauguauuuccaccgucgcgaccuccggcucgcggcgaacgccaucuguuccgccgugcccgucgacugggugcccaccagccgcacgaccugguccauccaugcccaccaccaguggaugaccaccgaggauauguugagcguguggaaccgugucuggaucgaggaaaacccauggauggaggacaagacgcacaucuccagcugggaggacgugccguaucucggaaagcgggaggaccaauggugugguagccuuaucggguugacugcccgcgccaccugggccaccaauauccagguugccaucaaccagguccggagguugaucggcaaugagaauuaccuugauuacaugacaagcaugaagagauuuaaaaacgaguccgacccagagggggcccuaugguag

SEQ ID NO: 24436 - RNA, 9879 nt, Artificial Sequence
  derived and/or modified CDS sequence (opt11) from DENV-1__GU131726__SS-prME
aguguuaccauguuacucaugcugaugcccaccgcccuagccuuccaccucaccaccagagggggugaaccacacaugauagugacgaagcaggaacggggcaagucucuacuguuuaagaccagcgcggggguuaauaugugcacacucaucgcgauggaccuuggcgagcugugugaggacaccaugaccuauaaguguccaagaaucacugaggccgagcccgaugacguggacugcuggugcaacgcgacagauacaugggugacauaugggaccuguagccagacgggggagcaccggcgagacaagaggagcguggcgcucgcgccgcacgucggccuuggguuggagacccgcaccgagaccuggaugucuucugaaggcgccuggaaacaaauccagaggguggagacuugggcuuugcgucacccaggguucaccgugauugccuuguuucuggcucacgcaaucgggaccucaaucacgcagaaaggaauuaucuucauucuucugaugcugguuacgccgagcauggcuaugcguuguguagggaucggcagucgagacuucgucgaagggcucagcggugcuaccugggucgaugucguuuuggaacacgggucaugcgugacgaccauggccaaggacaaacccacucuggacaucgagcucuugaaaacugaggucaccaaucccgccguccugcggaagcucuguauugaggccaaaaucagcaacaccacuaccgauucccgcugcccgacccaaggcgaggccacacuuauggaggaacaggacgccaacuucguuuguagacgaacuuucguagaucguggcugggggaauggcugcgggcuguuugguaaggggagccucaucacaugugccaaguucaaaugcguaaccaaauuggagggcaagaucgugcaauaugagaacuugaaguacagugucaucguuaccgugcacacuggagaucaacaccaggucgggaaugaaagcaccgagcacgguaccaccgcgacaaucacgccccaggccccuaccuccgagauccaacugacggacuauggcgcccugacccucgauugcagcccucgcaccggccucgauuuuaaugagaugguacugcugaccaugaaagagaaguccuggcuaguacacaagcagugguuccuugaccugccgcuuccguggacaagcggggccuccacuucccaagagacguggaaccggcaggaccugcuggugaccuuuaagaccgcacacgcgaagaagcaagagguggucguucugggcagccaagagggugccaugcacacugcccucacgggggcgaccgagauacaaaccucagguacgaccacaaucuuugcagggcaccugaaaugccgccucaagauggauaaacugacccugaaggggaugucauacgugauguguaccggguccuucaaacuugagaaagaagucgcggagacgcagcauggcacggugcugguccagaucaaguaugaggggacggaugcccccugcaagaucccguucagcacccaggacgagaagggcgccacccagaacggccggcugauuacagccaacccaauugucaccgauaaggaaaaaccuguuaacauagaggcagaaccuccguucggggaauccuacaucgucaucggcgccggcgagaaggcccugaaguugagcugguucaagaaaggguccaguauuggaaagauguucgaggccaccgcccgcggagcgcgaagaauggcaauccuaggcgacacggccugggacuucgguucugucgggggaguguucaccuccgugggcaagcugguccaccagaucuucgguacagccuacgggguauuauucuccggggucagcuggacaaugaagauuggcauuggaguccucuuaaccuggcucggccuuaacucccgcucuaccucgcugucgaugaccuguauagcgguugggcucgugacucuguaccugggcgucaugguucaggcggacuccgguugcgucaucaacuggaaaggccgcgagcucaagugcgggaguggcaucuucgucacgaacgaagugcacaccuggacugaacaguacaaauuccaggccgacagccccaagagacuauccgcggcaaucggcaaagccugggaggaaggggugugcggcauccgaagcgcgacccgccuggagaauaucauguggaagcagaucuccaaugagcuaaaucauauccugcuggagaacgauaugaaguucacggucgucgugggagauguugugggcauucuagcccaagggaagaaaaugauccgcccccagcccauggaacacaaguauucuuggaaaaguuggggcaaagcuaagaucauuggagcggauguucaaaacacgaccuucaucauagacggccccaacacaccggagugccccgaugaucagcgcgcguggaacaucugggagguggaggacuacggcuucgggauuuucgccaccaacauuuggcugaaacugcgggacagcuacacccaagugugcgaucauagacucaugagugccgcuauuaaagacuccaaggcuguucacgcagauaugggcuacuggaucgaauccgagaaaaaugagacauggaagcuggcacgggccagcuucaucgaggucaagacuugcaucuggcccaagucccauacgcuguggagcaauggcguucuagaauccgagaugaucauccccaagaucuacgggggcccgaucagucagcauaacuaccgccccggguacuuuacgcaaacggccgguccuuggcacuuagggaagcuggagcucgacuucgaccuaugcgagggaaccaccguagucguggacgagcacugcggcaaucgagggccgucacugcggaccaccaccgucacagggaaaaucauccacgaguggugcugcaggagcuguacgcugccgccccuccguuuuaagggcgaggacggcugcugguacgguauggagaucagaccagucaaggaaaaggaggaaaaccuggugaagucuauggucagcgccggcagcggcgagguggacuccuucucgcucggguuauuaugcauaucuaucaugaucgaggaaguuaugaggucaaggugguccaggaagaugcucaugaccggcacccuggcgguauuuuuauuacugaucauggggcagcucaccuggaacgaccucauccggcuaugcaucauggucggcgcgaacgccucugaccgcaugggaaugggaacgacguaccuggccuuaauggccacuuucaagaugcgucccauguuugccguggggcuacugcucaggagguuaaccucacgggagguucuacuccugacgaucggucuaagccucguugccaguguggagcugcccaacagccuggaggagcucggcgauggccuugccaugggcaucaugauccugaagcuccugaccgauuuccaaagccaccaacuuugggcuacucuacugucucuuacguucaucaagacgacccucucccugcacuaugcuuggaagaccauggcgaugguccugagcaucgugucccucuucccccugugccugagcacgacgucccagaagaccaccuggcuccccgugcuacucgggucguucgggugcaagccuuugaccauguuccugaucacggagaacaaaauauggggccguaaguccuggccccugaaugaggggauaauggccguagggguggugagcauauugcugagcucucugcuaaagaaugacgugccccuugcaggaccacugauugccggagggauguuaauugccugcuauguaaucagcggcuccaguccggaucucucccuggagaaggcagccgaggugagcugggaggaggaggcagagcauuccggcgccucgcacaauauccuaguugagguccaggacgauggcaccaugaagaucaaggacgaggaacgcgacgauacucuuaccauccuguugaaggcaaccuugcuggccgugucgggcgucuauccacucagcauccccgccacgcuguuugugugguacuuuuggcaaaagaaaaagcagcggucgggggugcucugggacacgcccagcccucccgagguagagcgggcggugcuggacgacggcaucuaccgcaucaugcagcggggacuccuuggccgcucccagguuggggucggggucuuccaagagaacguguuccacaccauguggcaugucaccaggggcgcggugcugauguaccaaggaaagcgcuuggagcccagcugggcguccgucaagaaggauuuaauuaguuaugguggaggguggcggcugcaaggguccuggaacacgggugaggaggugcaggucaucgcuguggagcccggcaaaaacccuaagaauguccagaccgcaccagggaccuuuaagaccccggagggcgaggugggcgcaaucgcccucgacuucaagcccgggacgagcggcuccccuaucgucaaccgcgaggggaagaucgucggcuuauacggcaacggggugguuaccaccagugggaccuacguuagcgcgauugcccaggcuaaggccucccaggaggggccgcugcccgaaaucgaagacgagguauuucggaagcgcaaucucacgauuauggaccugcacccgggcagcgguaagacacggcgauaccuccccgcgauugugcgggaagccaucaaacgcaagcuccggacgcugauccucgcgcccacccgugucgucgccuccgagauggccgaggcgcucaagggcaugcccauccgcuaccagaccacagcugucaaaucagagcacacuggcaaagagauagucgaccugaugugucaugccaccuucacuaugcgguuacucucacccgugcgcgugccaaauuacaauaugaucaucauggacgaggcccauuucaccgacccgagcaguaucgccgcgcgugguuacaucucaacccgcgucggaaugggagaagccgcagccauauucaugaccgccacgcccccgggcaguguggaggccuucccucagucgaacgccguaauccaggacgaggaaagggauauacccgagagauccuggaauagcgguuacgaguggauaaccgacuuuccagguaagacagucugguucgugccguccaucaagucgggcaacgacaucgccaauugcuuacggaaaaaugggaagcgcgugauccagcugucccggaagaccuucgacacggaguaucagaaaaccaaaaacaaugauugggauuacgucgucacaacugauaucucggagaugggugcaaacuucagagcggaccgugucaucgauccccggcgaugcuuaaagccugugaucuuaaaggaugggccagagcgcgugauccuagccggccccaugcccgucacaguggccucugcggcccagcggcgcgggcggauaggacgcaaccacaacaaggagggugaccaguacaucuacauggggcagccccucaacaacgacgaggaccacgcgcauuggacggaggccaagaugcugcuggacaauauaaacaccccugagggcaucauuccugcacucuucgagcccgagagagagaaguccgccgcaaucgacggggaguaucggcuacgcggcgaggcgcggaaaaccuucguggaacugaugcgccgcggggaucuucccguauggcuguccuacaaaguugccucagagggcuuccaguacagcgaccgccgaugguguuuugacggcgagcgcaauaaccagguacucgaagagaauauggauguagagauuuggaccaaagagggugagaggaagaagcuccgccccagguggcuggaugcccgcaccuauucagauccguuagcccuccgggaguucaaagaguucgccgcgggcagaagaagcguguccggggaucugauccuggagaucggaaaguuaccccagcaccugacccagcgcgcacaaaacgcccuggacaaccuggugaugcugcacaacagcgagcaaggugggcgagcguaccgacacgcgauggaggagcugccagacacaauugaaacgcucaugcugcuggcccucauagccguccugacagggggugugacccuguucuuccucuccggcaggggccugggcaagaccuccauuggccugcuuugcgugauggccuccucaguucugcuguggauggccuccguggagccgcauuggaucgcagccagcauuauccucgaguucuuccugauggugcugcucauaccggagccggaucgccaacggacgccccaagacaaccagcuggccuacgucgugauuggguuacucuucaugauccuaaccguggccgcaaacgagaugggacugcucgagaccaccaagaaagaccuggggaucggucaugucgcgguggagaaccaccaccaugcaaccauguuggauguagaccuccacccggcguccgccuggacgcuguacgccgucgcgaccaccaucaucaccccuaugaugcgccauacgaucgagaacacgacagccaauaucagccugacugcuauugcgaaccaggcagcgauucucauggggcuggacaagggauggccgauuuccaagauggacaucggagugccgcugcucgccuugggaugcuacagccaggugaacccucugacgcucaccgcagcaguauugaugcugguagcucacuaugccaucaucggaccuggccuccaggcuaaagcaacccgcgaggcccagaagcggacagcggcgggcaucaugaaaaaccccaccguugaugggauuguagcaaucgaccucgauccaguggucuacgacgccaaguucgaaaagcaacuggggcagauuauguugcugaucuugugcacaagccaaauccuacucaugcgcaccaccugggcguuaugcgagaguaucacguuggcgacuggccccuuaaccacccugugggaagguagucccgggaaguucuggaacacgacuaucgccguuagcauggccaacaucuucagggguaguuauuuggccggcgccggcuuagcguuuucauuaaugaagucccucgggggcgggaggcggggaaccggagcccagggcgagacccugggugagaaguggaaacgccaguuaaaccaacuuucgaaaagcgaguucaacaucuacaagcgguccgggaucauggagguggacagaagcgaggccaaggagggccuaaagcgcggugagacuacccggcacgcaguguccagaggcacagcgaagcugcgaugguucguagagcggaaccugguaaagcccgaggggaaagugauagaccuugguugcggucgcggaggguggagcuacuacugugcagggcugaagaaagucaccgaggugaaaggcuacacgaaaggagggcccgggcacgaggagccgauccccauggccaccuacggauggaaucuagugaagcuccauucgggcaaggacgucuucuucacgccgcccgagaagugcgauacccugcugugugacaucggggaguccagcccaaaccccacuaucgaggagggccggacccugcgcgugcuaaagaugguggagccauggcugcgugggaaccaguucugcaucaaaauauugaaccccuacaugccgagcguuguggagacccuggagcaaaugcagcgcaaacauggcggcaugcugguucgcaacccacucucccgcaacagcacccacgagauguacugggucaguugcgggacgggcaacauaguguccgccgugaacaugacgucgcggaugcugcucaaccgcuucaccauggcccacagaaaaccgaccuacgagcgagacgucgaccugggggcugggacccgccacguggcgguugagccagaggucgccaaccuugauauuaucgggcagcggaucgaaaacauuaagcaugaacacaagagcacguggcacuacgacgaggacaaccccuacaaaaccugggcauaccacggguccuacgaagugaagccaagcggauccgcgucuuccauggugaacggaguggugaagcugcucacuaaacccugggacguaauccccaugguuacgcaaaucgcaaugacggacaccaccccauucggccaacaacgcguuuucaaggagaagguagacacccggacgcccaaggcuaagcgcgggaccgcccagauaauggaggugacugcccggugguuauggggcuucuugucccggaacaagaaaccgagaaucugcacgcgcgaggaguucacccguaaggugcgcucaaacgcugcgauaggggccgucuuuguagacgaaaaucaguggaacucugcuaaggaggccguggaagacgagagguuuugggaccucguccaaaaggagagagagcugcacaagcagggaaagugcgcaaccugcguguauaacaugaugggcaagcgugagaagaaacugggagaguucggcaaggccaaagggucucgcgcaauaugguauauguggcucggcgcccgguuuuuagaguucgaggcccugggcuuuaugaaugaggaucacugguucagucgcgagaauagucucagcggcguggaaggagagggucugcauaaauugggguacauacuccgggacauaagcaagauccccgggggcaauauguaugcggaugacaccgcaggcugggauacccgcaucacggaggacgauuuacagaacgaggcaaaaaucaccgacaucauggagccugagcaugcccuacucgcgaccucaaucuucaaguuaacauaccagaauaagguggugcgugugcaacgcccagccaagaaugggacgguaauggacgugauuucucgccgggaccagcggggcuccggccaggugggcaccuacggccugaacaccuucacuaacauggaggcccagcucauccggcagauggagagcgagggcaucuuccugcccuccgagcuggagacaccaaauuuggcugagcgcgugcucgauuggcuggagaaauacggcgucgagcggcucaagaggauggcaaucucuggggaugacugcguagucaagcccaucgacgaucgguucgcuaccgcccugaccgcccugaacgacauggguaagguucgcaaggacaucccgcagugggagcccucuaaaggguggaacgacuggcagcaagucccauucugcagccaccauuuccaucagcucaucaugaaggacggccgggagaucgucgugcccugcagaaaccaagacgagcuaguuggccgggcccgcgucucccagggggccggcuggucacugcgggagaccgcgugucucggcaaaagcuacgcacagauguggcagcugauguacuuccaccgccgggaccuucgcuuggccgccaaugcuaucuguucagcaguaccaaucgacugggugcccacgagccggaccacgugguccauccacgcccaccaucaauggaugaccacagaggacaugcugagcgucuggaaccgcguguggaucgaggaaaauccguggauggaggacaagacccacguguccagcuggggcgacguacccuaccuuggcaagcgggaagaucaauggugugguucccucaucggcuuaaccgcucgcgcaacuugggccagcaauauccagguggccaucaaucaagugcggcggcugauugggaacgagaacuaucuggacuacaugacuuccaugaagcgcuucaaaaacgagggcgauccugagggggcucugugguga

SEQ ID NO: 24437 - RNA, 9879 nt, Artificial Sequence
  derived and/or modified CDS sequence (opt11) from DENV-1__GU131727__SS-prME
agcguuacaaugcuucucauguuaaugcccaccgcacucgccuuccaccucacgacccggggaggggaaccucacaugaucgugaccaaacaggaacggggcaagagccugcuguucaagaccagcgccggaguaaauaugugcacccucaucgccauggaccucggcgagcugugcgaggacaccaugacuuacaaauguccccggaucaccgaggccgagcccgacgacguagauugcuggugcaacgccaccgacacgugggugaccuacgggaccugcagccagacgggcgagcaccggcgcgacaagagaagcguugcgcuggcgccccacguuggcuuagggcuggagacccgaaccgagaccuggauguccagcgagggcgcauggaagcagauccagcgggucgagacgugggcguuacgccacccaggcuucaccgugaucgccuuguuccuggcgcacgccaucggcacauccauuacccagaaggggauuaucuuuauccuacuaauguuggugacacccagcauggccaugcggugcgucggcaucggaucgcgcgacuucguggaggggcucagcggcgccaccugggucgacgucgugcuggagcacggguccugcgugaccaccauggcaaaggacaaaccaacgcuggacaucgaguuacuaaagacagaggucaccaacccugcgguccuccggaaacucugcaucgaggccaagaucaguaacaccacgaccgacucgcgcugcccuacccagggcgaggccacccugauggaggagcaggaugccaacuucgugugccggcguaccuucgucgaccggggaugggggaacggaugcgggcuguucggaaagggaucgcucauaaccugcgccaaguucaaaugcgugaccaagcuggaaggaaagaucgugcaauacgagaaccugaaauacucugucauugugaccgugcacacuggcgaccagcaccaggucgggaacgagagcacggaacacgguaccaccgcgaccauaacgccccaggcgcccaccuccgagauacagcucaccgauuauggggcccugacccucgacuguagcccccggacgggcuuagauuucaaugagauggugcugcugacuaugaaggaaaagucuuggcucguccacaagcagugguucuuggaccugccgcuucccuggaccagcggugcuagcacgucccaggagaccuggaaccggcaagaccugcuggugaccuucaagacagcccacgcgaagaagcaggaaguugugguacucggcagccaagaaggcgcaaugcauaccgcacucacgggggcaaccgagauccagaccucgggcaccacgaccaucuuugccgggcaccugaagugucgccucaaaauggacaagcugaccuugaagggcaugagcuacgugaugugcaccggguccuucaagcucgagaaggagguugcggagacgcagcacggcaccguauuaguacaaaucaaguacgaaggcaccgacgcccccugcaagauccccuucagcacccaggacgagaagggggucacgcaaaacggccgacugaucacggccaacccgauuguaaccgacaaggagaagccugucaacaucgaggcagagccgccauuuggugaauccuacaucgucaucggagcuggcgagaaggcguuaaaacuuucaugguucaaaaaggguuccagcaucgggaagauguucgaggcuacagcccgcggggcacggcgaauggcgauccugggagacacggcgugggacuucggcuccgugggcggcguauucacaucugucgggaagcuggugcaccaaaucuucgguaccgccuauggcgugcuguuuuccgggguuucguggaccaugaagaucgguauaggcgugcugcugacguggcucggccugaacucacgcagcaccucccugagcaugaccugcaucgcggucggccugguuacccuguaccugggcgugauggugcaagccgauuccgggugugucaucaacuggaagggccgggaacucaagugcgggagcggcaucuucgugacgaacgagguucacacauggaccgagcaauacaaguuccaggcggacucaccgaaacgcuuguccgcugccaucggcaaggcuugggaggagggcgugugcgguauccggagcgcuacccggcuggaaaacaucauguggaaacagaucuccaaugagcucaaccacauccugcuggaaaaugacaugaaauuuaccgugguggucggggacgugguggguauccucgcgcaggguaaaaagaugauacggccccaacccauggagcacaaguauagcuggaaauccugggggaaagccaagauaaucggugcugacguccaaaacacgacuuucaucaucgacggacccaacacaccggagugucccgacgaccagcgcgccuggaauaucugggaaguugaggacuacggcuucgggaucuucaccacuaauaucugguugaagcugcgagacagcuacacccaggugugugaucacagacucaugagcgcggccaucaaggacaguaaggcuguucacgccgacaugggcuauuggauugaguccgagaagaaugagacauggaaguuagcccgggccagcuucaucgaggugaagaccugcaucuggcccaaaucccacacacuguggucuaacgguguguuagaauccgagaugaucauccccaagaucuacgguggccccauaucgcagcacaauuacagacccggguacuuuacccagaccgcaggcccuuggcaccuggggaaacuggagcucgacuucgaucugugcgaggggacuacggucgugguugacgagcacuguggcaaccgggggccgucccuccgcaccaccaccguuacuggcaagaucauccaugaauggugcugucggagcugcacgcuaccgcccuugcgcuucaaaggagaggauggaugcugguacgggauggagauccggccagucaaagagaaagaggagaaccuggugaaguccauggucucggccggaagcggcgagguggacaguuucagccucgggcugcugugcauauccauuaugaucgaggaggugaugcgaagccguuggucccgcaagaugcucaugaccggaacccuggccgucuuuuuacuccugaucaugggucagcugacauggaacgaucuaauccggcuguguauuauggugggcgccaacgcgucggaccgcauggggaugggaaccacguaccuggcccucauggccacuuucaagaugcgcccgauguucgccguggggcugcuguuucgccgucugacgucccgggagguccugcuguugacuaucgggcucagcuuaguggccucugucgagcuucccaauucauuggaggaguugggggacggacucgcgaugggcaucaugauccuaaagcugcucacagauuuccagucccaucaacugugggccacuuugcucagccugacguucaucaagacgacccugucgcuacacuaugccuggaagaccauggccaugguucugaguaucgugucccuguuccccuuaugccugagcacgacuucccagaagacaaccuggcugcccguccucuuaggcagccuugggugcaagccgcucacgauguacuuaaucaccgaaaacaagaucuggggccgcaagucauggccccugaacgaggggaucauggcggugggcguggucagcauccuucucagcucccuacucaagaaugaugugccacuggccggaccgcugauagcaggcggcauguuaaucgccuguuacgugauuagcggguccagcgccgaccugagucucgagaaagcggcugaggucagcugggaggaggaggccgagcauucaggcgccagccacaacauccuggucgaggugcaggacgacgggaccaugaagaucaaggacgaggagcgggaugacacccucacgauccugcucaaggccacccugcuggcugucuccggcguuuacccgcucuccauccccgccacccuauucgugugguacuucuggcagaagaagaagcagcgcagugggguucugugggacacacccagcccgcccgagguggagcgggccguacuggacgauggcaucuaucgcaucaugcagcggggcuuacucggacggucccagguaggcguagggguguuccaagagaacgucuuccauaccauguggcacgugacgcggggcgccgugcugauguaucaggggaagcgccucgagcccagcugggccuccgucaaaaaggaucugaucucguacgguggcggauggcggcuucagggcuccuggaacaccggggaggagguccaggugauugcggucgagcccggcaaaaacccgaagaacgugcaaaccgcccccgggaccuuuaagacgcccgagggcgaggugggcgcaaucgcccucgacuucaagcccgggaccucaggcuccccuaucguuaaccgcgagggaaagaucguuggccuguacggcaaugggguugucaccaccagcggcacauacgucagcgcaaucgcccaagcaaaggcgucacaggaggggccacucccugagaucgaggacgagguauuccggaaaagaaacuugacgaucauggaccugcauccaggcucggguaagacccggcgcuaccugccagccauaguccgggaggcuaucaaacgcaaacuucggacccugauauuagccccuacgcgugugguggccuccgagauggccgaggcccucaagggcaugccaauccgguaccagacaaccgcggucaagagcgagcacaccggaaaggagaucguagaccugaugugccacgcuacauucaccaugcggcugcucucccccgugcgcgugccuaacuacaacaugaucaucauggacgaggcccacuucaccgacccaagcucaaucgcggcccggggguacauaagcacccgcgugggaaugggggaggcagccgccauuuucaugaccgccacgccgcccggcagcguagaggccuuuccucagagcaacgcaguaauccaagacgaagaacgggacauccccgagagguccuggaacuccggguacgaguggaucacugacuuuccuggcaaaacugugugguucgugccauccaucaagagcggcaacgauaucgccaacuguuuacggaagaacggaaagcgcgucauccagcugucccggaagacguucgacaccgaauaucagaaaacgaaaaacaacgacugggacuacguggugaccaccgauaucagcgaaaugggcgccaacuuucgggccgacagagucaucgauccgcgccggugucucaagcccgucauccugaaggaugggcccgaacgcgucauccucgcgggccccaugccggucaccguggcuucugccgcgcagagacgcgggcggaucgguagaaaccacaauaaggagggcgaccaguauaucuacaugggucaaccacucaacaacgacgaggaccacgcucauuggaccgaggcgaagaugcugcuugacaacaucaacaccccugagggcaucauccccgcccucuucgagccggagcgggagaaguccgcagccaucgauggggaguaccgccugcgaggcgaggcccgaaagacguucgucgagcugaugcgccgcggggaccuccccguguggcuuucuuacaagguggcgagcgagggcuuccaguacagcgaccgccgguggugcuucgauggcgagcgcaacaaccagguuuuagaggaaaacauggacguggagaucuggaccaaggaaggggagaggaagaagcugcgcccccggugguuagacgcacguaccuacuccgacccccuggcccuccgggaguuuaaggaguucgccgccggacgccggagcguauccggggaccugauucucgagaucggcaagcucccucagcaccugacccaacgcgcgcaaaaugcccuggacaaccucgucaugcuccacaacagcgagcagggcgggcgggccuaccgucaugcuauggaggagcugcccgacacgaucgagaccuugaugcugcuggcacuuauagccgugcuaaccggcggcgugacccuguucuuccuuuccggucgggggcugggcaagaccagcaucggccugcucugcgucauggccuccagcgugcuucuauggauggccuccguagagccccacuggaucgccgcgagcaucauccucgaguucuuucugaugguccugcucauccccgaaccggaccgccagcggacgccccaggacaaccagcuggcauauguggugaucgggcucuuauuuaugauccugacugucgcggcgaacgagaugggccugcucgagaccaccaagaaggaccugggaaucggccacguggccguggagaaccaccaccaugcgacaaugcuugacguagaccugcaccccgccagugcguggacacuguacgccguggccacgacaaucaucacgccaaugaugcgccauaccauagagaacaccaccgcgaacaucagccugacggccauugccaaucaggcggcuauccugaugggucuggacaaaggauggcccaucucgaagauggauaucggcgugccccugcucgcucuggggugcuacagccaggucaacccgcugacccucacugcagccgugcugauguuaguggcccauuacgcgaucaucgguccgggucuccaagccaaggccacccgggaggcccagaaacgcacggccgcaggcaucaugaagaaccccaccgucgacgggaucgucgccauugaccuggacccaguggucuacgacgccaaguuugagaagcaacugggucaaaucaugcuacuuauucugugcaccucccagauucugcuaaugcgcaccacuugggcccuuugcgagagcauuaccuuggccaccgguccucugacgacgcugugggaagggucgccgggcaaguuuuggaacaccaccaucgcgguaagcauggcgaacaucuucaggggcucuuaucucgccggagccgggcuggcuuucagccucaugaagagucucgggggugggcgcaggggcacaggugcgcagggggagacucugggugagaaguggaagagacaacugaaccagcucucgaaguccgaguucaacauuuacaagcgaucugggaucauggagguggaccgcucagaggccaaggaaggccugaagcgcggggagaccaccaggcacgccgucucccggggcaccgccaagcugcgaugguuuguagaacggaaccuugugaagcccgaagggaaaguaaucgaccucggcugugguagagggggcuggagcuacuauugugcgggguugaagaaggucacggaggugaagggcuacacaaagggcggcccgggucacgaggagccuaucccgauggccaccuacggcuggaaccuggucaagcuacacuccggaaaagacguuuucuucacgccgccggagaagugcgacacacuucugugugacaucggggagagcagccccaacccuacuauugaggagggucguacccuccgcguguuaaagauggucgagcccuggcugcggggaaaccaguucugcauuaaaauacucaacccuuacaugccaagugugguggaaacucuggagcaaaugcaacgcaagcauggcgguaugcugguucggaacccccucucccgcaacagcacccacgagauguacugggugucgugcgggacgggcaauauugugucagccgugaacaugacuucccggaugcuucugaaccgcuucacuauggcccaccgaaaacccaccuacgagcgugacguggaccucggggccggcacgcgccacguggcgguggagcccgaaguggccaaccuggacaucaucggccagcgcauugaaaauaucaaacacgagcauaaaagcaccuggcacuacgacgaggacaaccccuacaagaccugggccuaccaugggucuuacgaggucaagccgucaggcuccgcaagcagcauggucaacgggguggucaaacugcucacuaagcccugggaugugaucccaauggugacgcagauugccaugacagacaccaccccauucggccagcagcgcguauucaaggagaaaguagacacgcggacuccgaaggcgaagcgcgggaccgcccagauaauggaggugaccgcccgguggcuguggggcuuccugucccgcaauaagaagccacguaucugcacacgcgaggaguucacccggaagguccguagcaacgccgcaaucggcgcgguguuugucgacgagaaccaauggaacucggccaaagaagcugucgaggacgagagguuuugggaccucguacagaaggaacgugagcugcacaagcaggggaaaugcgcaaccuguguauacaauaugaugggcaaaagagagaagaagcugggggaguucggcaaggcuaaggggucacgggccaucugguacauguggcucggcgcacgauuucuggaguucgaggcccuaggcuucaugaacgaggaccacugguucucccgcgagaacuccuuauccggggucgagggcgagggguuacacaagcugggcuacauuuugcgggacauuagcaagauccccgggggcaacauguacgccgacgacaccgcgggaugggacacgagaaucaccgaagacgaucugcagaacgaggcuaagauaaccgacaucauggaaccggagcacgcccugcucgccaccaguaucuucaagcugacguaccaaaacaaggugguccggguccagcgcccugccaagaacgggaccguaauggacgugaucagccgcagggaccagcggggcucaggacaggugggcaccuauggccugaacaccuucacgaacauggaggcgcagcucauacggcagauggagagcgaggggaucuuccuucccuccgaacuagagacccccaaccucgcagaaagaguguuagacuggcuggagaaguacggaguugagcggcucaagcgcauggcaauuagcggggaugacugcgucgugaagccaaucgacgaccguuuugccaccgcucugacagcgcugaacgacaugggcaaggugcgcaaggacaucccccagugggagcccaguaaaggguggaacgauuggcagcaggucccuuucugcagccaccacuuccaccagcucaucaugaaggacggccgggagauuguggugccgugccgcaaucaggacgagcugguuggccgggcucgcgugucucaaggagccggcuggagccugcgggagacagcuugccucggcaagagcuacgcccagauguggcagcugauguacuuccaccggcgggaccugcgccucgccgccaaugcgauaugcuccgccguacccgucgacugggugccuaccagccggaccacguggucgauucacgcgcaccaccaguggaugacgaccgaggacaugcugagcguguggaaccgcguauggaucgaggagaaccccuggauggaggacaaaacgcacgugagcagcuggggcgacgugccguaucuggggaagagagaggaccaguggugcggcuccuugaucggcuuaaccgcccgggccaccugggccagcaauauccaggucgccaucaaccaggugcgccggcuaaucgggaacgagaacuaccucgacuacaugacguccaugaaacgcuuuaagaacgaaggcgacccggagggggcucugugguga

SEQ ID NO: 24438 - RNA, 9879 nt, Artificial Sequence
  derived and/or modified CDS sequence (opt11) from DENV-1__HM631850__SS-prME
agcgugaccaugcugcucaugcucaugccaaccgcacuggccuuucaccucacaacccgcggcggggagccccauaugaucgugucaaagcaggagaggggcaagagcuugcuguucaaaaccagcgcgggcgugaacaugugcacccucaucgccauggaccugggggaguucugcgaggacacgaugacguacaagugcccccggauuaccgaggccgagcccgacgauguagacuguuggugcaacgccaccgauaccuggguaaccuacgggacuugcagccagaccggggagcaccggagagauaaacggagcguggcccuggcgccccacgugggucucgggcuggagacccgcaccgagaccuggaugagcucagaaggugccuggaagcagauccaaagaguggagaccugggcccugcggcaccccggcuuuacugugaucgccuuguucuuggcgcaugccauaggaacgagcaucacccagaagggcaucaucuucauacugcuaaugcuggugacccccuccauggccaugcguugcgucgggauuggcagccgcgacuuuguggaggggcuguccggcgcgacguggguggaugucgugcuugagcacgggagcugcgugaccacgauggccaaggacaaacccacccuugacaucgagcugcucaagacugaggucaccaaccccgcggugcugcggaagcucugcaucgaggccaagaucuccaacacaaccacggacagccguugccccacccagggcgaggccacccucguggaggagcaggacgccaacuucgucugcaggaggaccuuuguggaccggggcugggggaacggcugcgggcuguuuggcaaggggucucucaucacgugcgccaaguucaagugcgugacuaagcuggaaggcaagaccguccaguacgaaaaccugaaauacagcgugaucgucacgguccacacgggcgaccagcaccaggugggcaacgaguccaccgagcauggcaccacggcgaccauuacgccccaggcccccucaaccgaaauccagcugacggacuacggcgcccucacccuggauugcucgccucggacgggccuagacuucaacgagauggucuuacugaccaugaaggagaaguccuggcucgugcacaagcagugguuucuagacuugccgcuacccuggaccagcggggccucaaccagccaggaaacguggaaccggaaggaccuccuagugaccuucaagacugcccacgcgaagaagcaggagguaguggugcugggcucacaggaaggcgccaugcacaccgcccucacaggggccaccgagauccaaaccagcggaacuacgacaaucuuugccgggcaucugaagugucgccugaagauggauaagcucacacuaaaaggcauguccuacgucaugugcaccgggucuuucaaguuagagaaggagguggcugaaacgcagcaugggaccgugcucguccagaucaaguacgagggaacagacgccccaugcaagauccccuuuucuacccaggacgagaaaggcgugacgcagaauggccgucugaucacggccaaccccaucguuaccgauaaagaaaagcccgucaacaucgaggccgagccccccuucggagagagcuacauagugaucggcgcgggcgagaaagcccugaagcuguccugguucaagaaggggagcuccaucgguaagauguucgaagcgaccgcgcgcggcgcccggagaauggcgauucucggcgacacggccugggacuucgggucgaucggggggguguucaccucagucgggaagcucgugcaccaaaucuuugguaccgccuacgggguucuuuucucuggcgucuccuggaccaugaagaucgggauuggcgugcuccugacguggcugggacucaacucgcgcuccaccagccuguccaugaccugcaucgccgucgguuuggucacccucuaccugggcguaauggugcaggccgauucggggugugucauaaacuggaagggucgugagcuuaaaugcgggagcgguaucuucgugacgaacgaggugcacaccuggaccgagcaguacaaauuccaggcggacuccccaaagcgccucagcgccgccaucggcaaggccugggaggagggggucuguggcauucgcuccgccacccgacuagagaacauuauguggaagcagaucagcaacgagcugaaccauauauugcuggagaacgacaugaaauucaccgugguggucggggauguugccggcauccuggcccaagggaagaagaugauccggccccagccuauggaauacaaguacuccuggaagucguggggcaaggccaagaucaucggcgccgacguacagaacacgaccuucaucaucgacgggcccaacacuccggagugcccagacgaccaacgcgccuggaauaucugggaggucgaggacuacggcuucgggaucuucaccacgaacaucuggcuuaaacuccgggacuccuacacccagguaugcgaccaccgacuuaugagcgccgccaucaaagauuccaaggccguccacgcggacauggguuacuggauugaaagcgagaagaacgagaccuggaagcucgcgcgggcgucuuucaucgaggugaagaccugcaucuggccgaaaucucacacucugugguccaacggcguucuugagagcgagaugaucaucccgaaaaucuacggaggcccgaucucccaacacaacuaccgccccggauacuucacccagaccgccggcccuuggcaccucgggaagcuggagcuggacuucgaucucugcgagggcaccacgguaguggucgacgagcacuguggcaaccgcgggccgucccugcgcaccaccaccguuacgggcaagaucauccacgaguggugcugcagaaguuguacccuuccuccccugagauuuaagggggaagauggcugcugguacgggauggagauccgcccugucaaggagaaggaggagaaccuggugaagagcauggugucugccggcucgggcgaggucgacagcuucucccuaggucucuugugcaucagcaucaugaucgaggaggugaugcgcucccguuggucucgcaaaaugcugaugacgggcacccucgccgucuuuuuccuacugaucauggggcagcuuacguggaacgaccugaucaggcugugcaucauggucggcgcgaaugccucagacagaauggggauggguaccacguaucucgcccugauggccacauucaaaaugagaccgauguucgcagugggccucuuauuccggcgccugacaagccgggaggugcuguugcugaccaucggguugucccucgucgcuuccguggagcuccccaacucccuggaggaauuaggcgacgggcuggccaugggcaucaugaucuugaagcuccugaccgauuuucaaagccaccagcucugggccacccugcugucccuaacguucauuaaaaccaccuucagucuccacuacgccuggaagacuauggcaauggugcuguccauagugucguuauucccgcuuugccuguccacgaccagccagaaaaccacuuggcugccagugcuccugggcucgcuuggguguaagccucucacgauguuccugauagcagagaacaagauuuggggccgcaagagcuggccacugaacgaagggaucauggcggucggcaucgugucgauccuucuguccucccugcucaagaaugacguuccucuggccgggccccuuaucgccggcgggaugcucaucgccugcuacgucaucuccgggagcucccccgaccugucccuggagaaggccgccgagguguccugggaggaggaggccgagcacagcggcgcaucucacaacauccucguggagguacaggaugacgggaccaugaagauuaaggacgaggagcgggaugauacccugacaauccugcucaaagcuacccugcuggccguaucugggguuuacccccugucuauacccgccacguuauucgucugguacuucuggcagaagaagaagcagcgcagcgggguuuuaugggacacgccgagcccacccgagguggaacgggccguccucgacgacggcaucuaccgaaucaugcagcggggccugcuggggcgcagccaggugggcgugggagucuuccaggagaacguguuccacacuauguggcacgugacgcggggcgccguccugauguaccagggaaagcgccucgagcccuccugggcaagcgugaagaaagaccugaucuccuacggcgggggguggcgucuccagggcagcuggaauaccggggaggaggugcaagucaucgccguggagcccggcaagaacccgaagaacgugcagacagcacccgggacauucaagaccuccgagggcgaggucggcgccaucgcccucgacuucaaacccgguacgagcggaagucccaucgugaaccgcgaggggaagauagugggguuauacggcaacggagucgugaccaccaguggcacauacgugagcgcgaucgcgcaggccaaggccucccaggaggggccucugcccgagaucgaggacgagguguuucggaagcgcaaccucacgaucauggaucugcacccaggcagcggaaaaacacggcgcuauuuaccggcgaucgugcgggaggccauuaagaggaaacugcggaccuugauccuggcccccacucgcguggucgcuuccgagauggccgaagcgcuuaaaggcaugcccauccgcuaucagacgaccgccgugaaaagcgagcacaccgguaaggaaaucguggaccuaaugugucacgccaccuucacgaugagacugcucucucccguccgcguaccuaacuacaacaugaucauaauggacgaggcccacuucaccgacccuaguuccaucgccgcgcggggguacaucagcacccgggugggaaugggggaggccgccgccaucuucaugaccgccacgccgcccggcuccguggaggcguucccgcagagcaacgccgugauccaggaugaggaacgggacauccccgaacgcuccuggaauuccggauacgaguggauaacugacuuccccgggaagaccgugugguucguccccuccaucaagucaggcaacgacaucgccaacugccugcggaagaacggaaagcgcgugauacaguuaucccggaagacauuugacacggaauaucaaaagaccaagaacaacgauugggacuacguagucaccaccgacaucagcgagaugggcgccaacuuccgggcggaccgggugauugacccgcgccggugcuugaagcccguuauccuuaaggacgggccugagagggucauccuggccgggcccaugccggugacggucgcguccgccgcacaacggcgcggccggaucggccgcaaccacaacaaggagggggaccaguacaucuacauggggcagccucucaacaacgacgaggaccacgcgcacuggacagaggcaaaaaugcugcuagacaacaucaacacgcccgagggcaucaucccagccuuguucgagccugaacgggagaagagcgccgccaucgacggcgaguaccgccuacgcggggaggcgcggaagaccuucguugagcugaugcgccggggggaccucccuguguggcuuagcuacaagguggcuagcgagggcuuccaauacuccgaccgacgguggugcuucgacggcgagcggaacaaucaggugcuggaggagaacauggaugucgagaucuggacaaaggaaggugagcggaagaagcuccgaccccgaugguuagacgcccgcacauacucugauccccuugcccuccgggaguucaaagaguucgccgcgggccgucguuccguguccggggaccuaauccuggaaaucggcaagcucccgcagcaccugacccaaaaggcucagaacgcccuagacaaccucgugaugcugcacaauagcgagcagggggggcgcgccuaccggcacgcgauggaagagcuccccgacaccaucgagacgcucaugcuauuagcccucauugcugugcugaccggaggugucacacuuuucuuccucuccggacgcgggcugggcaagaccuccauaggcuuacucugugucauggccucgagcgugcuucuguggauggccuccgucgagccgcacuggauagcggccagcaucauccucgaguucuuccugauggugcugcucauacccgagccggaccggcaacgcacgccccaggacaaccagcuagcauacguggucaucggccucuuguucaugauccugacgguggccgccaacgagauggggcugcucgagaccaccaaaaaggacuuagguauaggccacguggcagucgagaaucaccaccacgccgcaauguuagauguggaccuccaucccgccucugcuuggacccuguaugcgguggccaccacaauaauaaccccgaugaugcgccacaccaucgagaacacgaccgccaacauaagcuuaacagccauagcuaaccaagccgccauacucaugggacuggacaaaggcuggcccaucuccaagauggacaucggcgucccccugcuugcucuaggguguuacagccaagugaauccccugacccugacggccgcagugcuaaugcugguagcacacuaugcaauuaucgggccggguuuacaggccaaagccacucgcgaggcgcagaaacggaccgccgccgguaucaugaagaacccgaccguagacgggaucguagccaucgaccuagaccccgucguguacgacgcuaaguucgagaagcagcugggccagaucaugcuccugauccugugcacaucccagauacuccugaugcguacaaccugggcgcugugcgagagcauaacgcucgccacgggaccgcuuaccacucugugggaggggucaccggggaaguucuggaacaccacgaucgccgugagcauggcgaacaucuucagggggagcuaccucgccggcgcgggacuggcguucuccuuaaugaaaucuuuggggggcgggcggcgcggcaccggagcccagggcgagacccuuggggagaaguggaagcggcagcugaaccagcucucaaaguccgaguucaauaccuacaagcgcuccgggauaauggaagucgaccguagugaggccaaggaaggcuuaaagcgcggggaaacuaccaaacacgcugugucccgggguacagcgaaguuacgcugguucgucgagcggaaucucgucaagcccgaggggaaggugaucgaucugggcuguggacgggggggcuggaguuacuauugugcgggguuaaagaaggugaccgaggucaagggauacacuaagggcgggcccggccacgaggagcccaucccgauggccaccuacggauggaaccuggugaaacuacacuccggaaaagacgucuucuucaucccacccgaaaaaugcgacacccuacucugcgacaucggggagagcucgccgaacccgaccaucgaggagggccggacgcuacgcguccugaagaugguagagcccuggcuacgugguaaccaguucugcauaaagauucucaaccccuauaugcccagcgucgucgaaacccucgaacagaugcagcgcaagcacggcggcaugcuggugcgaaauccgcuuucgaggaacagcacccacgaaauguacugggugaguugugggaccgguaauaucguaagcgccgugaacaugaccagccggaugcugcugaaccguuuuacgauggcccacagaaaaccuaccuaugagcgcgauguggaucucggggccgggacucggcacgucgcaguagaaccggagguggcaaaccuggacaucaucggccaacggaucgagaacaucaagcacgagcacaaaaguacuuggcacuacgacgaggacaaucccuacaagacgugggccuaccauggguccuacgaggucaagccgucuggcagcgcguccagcaugguuaaugggguugugaaguuacucaccaagcccugggacgugauccccauggucacacagaucgccaugacugacacgaccccguucggccaacaacgcguguucaaggagaagguggauacgcggacaccaaaggccaagagggguacggcucaaaucauggaagucaccgccaaguggcuuuggggcuuucugucccguaacaagaagccccgcaucugcacccgggaagaguuuacccgcaaggugagaagcaacgcggccaucggagccguguucgucgacgagaaccaauggaacuccgccaaggaggcgguugaggacgagcgcuucugggaccuaguucaccgagagagagaacuacacaaacaggggaagugcgccacgugcguauauaacaugaugggcaaacgggagaagaagcugggggaguucggcaaggccaaggguagucgcgcaaucugguacauguggcugggcgcccguuuccucgaguucgaggcgcucggguucaugaacgaagaccauugguuuucccgggaaaacucucuuuccgggguagagggcgaggggcuccacaagcugggauacauccuccgcgacaucagcaaaaucccagggggcaacauguacgccgacgacaccgcaggaugggacacucgcaucaccgaggacgaccugcagaaugaggccaagaucacggacauuauggagccggagcaugcccugcucgcuaaguccauauucaagcugacguaccaaaauaaagugguccggguccagcgcccugccaagaacgggaccgugauggacguaaucagccggcgcgaccagcgcggcagcggccaagugggcaccuacggucugaacacguucaccaauauggaggcccagcucauccggcagauggagagcgaggggaucuucucccccagcgagcuggagacccccaaccuggccgggcgcgugcucgacuggcuagagaagcacggggucgagagguuaaagcgcauggccaucuccggcgaugacugcguggugaagccgaucgaugauagauucgcuaccgcgcucacggcccugaaugacauggguaagguccgcaaggacaucccccagugggagccgucgaagggcuggaaugacuggcagcagguucccuucugcagccaccacuuccaucaauugaucaugaaggacggcagagagaucgucgucccgugccgcaaccaagacgagcucguggggcgggcccgagugucacagggcgccggauggagccugagagagaccgccugccuggggaagagcuacgcccagauguggcagcucauguacuuccaccggcgugaccugcgccuggcugccaaugcgaucugcagcgccguccccguggacugggugcccacaucccgcaccacguggucuauccacgcccaccaccaguggaugaccacagaggacaugcugagcguauggaaucgcguguggaucgaagagaaccccuggauggaggacaagacccacaucagcaacuggggcgacgugccguaccugggaaagcgggaggaccaguggugcggcagccugaucgggcucacugcccgggccaccugggcuaccaacauacaagucgcgauuaaccaagugcggcgccugaucggcaacgaaaacuaccuggacuacaugacaagcaugaagcgcuucaagaaugaguccgaccccgagggcgccuugugguga

SEQ ID NO: 24439 - RNA, 9879 nt, Artificial Sequence
  derived and/or modified CDS sequence (opt11) from DENV-1__KF955446__SS-prME
agcguaacgauguucuuaaugcuaaugccaacugcccuagccuuccaccuaacuacccguggaggugaaccucauaugaucguaucaaaacaagaaaggggaaaauccuuguuauuuaaaacaagcgcuggcgugaacaugugcacucucaucgccauggaccucggugaacuuugcgaagauaccaugacauauaaaugcccuagaauaacggaaacagaaccggacgacguagauugcuggugcaaugccacggauacuuggguuaccuauggcaccuguucucaaaccggcgaacacaggagagacaaaagguccgucgcacuagcaccacauguaggacucggacuagaaacgagaacagaaacguggaugucaagcgaaggagccuggaaacagauucaacgaguagaaaccugggccuuacgccaccccggguucaccgucauagcguuguuucucgcacaugcgaucggcacuuccauaacacaaaaagggaucaucuucauacuacucaugcuaguaacuccaucuauggcaaugcgcugcguagggauaggaagucgcgauuucguggaaggguuguccggagccaccuggguugacgugguccucgagcacgggucaugcguuacgaccauggccaaagacaaaccgacgcuggacaucgaacugcugaaaaccgagguuacuaaccccgcuguacuaagaaaacucugcauagaagccaaaauaagcaacacuaccacagauucgcguuguccaacccaaggggaggcgacauuaguggaagaacaagacgcaaacuucguaugccgccgaacguucguagaccgcggguggggaaacggcuguggucucuuuggcaaaggaagccuaauaacuugcgccaaauucaagugugucacuaaacuugaggguaagaucguccaauacgaaaaccuaaaguacaguguaauagugacaguccacacaggagaccaacaucagguugggaaugaaaguacagaacaugggacgacggccacuauuacuccgcaggcaccgacgacggaaauacaauugaccgacuacggagcgcuaacuuuggacugcagcccgcggaccggacucgauuuuaacgagaugguccugcugaccaugaaagaaaagucguggcucguacacaaacaaugguuucuggaccuuccccuacccuggacaagcggcgcauccacgucucaagaaaccuggaacagacaagaucuccuagucacuuucaagacugcccacgccaagaagcaagaaguuguagugcucggaucccaggagggggcaaugcacacagcgcuaacgggcgcuacagagauccagacgucagggacaacaacaauauucgccggccaucugaaaugccgccugaagauggacaaguuaacccuaaaaggaaugagcuaugucaugugcacgggcaguuucaaacuggaaaaggaacuugccgagacccaacacgggacggugcucgugcagauuaaauaugagggaaccgacgccccaugcaaaauaccauucagcacgcaggacgaaaaaggugucacacaaaacggacggcucauuacagcaaacccaaucgugaccgauaaagagaagcccgucaacauagaagcggaaccuccuuucggugaguccuacauagucaucggcgcgggggaaaaagcgcucaaacuaagcugguucaagaaaggcagcagcaucggcaaaauguucgaagcgacagcccgaggugcccggaggauggcuauauuaggagauaccgcuugggacuuugggucgaucggaggagucuucacaucagucgggaaacucguccaccaaauauucggcacagccuacggcgucuuguucucgggcgucuccuggacaaugaaaauuggcaucggaguacucuuaaccuggcucggcuuaaacucgagaagcacaaguuugagcaugacaugcauagcagucggacucgucacucucuaucuuggaguaaugguccaggccgacagugguugcguaauaaacuggaaaggacgcgaacucaaaugcggaucgggaaucuucgucacaaacgaaguucauaccuggacagaacaauauaaguuccaggcagacagcccaaagaggcuaucagccgcgaucggaaaagcaugggaagaaggcguaugcggcauucgcuccgccacacgacuugaaaacauaauguggaaacaaaucucaaaugagcuaaaccacaucuugcuggaaaacgauaugaaguuuacaguaguagugggcgacgucgccgggauacucgcccaagggaagaaaaugauacgcccgcaaccaauggaauacaaauacaguuggaagucaugggggaaagcaaaaaucaucggcgcggauguucaaaacaccaccuucauuaucgacggaccuaauacccccgagugucccgacgaucagagagcauggaacaucugggagguagaggacuacggguuuggcauuuuuacaacaaacauauggcuaaagcucagggauucguacacccaagucugugaccaucgccucaugucggcggccaucaaagacucaaaagcaguacacgcagacaugggauacuggaucgaauccgagaaaaacgagacauggaagcuggcacgcgcuuccuuuaucgagguaaaaaccugcauuuggccgaaaagccauacgcuauggaguaaugggguccuugaaagugagaugaucauacccaaaaucuacggaggcccaauuagccagcacaauuaccgacccgguuacuucacucaaacagcaggaccauggcaucucgggaaacucgaauuggauuucgaucugugcgaagguaccacuguaguagucgacgaacacuguggcaacagagggccgucccucagaacaacgacggugacggggaaaaucauccacgaauggugcugcagaucgugcacgcuacccccguugcgauuccgaggggaagacggcugcugguauggaauggaaauccgucccgucaaggaaaaagaagaaaaccuggugaaaucaaugguuagcgcaggaucaggagagguagacaguuucucacucggacuacugugcauaagcauaaugaucgaggagguuaugcgcagccgauggagccgcaaaaugcucaugacgggcacacucgcaguuuucuuccuacucauuaugggucaacugaccuggaacgaccucauucgcuugugcauaaugguaggagcgaacgccucggaucgaaugggcaugggcacgaccuaccucgcgcugauggccacauucaagaugagaccgauguuugccguagggcuacuguuuagacgucuaacuucgcgagagguccuauugcuaacaauaggccuuucucuuguagcuagcguggaacugccaaauucacuagaagaacuaggagacggucuagccaugggaauuaugaucuugaaacugcuaaccgacuuucagagccaucagcuaugggcgacccucuugagucugacguucauaaagaccaccuuuucacuccacuaugcuuggaaaacgauggcaaugguucucucgaucgugagcuuauuuccccuuugucugaguacaacaucgcagaaaacgacuuggcucccuguucugcucggcagccuaggaugcaagccccucaccauguucuuaauagccgagaauaagaucuggggaagacggaguuggccgcugaacgaagggauuauggcggucggaaucguaaguauucuacugucgucccugcugaaaaacgacgucccucuagcaggaccguugaucgcaggaggaaugcuaauagcgugcuacgugaucaguggcagcagugcggaucuaagccucgagaaggcagcagaggucucaugggaagaagaagcggaacacucaggugcaagccauaauauccuagucgagguccaagaugacgggacgaugaaaauaaaggacgaggaacgagaugacacacuaaccauacuucucaaggcgacccucuuagcaguaagcgggguguacccgcucucaauaccagcgacacuauucgugugguacuucuggcaaaagaagaaacagcggucuggggugcucugggacaccccgagcccaccggagguagaacgagcgguacuggaugacggcauauaccgaauuaugcagagggggcucuugggaaggagucaaguaggagucgggguauuccaagagaauguuuuccacacaauguggcacgugacacgaggagcaguacuaauguaccaggggaaacgccuagagccaucgugggcaagcgucaagaaagaccucauaucguaugggggcggcuggcgacuccagggaucuuggaacacaggcgaagaaguucaggucaucgcaguggaaccaggcaaaaaucccaagaauguacaaacggcgccaggcacauucaaaacgccagagggcgaagucggggccauagcccucgacuucaaaccggguaccuccggcagcccaauagugaaccgugagggaaaaauugucgggcucuacgguaacgggguaguuaccaccucuggcacauacgucucagcuaucgcgcaggccagggccagccaagaagguccucuacccgaaauugaagcggagguuuuucgaaaacgcaaccuuaccauuauggaccuacacccuggcucgggaaaaacacgccgguaucuaccagccauagucagggaagcgaucaaaagaaagcuacgaacccuaauccuggcccccacccgcgucggggccagugagauggcagaggcccucaaaggaaugccuauccgauaucagacaacugcuguaaagucggaacacaccggcaaagaaauaguugaccugaugggacacgcaacauucacaaugggucuauuagcuccugggagggugccaaauuacaacauggugauuauggaugaggcacacuucacagauccaucucgaauagcagcucgaggguacauuuccacccgagugggcaugggagaagcugccgccaucuuuaugacagcuacgccuccagggucggucgaagcauucccacaauccaacgccgugauucaggaugaagaaagggacaucccagaaagaucguggaacucaggcuacgaguggauuaccgacuucccggggaaaacgguuugguucgugccaagcauaaaaucaggaaacgacauugcgaacugccuccgcaaaaaugguaagagaguaauccagcuaucccgaaaaacguucgacaccgaguaccagaaaaccaaaaauaacgacugggacuacguagucacaaccgacauaucagagaugggcgcuaacuuucgggcggaccgggucauagauccaagaaggugccuaaacccaguaauccucaaggacgguccggaaagaguuauccuugccggcccuaugcccguaacaguggccagcgcugcacaacgccgcggcagaaucgggagaaaccacaacaaggaaggcgaucaguacaucuacaugggacaaccccugaauaacgacgaggaccaugccccauggacggaagcaaagaugcugcuugacaacauaaacacacccgaagguaucauuccugcccucuuugaaccagagcgcgagaagucagcggcuaucgacggugagucacggcuacgaggggaagcccgaaaaaccuucgucgagcuaaugcgaaggggagacuugccgguauggcugagcuacaaaguggccuccgagggcuuccaauacuccgaccgacgaugguguuucgacggggaacguacgaaucagguacuagaagaaaacauggcgguagaaaucuggccaaaagaaggagagaggaagaaauugcgaccgcgaugccuugaugcaaggaccuauagugacccuuuagcgcugagggaauuuaaggaguucccaccaggccgaaggagugucucaggagaccucauacuugagauaggcaagcuaccgcacccacuuacgcagcgaccgcaaaacgccuuagccacccucgucaugagccacaccagcgaacaggguggacgagcguacagacaugcaauggaggagcucccggccacaauagaaacccuaaugcuacuagcgcuuaucgccguccucacaggaggagucacgcuauuuuuccucuccgggagaggacuaggcaagacaaguauaggcuugcugugcguaauggccucuagugugcuacuguggauggccagcgucgaaccccacuggaucgcggcguccaucauccuggaguucuucuugaugguacuauugauucccgaaccagacuccaacgcuacacggcaagacaaccagcuggccuacguaguuaucgggcuacuuuucaugauccucaccgucgccgccaacgaaaugggccuacuagagacgaccaagaaagaccuugggaucggccacguggcugucgagaaccaccaucacgccgcuaugcuggacguagaccuucaccccgccagcgccuggacccucuaugcaguagccacgacaaucauuacaccgaugaugcgacauaccaucgaaaacacaacggccaacauaagccucaccgcaaucgcgaaccaggcagccauauuaauggggcucgccaagggauggccaaucagcaagauggacauaggcgucccacuccucgcauugggaugcuauagccagguaaacccccucacguuaacggcucccgucuugaugcuagucccacauuauccaauaauaggaccgggccuccaagccaaggccaccagagaggcucagaaaagaaccgcugcaggaaucaugaagaacccaacagucgacggcauuguagcaaucgaccucgacccuguagucuacgaugccaaguuugaaaagcaauuaggccaaauaaugcuucuuauccuaugcaccagccaaauacuacuuaugagaacaacgugggcacucugcgaguccauaacgcuugccaccggcccauuaacgacucuuugggaggggaguccugggaaauucuggaacacgaccauagcaguauccauggcgaacauauuccguggaagcuaccuagcuggugccggauuagcauucucacuaaugaaaucguuaggcggaggacgccgcgguacaggggcacaaggcgaaacacucggggaaaaguggaagcgccagcucaaccagcuaacuaaguccgaguucaacacguacaaacguuccgggaucauggaaguagaucggagcgaagcuaaagaagggcugaagcguggcgaaacgacaaagcaucccgugagccguggcacggcgaaacuccgcugguucguagagagaacacucguaaagcccgaggggaagguaauagaucuuggcugcgggcgggguggguggucguauuauugcgcagguuugaagaaagucaccgaggugaagggcuacaccaaaggaggacccggucaugaagacccaauaccaaugggaaccuacggcuggaaccuuguaaaacugaggucaggcaaagacguauucuuuaucccgcccgaaaaaugcgacacgcuccuuugugacaucggcgaaagcucgccuaacccgacuauagaggagggccgaacccugcgcguacuuaaaauggucgaaccaugguuacguggcaaucaauucugcauuaaaauacuaaacccguacauggcaucaguugucgaaacauuagaacagaugcaacgaaagcacgggggaaugcugguccgcaacccucuaucucggaacuccacccaugaaauguacuggguaucaugggguaccggaaacauaguaagcgccgucaacaugacaagccgaaugcugcugaaccgguucaccauggcccacagaaaaccaacuuaugaacgcgacgucgaccuuggcgcgggaacacgucauguagcugucgaaccagagguugcgaaucuggauaucauagggcaacggauagaaaacauaaaacaugaacacaaaucuacauggcauuacgacgaagacaauccuuacaaaaccugggccuaccauggcagcuacgagggcaaacccagcggaagcgcgaguucgaugguaaacggaggcgucaaacugcuaacgaaaccaugggacgggauaccaaugguaacgcaaaucgccaugacagacacgacuccuuucggucaacaacggguuuucaaggaaaaagucgacacucggaccccaaaggcaaagcgaggcacugcacagaucauggagguaaccgcuaaguggcuguggggguuccuaagucgcaacaagaaaccacgaauaugcacacgggaggaguuuacaaggaagguccgcagcaacgccgcaauaggggcuguuuucguggacgagaaccaauggaacagcgcgaaagaagcggucgaggacgagcgauucugggaccuuguacaccgcgagagagaacugcauaaacaggggaagugcgcuacaugcguauacaauaugaugggcaaaagggagaagaaacucggcgaguuugggaaggcaaaagggagcagggcaaucugguacauguggcuaggcgccagauuccucgaguucgaagcccuaggguuuaugaaugaagaccacugguucucucgggaaaacucauugucgggggucgagggcgagggccuccacaaacucgguuacauacugagggacaucagcaaaauaccagggggcaauauguacgcagacgacacagcgggcugggacacgaggaucacagaggacgaucuacagaaugaagcaaggauaacggacauaauggaaccugaacaugcacugcuugccaaaucgauuuucaaacuaacauaccagaacaaaguagucagagugcaacggcccgcgaaaaacggcacagucauggaugugauauccagacgcgaucaaagaggcuccggucaaguggggacauacggacuaaacaccuucacgaacauggaagcucagcuuauccgucaaauggaaagcggggguaucuucaguccgcgggaacuagaaaccccuaaccuagcagaaagaguccuugauuggguggaaaaauauggcguugaacgcuuagagaggauggccauuaguggggacgauugucuuggagagccaauuuacgacagauucgcaaccgcccucacggcucuuaacgacauggguaaagugcgcaaggacauaccacagugggaaccgucgaaaggguggaaugacuggcagcagggaccguuuugcucacaccauuuccaccaacuuauaaugaaagacgggagagagaucgucgugccuugcagaaaccaagaugagcuaguuggacgcgcacgagucucccaaggagccggauggagccuccgagaaacggcaugccuaggaaagucauaugcacaaauguggcaacugauggacuuccaccggagggacuuacgacuugccgcgaaugccauauggucggcaggaccgggcgacuggauuccaacucggcggacaaccuggagcauacacgcgcaccaccaguggaugaccacggaggacaugcugucaguauggaacagaguauggauagaagaaaacccauggauggaagacaagacgcacauauccucauggggcgaugugccguaucuggggaagcgagaagaucaauggugcggcucccugaucggacuuacagcccgggcaacuugggcgacgaacauccagguagcgaucaaccaaguaagacgccugaucgggaacgagaacuaccucgauuacauggcuagcaugaaacgcuucaagaaugaguccgaucccgagggcgcccucugguaa

SEQ ID NO: 24440 - RNA, 9879 nt, Artificial Sequence
  derived and/or modified CDS sequence (opt11) from DENV-1__KF921942__SS-prME
uccgugaccaugcuccucaugcuaaugcccacggcgcuggcguuucacuuaaccacacgcggcggggaaccccacaugaucguuucaaagcaagagcgugggaagucccuacuguucaagacaucagcaggugugaauaugugcacccugaucgcuauggaccuaggcgaguugugcgaggacacaaugaccuacaagugcccucggaucaccgagaccgagccugacgacguggacuguuggugcaacgccacagauaccuggguaaccuacgggaccugcucacagacgggcgaacaucggcgggacaagcgguccgucgcgcucgcgccccaugugggccugggguuagagacucggaccgagaccuggaugagcagcgagggcgcuuggaagcagauacagcgggucgagaccugggcccuccggcaucccggguucaccgugaucgcccuguucuuggcacacgcaauuggcaccagcaucacccagaagggaaucaucuucauccuccugauguugguaacucccuccauggccaugcgguguguagggaucggcucucgcgauuucguagaggggcuauccggcgccaccuggguagacguugugcucgagcacgggucuugcgugacuaccauggccaaggauaagcccacauuagacaucgagcucuuaaagaccgaggucgccaaccccgcgguccuucgaaagcucuguauagaagcgaagaucuccaauaccacgacagauagccgaugcccgacccagggcgaggccacacuggucgaggagcaggacgccaauuucgucugccggcgcaccuucguggaccggggcugggguaaugggugcggguuguuuggcaaggguucacucaucacgugcgccaaguucaaaugcguuaccaaacuggaggggaaaauuguccaguacgagaacuuaaaguauagcgugaucgugacuguccacacgggagaucagcaccagguggggaacgagucuacggagcacgguaccaccgcgaccaucaccccccaggcaccgacuacggagauacagcugaccgacuacggggccuugacgcuggauugcagcccccgcacuggccucgacuucaacgagaugguacuucuuaccaugaaggaaaaguccuggcucguacauaaacagugguuccuggaccugccccugcccuggaccagcggagcgagcacgagccaagagaccuggaaccggcaagaccuacugguuaccuuuaagacugcgcaugcgaagaaacaggaagucguagugcuaggcucgcaggagggcgccaugcauacagcccugacgggggccaccgagauccagaccuccggcaccaccacgauauucgccggacaccugaaaugccgccuuaagauggauaagcucacccuaaagggcaugucguacgugaugugcaccggauccuuuaagcuggagaaggagcuggcagaaacacagcacggcaccgugcuggugcaaauaaaguacgaggguaccgacgcccccugcaagauuccuuucucuacccaggaugagaagggagucacgcagaauggccgguugaucaccgccaaccccaucgugaccgauaaggagaaaccagugaauauugaggccgagccgccuuucggggagagcuacaucguuaucggcgcaggcgaaaaggcccuaaaauuaaguugguuuaaaaagggguccagcaucggcaagauguucgaggccaccgcuagaggggcccggagaauggccauccuaggcgacacggccugggacuucgggaguauaggugguguuuucacgucggccgggaaacucguucaccaaaucuucggcaccgcauacgguguacuguucucuggcgugagcuggacuaugaaaaucgguaucggaguacuucucacguggcucggccuaaacagucgcagcaccucccucagcaugacaugcauagccgucgggcuggugacccuguacuuaggcgugaugguccaggcggacaguggaugugugaucaauuggaagggccgggagcugaagugugggaguggaaucuucguuacgaacgagguccacacauggacggagcaguauaaguuccaagcugacagcccgaagcgccuguccgccgccauaggcaaggccugggaggaaggagugugcggcauucgcagcgcgacccgucucgagaacaucauguggaagcagaucuccaacgagcugaaccacauccugcucgagaaugacaugaaguucaccguggucgugggggacguagccggcauccuggcccagggaaagaagaugauuagaccccaacccauggaguacaaauauucauggaaguccuggggcaaggccaagaucaucggagcggaugugcaaaacacaacguucaucaucgacggucccaacaccccggaaugccccgacgaucagcgcgccuggaacauuugggaaguugaagacuacggcuuugggaucuucacaaccaacauuuggcugaaguugcgggauucuuacacccaggugugcgaucacaggcugauguccgccgcgaucaaggauagcaaggccguccacgccgauaugggcuacuggaucgagagcgaaaaaaacgaaaccuggaagcucgcuagggccagcuucaucgaagugaagaccugcaucuggccuaagucccacacucucuggucgaacggggucuuagaguccgaaaugaucauccccaagauauacgggggcccgaucucacaacacaacuaccggccugguuacuucacccaaacggcaggacccuggcaccuggggaagcuugaguuggauuucgaucuuugcgaggggaccacugucgugguggacgagcacugugguaaccggggaccgagccuccgcaccaccaccguuacgggcaagaucauccacgagugguguugcagguccugcaccuuaccgccccugcgcuuccgaggugaggacgggugcugguacggaauggagauccgccccgugaaggagaaggaggagaaccucgugaaauccauggugagcgcuggcagcggcgagguggauuccuucagccugggguuauugugcaucuccaucaugaucgaggaagugaugcggagccgcuggucccggaagaugcuuaugaccgggacccuggcggucuucuuccuccucaucaugggacagcuaacuuggaacgaucuuauccgacugugcaucauggugggagccaacgccagcgacagaauggggauggggacaacauaccucgcccucauggcgaccuucaagaugcggcccauguucgcgguuggccugcuauuucgccggcucaccuccagggagguccugcugcuaacuauuggacuaagccugguggccuccguggagcucccaaacagcuuagaagagcuaggcgacgggcucgccaugggcaucaugauccucaaacugcucaccgauuuucagucccaccagcugugggcuacacugcucagucugacauucaucaaaacaacguucucccuacauuacgcguggaagaccauggccaugguccucagcauugugucccuguucccccugugccucagcacaaccucccaaaagaccaccuggcuuccaguacuacucggcucccuagggugcaaaccucugaccauguuccucauagcugagaacaagaucuggggucgacgcuccuggccacuaaacgagggcaucauggccgugggcaucgugucgauccugcucucuuccuugcugaagaacgaugucccccuagccgguccccugaucgccggcggcaugcugaucgcguguuacgugauuagcgggagcagcgcagaccucucccucgagaaggccgcggaaguuucgugggaggaggaagcagaacauuccggcgccagccacaauauccuggucgaggugcaagacgacggaacgaugaagaucaaagaugaggagcgggacgacacacucaccauccugcugaaggccacccuccucgccguuuccggcguauacccucugagcauccccgccacccucuucgugugguacuuuuggcagaagaaaaagcaacgcucagguguguuaugggacaccccuagcccgcccgaggucgagagggcuguuuuagacgacggcauauauaggauuaugcaacggggccugcucggccggucucagguggguguaggaguguuccaggagaacguguuccauaccauguggcaugucacccggggcgccgugcuuauguaccaagggaagcgauuagagcccagcugggccagcgugaaaaaggaccucaucagcuacggaggcggguggcggcuacagggcaguuggaauaccggagaggagguccaggugauagccguggagccaggcaaaaaucccaaaaacguccagaccgcaccugggaccuuuaagacccccgagggcgaagugggugcgaucgcauuagacuucaaacccggaacgucggguuccccuaucgugaaccgcgaggggaagauaguuggccucuaugggaauggagugguaaccaccagcggcaccuacgucagugccaucgcccaggcgaaagccucccaggaggggccgcuaccggagauugaggacgagguguuccgaaagcgcaaccugaccauaauggaucugcaccccggcucggggaagacucggcgcuaccugccggccauuguacgagaggccaucaagaggaaacugcgcacgcuaauucuggccccaacgcgagucgucgccuccgaaauggccgaagcacuaaagggaaugccaauacgcuaccaaacgaccgccguaaagagcgagcacaccggaaaagaaaucgucgaccucaugugccacgcuaccuucaccaugcggcuguugucuccugugcgugugccgaauuacaauaugaucaucauggacgaggcccauuuuacagaucccagcucgaucgcugcgcggggauacauuagcacccgcguaggcaugggggaggccgccgcgauuuucaugacugcuacgccccccgguucgguggaagccuucccccagagcaacgcggugauccaagacgaggagcgggauauacccgaacgcuccuggaacagcgguuacgaauggaucaccgacuucccgggcaagaccguuugguuugugcccuccauaaagagcgggaacgauaucgcuaacugcuuacggaagaacgggaaacgugugauccagcucucccggaagaccuucgacacggaguaccagaagacaaagaacaaugacugggauuauguagugaccacggacauaucagagaugggcgccaauuuucgcgcagaccgggugauugacccccggcggugucugaagcccgucauccuuaaggacgggcccgaacgcgucauacuagcggggccuaugccagugacuguugccuccgccgcgcaacggcgcgggcggaucggccgcaaccauaauaaggagggcgaucaguacaucuacaugggacagccucugaacaacgacgaggaucacgcccacuggaccgaggccaaaaugcuccuagacaauauaaacacgcccgaaggcaucauccccgcccucuucgaaccggaacgcgagaaauccgcagccaucgacggcgaguacaggcuacgcggcgaggcccggaagacguucgucgaacugaugcgccgcggugaucugccggucuggcucuccuacaagguggcaucggagggcuuucaguauagcgaccgccgguggugcuucgauggcgagcguaauaaccaggugcuggaagaaaacauggaugucgagauuuggacgaaggaaggugaacggaagaaacuucgcccccgauggcuggaugcccgcaccuacuccgaucccuuggcgcugcgggaguucaaagaguucgccgccggucgccggagcgugucuggggacuugauacuagaaauugguaaauuaccgcagcaccucacccagcgcgcccagaacgcacuggacaaccugguuaugcuccacaacagcgaacagggaggccgggccuacaggcacgccauggaggagcugcccgacacuauugagacgcugaugcuccuggcuuugauugcuguccucacuggggggguuacccuguucuuccuauccggccgcggauugggcaagaccagcaucggucugcugugcgugauggcauccagcguccuccuguggauggcuuccguggagccccacuggaucgccgccucgauaaucuuggaguucuuccucaugguacucuugauccccgagccggaucgccaacggacaccgcaggacaaccaguuagcauacgucguaaucggccuccuguucaugauccuaacgguggcagcaaaugagaugggacugcuagagaccaccaaaaaagaccucgggauaggucacgucgcggucgagaaccaccaucacgccgccauguuagacguggaccugcacccagccuccgccuggacccucuacgcaguagcuacgacuaucauuacgccaaugaugcgccacaccaucgagaauacuaccgcgaacauaucacugacugcgaucgccaaccaggccgcaaucuugaugggguuggacaagggcuggcccauuucuaagauggacauuggggugccgcugcuagcguuaggaugcuacucacaggugaauccccugacccucacggccgcaguacuuaugcuggucgcgcauuacgccaucauuggcccgggguugcaagccaaggcgaccagagaggcccagaaacgaacugcagcggguaucaugaagaacccaacgguggacggcauuguagcgaucgaccucgaccccgucguguacgacgccaaguucgagaagcagcuaggucagaucauguuacucauccugugcacgucgcagauuuuacuaaugcggacuaccugggcucugugcgagagcauaaccuuggccacugggccccucacuaccuuaugggagggguccccggguaaguuuuggaauaccacgauagcugucuccauggcgaacaucuuccgggggucauaccuggcgggcgccggcuuagcauucucucugaugaagucacucgggggcgggcgccgagguaccggcgcgcagggagaaacccucggugagaaguggaagcgccagcuaaaccagcugucuaagagcgaauucaacaccuauaagagguccgggaucauggagguugaccgcagcgaggccaaggagggcuugaaacgaggggagacgaccaagcaugccgugucccgcggcaccgccaagcuccggugguucgucgagcgcaaccugguaaagccggaaggaaaggugauagaccuggggugcggccgggguggguggagcuacuacugcgccggucucaagaaagugaccgaaguuaaggguuauacgaaagggggccccggccacgaggagccuaucccgauggcgaccuacggguggaaccuggugaagcugcacuccggcaaggaugucuucuucaucccgcccgagaaaugcgacacucuuuuaugcgacaucggcgagagcucucccaacccgaccauagaggagggucgcacgcugcggguacucaaaaugguugagcccuggcugcgcgggaaccaguucugcaucaagauacugaaccccuacaugcccagcgugguggaaacccucgaacagaugcagagaaagcaugguggcaugcuaguaagaaacccgcugagccggaacuccacccacgagauguacuggguguccugugggacaggcaacauagugagcgccgugaacaugacguccagaaugcuccucaacagauucacgauggcccaccgaaagcccacuuaugagcgugacguugaucucggggccggcaccagacacguggccguugaaccggaggucgcuaaccucgauaucauugggcaacgcaucgaaaacauuaagcacgagcauaaguccaccuggcacuaugaugaggacaacccauauaaaacgugggccuaucacgguuccuacgaggugaagccgagcggcuccgccagcucgaugguaaacggagucgugaaguuacugacaaagcccugggacgucaucccaauggugacccaaaucgccaugacggacacgacccccuucggccagcaacggguuuucaaggagaaagucgacacccgcaccccgaaggccaagcgggggacugcgcagauuauggagguaacggccaaguggcucuggggcuuccugucgcgcaauaagaagccucguaucugcacccgggaggaguucacucggaagguucgauccaacgccgcuaucggagcggucuucgucgacgagaaccaguggaacuccgccaaagaggccguagaggacgaacguuucugggaccucgugcacagggagagagaguuacacaagcaagggaaaugcgccacgugugucuauaauaugaugggaaaacgcgagaagaaguugggggaguuugggaaggccaagggcucacgcgcaauaugguacauguggcugggcgcccgcuuucucgaauucgaggcgcugggauucaugaacgaagaccacugguucucccgggaaaacucccuuuccggcguugagggugaggggcuccacaaguuggguuacaucuuacgcgacaucagcaagaucccagggggcaauauguacgcugaugauaccgccggcugggacacccggaucaccgaggacgaccuccagaaugaggcgcgcaucacagauaucauggaacccgaacacgcccugcuggccaaauccaucuucaagcugaccuaucagaacaaggucguacggguccagcggcccgcuaagaacgggaccgugauggacgugaucagccgccgggaccaacguggauccggucaggugggcacguacgggcugaacacguucaccaacauggaggcccaacugauccggcagauggagagcgaggguaucuucucucccagcgaguuggagacacccaaucuggcggagcguguacuggacuggcucgagaaguaugguguggagaggcugaagaggauggccaucaguggggacgacuguguggucaagccuaucgacgaccgguuugccaccgcccugacggcacugaacgacaugggcaaggugcgcaaggacaucccccagugggagcccucgaagggguggaacgacuggcagcaaguaccauucuguucccaccacuuucaccagcugaucaugaaggacggccgggagaucguagugccgugcagaaaccaggacgagcuggugggccgggcgagagucagccaaggugcaggcuggagcuugcgggagaccgccugccuggguaagucguacgcccaaauguggcagcuaauguacuuccaccgccgagaccuccgccuggcagccaacgccaucugcagcgccguucccguggacuggauccccacuucacggaccacaugguccauccacgcccaccaucaauggaugacgaccgaggacaugcucuccgucuggaaucggguguggaucgaggagaaucccuggauggaggacaagacccacaucaguaguuggggcgaugugcccuaccucgggaagcgcgaggaccaauggugcggaagucugaucggauuaaccgcgcgugccaccugggcuaccaacauccagguggccauaaaucagguuaggaggcuaauugggaacgaaaacuaccuugacuauaugacauccaugaagcgcuuuaagaacgagagcgauccagagggcgcccugugguga

SEQ ID NO: 24441 - RNA, 9879 nt, Artificial Sequence
  derived and/or modified CDS sequence (opt11) from DENV-1__JF937602__SS-prME
agcgucacaaugcugcucaugcugaugcccacggccuuggccuuccaccucacgacucgcggcggggagccccacaugaucguguccaagcaggagcggggcaagucucugcuguucaaaacuucagcuggcgugaacauguguacccucauugcuauggaccugggcgaguucugcgaagauaccaugaccuacaaaugcccucgcauaaccgaggccgagcccgacgacguggauugcuggugcaacgcuacugacacgugggucaccuacgggacguguucucagaccggcgaacaccggcgcgacaaaagguccguggcguuagccccacacgugggccucgggcuugaaacucgaaccgagacuuggaugagcuccgagggugcuuggaagcaaauccagcggguggagaccugggcacugagacaccccggguucacgguuaucgccuuauuccuggcucacgccaucgggacgucuaucacccaaaaggggaucaucuucauacugcucaugcuggugacccccucgauggcgaugcggugcgucgggauugguagccgcgacuucguugaggggcuguccggagccacuuggguggaugucguuuuagagcacgggagcugugugaccacgauggcaaaggauaaacccacccuggacaucgagcugcucaagaccgaagucaccaacccggcugugcugagaaaacugugcaucgaagccaaaaucagcaacacaacgacggacagccgcugcccgacccaaggcgaagccacacucguggaagaacaggaugcgaauuucgugugccgacgcacuuucguggacaggggcuggggcaacggcugcgggcuguucggcaaggguuccuugauuacuugcgcuaaauucaagugcgugacaaaauuagaaggcaagaucguccaguacgagaaccugaaguauagcguuaucgugacgguccacaccggcgaucagcaccagguggggaacgaguccacugaacacggaaccacagcuaccaucacgccccaggcccccaguacggagauccaacugaccgacuacggggcccucaccuuagacugcucuccccgcaccggccuggacuucaacgagauggucuugcugacgaugaaggagaaaaguuggcuggugcauaagcagugguuucucgaccugccgcugccuuggaccagcggagccaguacuagccaggagaccuggaaccgucaggaccugcuggugacguucaagaccgcccaugcaaagaaacaggaggucguagugcugggcagucaggaaggcgcuaugcacaccgcuuugaccggcgccacggaaauccagaccucaggcacgacaacgaucuucgcagggcacuugaagugcagacugaagauggacaagcucacccugaagggcaugucauaugucaugugcaccggguccuucaaguuggagaaggagguggcggagacgcagcacggcacgguccucguccaaauuaaguacgagggcaccgacgccccauguaagauccccuuccugacgcaagacgagaagggugugacacaaaacggccggcugaucacggcaaacccgaucguaaccgauaaggaaaagcccguaaacauugaggcugaaccgccuuucggggaguccuauaucguuaucggcgcgggcgaaaaggcccugaaacucagcugguucaagaaagggaguagcaucggcaagauguucgaggccaccgcccgcggggcccggcgcauggcgauccugggcgauaccgccugggacuucggguccaucggcggcguguucacguccgucgguaagcuggugcaccagaucuucggaaccgccuacggggugcuuuucaguggagucagcuggaccaugaagaucggaaucgguguccuguuaacauggcugggccugaacucccgcagcacuucccuuagcaugaccuguaucgcaguggggcucgucacccuuuaccugggcgugaugguccaagccgacucuggcugcgucaucaacuggaagggccgcgagcucaaguguggaagcggcaucuuuguaaccaacgagguacacacuuggaccgagcaguauaaguuccaagcggacagcccgaagcgccuguccgccgccaucgguaaggccugggaggaggggguuugugggauccggucggccacccgccuggagaauauaauguggaagcagauauccaaugaacuuaacuacauccugcuagaaaacgacaugaaguugaccgugguagucggggauguggccggcauucuggcccagggcaagaagaugauccgaccgcagcccauggaauauaaguacagcuggaagucaugggguaaggccaagauuauaggcgccgacgugcagaauaccacguucauaaucgacgggcccaacaccccggagugccccgacgaccaaagagcuuggaacaucugggaggucgaagacuacgguuucgguaucuucaccacaaacaucuggcugaaguugcgggacagcuacacccaagugugcgaccaucgccugaugucggccgcaauaaaggacagcaaagccgugcacgccgacaugggguauuggaucgaguccgagaagaacgagaccuggaagcuggcccgggccagcuucaucgagguaaagacguguauauggcccaaaucccacacccuauggucaaacggugugcuagaguccgagaugaucauacccaaaaucuacgggggcccgaucagccagcauaauuacagacccggguauuucacucagacggccggccccuggcaccuggggaaacucgagcuggacuucgaccugugcgagggcaccaccguugucguggacgaacacugcggcaaccgcggucccucccuccgcacaacgaccguuaccggcaagaucauacaugaauggugcugcaggucuuguacgcugccgccgcuacgcuucaagggggaggacggcugcugguacggaauggagauuagacccguaaaagagaaggaggagaaccucguuaagucaauggugucggccggcucaggcgagguggacagcuuuagucuggggcugcucugcaucaguaucaugaucgaggagguuaugaggucgcgguggucacgaaaaaugcuuaugacugguaccuuagcuguguucuuccuccugaucaugggccagcugacuuggaacgaccucauccggcuguguaucauggucggagcaaacgcaagcgaccgcauggggaugggcacgacguaccuggcgcucauggccaccuucaagaugagaccgauguucgccguaggccuacuauuucgcaggcucacaucccgcgagguacugcugcucacuauuggacuuaguuuagucgcguccgucgagcugcccaacagccuggaggaacugggcgacgggcucgccaugggcauaaugauauugaagcugcucacagacuuccaaucacaccagcugugggccacgcugcucagccugaccuucguucgcacaacuuuuucccugcacuaugccuggaagaccauggcgauggugcucagcaucgugagccuguucccccucugccucagcaccacgucucagaagaccaccuggcugcccguccugcucggcagccucgggugcaagccucugaccauguuccucaucgccgagaacaaaauauggggccggaagucuuggccccugaacgaggggaucauggccgugggcaucgucagcauucuccugaguucccugcugaagaacgacgugccccuugcagggccccuuauugcuggaggaauguugaucgcgugcuacgugauuucuggcuccucugcggaccucucccuggagaaagccgcgguggucagcugggaggaagaggccgagcacagcggugcgagccauaacauucugguggaggugcaggaugacgggacgaugaagauaaaggaugaggagagagacgacacacucaccauccugcugaaagccacccucuuggccgucuccggcguuuauccgcugagcaucccggcuacccucuucguuugguacuucuggcagaagaagaagcagcgguccgguguccugugggacacgcccagcccgccggagguggagagagcggugcuggaugacgggaucuaucggaucaugcagcgcgggcugcuagggcgcucccaggucgguguggggguuuuccaggagaacgucuuccacaccauguggcaugugacccgcggggcgguuuugauguaccagggaaagcggcuggagcccuccugggccuccgucaagaaggaccugauuagcuacgguggcggguggcgccugcaaggcucguggaacaccggcgaggaaguacaggugaucgccguggagcccgggaagaaucccaaaaacgugcagacagcccccgggaccuuuaagaccagcgagggcgaggugggugcuaucgcgcuggacuucaaaccaggcacguccggaaguccgaucgucaaccgagaggggaaaaucguuggccucuacggcaauggcguggucacgacguccggcaccuacguguccgccauagcacaagccaaggcgagccaggaaggaccccugccagagaucgaggacgagguguuccgaaaacggaacuugacuaucauggaccugcaucccggcucggggaagacgcgccgguaucugccggccaucguccgcgaggccaucaaacggaagcugcgcacacuuauacucgcaccuacccgcguuguggcuagcgagauggcagaggcgcuaaagggcaugcccauucgguaccagaccacagccgucaaguccgagcacacugguaaggaaaucguggaccucaugugccaugcuaccuucacgaugcgcuugcugagcccugugcgagucccuaacuacaacaugaucaucauggacgaggcccacuucaccgacccuucgagcauugcggcccgcggguacaucucaacccgagucgggaugggggaagcugccgcgaucuucaugaccgcgaccccgcccggcagcguagaggcauucccccagucgaacgccgucauccaggacgaggagcgcgacauaccggagcggucguggaacuccggguaugaauggaucacggauuucccuggcaagaccgugugguucgugcccagcauuaaguccgguaacgacaucgccaacugcuuacgcaagaaugggaagcgugugauucaacugagucguaagacuuucgacaccgaauaccagaagacuaaaaacaacgauugggacuauguggugaccacggacaucucggaaaugggcgcgaacuuucgggcagaccgaguuaucgacccgcggcgcugccuaaagccagugauccucaaggacggucccgagcgggugauccuggccggucccaugcccguuaccguggcuagcgcagcgcagcggcgggggcgcaucggucggaaucacaacaaggagggcgaucaguacaucuacauggggcagccgcucaauaacgacgaggaccacgcccacuggacggaggcgaagaugcuccuggacaacaucaacaccccggagggcaucauuccggcucuguucgagcccgagcgcgagaaguccgcggcgaucgacggggaauaccgacuccggggagaggcgcgcaaaacauucgucgagcuuaugcggcgcggggaccuuccgguuugguugagcuauaagguggccagcgaaggcuuccaguacagugacaggcgauggugcuucgacggcgagagaaacaaccagguccuagaggaaaacauggacguagaaauauggaccaaagaaggggaacgcaagaagcugcgucccagauggcuagacgcccggacguacagcgacccccuggcacugcgcgaguucaaagaguuugcggccggccggcgcaguguguccggagaccucauacuggagauuggcaagcugccgcagcaccucacccagcgagcccagaacgcucuggacaaccugguaaugcuccacaacuccgagcaaggagggcgcgccuaucggcacgccauggaagaacugccggauaccaucgagacccugaugcucuuggccuuaauagcagugcucaccggcggcgugaccuuauuuuuccugucaggccgcgggcucggaaagaccuccauaggacugcuguguguuauggcgagcucgguucuccuguggauggcaucgguagagccucacuggaucgcggccuccaucauccuggaguucuuccucaugguacuguuaauccccgagcccgaucggcagcgaaccccgcaggacaaccagcucgccuacguggugaucggccuacucuucaugaucuugacugucgccgcgaacgagauggggcuccuggagacgacaaagaaagaucucgggaucggccacguugccguggagaaccaccaccacgcugcuaugcuugacguagaccugcaccccgcgagcgcguggacccuuuacgcaguggccaccacgaucaucaccccgaugaugcgacauaccaucgagaauaccacagcuaacaucucccugaccgcuaucgcgaaccaagcugccauucugauggggcuagacaaaggauggccuaucucuaaaauggauaucggggucccguuacuggcauugggguguuauucccaagucaacccacugaccuuaaccgcggccgugcucaugcuuguagcccacuacgccaucaucgggcccgggcuucaggcuaaggcgacgagggaggcccagaagcguacagcggcaggcaucaugaaaaacccgacaguggacgggaucguggccaucgaccucgauccaguggucuacgacgcgaaguuugagaaacagcugggccagauuaugcuacucauccucuguacuagccagauccugcucaugcgcacuacaugggcccugugugaauccauaacccuagccaccggcccacucacgacccugugggaggggucgcccggcaaguucuggaacaccacaaucgcaguguccauggccaacaucuuccgcggcucguaccuugcgggcgccggauuagccuucagccuuaugaagucccuagggggcggucggagaggaacgggggcccagggcgagacccuuggcgagaaguggaaacggcagcugaaccagcugagcaagagugaguuuaacaccuacaagaggagcgggauuauggaaguggaccgguccgaggcgaaggagggucucaagagaggggaaaccacgaagcacgccguaagccgcggcaccgccaagcugcgcugguuuguggaacggaaccuggugaagccggagggaaagguaaucgaccuggguugcggucgcggagggugguccuauuacugcgccgggcucaaaaaggugaccgaggugaagggcuacacgaaaggagggcccggccacgaggagcccaucccaauggccacguacggguggaaccuggucaaacugcauagcggcaaggacguguucuucaucccgcccgaaaaaugugacacgcucuugugcgacaucggggaguccagccccaaccccaccaucgaggaaggccgaacccugagaguccucaagauggucgagccguggcugagagggaaucaguuuugcaucaagauuuugaaccccuacaugccgucagugguggagacgcucgagcaaaugcaaaggaagcacggaggcaugcugguccggaacccacugagcaggaacagcacccacgagauguacuggguaucuugcgggaccggcaauauuguaucggcuguaaacaugaccucgcggaugcuccugaaccgcuucaccauggcucaccgcaagccgacguaugaacgggauguggaccuuggggccggcacacgccacguugccgucgagccggagguggccaacuuggacauuaucggccaacggaucgagaacaucaaacacgagcauaaguccaccuggcacuacgacgaggacaaccccuacaagacgugggcauaccaugggucuuacgaaguaaagcccaguggcagcgcgagcuccauggugaacggggucguaaaauuacugacgaagccgugggacgugaucccuauggugacccaaauugccaugacugacaccacuccuuucggccagcagagaguguucaaggagaagguggacacccggacccccaaggcgaagcgugggacggcccaaaucauggaggugaccgcgaaauggcucuggggcuucuugagcagaaacaaaaagccgaggauauguacgcgugaggaguucacccgcaaggucagguccaacgccgccaucggcgccguauucguagacgagaaccaguggaacuccgcgaaggaagcagucgaggacgaacgcuucugggaucuagugcaccgggaacgcgaacuacacaagcaggguaagugugcaaccugcguguacaacaugaugggaaagagggagaaaaaguuaggggaguuuggcaaagcaaaggguucccgcgccauaugguacauguggcucggagcgcgguuccucgaauuugaggcgcugggcuuuaugaacgaggaccacugguuuagccgcgaaaauucccuuagcggggucgagggcgaggggcuccacaaguuaggguacauccuccgggacauaucuaagauaccaggggguaacauguacgccgacgacacggccggcugggacacucgcauuaccgaggaugaccuccagaacgaggcuaagauuaccgauaucauggagcccgagcacgcgcugcuggccaagaguaucuucaagcuaacguaccagaacaaagugguacggguccagagaccggccaagaaugggaccgugauggacgugauaucccggcgggaccagcgaggcagcgggcaggucgggaccuacggccuaaacacguucacgaacauggaggcccagcugauccgucagauggaguccgaggggaucuucucgcccucggagcucgagacccccaaccuggccgggcgcguacuagacuggcucgaaaagcaugguguugagcggcuuaagcgcauggcaauaagcggugacgauugugucgugaagcccaucgaugaucgguucgcaacugcacugaccgcccuuaacgacauggggaaggugcgcaaggauaucccgcagugggagcccaguaagggcuggaacgauuggcagcagguccccuucugcagccaucauuuccaccaacugauaaugaaggauggccgggagaucguggugcccugucgcaaccaggacgagcuagugggccgggcccgcgucagccagggcgcaggcuggucuuuacgggagacggcgugucucggcaagucauacgcccagauguggcaacuuauguacuuccaccgccgggaccuccgccuggcagcgaacgccaucugcuccgccgugcccguugacugggugcccaccucacggaccaccugguccauccacgcucaccaccaauggaugacgaccgaagacauguugagcguuuggaaccgggucuggaucgaggagaaccccuggauggaggacaagacccacaucuccagcuggggcgacgugccauacuuaggcaagcgagaggaccagugguguggcucccugaucgggcugaccgcccgcgcgacgugggcuaccaacauucagguggccaucaaccagguccgccggcuccugggaaacgagaauuaccuagacuauaugaccagcaugaagcgcuucaagaacgagucagauccggagggcgcguuaugguaa

SEQ ID NO: 24442 - RNA, 9879 nt, Artificial Sequence
  derived and/or modified CDS sequence (opt11) from DENV-1__GU131729__SS-prME
uccgucacuaugcuccuaaugcucaugccaacagcgcuagcguuccaucuaacuacucgugggggugaaccacacaugauaguauccaaacaagaaagaggaaagagcuuacuguuuaaaacgagcgcuggcgugaauaugugcacccuaauagcgauggacuugggcgaacucugcgaagauacgaugaccuacaagugucccagaauaacggaaaccgagccggacgacgucgauuguuggugcaaugcaaccgauaccugggucacguacggcacuugcagccaaacgggggaacacagacgcgauaagagauccguagcucucgcgccacacgucggucugggacucgaaacccggacagaaacauggaugagcuccgaaggagccuggaaacaaauccaacgcgucgagacgugggccuugcgccacccggguuucaccguuauugcguuauuucucgcacacgcgauaggaacaagcaucacccaaaagggaauaaucuuuauacugcucaugcuaguuacuccgagcauggcaaugagaugcguuggaauaggcucgagagacuucguugaaggccucagcggagcgacaugggucgacguggugcucgaacacgggagcugcgugaccaccauggcuaaggacaaaccgacacucgauauagaauuacuaaaaaccgaaguuacgaaucccgcgguguuagguaaauugugcaucgaagcaaaaauuagcaauacgacgacagacagccgaugccccacacaaggcgaagcgacccuaguggaggagcaagaugccaacuucgucugccggagaacguucguugaucgcggcuggggaaacggguguggccuuuuugggaaaggcaguuuaaucacaugcgccaaauucaaaugcgugacgaaacucgagggaaaaauaguucaauacgagaaccugaaauauagcgugaucgugacgguacacacuggagaccaacaccaagucgguaacgagagcacggagcacgggacuaccgccacuaucacgccccaagcacccacgacagaaauacaacucacugauuacggggcgcugacacuagauuguucccccaggacaggcuuggacuucaacgaaaugguacugcucacgaugaaagagaaauccuggcugguccacaaacaaugguuccucgaccugccccuaccuuggacuagcggagccagcacaucucaagaaaccuggaaccgacaagaucuuuuggugaccuucaaaacggcgcacgccaagaaacaagaagucgucguacuggguagccaagaaggggccaugcacacugcccugacaggagccaccgaaauacagacauccggaacaacgacuauuuucgccggccaccuaaaaugcagacugaaaauggacaaacugacacucaagggaaugucauacguaauguguacgggcuccuucaaacuggagaaagaacuagcggaaacccagcauggcacaguccucguacagaucaaauaugaagggacagacgccccuuguaaaauaccauucaguacacaggacgaaaaaggagugacgcaaaacgguaggcugaucacagccaacccgauagucaccgacaaggaaaagccggugaauauugaagcagaacccccauucggcgagaguuacauuguuauaggcgcaggagagaaggcgcuuaaacucagcugguucaagaagggcuccucuaucggcaaaauguucgaagccaccgcccgaggggccagacguauggcgauacucggagacaccgcaugggacuucggcagcauagggggcguauucacguccguagguaaacucguccaccaaauauuuggaacggccuacggcguccucuucuccggggucagcuggaccaugaaaaucgguauaggaguccucuuaaccuggcuagggcuaaauucgcgcuccacgagccucaguaugacgugcaucgccguagggcuagucacucucuaccugggcgucaugguucaagccgauucaggaugugugauaaacuggaaagggagagagcucaaaugcgggaguggaaucuucgugacgaacgaaguucacacuuggacagaacaauauaaauuucaggcugacucaccuaaacgacuaagugcagccaucggaaaggcgugggaagaagggguaugcggcauucgaucggcgacgaggcuagagaacaucauguggaaacaaauauccaaugaacuaaaccacauauuauuggagaaugacaugaaguucacggucguaguaggcgacguagcugguauucuagcgcaaggcaaaaagaugauacgcccgcaaccuauggaauacaaauauucauggaaaagcuggggaaaagccaaaaucauuggcgcagacguccaaaacacaacauucaucauagacggacccaacacacccgagugccccgacgaucaacgcgcauggaacaucugggaaguagaagacuauggauucggaauauuuacaacuaacauuugguuaaaacugcgcgacucauacacgcagguaugcgaccaccgccucaugagugccgccauuaaagacuccaaggccgugcacgcggacaugggguacuggauagagucagagaaaaacgagacguggaagcucgcacgagcaucauucauagaaguaaaaacaugcauauggcccaagucgcauacucuguggucuaacgggguccucgaguccgagaugauaauccccaaaaucuaugguggaccaaucucacaacacaacuaccgcccaggcuauuucacgcagacagcggggccuuggcaccucggcaagcuggaacuagacuuugaccuaugcgaagguacaacagugguaguagacgaacauuguggcaacagagggccaagucuccgaacuaccacuguaaccgggaaaauuauccacgaauggugcugcagaucauguacccugcccccguuacgguuccggggcgaagaugggugcugguacgggauggaaauacgacccguaaaagaaaaagaggagaaccuaguaaaauccauggugagcgccggguccggcgaagucgacucguucucucuaggacugcuuugcaucagcauaaugauagaggaaguaaugcgaaguagguggucaagaaagaugcugaugaccgguacucuggcugucuucuuccugcucaucaugggccaacuaaccuggaacgaucugauucgacucugcauaaugguuggcgcuaacgcaagcgaccggaugggcaugggaacaacauacuuggcccucauggcgacguuuaaaaugagaccaauguucgccguagguuuacuguuuaggaggcuaaccucgcgagagguccugcuacuaacgauaggacucagccuaguagcgagugucgaguugccuaauagccuugaagaacucggagacggacucgcaaugggcauaaugauacugaaacuauuaaccgacuuucagucgcaucaacugugggcaacacuacugagccucacguucaucaaaacaacauucagccugcacuacgccuggaaaacaauggcaaugauacucagcauugugucccuauuuccgcuaugucugaguaccacaucacagaagacuacauggcuuccggugcuacucggaagucuaggauguaaaccguuaaccauguuccuaaucgcagaaaacaaaauuuggggucggagguccuggccucugaacgaagguauaauggccgugggaauaguaagcauacuacugucaagccuccugaagaacgaugugcccuuagcugguccacuuauagcaggcgggaugcuaaucgcaugcuacguuauaucugggucuuccgccgaccucagccuggagaaggccgccgagguaagcugggaagaagaagcggagcacucaggggccagccacaauauacugguagaaguccaagacgacggaccaaugaaaaucaaagacgaggagcgagacgacacacuaacuauauugcucaaagccacccuacucgccgucucagggguauaucccuugagcauaccggcaacacucuucgugugguacuucuggcagaagaagaaacaacggagcggaguuuugugggacacaccgaguccaccggaggucgagcgagcaguccucgacgaugguaucuaccgaaucaugcaaagaggccugcuuggcaggagccaagugggcguaggaguguuucaagagaacguguuccacacgauguggcauguaacccggggcgccgugcuuauguaccaaggaaaacgucuugagccgucgugggcgagcguaaagaaagaccuaaucagcuacggaggaggguggaggcuccaagggagcuggaauaccggagaggagguacagguaauagcagucgaaccuggcaaaaacccgaagaacguccaaaccgcaccuggcacauuuaagaccccggaaggggagguaggcgcuauagcgcuagauuucaaacccggaacaagcggguccccgaucgugaaccgagaagggaaaaucguaggccuauacggaaacggugucgugacgacaaguggcaccuacgucagugccauagcacaagcgaaagcgagccaggaggguccccuacccgaaaucgaggacgaagucuuccgcaagcggaaccuuacaauaauggaccuccacccaggaucaggcaagaccagacgguaucugcccgcgaucgugcgcgaagcgaucaagcggaaacuccguaccuuaauacuggcgccgacacgcgucguugccagcgaaauggccgaagcgcuuaaaggaaugccgauacgguaccaaacaacagccgucaagagcgagcacacagggaaggagauagucgaccuaaugugucacgcgacauuuaccaugcgccuccuauccccuguuaggguuccaaauuacaacaugauaauaauggacgaggcccacuucacagacccauccuccaucgcggccagaggcuacaucucaacgaggguuggaaugggagaggccgccgccaucuuuaugacagcaaccccuccgggaagugucgaagccuucccucaguccaaugccgugauacaggacgaggaacgcgauaucccggagagaucauggaacucaggcuacgaguggauaacggacuuccccggcaagaccguaugguucguccccagcaucaaaucaggaaacgauauugcaaacugccuacgaaagaaugggaaaagagucauccagcugagccguaaaacauucgacacggaguaucagaagaccaagaacaacgauugggacuacgugguaaccacggacaucagcgagaugggugcaaacuuccgagcugcaagagucauagacccaagacgaugucugaaaccggucaucuuaaaggaugggccggaacgaguaauacucgccgguccaaugcccgugacuguagcgucggccgcacagcgcaggggccgaaucggacgaaaucacaauaaggagggcgaccaguacaucuauauggggcaaccauugaacaacgacgaggaucacgcccacuggaccgaggcgaaaaugcuauuagauaacaucaacacaccagaggggaucauccccgcacucuucgaaccagaaagagaaaagagcgcagccauagauggggaauauagacuaagaggggaagcuagaaaaacguucguagaacugaugaggcgaggggacuuaccggucuggcucucuuacaaaguggccucugagggauuucaguauagcgaccggcgcugguguuucgacggggaacggaauaaccagguccucgaagaaaauauggacguagaaaucuggacaaaagagggcgagcgaaagaaacuccgcccaaggugguuagacgcgcgaacauacagcgacccacucgcgcuaagggaguucaaagaguucgccgcaggaagacggagcguaucuggagaucuuauacuagagaucgggaagcuaccgcaacaccuaacucagagggcccaaaacgcacuagacaaucugguaaugcuucacaacucagagcaaggcgggagggcguaucggcaugcaauggaggaacuuccagauaccauagaaacacuuaugcuucucgcccuaauagccguguuaacgggaggggucaccuuguucuucuugucgggccggggacuuggcaagaccagcaucgggcuccucugcgugauggccucgagcguguugcucuggauggccagugucgaaccgcauuggaucgcugcuagcauaauacuagaguucuuccuuaugguacuccucauaccagagcccgaccgccaaaggacaccccaggauaaccaacuggcauacguagugauaggauuguuguuuaugauacugacaguugcggcuaaugaaaugggauugcuagaaacgacgaagaaggacuuaggaauaggccacguggccguagaaaaccaccaccacgcggccaugcuugacgucgaccuccacccugccuccgccuggacccucuacgcaguagcgaccaccauaauuacgcccaugaugaggcauacuauagagaacaccacagccaacauaagccuuacggcaaucgccaaccaagcagcuauauuaauggggcucgacaaaggcuggcccauaucaaagauggauauuggaguaccacuacucgcucucgguugcuacucccaaguuaacccgcugacgcuaacugcagcaguacucaugcuuguugcccacuacgccauaaucggaccgggacuccaagcaaaagcuacgcgggaagcucagaaaagaacugcggcugggauaaugaaaaacccaacaguggacgguaucguagcuaucgauuuagacccgguuguauacgacgcaaaauucgagaaacaauugggccagauuaugcuacuaauccugugcacaucgcaaauacuccugaugaggaccaccugggcguugugcgaauccaucacgcuagccaccggaccacugacaacacugugggaagguucgccaggaaaguucuggaauaccaccaucgcgguuagcauggcaaauaucuuuagaggaucuuaccuugccggggcaggacucgccuucucgcucaugaaaagccucgggggcggaagacggggaaccggggcacaaggggaaacguugggggagaaguggaaaaggcaacucaaucaacuaagcaagucagaguucaacaccuacaagaggagcgggauuauggaggucgaccggagcgaggccaaagaggggcuaaaacgaggugaaacgaccaagcacgcagucucgcgaggcacagccaaacuacgcugguucguugaaaggacgcuuguuaaacccgagggaaaagucauugacuuaggguguggcagaggugggugguccuacuauugcgcuggacuaaagaagguuaccgaaguaaagggauacacuaagggaggcccaggccacgaggagcccauccccauggcaacauacggauggaaccuugugaagcuacauuccggcaaggacgucuucuucaucccgccagagaaaugcgacacgcuacucugcgacauuggggaguccucgcccaauccaaccauagaggaaggcaggacgcuccgggugcuaaagaugguggagccguggcuccgaggcaaccaauucuguaucaagauauugaacccuuacaugccguccguaguagaaacacuggaacaaaugcagaggaagcacggcggaaugcucgucaggaauccacucucgcggaacucaacucacgaaauguauugggucucauguggaacggggaauaucgugagcgcaguaaacaugacaucucgaaugcugcugaauagguucacaauggcgcaccggaagccuacauacgaaagagacgucgaccucggggcaggcacucgccauguggcgguagaacccgagguggcaaacuuagacaucaucggccagcgcauagaaaauaucaaacacgaacacaaaagcaccuggcacuacgacgaagacaacccauacaagaccugggccuaccacggcucauacgagggcaaaccaucgggauccgccucaucaauggguaacgguguaguaaaacuacuaacaaaaccgugggauguaauaccaauggugacacagauagcgaugacggacacgacaccauuuggccaacaacgaguuuucaaggagaaaguagacacgaggacacccaaggcuaaacgaggaaccgcccaaaucauggaaguaacagcuaaguggcuaugggguuuccucucccggaauaagaaaccccggaucuguacacgagaagaauuuaccaggaagguccggagcaacgcagccauaggagcagucuucguagacgagaaccaauggaacuccgcaaaagaagcagucgaggacgaacgauucugggaccugguacaccgagaacgagaacuucacaagcaaggcaaaugcgcgacaugcguauauaauaugauggguaagcgcgagaagaaacuuggagaguucgggaaagccaaagggucgcgagcaaucugguacauguggcugggugcgcgcuuccuagaguucgaggcccuaggcuuuaugaacgaagaccauugguucucgagggaaaauagccugucgggcguagagggcgagggauugcacaaacuaggcuauauucuucgcgauauaucgaaaauccccggcgggaauauguacgccgacgacaccgccgguugggauaccaggauuacugaggacgaccuccaaaacgaggcacgaauaacagacauaauggaaccagaacacgcccugcuggcaaaaucgauuuucaaauugaccuaccagaacaaaguaguccggguacaacggcccgccaaaaaugggacgguuauggaugugaucucccggcgagaccagaggggcagcggucaggugggaacauacggccugaauaccuucacaaacauggaggcucaguuaauaagacaaauggaaucggaggguaucuuuucccccagcgaacuagaaacaccuaaccuggcggaacgaguacuugacuggcuggaaaaauauggcguagaacggcucaagcgcauggcgauuucaggugacgacugcgucguaaagccgauagacgaccgauucgcaacugcccucacggcacucaacgacauggguaaaguccgcaaagacauaccucagugggagcccagcaaaggcuggaacgacuggcaacaagugccguucugcagucaccacuuccaccaacuuauaaugaaagacggccgcgaaauugucgugccaugucggaaccaagaugaacucguagggagagcuagggucucgcaaggagcaggcuggucgcuucgcgaaacggcuugccuaggaaaauccuacgcccaaauguggcaacucauguacuuucacagacgcgacuuacgucuagccgcgaacgcaauuuguuccgcagugccaguugacuggaucccgacuucaagaaccacguggucaauacaugcacaucaccaauggaugacaaccgaagacaugcucagcgucuggaaccgcguuuggauugaggaaaacccauggauggaagacaagacgcauaucuccagcuggggagacguacccuauuuaggaaaacgggaagaucaguggugcggaucucugauaggucugacugcucgagccacaugggcuacaaacauccaaguggcgaucaaccaaguccgcaggcucaucggaaacgaaaacuaucuugacuauaugacaucaaugaagcgauuuaagaaugagucagauccagaaggcgcccucugguaa

SEQ ID NO: 24443 - RNA, 9879 nt, Artificial Sequence
  derived and/or modified CDS sequence (opt11) from DENV-1__GU131730__SS-prME
agcgugacgaugcugcucauguuaaugcccacugcccucgccuuccaucucaccacccggggaggggaaccccacaugauagugucgaagcaggagcgcggcaagagccugcuguucaaaaccagcgcgggagugaacauguguacccucaucgccauggaccuuggugaguucugcgaggacacgaugaccuacaaguguccccgaaucaccgaggccgaaccggaugacguggacuguuggugcaacgcuaccgacacgugggugacuuacggcacgugcagucaaacgggcgagcaccggcgggacaaacggucaguugcccuggcgccccacgugggccucgggcuggagacgcgcaccgagaccuggaugagcucggagggggccuggaagcagauccagcggguggagaccugggcccugcgucacccgggauuuacggucaucgcccucuuccuggcucacgccaucggcaccucgaucacacagaagggaaucaucuucauccugcucaugcuggugacgcccuccauggccaugcggugcgucggaauaggcagccgcgacuucguggagggcuugucuggcgcgacgugggucgacguugugcucgagcacgggucuugcgugaccaccauggccaaggacaagccuacucuggacaucgaacuguugaagacggagguuaccaaccccgcggugcuacggaagcugugcaucgaagccaagaucuccaacaccaccacugacagccgcugccccacacagggcgaggccacucucguggaggagcaggacgccaacuucgucugccggcgcaccuucguggaccggggcugggggaauggcugcgggcuguucgggaaggggucccuaauuacgugugccaaguucaagugcgugacgaaacucgagggcaagauuguccaauacgagaaucugaaguacagcgugaucgugaccguccacaccggcgaucagcaucagguggggaacgagucgacugagcauggcacgaccgcuaccaucacuccccaagcccccagcaccgagauacagcugaccgacuacggcgcccucacccuggacuguucgccccggaccggccuggacuuuaacgagaugguccuccugacgaugaaagagaagaguuggcucgugcacaagcagugguuccucgaccugccgcugcccuggaccagcggggccaguaccucgcaagaaaccuggaaccggcaggaccuccugguaacguuuaaaaccgcucacgcgaagaagcaggagguggucgugcugggcagccaggagggcgcgaugcacaccgcccucaccggggccacggaaauccagacgucaggcaccaccacgaucuuugccgggcaccugaagugccgccugaagauggacaagcuaacgcugaagggcauguccuaugugaugugcacagggucauucaaacuugagaaggagguggcagagacccagcacggcacggucuuaguccaaaucaaguacgagggcaccgacgccccuuguaagauacccuucagcacacaggacgagaaaggggugacccagaacggccggcugaucacggcgaacccgauagugaccgacaaggagaagcccguaaacauagaagcggaaccgcccuucggagagagcuacaucgugauaggcgcgggcgagaaggcccugaaguuguccugguuuaagaaggggaguuccaucgguaaaauguucgaagccaccgccagaggggccaggcgcauggcgauccucggcgacacggccugggacuucgggagcaucggcgggguguucacgagugucgggaagcuggugcaccagaucuucggcacggcauacggggugcuguucagcggcgucucguggaccaugaagaucgggaucggcguguugcugaccuggcugggcuugaacagccgcuccacgagccuuuccaugaccugcauugccguggggcuggucaccuuguaucugggcgugaugguccgggccgacagcgggugcgucaucaacuggaagggccgcgaacugaagugugggagcggcaucuucgugacaaacgaagugcacacguggaccgaacaguacaaguuccaggccgacuccccgaagcggcucucugccgcgaucggcaaagccugggaggagggggucugcgguauccgcuccgccacucggcuagagaacaucauguggaagcagauuagcaacgagcugaaccacauccuccuggagaacgacaugaagcugaccguggugguuggugacguggcuggcauucucgcccaggggaagaagaugauccgaccccagcccauggaguacaaguacuccuggaagucauggggcaaggccaagaucaucggcgcagacgugcaaaacaccacguucauaaucgacgggcccaacaccccggaaugcccggacgaccagcgggcguggaacauuugggaaguagaggacuacggcuucgggaucuucaccaccaacaucuggcuuaagcugagggacuccuacacccaggucugcgaccaccggcucauguccgccgccaucaaggacuccaaggccgugcacgccgacaugggcuacuggauagaaagcgagaagaacgaaacauggaagcuggcgcgcgccuccuuuaucgaaguuaagaccugcaucuggcccaagagccacacccugugguccaacggcgugcucgagagcgaaaugaucauccccaaaaucuacgggggcccuaucucucagcacaacuaccggccuggguauuuuacgcagacagccggccccuggcacuuagggaagcuggaacuggacuucgaccugugcgagggcacaaccguggugguagacgagcacugcgguaaccgcgggccuagccuacggacgaccaccguuaccggcaagaucauccacgaauggugcugccgcuccugcacgcugccaccccuccgguucaagggggaggacggcugcugguacgggauggagaucaggcccgugaaagagaaggaggaaaaccuggucaagagcauggugagcgccggcuccggcgagguagacucguucagucucgggcugcugugcaucucuaucaugaucgaggaggugaugcggagccguuggagucggaagaugcuaaugacgggcacccuggccguguuuuuccugcucaucauggggcagcugaccuggaacgaccuuauccgcuuaugcaucaugguuggugcgaacgccagugaccgcauggggauggguacgaccuaccuagcucuaauggccacauucaagaugcggccgauguucgccgugggccuacuguuccgacggcugaccagccgcgaaguccuccugcucacgaucgggcucucccuggucgcuagcguggaacugcccaacucccucgaggagcugggcgacgggcuggcaaugggcaucaugaucuuaaagcugcugacagacuuccagucacaccaguugugggcgacccugcuaucccucaccuucauccggacuaccuuuagcuugcacuacgccuggaagaccauggcuaugguccuguccauagugucccucuucccccucugccuguccaccacgagccaaaagaccacauggcuccccgugcugcuaggcuccuuggggugcaagccgcugaccauguuccugaucgccgagaacaagaucugggggcgcaaaagcuggccccuuaaugaaggcaucauggccgucggcaucgugaguauccugcugaguagccuccugaagaacgacguuccauuagccgguccccucaucgccggcggcaugcugauagcgugcuacgugaucuccggguccucugccgaccugucucucgagaaggcagccgugguguccugggaagaagaggccgagcacucaggcgcgagccacaacauccuaguggaggugcaggacgacggcacgaugaagauaaaggacgaggaacgugacgacacucugaccaucuugcugaaggccacccuacucgccgugagcggcgucuacccccuguccauccccgcaacacuauucgugugguacuucuggcaaaagaagaaacagcgcagcggggugcuuugggacacgcccuccccgcccgaggucgagcgggccgugcuggacgacggcauauaccgaaucaugcagcggggccugcugggacgcucucagguaggcgucgggguguuccaggagaauguguuccacaccauguggcacgucacccggggcgcagugcucauguaccaggggaagcgccuggagccuuccugggccagcguaaagaaggaccugauauccuacggcgguggguggcgacuccaagggagcuggaacaccggggaggagguccagguaaucgccguggagcccggcaaaaauccgaagaauguccagaccgccccggggaccuucaagaccucggagggggagguuggcgccaucgcgcuggacuucaagcccgggacaagcgguucccccaucgugaaccgcgaggggaagaucguuggccuguacgggaacgggguggugacgaccuccggcaccuacgucagcgccaucgcccaggcgaaagcgucccaggaggggccccucccggagaucgaggacgagguuuucaggaagcgcaaccugaccacgauggaccugcaccccggcucaggaaagacccggcgcuaccuccccgccaucgugcgugaggccaucaagcgcaaacugcgcacccugauccucgccccgaccaggguuguggccuccgagauggcggaagcacugaagggcaugcccauccgcuaucagacgaccgccgucaagagcgagcauaccggcaaggagaucgucgaccugaugugccacgccaccuucacgaugcggcuucugagcccagugcgcguccccaacuacaacaugaucauaauggacgaggcacauuucacggauccaagcuccaucgcagcccggggguauaucuccacccgcgucggcaugggugaggccgccgccaucuucaugaccgcgacuccgcccgguuccguggaagccuucccccagagcaacgccgugauucaggacgaagagagggacauaccggaacgcuccuggaacagcggcuacgaguggaucaccgacuucccaggcaaaacaguuugguucgugcccuccaucaagagcggcaacgauaucgccaacugccugaggaaaaacgggaagcgcgugauucagcucucucguaaaaccuucgacacagaguaccagaagaccaaaaacaacgacugggacuaugucgugaccaccgacaucuccgagaugggcgcgaacuuccgcgccgaccgggugaucgauccccgccggugcuuaaagccugucaucuuaaaggauggccccgagcgcgucauacucgccggccccaugcccgucacgguggccuccgccgcacaacggcgcgggcggauaggcaggaacccgaacaaggagggcgaccaauacaucuacauggggcaaccacugaacaacgaugaggaccacgccccguggaccgaggccaaaaugcugcucgacaauaucaauacucccgagggaaucaucccggcuuuauucgaacccgagcgcgagaagucagccgcgaucgacggagaauaccggcuacgcggcgaggcccggaagaccuucguggagcucaugcgcagaggggaucugcccgucuggcugagcuauaagguugccuccgagggcuuccaguacagcgaccgacgguggugcuucgacggcgagcggaacaaccagguacucgaggagaacauggauguugagaucuggacgaaggagggggagcggaagaagcugcgcccccgguggcuggacgcccgaaccuacucagacccgcucgcccugcgggaguucaaagaguucgcggcuggcaggcggagcgugucuggggaccuaaucuuggagaucggcaagcugccccagcaccugacccaacgcgcccagaacgcccucgacaaccuagugaugcuucauaacagcgagcagggcggacgggcguaccgccacgccauggaggagcucccagacaccaucgagacgcugauguugcucgcccucaucgcuguucugaccggcggggugacccucuucuuccuguccggucgggggcugggcaagacuagcaucggucuuuugugcguaauggccuccucuguccuacucuggauggcaagcguggagccgcacuggaucgccgccagcaucauccuggaguucuucuuaauggugcuccuuaucccagagcccgaccgccaacggacgccccaggacaaccagcuagccuacgucgugaucggccuccuguucaugauccugacgguugcugcaaacgagaugggccuccuggagaccacuaagaaggaccucgggauaggccacgucgccguggagaaccaucaccacgccgccaugcuugauguggaucugcacccggccucagcguggacacuguaugccguggccacgacuaucauuacccccaugaugagacacaccauagaaaacacuaccgccaacauuagccucaccgccaucgccaaucaagccgccauccugauggggcuggacaagggcuggcccaucucuaagauggacaucggcgugccccugcuggcguuaggguguuacagccagguaaacccguugaccuugacggcggccguccugaugcucguugcccacuacgccaucaucggucccgggcugcaggcuaaggcaacccgcgaagcccagaagcgcaccgccgccgguauaaugaagaaccccacgguggacgggaucgucgcaaucgaccuggaccccgugguguacgacgcgaaauucgagaagcagcucggccagaucaugcugcuaauccuaugcacgucucagauccugcuuaugcgcaccacuugggcccucugcgaaagcaucacccuggccacgggcccguugacgacccucugggagggcucccccggcaaguucuggaauaccacgaucgccgucagcauggcuaacauauuccgagggagcuaccuggcgggagccggccuggccuucucccucaugaagucccuagggggugggcgccgggguaccggggcucagggcgaaacccuaggcgagaaguggaagcgccagcucaaccagcugucuaagagcgaguucaacaccuacaagcgguccgggaucauggagguggaucggagcgaggcgaaggagggccuaaagcgcggggagacuacgaagcacgccgugucccgcggcaccgccaagcuccggugguucguugagcgcaaccuagugaagcccgaggggaaggugauagaucugggcuguggccgcggcgguuggagcuacuacugcgccgggcugaagaaggucaccgaggugaaaggguacacgaagggcggccccggccacgaagaaccaaucccaauggccacguacggguggaacuuggugaagcugcacuccggcaaagacgucuucuucaucccgcccgaaaagugcgacacccuucuaugcgacaucggggagagcuccccaaaccccaccaucgaggagggccgcacgcugcgggugcugaaaaugguugagcccuggcuccgcgggaaccaguucuguaucaagauccugaaccccuacaugccgagcgucguggaaaccuuggagcagaugcagcggaagcacggcgggaugcuaguucgcaacccccucuccagaaauuccacccacgaaauguacugggucuccugcgggaccggcaacaucgugagcgcggugaacaugacgucccgcaugcuucucaaccgcuucacaauggcccaccggaagcccaccuaugagcgcgacgucgaccugggagccggcacccggcacguugccguggagccggaggucgccaaucuggauaucaucggccaacgcaucgagaacauuaagcaugagcauaagagcaccuggcauuacgacgaagacaacccguacaagacgugggcguaccacgggucuuacgaggugaaacccagcggcagcgccuccagcauggucaacggcguaguuaagcuccugaccaagcccugggacguuauccccauggugacucagauagccaugaccgacacgaccccguucggccaacagcggguguucaaagagaaggucgacacccggacccccaaggccaagcgggggacggcccaaaucauggaggugaccgcgaaguggcugugggguuuccucucccgcaacaagaagccccggauuuguacccgcgaggaguucacccggaaggugcgcagcaaugccgccaucggcgccguauucgucgacgagaaccaguggaacagugcgaaggaggccguggaggacgaacgguuuugggaucucguccaccgcgagcgggagcugcacaaacagggaaagugcgccacgugcguguacaacaugaugggcaaacgugagaagaaguuaggggaauuuggcaaagccaaggggagccgggccaucugguacauguggcugggcgcgcgguuccuggaguucgaggcacucggcuucaugaacgaggaccauugguuuuccagggagaacucacuguccgggguggagggcgaggggcuucacaagcucggcuacauccuacgcgacaucagcaaaauccccgggggcaacauguaugccgacgacaccgccggcugggacacccgcaucaccgaagacgaccugcagaacgaggccaagaucacggacaucauggagcccgaacaugcgcugcuggcaaaguccauuuucaagcugaccuaccagaacaagguggugcgcgugcagaggccggcaaagaacgggaccgucauggacgugaucagccgucgcgaccagcgcgggagcgggcagguuggcaccuacggccucaacacguuuaccaauauggaggcccagcugauccgccagauggagagcgaggggauauucucccccagcgagcuggagaccccgaaucucgccggacggguccuggacugguuagagaagcacgguguggagcggcugaagcggauggcgaucuccggcgacgauugcguggucaagccaaucgacgaccgcuucgccacggcccugacggccuuaaacgacaugggaaaagugcggaaggacaucccacaaugggagcccagcaagggcuggaaugacuggcagcaagucccguuuugcucccaccacuuccaucagcucaucaugaaggacggccgcgagaucgucgugcccugccggaaucaggacgaguugguggggcgcgcucgggucucccagggugcaggguggagccugcgggagaccgccugccuugggaaauccuacgcccagauguggcaacugauguacuuccaccggcgcgaucugcggcucgccgcgaacgccauuugcagcgccgugcccguggacuggguacccaccucccgcaccacguggagcauccacgcccaccaccaguggaugaccacggaggacaugcugucgguguggaaccguguguggaucgaggagaauccguggauggaggacaagacacacaucagcuccuggggcgacguccccuaccugggcaagcgcgaggaucagugguguggcagccuuauugggcugacggcccgcgcgaccugggcuaccaacauacaggucgccaucaaccagguacgccggcugcucggcaacgagaacuaccucgacuacaugaccuccaugaaacgauucaagaacgaaagcgaucccgagggggcccugugguga

SEQ ID NO: 24444 - RNA, 9879 nt, Artificial Sequence
  derived and/or modified CDS sequence (opt11) from DENV-1__GU131731__SS-prME
agcguaacgaugcuccucaugcugaugcccacugcuuuggccuuucauuuaaccacccgcggcggggaaccacauaugaucgugacaaaacaggagcgggggaagagucuacuguucaagaccagcgcgggggugaacauguguacccugaucgccauggaccugggugaguugugcgaggauacgaugaccuauaaguguccccggaucacggaggccgagcccgacgauguggacugcuggugcaaugccacggacaccugggucaccuacgggaccugcagucagacaggugagcauagacgagauaagaggagcguggcccucgcaccccacgugggacugggguuggagacaagaacagagaccuggauguccagcgagggcgccuggaagcagauccagagagucgagacgugggcccuccgccaccccggguucaccgugauugcccuguuccuggcccaugccaucggcaccucuauaacccagaaggguaucaucuuuaucuugcugauguuagucacgcccagcauggccaugcgcugcgucgguaucggcucucgggacuuuguagaggggcucuccggggcuacuuggguggacgucgugcuugagcacggguccugcgugaccaccauggccaaggacaaacccacgcuggauaucgaacucuuaaagaccgaggucaccaaccccgcggugcuacggaaacucugcaucgaggccaagaucagcaacacaacuacagacucccguugcccuacccagggcgaggccacauuaauggaggagcaagacgcgaacuucgugugucggcgcaccuucgucgaccggggcugggggaacggcugcggauuguuuggcaaagggucgcuuaucacgugcgcuaaguuuaagugugucacuaagcuggagggcaagauagugcaauacgaaaaccugaaguauuccguuaucgugaccgugcacacgggcgaccagcaccagguugggaacgaguccaccgagcacgguaccaccgccacaaucacuccucaggcaccaacguccgagauccagcucaccgacuacggggcccugaccuuggacuguucacccagaacgggccuugacuucaaugaaauggugcuccugacaaugaaggagaaguccugguugguccacaagcagugguuucuggaccugccgcugcccuggacaagcggggccagcacgucccaggagacguggaaucggcaggaccugcuggugaccuucaagacagcucacgcgaagaagcaggaaguggucgugcuuggcucacaggagggcgccaugcacaccgcucucacgggggccacagagauccaaacuuccggcacaacgaccaucuucgccggccaucugaagugccgcuuaaagauggacaaacugacccucaagggcaugagcuaugucaugugcaccgguucauuuaaacuugagaaggaggucgcagagacgcagcacggcaccgugcuugugcaaaucaaguacgagggcaccgaugcgcccugcaaaauccccuucagcacccaggacgaaaaaggagucacgcagaacggccggcugaucaccgccaacccgauugugaccgacaaggagaagcccgugaacauagaggccgagccgcccuucggggaguccuauauagucauuggcgcaggcgagaaagcacuaaaacuuucuugguuuaagaagggguccagcaucggcaaaauguuugaggccacugcccguggagcccggcggauggcgauccugggugauacggccugggacuucgggucugugggcgguguguucaccucggucgggaagcugguacaccagaucuucggcaccgcauauggggucuuguucuccggcgucagcuggaccaugaagaucgggauaggggugcugcugacguggcucggccugaacuccagaagcacuucccugagcaugaccugcaucgccguggggcuagugacccuguaccugggcguuauggugcaggcggacuccggaugcgugaucaacuggaagggccgggaacucaaaugugggucgggcauauucgugaccaaugaggugcauaccuggacggagcaguacaaguuucaggcagauagcccgaaacgcuuauccgcugccauaggcaaggccugggaggaaggggucugugguauccggucugccaccagacuggaaaacaucauguggaagcagauuuccaaugagcugaaccauauccuucuugagaacgacaugaaguuuaccguagucgucggggauguuguaggcaucuuggcccaggggaagaaaaugauccggccgcagcccauggagcacaaguacagcuggaaguccugggguaaggcaaagaucauuggagccgacguacagaauaccacguuuauaaucgacgggccaaauaccccugagugccccgacgaccaaagagcguggaacaucugggaaguggaggacuacggcuucggaauuuucaccacgaacaucuggcugaagcuuagagacagcuacacccaggugugcgaccaccgccucauguccgcugccaucaaggauagcaaggccgugcacgccgauauggguuacuggaucgaguccgagaagaacgagacauggaaguuggcgcgggcgucauucaucgaggugaagaccugcaucuggccgaagucccacacccuauggagcaacggugugcucgagucagagaugauaauccccaagaucuacggcgggccgaucucccagcacaauuaucgccccggguacuucacccagaccgcgggccccuggcaucuugggaagcucgagcucgacuuugaccugugcgaggguaccacgguggugguggacgagcauugugguaaccgcgggccgucccugcgcaccaccaccgucacggguaagauaauucacgaauggugcugccggagcugcacccugccgccccuucgcuucaagggggaggacggcuguugguacggaauggaaaucaggcccgucaaggagaaggaggagaaccuggugaaguccauggucagcgcgggcucaggggagguggacagcuucagccucgggcugcugugcaucucaaucaugaucgaggaagugaugcgcagccgguggucccguaaaaugcucaugaccggcacucuggcugucuuucugcuccucaucauggggcaacugacguggaacgaccucauccggcugugcauaauggucggugcuaacgcgagcgaccgcauggguaugggcaccacauaccuggcgcuaauggccacuuucaaaaugcguccgauguucgcugugggccugcuguuucgccgccucacgucccgggagguauugcugcugaccaucgggcugaguuuaguggccuccgucgaguuacccaacagccuggaggagcuaggggacggacucgcgaugggcauaaugauccugaagcuacucaccgacuuccagucccaccagcugugggccacguuacucagccuaaccuucaucaaaacuaccuugucccuccauuacgccuggaagaccauggccauggugcugaguauaguuucccuuuucccccucugccugagcacgaccucccagaagaccacauggcugcccgucuuacugggcagccuggggugcaaaccguuaaccauguuucugaucaccgagaauaagaucuggggccgaaagaguuggccccugaacgaggggauuauggcuguggguguggucagcaucuuacucuccucccuguuaaaaaacgacgugccacuggccgguccccugaucgcaggugggaugcucauugccugcuaugugaucagcggguccucagccgaccugucccuggagaaggcggccgaagucaguugggaggaggaggccgagcauuccggcgccucucacaacauacuuguagagguccaggacgacgggaccaugaagaucaaggacgaagaacgggaugauacccugaccauacugcuaaaagccacgcugcuggcggucuccggcguguacccguugagcauucccgccacgcuguucguaugguauuuuuggcaaaagaaaaagcagcguagcgggguccugugggacacaccuaguccacccgagguugaacgggccguccuggacgacgggauuuaccgcaucaugcaacggggccuccuggggagaucgcaggucggcgucgggguguuccaggagaacgucuuccacaccauguggcacgugacgcggggcgcuguauuaauguaccaggggaagcggcucgagcccagcugggccuccgucaagaaggaccugaucuccuauggcggcggguggcgguugcaaggcuccuggaacacuggggaggaaguccaggugaucgccgucgagcccggcaagaauccgaagaacguccagaccgccccgggaaccuucaagacccccgagggcgaggugggcgcaaucgcccuagacuucaaacccgguacaagcggcucccccaucguaaaucgcgaaggcaagaucgugggccuguauggcaacgggguggucaccacgaguggcacguacgugucggccaucgcgcaagccaaggcuucccaagaagggccgcuccccgagauugaagacgagguauuccggaagcgaaaccuaacuaucauggaccugcaccccggaucagggaagacccggagguaccugccggccaucguccgugaagcgauaaagcgcaagcuccggacacuuauccuggcaccuacgagaguggucgcauccgagauggccgaagcgcugaagggcaugccaauccgauaucagaccacugcugucaagucggaacacaccggaaaagagaucgucgaccucaugugccacgcgacauucacaaugaggcuacucuccccggugcgcguccccaacuacaacaugaucaucauggacgaggcccacuucaccgaccccuccuccaucgccgcgcggggcuauauuagcacucgcguggguaugggggaggcggccgcaaucuucaugacagccacgccucccggaucuguugaggccuuuccgcagagcaacgcugucauccaggacgaggaacgggauauaccagaacgcaguuggaacagcggguaugaauggaucacagauuuucccggcaagaccgugugguucgugcccuccaucaagagcggaaaugacaucgccaauugccugcggaagaacggaaagcgggucauacagcugucccgcaagacguucgacaccgaguaucagaagacgaagaacaacgacugggacuacgugguaacgaccgacaucagcgagaugggcgccaacuuccgcgccgaccgggucaucgacccacgccggugucuaaagcccgugauccugaaggacgggcccgagcgcgucaucuuggcgggcccgaugccagugaccguggcuuccgcggcccagcggcgcggucguauuggccgcacucacaacaaggagggcgaccaguacauaagcauggggcagcccuugaacaccgccgaggaccacgcacccuggacggaggcuaagaugcuccuggauaacaucaacaccccagagggaaucauaccggcccucuucgagcccgagcgggagaaguccgccgccaucgacggcgaguacaggcugaggggcgaggcgcgaaagaccuucguggagcugaugcgccgcggggaccucccuguuuggcugagcuacaagguugccagcgaaggcuuucaauacucggaccgucgguggugcuucgacggcgagcguaacaaccagguccuggaggagaacauggauguggagauuuggaccaaagagggggagcggaagaagcuccgcccgcgguggcuagacgcccggacuuacagcgacccgcuggcauuacgggaguucaaggaauuugcggcgggccgccgauccgugucuggugaccugauucuggagaucggcaagcucccucagcaccugacucagagagcgcaaaacgcccuggauaaccucguuauguuacacaacucagaacagggcgggcgcgccuaccggcacgcgauggaggaguugcccgauaccauugagacccucaugcuacuggccuugaucgccguccugaccgggggggugacgcuguucuuccucucuggccggggccugggcaagaccuccaucggccugcuuugcgucauggccucguccgugcugcuguggauggccagcguggagccacacuggauagcagccucgaucauccuugaauucuuccugaugguucugcuaaucccggagcccgaccgccagaggacaccacaggacaaccaacuggccuauguaguuaucgguuuacucuucaugauauuaacaguugccgccaacgaaaugggucugcucgagacgacuaagaaagaccuggggaucggacacguugcgguggagaaccaccaccacgccacaaugcuggaugucgacuugcacccggccucagcauggaccuuguacgccguggccacgacgaucaucacgcccaugaugcgucacaccaucgagaacacgaccgccaacaucucccugacugccaucgcgaaccaggccgcgauccucaugggguuggacaagggguggcccaucagcaagauggacaucggagugccucuguuagcccugggauguuacucccaggucaacccacucacccuaacggccgccgugcugauguuaguggcgcacuaugccauuaucggcccagggcuccaggcgaaggcgacacgggaggcccaaaagcggacugcagcaggcauaaugaagaaccccaccgucgacgggaucguagcaaucgaccuggacccugugguuuacgacgcgaaauuugagaagcaauuaggccaaaucaugcuccugauccugugcacuagccagauccuccugaugcguacgaccugggcucugugcgaguccaucacccucgccacgggcccauugaccaccuugugggaggggagcccaggcaaguuuuggaacaccacuaucgccguguccauggccaacaucuuccgagggucguaccuagcuggcgcgggccuggcguucagccuaaugaagucccuagggggcggccgccgcggcaccggcgcgcagggcgaaacccuuggggaaaaauggaagcgccagcugaaccagcuaaguaaguccgaguuuaauaucuacaagcggucugggauaauggagguggaucgcuccgaggcgaaggaaggacuuaagcgcggggagaccacgcgucacgccgucagcagagguaccgcgaagcugaggugguuuguugagcggaaccuuguuaaaccggaagggaaggucauagaccucggcugcgggcgcggaggcuggagcuacuacugcgccgggcugaagaaggugacagaggugaaaggcuacacuaagggcggucccggccacgaggaccccauccccauggccacguauggauggaaccuggucaagcugcacaguggcaaagacguguucuucacgccgcccgagaagugcgauaccuugcugugcgacauuggugaguccucgccaaaccccacuaucgaggaggggcgaaccuuacgcguacugaagauggucgaacccugguuacgugggaaccaguucugcaucaagauccucaacccauacaugccguccguaguggaaacucucgagcagaugcagcgcaaacacggcgguaugcugguccggaacccacucagccggaacucuacccacgaaauguauugggugagcugcgguaccggcaacaucguguccgcaguuaacaugaccucgcggaugcugcucaaccgcuucacgauggcucaucgcaagcccaccuaugagcgggacguggaucucggggcgggcacccgacacguggccgucgagccagagguggcgaaccuggacaucaucggccagcggauugagaacauuaagcacgagcacaagucuacauggcacuacgacgaggauaacccauacaagacgugggccuaccacgggagcuacgagguaaagcccuccggcagcgcaagcuccauggugaacggggucgucaagcugcugaccaagcccugggacgugauccccauggugacucagauagcgaugacugacacgaccccguucggccagcagcgggucuucaaggagaagguagacacccggacccccaaagcuaagcgcggcacugcccagaucauggaggugacggcacgguggcucuggggcuucuugagccgcaacaagaagccccggauaugcacccgagaggaauucacccggaagguacgcuccaacgccgcgaucggcgccguguucguggacgagaaucaauggaacagcgccaaagaggccgucgaggacgagcgguucugggaccucguacagaaggagagggagcuucauaagcaggggaagugugcgacaugcguguacaacaugaugggcaagcgggagaagaagcugggggaguucggcaaagccaaagggucccgcgcgaucugguacauguggcugggagcccgguucuuggaauucgaggcccuuggcuucaugaacgaagaccacugguuuagccgugagaacucacugagcggggucgagggcgagggucugcauaagcugggcuauauccuccgggacaucuccaagauucccggcgguaacauguacgcggacgacaccgccggcugggacacccgcaucaccgaagaugaccugcagaacgaggccaagaucacggacaucauggagccggagcacgcccugcucgccaccucgaucuucaagcuuaccuaucagaacaaaguagugcguguccagcgccccgcgaagaacgguacagugauggacgucaucucccgccgggaucagcggggcucgggccagguaggcacguacggauugaacaccuucacuaacauggaagcccagcucauccggcagauggaguccgagggcaucuuccugcccagcgagcucgaaacccccaaccucgcggagcgcguguuggauugguuggagaaauacggcguugagcggcucaagcgcauggccaucuccggugacgacugcguugugaaacccaucgacgaccguuucgcuacggcgcugaccgcccugaaugacaugggaaaggugcgaaaggacaucccccaaugggaacccagcaaaggguggaaugacuggcagcaggucccguucugcucccaccacuuccaccagcucaucaugaaggacggccgggagaucgugguacccugcagaaaccaggacgaguuaguaggccgggcccgugugucgcagggggccggcuggucgcugcgggagaccgccugccucgggaagucauacgcgcagauguggcaacuaauguacuuccaccgccgggaccugcgccucgccgccaacgccaucugcagcgcggugccugucgacugggugccgaccagccguacgaccuggucuauccacgcccaucaucaguggaugaccaccgaggacaugcuguccguguggaaccgcguuuggaucgaggagaacccauggauggaggacaagacccacgucagcucguggggcgaugucccauaccuggguaagcgggaggaccaauggugcggcagccuaauuggacucacugcgcgcgcuaccugggcauccaacauucagguagcgauuaaccaggugagacggcucauugggaacgagaacuaucucgacuacaugaccagcaugaagcgcuucaaaaaugaaggcgauccagagggcgcacugugguga

SEQ ID NO: 24445 - RNA, 9879 nt, Artificial Sequence
  derived and/or modified CDS sequence (opt11) from DENV-1__GU131733__SS-prME
agcgucaccauguucuugauguuaaugccuaccgcccuggccuuucauuuaacgaccaggggcggggagccgcacaugaucgugagcaagcaggaacggggcaagagccugcuguucaagacguccgccggcgugaacaugugcacccugaucgcgauggaccucggggagcugugcgaagacaccaugaccuacaagugcccgcgcaucacggagaccgagcccgacgacguggacugcuggugcaacgcgacggacaccugggucaccuacgggaccuguagccagacaggcgagcaccgccgcgacaagcgguccgucgcccuggcgccccacguaggccucgggcuggagacgcgcacggagacauggaugagcucggagggcgccuggaagcagauccagcgggucgagacuugggcccugaggcaccccggguucacagugaucgcccucuuccuggcgcacgcgaucggcaccagcaucacccagaaggggaucaucuucauccugcuaaugcuggugacaccauccauggccaugcggugcgucggcauuggcucuagggacuucguggaggggcugagcggagcgaccuggguggauguagugcucgagcacgggagcugcgugaccaccauggcuaaagacaaacccacacuggacaucgagcugcucaaaaccgagguuacaaacccagccguucugcggaaauugugcaucgaggcgaagaucuccaacaccacuaccgacagccggugcccgacgcagggcgaggccacuuugguggaggagcaggaugcuaacuucgucugcaggaggaccuucguggaucggggcuggggcaacggcugcggguuauuuggcaaggggucccugaucacgugugccaaguucaagugcgucacaaagcucgaggggaaaaucguacaguacgaaaaccugaaguacagcgugauagugaccguacacacuggagaccagcaccagguggggaaugaauccaccgaacacggcacuacggccacuaucacuccccaagcacccacuaccgagauacagcugacugacuacggggcgcucacgcucgacugcucgccccgcaccggccucgacuucaaugaaaugguccucuugacgaugaaggagaaguccuggcugguccacaagcagugguuccucgaccugccgcugcccuggaccagcggcgccagcacgucgcaggagaccuggaacaggcaagacuuacuggugaccuucaaaaccgcccacgccaagaagcaggagguggugguccucggcucacaggagggcgcaaugcacacggcucucacaggggccaccgagauucagaccucaggcacgaccacaaucuucgcagggcaucugaagugccgccugaagauggacaagcucacccugaaaggcaugagcuacgucaugugcacggguuccuucaagcuggagaaggagcucgccgagacgcagcauggcaccgugcuggugcagaucaaguacgaaggcaccgacgcgcccugcaagauccccuucagcacacaggaugagaagggagucacccagaacggccggcugaucaccgccaacccgaucgugacugacaaggagaagcccguuaacaucgaggcagagccacccuuuggggaguccuacaucgucaucggcgccggcgagaaggcgcuaaaacucagcugguuuaagaagggauccucgauagguaagauguucgaggcaacagccagaggggccaggcggauggcaauccugggcgacaccgcaugggauuucggguccaucggcgguguguucaccagcguagggaagcugguccaucagaucuuuggcaccgcguacggcgugcuauucuccggcgugagcuggacgaugaaaaucgggaucggaguccuguugaccugguuaggucuaaauucccgcagcaccucccugucaaugaccugcaucgcggugggccucgugacgcuguaccugggcguuaugguacaggccgacuccgggugcgugaucaacuggaagggccgggagcucaagugcgggagcggcauauuuguaaccaacgagguacacaccuggaccgaacaguacaaguuccaagccgacucaccuaaacgccuguccgcggccaucggcaaagccugggaggaggguguguguggcauccggagcgccacccgccuggagaacaucauguggaagcagaucucuaacgagcuaaaccacauuuuacuggaaaacgacaugaaguucacggucguugugggugacgucgccggcauccucgcacaggggaaaaagaugauacgcccccagccgauggaguacaaguacagcuggaaguccuggggcaaggccaagaucaucggcgcggacgugcagaacacaacauucaucauugacgggcccaacaccccugagugccccgacgaccagcgcgcuuggaacauaugggaaguggaggacuacggcuucgggaucuucacaaccaacaucuggcugaagcugcgggacagcuacacacaggucugcgaccaccgccucauguccgcggcuaucaaggacagcaaggcuguccacgccgacaugggauacuggaucgaguccgagaaaaacgagacauggaagcuggcccgggcuagcuucaucgaggugaagacgugcauauggcccaaaucccacacucuguggagcaacggcguccucgaguccgagaugaucaucccaaagauuuacgggggcccgaucagccagcacaauuaccgccccgguuacuucacccaaaccgccggccccuggcacuuagggaaacuggaacuagacuucgaccugugcgagggcacuaccgugguggucgacgagcauugcggcaaccgcgggccgucucugagaaccaccacagugacggggaagaucauccacgaguggugcugccggagcugcaccuuaccuccccuacgcuuccgcggugaggacggcugcugguacgggauggagauccgccccgugaaggaaaaagaggagaaccuggucaaguccauggugagcgccggcucaggggagguugacucuuucagccucggguugcugugcauuuccaucaugaucgaggaggucaugcgcaguagguggucucggaagaugcucaugaccggcacgcuggccguguucuuucugcuaaucauggggcaacuaaccuggaaugaccugauucgccucugcaucauggugggcgccaacgcgagugaccgcauggggaugggcaccaccuacuuagcucucauggcgacguucaagaugcguccgauguuugccguuggccucuuguuucgccgccugaccucacgcgaggugcuccuguuaaccauaggccucagccugguggccuccguugagcugcccaauagccuugaggagcugggcgaugggcuggcgauggggaucaugauccuaaagcugcuuaccgacuuccagucccaccaguugugggcaacgcuguuaagccugaccuucaucaagacuacuuucucccugcacuacgccuggaagacgauggccauggugcugagcaucgucucccucuuccccuugugcuugagcaccaccucccagaaaaccacgugguugccaguccuguugggcagccucggaugcaaaccgcugacgauguuucugauagcugagaacaagaucuggggccggcgcuccuggccccucaacgaggggaucauggccgugggcaucguaucuauccugcuaagcuccuuacugaagaacgacgugccccucgccggcccgcucaucgccggcggcauguuaaucgcguguuacguaaucagcggguccagcgcggaucuuucgcucgagaaagcagccgaggucagcugggaggaggaggccgagcacuccggggccagccauaacauccuggucgaggugcaggacgacgggaccaugaaaaucaaggacgaggagcgggacgacacccugaccauccuccugaaggcgacgcugcuagcuguuuccggcguuuacccgcugagcaucccggccacgcuguucguaugguacuucuggcagaagaagaaacagcgcuccgggguccucugggacaccccgagcccacccgaaguggagcgggccguacuagacgacggcaucuaucgaaucaugcagcggggccugcugggccgcucacaggugggcguggggguguuccaggagaacguauuccauaccauguggcacgugacacggggcgccguccucauguaccaggggaaacgcuuagagccuagcugggcguccgucaagaaggaccugaucagcuacggcgggggauggcggcuccaaggguccuggaacacaggggaggagguccaggugaucgcagucgagcccggcaagaacccgaagaacgugcagaccgcccccgggaccuuuaaaacucccgagggcgaagugggcgcgaucgcgcuggacuucaagcccgggaccucuggcucccccaucguuaaccgcgaggggaagauugucggcuuguacggcaaugggguaguuaccacgucgggcacguacgugagcgcuaucgcucaggcccgggccucccaagaggggccccuccccgagaucgaagacgagguguuccgcaagcggaaccugaccauaauggaccugcauccuggcucugggaaaacccgccguuacuuaccagcgauuguccgagaagccaucaagcgcaagcugcggacccugauccucgccccgacgcgagugguagcguccgaaauggccgaggcgcugaagggcaugcccauccgguaccagacuaccgccgucaaguccgagcacaccggcaaagagaucguggaccugaugugccacgccacguucaccaugcgccuccugucccccgugcgggucccgaauuacaacaugaucaucauggacgaagcccacuuuaccgaccccuccucaauugccgcgcgcggcuacaucaguacgcgugugggcaugggggaggcugccgccaucuucaugacggccaccccgcccggcucgguggaggcguucccccagucuaaugccgucauccaggacgaggagagagacauccccgagcgguccuggaacagcggguacgaguggaucaccgacuuccccgguaagaccgugugguucgugcccuccaucaagagcggcaaugacaucgccaacugccugcgcaagaacgggaagcggguaauccagcucucccguaagacguucgacaccgaguaccagaagaccaagaacaaugauugggauuacguggugaccacggauauuucagagaugggcgccaacuuccgugcggauagaguuaucgacccgcggcgaugccugaagcccguaauccugaaggacgggccugagcggguuauucucgccggccccaugcccgucaccguggcuuccgcugcccagcgccgggggcgcauuggccgcaaccacaauaaggagggcgaccaguacaucuauaugggccagccucucaacaaugacgaggaucacgcucacuggaccgaggcaaagaugcuguuggacaacaucaacacccccgagggcaucauccccgcgcuguuugagccggagcgggagaaguccgccgcgaucgacggggaguaccgcuuacggggcgaggcgcgcaagacguucguggaacucaugcgacgcggggaccugcccgugugguuguccuacaaaguggccagcgaaggcuuccaguacagcgaccggaggugguguuucgauggcgagcggaacaaccagguccucgaggaaaacauggauguggagauuuggaccaaggagggggagcgcaagaaguuacgaccccgcuggcuggacgcccgaacguacucagaccccuuggcccugcgcgaguucaaggaauuugccgccggacggcgcucuguguccggggaucugaucuuggagauuggcaaacugccgcagcaucugacccagcgggcgcagaacgcccucgauaaccuggucaugcugcacaacagcgagcagggcggucgcgccuacaggcacgcgauggaggagcugcccgacacgaucgagacccugauguuguuggcccugauagccgugcugaccggcggagugacacucuucuucuuguccggccgcggucuuggcaagaccagcaucggccuccugugcgugauggccucgucugugcugcucuggauggccucugucgagccccauuggaucgcggccuccaucauauuagaguucuuucugauggugcuucugauacccgagccggaucgccagcgcacgccccaagacaaccagcuggccuacguggugaucggccuccuguuuaugauccuaacuguggccgcgaacgaaauggggcuacuugagaccaccaagaaagaucuugggauuggacacguggcgguugagaaccaccaucacgccgcuaugcucgacgucgaccuccaucccgccuccgccuggacgcuguaugcgguugccacgacgaucauuaccccgaugaugcgccacacgaucgagaacaccaccgcaaacaucagccuuaccgcaaucgccaaucaagcggccauccuaauggggcuggacaaaggcuggcccaucuccaagauggacauaggcgugccccuccuggcucugggguguuacagccaggucaacccucucacgcugaccgccgcgguccugaugcuagucgcccacuacgccaucaucggccccggucugcaagcgaaagccacccgagaggcgcagaagcgcaccgcggcaggcaucaugaagaaucccacgguggacgggauaguugccauagaccuugaccccguaguuuacgacgccaaguucgaaaaacaauugggccagauaaugcugcugauauuauguaccucccaaaucuuacugaugcggaccaccugggcgcucugcgagaguauuacgcuggccacaggaccccugaccacacucugggagggguccccgggcaaauucuggaacacgaccaucgccguguccauggcuaacauuuuccgggggaguuaccuggcaggcgcgggccuggccuucagccucaugaagucgcucgggggcgggcggcgcggaaccggggcacagggcgagaccuugggcgagaaguggaagcggcaacucaaccagcugaguaaaagcgaguucaacacguacaagcgcuccgggaucauggagguggaccggagcgaggccaaggaggggcugaagcgaggggagaccaccaagcaugcggucucgcggggcaccgcgaaacuccgcugguucguggagaggaaccucgugaagccugaggggaaagucauagaccugggcugcggcagaggaggaugguccuacuacugcgccggucugaagaaggucacugaggugaaaggcuacacgaagggcggacccggccacgaggagccuaucccaauggcgaccuacggauggaaccucgucaagcugcacuccggcaaggaugucuucuucauaccacccgagaagugcgacacucugcucugcgacaucggggaaagcucccccaacccgacgaucgaggagggccggaccuugcgcguucugaaaauggucgaacccuggcuccgggggaaccaguuuugcauaaagauccugaaccccuacaugcccaguguuguugaaacacuggaacagaugcagcgcaaacacgguggcaugcucguacggaauccgcugucacgcaacucuacccacgagauguacuggguguccugcgggaccggcaacauugucagcgccgucaacaugacuucccgaaugcugcucaaccgguucacuauggcacacagaaagcccaccuacgaaagagacguggaccuuggggccggcacgcgccacgucgccgucgagccagagguagcuaacaucgacauuaucggccagcggauagagaacaucaagcacgagcacaagagcacguggcacuacgacgaggacaacccauacaagaccugggccuaccacgggaguuacgaggugaagcccucagguuccgcgagcaguaugguaaaugggguggucaaguuacugacgaagccaugggacgugauccccaugguuacccagauugcaaugacagauaccacccccuucggacagcagagggucuucaaggagaagguggacacccgaacuccgaaggccaagcgggggaccgcccagaucauggaagugacagcuaaguggcuuuggggcuuccuauccaggaacaagaaaccccgcaucugcaccagggaagaguucacgcgcaaaguucggagcaaugcggccauuggcgccgucuuuguugacgagaaccaguggaacuccgccaaggaggcggucgaagacgagagauucugggaccucguccaccgggagcgugagcuccacaagcaggggaagugcgcgaccugcguguauaacaugaugggcaaacgggagaagaagcugggagaguucggaaaggccaaggggagccgcgcuaucugguauauguggcucggagcccgguuccuggaguucgaggcgcuuggcuucaugaacgaggaccauugguucucccgcgagaacucucucuccgggguggagggugaggggcugcacaaguuaggcuacauccuccgugauaucagcaagauccccgggggcaauauguacgccgacgacaccgccggaugggacacgcgcaucaccgaagacgauuugcagaacgaggcccgcaucaccgacaucauggagccggagcacgcccugcuagcgaaguccaucuucaagcugacauaccaaaacaaagugguucggguccaacgccccgccaagaaugguaccgugauggacguaaucucucggcgcgaccagcgggggagcggacagguggguacuuacggcuuaaacaccuucacgaacauggaagcccagcucauacgccagauggaaagcgaggggaucuucuccccgagcgagcucgagacccccaaccuggccgagcgugugcuagauuggcuggagaaauacggcguagagcgccugaagcggauggccaucuccggggacgacugcgucgugaagccgauagacgaccgguucgcgacagcccucaccgcccugaacgauaugggcaaggugcgaaaagacaucccccagugggagcccaguaagggguggaacgacuggcagcagguccccuucuguucccaucacuuccaccagcuaaucaugaaggacggccgcgagaucguggugccgugccggaaccaggacgagcucgucggccgcgcccgggucagucagggcgccggcuggagccugcgcgagaccgcgugucugggaaagucuuaugcccagauguggcagcucauguauuuucaccggcgcgaccugcggcuggcugcgaacgcuaucugcucugccgugcccgucgauuggaucccuaccucccgcacaaccuggucuauccaugcccaccaucaguggaugaccaccgaggacaugcucuccguuuggaaucgaguguggaucgaggagaaccccuggauggaagacaaaacacauauuagcuccuggggcgacgucccguacuuaggcaagcgggaggaccagugguguggcagccugaucggccugaccgcgcgcgcgaccugggcaaccaacauccagguggccaucaaccagguccggaggcugaucgggaacgagaauuaccuagauuacaugaccuccaugaagcgguuuaagaaugagagcgaccccgaaggggccuugugguag

SEQ ID NO: 24446 - RNA, 9879 nt, Artificial Sequence
  derived and/or modified CDS sequence (opt11) from DENV-1__GU131734__SS-prME
agcgucacaaugcuccuaauguuaaugccuacagcguuggcauuccaccuuacaacgcgcgguggcgaaccccauaugaucgucuccaaacaagaaaggggaaagagcuugcuguucaaaacaucagcaggcguuaacaugugcacacuaaucgcaauggauuuaggggaguucugcgaagacacaaugacguacaaaugcccgcgaaucaccgaagcggaacccgacgacguggacugcugguguaacgccaccgacaccugggucaccuacggcacgugcucacaaacaggcgaacaccgccgagacaaacggagcguugcauuggcaccgcacgucggccuaggccuagaaacacgcacggaaaccuggaugucaagugaaggagcguggaaacaaauccagcggguagagacaugggcucugagacaccccggauucacagugaucgcgcuguuccuagcgcaugcaaucggcacaaguauaacacaaaaagggaucauuuucaucuugcucauguuaguaacaccgagcauggccaugagaugcguggggaucgggagcagggauuucguggaagggcugagcggugcaacauggguagacgucguucuggagcacggaagcuguguaacaacuauggccaaagacaagccaaccuuggauaucgaacuucucaaaacagaagugacggacccugcuguguugcgcaaacucugcauagaggcgaaaaucagcaauacaacaacggacucaagaugccccacgcagggagaagcgacccuaguggaagaacaagacgcaaacuuuguaugccgacgaaccuucguagaccggggaugggguaacggaugcggacuauucggaaaaggauccuugaugacgugcgccaaauucaaaugcgucacuaaacuagaagggaaaauaguccaguacgaaaaccugaaauacucagucauaguaacaguacauaccggcgaccaacaucaaguaggaaacgaaagcacagagcacggaacgacggcuacaaucacgccacaagcaccgaguacagagauacaacuaacagacuauggggcauugacgcuugacugcucaccgcgaacaggcuuagauuucaacgaaaugguacuacugaccaugaaagagaaaagcugguuaguccauaagcaaugguuccuagaccugccccuaccauggacauccggcgccagcacgagccaagaaacguggaauagaaaggaccuccucgugacguucaagacagcgcacgcgaaaaagcaggagguggugguucuaggcagucaggaaggcgcuaugcacaccgccuuaacaggggcaacggaaauacaaacuucuggcacaacgaccauauucgcuggccaucuuaagugccgacucaagauggacaaacucacccucaaagguaugucauacguaauguguacggauucauucaagcucgaaaaagaaguagcggaaacgcagcacggaacggugcuggugcaaaucaaauaugaaggcaccgacgcgccgugcaaaauuccauucagcacccaggacgagaaaggggucacgcaaaacggaagacucauuacggccaacccaauagucacugacaaagagaaaccagugaacauugaagcggaaccgccauuuggcgaaaguuacauagucaucggagcaggcgagaaagccuugaaacucucaugguucaagaaaggaucaaguauaggaaaaauguucgaagcgacagcacgcggagcgcgacggauggcaauacuaggagacaccgcgugggacuuuggcagcaucggaggagucuucaccagcguaggcaagcuaguccaccagauauucggaacagcguacggagugcucuuuuccggaguuuccuggaccaugaagaucggaaucggcgugcuacuaaccuggcugggccucaacucccggagcaccucacugagcaugacaugcaucgcagucggucucgugacccuuuaccugggcgucaugguccaagcugauucaggaugcgucaucaauuggaagggcagggagcugaaaugcgggagcgggauauucguaacaaacgaagugcauaccuggaccgaacaguacaaauuucaagcagacagcccaaagcgacucagcgccgcaaucgggaaagcaugggaagaaggcgucugcggcauccgaucagccacaaggcuugaaaacaucauguggaaacagaucucaaacgaacuuaaccacaucuugcuggaaaacgacaugaaauucaccgugguugucggugacguugcagggauacucgcacagggcaagaagaugauacgcccgcagcccauggaauauaaauacagcuggaaaucuugggguaaagcaaaaauuaucggagcugacguacaaaacaccacuuucauaaucgaugggccaaacacaccagaaugucccgaugaccaacgcgcguggaacauaugggagguggaggauuacggauucgggauauuuacaaccaacauauggcuaaaacugagagacucguacacacaaguaugcgaccauagacucaugucugcggcuaucaaggacucaaaggcaguacaugcagacaugggauacuggauagaauccgagaagaaugagacguggaaacucgcgcgcgcuaguuucaucgaaguaaagacaugcauauggccaaagagccauacacucuggagcaacgggguccuggagucggagaugauaaucccgaagaucuacggcggccccauaagccaacauaauuacaggcccggcuauuucacccagacugcggguccauggcaccuuggcaagcuggaauuagacuucgaccucugcgaaggcaccacagucgucgucgacgagcauugcggaaaccgcgggcccucucuacggacuaccacggugacagguaaaaucauucacgagugguguugccguuccugcacucugccaccgcuacgcuucaaaggggaagacggguguugguacggcauggagaucaggccagugaaggagaaggaagagaaccuagugaagaguaugguguccgcagggagcggugaaguagacagcuucucccugggacuacuauguaucucgauuaugaucgaagaggucaugcgaagccgauggucacgcaaaauguuaaugacaggaacccuggccguuuucuuccuacucaucaugggacagcucacauggaacgaccucaucagacuaugcaucauggucggagccaacgcuucagaucguaugggcaugggcaccaccuaccucgcacuaauggcaacauucaagaugcggcccauguuugcggucggacugcuguucagaagacuaacaucuagggagguacugcuacuuacaauaggacugucacucguagcaagcgucgaacucccuaacucgcuagaagaacuaggggaugggcucgccaugggcauaaugauccuaaaauugcugauagacuuccagagucaccaauuaugggcgacacuccucucucugacguuuaucaaaaccaccuucucccugcacuacgcauggaagacaauggccauggugcuuagcaucguaaguuuguuuccauuaugccugucgacaaccagccagaagacaacauggcugccaguccuccucgggagcuugggcugcaagccccugaccauguuucucauagcagaaaauaagauuugggggcgaaaaucguggccccucaaugagggcauaauggcaguuggcauuguuagcauauuguuaucugcacuacucaagaacgacgucccccuagccggcccccuuauugccggagggaugcucauagccugcuacguaauauccggaucaagcgcagaccugagccuagaaaaggcagcggaaguauccugggaagaagaggcggaacauagcggggcgagccacaacauccuaguagaaguacaggaugacgggaccaugaaaaucaaagacgaggaacgcgacgacacccuaacgauacuacucaaagcaacacuguuggcuguuucuggcguuuacccccucucaauccccgcaacccuuuucgucugguacuucuggcagaagaagaaacagagaucggggguacuaugggauacgcccaguccaccggaggucgagcgggcugugcuugaugacggcauauaucgaauaaugcaaagaggacuguugggacggagccaaguaggugugggagucuuccaggaaaacgucuuucacacgauguggcacgugacacgcggagcgguccugauguaccaagggaaaagacuggagcccuccugggccuccgucaagaaagaccuaauaucguacggcggcggguggaggcuacaaggcucguggaauaccggcgaagaaguccaagugauagcaguugagccgggcaaaaaccccaagaacgugcagaccgcuccuggaacauucaagacgucagagggggagguaggcgccauagcacuggacuucaaaccgggcaccagcgguucgccgauuguaaaccgggaaggaaaaaucgucggucuuuacggcaacgggguugucacgacauccggaacauacgugagcgcgaucgcgcaagccaaggcuucccaagaagggccgcuaccagaaaucgaagaugagguguucagaaaacgaaaccucaccaucauggaccuccaucccggcucggggaaaacaaggagauaccugccggcaauaguacgagaggcaauuaaacgaaagcuccggacccucaucuuagcuccaacccgcgucgucgccagugaaauggccgaggcacuaaagggaaugcccauacgcuaccagaccacggcaguuaaaagcgaacacacgggaaaggaaauuguagaccuuaugugccacgcaacauuuacgaugagacuacuuagccccguaaggguccccaauuacaacaugaucauaauggacgaggcucauuucacggauccgucgagcaucgccgcaagagguuacauauccacgagaguuggcaugggggaagcggcggcuaucuuuaugacagcgacaccuccaggguccguggaggcguucccccaauccaacgccgucauacaggacgaggaacgggauauucccgaaagauccuggaacagcggcuacgaauggaucacagauuucccgggaaaaacggucugguucgugccguccauaaaauccggaaacgauaucgcgaacugccuccguaaaaacgggaagagaguaauccaacuuucgcgaaagacguucgacacagaguaccagaaaaccaagaacaacgauugggacuacgucgucacaacggacaucucugaaaugggugcgaacuuccgagcggaccgggucaucgauccgcgcagaugccugaaaccuguaauauugaaggacggcccggagaggguaauccuagccggcccaaugcccgucacgguugcgucggcagcgcagaggcgaggcagaaucggccgaaaucauaacaaagaaggcgaccaguacauauacaugggccaaccacuuaauaacgacgaagaccaugcgcacuggacugaggcaaagaugcuguuagacaacauuaacacucccgaaggcauaauaccagcgcuguucgagcccgaacgugagaaaagcgccgcaaucgauggugaguaccgcuuaaggggagaggcgagaaaaaccuucgucgagcuaaugcgacggggugaucuaccgguauggcuaucauacaaaguugcgucagagggguuucaguacucggaccgaagguggugcuucgauggagaacgcaauaaucaagugcuggaagaaaacauggauguggagauauggacgaaggaaggagaacgcaagaaacugcgaccccgauggcuggacgcccggacguacagugaccccuuggcauuacgagaguucaaggaauuugcagcgggucggaggucggucuccggcgacuugauacuugaaauaggaaaacuaccccaacacuuaacacagcgagcccaaaaugcucucgauaaccuugugaugcugcacaacuccgagcagggcggcagagcauacagacacgccauggaggagcuaccagacacaaucgaaacccugaugcuguuagccuuaaucgccgugcucacaggaggagucacucucuuuuuccuaucggggagagggcuagggaaaacaagcaucggccuucugugcgucauggcauccagugugcuacuauggauggccuccgucgagccgcacuggauagcugccuccauuauccucgaguucuuccuaauggugcuacuaauaccugaaccugaucggcaacggacaccacaggauaaccaacuagccuauguagugaucgggcuacuauuuaugauacuaacuguagccgcuaaugaaaugggacuacuagaaacaaccaaaaaggaucuagggaucggccacguagcagucgaaaaccaccaccacgccgcgaugcucgacgucgaccuacacccagcgucggccuggacacucuacgcgguagcgacaaccauuauuacaccgaugaugcgccauaccaucgagaauacaacggcaaacauaucgcuaacagcuaucgcgaaccaggccgcaauccuuaugggcuuagacaagggcuggccaauuucaaagauggacaucggaguaccgcuacuugcgcugggcuguuacucacaagugaacccacuaacccucacagcggcagucuuaaugcuaguagcccacuacgcaaucauuggaccggggcugcaagcaaaagcgacacgagaagcccagaagagaacggcagccgggauuaugaaaaauccgacggucgauggaauuguugcaauagaccucgauccgguuguauacgacgccaaauucgagaaacaacucgggcaaauaaugcugcuaaucuuauguaccagccagaucuugcugaugcgcaccacgugggcccuaugugagucgaucacccuagcaaccggcccccucacuacccugugggaagggagcccgggaaaauucuggaauaccaccauugccguuagcauggccaauaucuuuaggggcucauaucucgccggagcgggccucgcguucagccugaugaaaagccuaggcggagggaggcgggguacaggagcacaaggcgagacacugggggaaaaguggaaaagacagcuaaaccaacuaucaaaaagcgaguucaacaccuacaagcgaagcgggauaauggaagucgacagguccgaagcgaaagaggguuuaaaacggggcgaaacaacgaaacacgccgucucccgcggaaccgcaaaacuacgcugguuuguggaacgaaaccucgucaagccagaagguaaagucauugaucuaggcuguggacgagggggaugguccuauuacugcgccgggcugaaaaagguaacagaggucaaaggcuauacgaaaggaggcccaggccacgaagaaccaaucccuauggccacauacggcuggaaccuagugaaacuacacagugggaaagacguauucuucauaccacccgagaagugugacacgcuccucugcgauaucggcgaaucaaguccaaaccccaccaucgaagaagggaggacucuucggguccuaaaaaugguugaaccguggcuaagagguaaccaguucugcaucaaaauccugaauccguacaugccgagcguuguugaaacccuugagcagaugcaacgcaaacacggaggaaugcuggugcggaaccccuugucgcggaacucaacccacgaaauguacuggguuucaugcggcacaggaaauaucgucuccgccguuaacaugacaucgagaauguugcucaaccgcuucacaauggcccacagaaaaccaacauacgagagggacguagacuuaggcgcagggacaagacaugucgccguugagccugagguggcaaaccuagacaucauaggacaacggaucgagaauauaaagcacgaacacaaaaguacguggcauuacgaugaagauaacccguauaaaacgugggcguaccacggaucauaugaggugaaaccgaguggaagugccagcagcauggucaacggcguggugaaauuacuaaccaaaccuugggacguuauacccaugguaacccaaaucgcaaugacagauacaaccccauucggccagcagcgcgucuucaaagagaaggucgacaccagaacacccaaggccaagcgcgggacggcccagaucauggaaguaacagccaaauggcuguggggcuuccucucucgaaauaagaaaccacggauaugcacuagggaagaguucacccgaaaaguaaggaguaacgcggccauuggcgcaguguucguggacgaaaaccaauggaacagcgcaaaagaagcagucgaagacgaacgauucugggauuuaguccacagggaaagagaacugcacaaacaagguaagugcgcgacguguguauauaacaugaugggaaaaagggaaaagaaacuaggggaguucggcaaagccaaaggcucacgggcaaucugguauauguggcucggagcccgcuuccuggaguucgaggcccucggauucaugaacgaagaccacugguucucgcgugaaaacagucuaucaggcgucgaaggggaagggcuucacaaauuagguuauauacugagggacaucucaaaaauccccggcgggaacauguacgccgacgacacggcgggcugggacacccgcauaaccgaagacgaccugcaaaacgaagcgaaaauaaccgacaucauggagccagagcacgcgcuacuggcgaaaagcaucuucaaacuaacuuaccaaaauaaaguuguccgcguacaacgcccugccaaaaacggaacuguaauggaugucaucucgcgacgagaccaacgcggcucgggccaggucggaacauacggcuuaaauacuuucacgaacauggaggcacaacucauacgacagauggaaucggaaggaaucuucagcccgagcgaacucgaaacaccuaaucucgcagguagaguauuagauuggcuugagaagcacggaguagagagacugaagagaauggccauaaguggagacgauugcguaguuaaacccaucgacgaccgauucgccgcggcccucacagcgcucaaugacaugggaaaaguccgaaaagauauaccgcaaugggaaccaucaaagggcuggaacgacuggcaacaaguaccauucugcagccaccacuuucaccagcugaucaugaaggacggaagagagauaguaguccccugucggaaccaagacgaguuagucgggagggcucgggucagccaaggggccggauggucccugcgggaaacagcauguuuaggcaaaaguuacgcccagauguggcaacuuauguauuuccacagacgcgaccuccggcuagcagcaaacgccauaugcucugcaguaccgguagacugggucccaacgagccgaacaaccuggucuauacaugcgcaucaucaauggaugaccacagaggacaugcucucagucuggaaucgggucuggauugaagaaaacccguggauggaggacaaaacucauaucucaagcuggggcgaugucccguaucugggcaaaagagaggaucaauggugcggaagccugaucggacuaaccgcccgagccacaugggcuacaaacauccaaguagcgaucaaccaagugaggcgacuaauaggcaacgaaaacuaccuggacuauaugaccuccaugaaaagguuuaaaaacgaaagcgauccggaaggagcacugugguag

SEQ ID NO: 24447 - RNA, 9879 nt, Artificial Sequence
  derived and/or modified CDS sequence (opt11) from DENV-1__GU131738__SS-prME
agcgucaccauguugcucaugcucaugcccacggccuuggcauuccauuugacuacacggggaggagaaccgcacaugaucgugacaaaacaggagcgggggaaaucccuacuguuuaaaacgucggcuggaguaaacaugugcacccuaauagccauggaccuuggcgaacucugugaagauacuaugaccuacaaaugcccaaggauuacggaggccgagcccgacgacguugacugcuggugcaacgccacagacacgugggucacauacggaacaugcucacagacgggagagcaccgacgcgacaaacggagcguagcucuggccccacacguaggccuuggauuagaaacacggacggaaacauggaugagcagcgaaggagcguggaaacaaauccaaaggguggagacuugggcgcuacgccacccuggcuucacuguaauagcccuguuuuuggcgcacgcgaucggaacgagcauaacgcagaaagggaucaucuucaucuuauugaugcuagucacccccagcauggccaugaggugugucgggauaggaucaagagauuuuguugaaggccucagcggagcaacguggguggacgugguccucgagcacggcaguugcguaaccaccauggcaaaagauaaaccgacacuagacauugagcugcuaaaaacggaagugacaaacccggccguccuacgcaaacugugcauugaggcgaaaauuuccaacacgacgaccgacuccagaugccccacacaaggagaggccacacuaauggaagaacaggacgcgaauuuugugugcagacggacauucguagaccgcggguggggcaacggcuguggccuuuucggaaaaggcucccuaauuaccugcgccaaauucaaaugugugacaaaacuggaggguaaaauagugcaauaugagaaccugaaauacagcgucauaguuaccguccauaccggcgaccaacaucagguagggaacgaaagcaccgagcacggcacgacugccacgaucacaccacaagccccaacgucagaaauacagcucaccgauuacggagcacuaacccuggauuguaguccacgaacgggguuagacuuuaacgaaaugguccuacugacaaugaaagagaaaaguuggcucguacacaaacagugguuuuuagaccucccgcuacccuggacgucuggggcgucuacgagccaagagacauggaaccgccaagaccucuuaguaacguucaaaacagcgcacgcuaaaaagcaggaggucguaguguugggcucgcaagaaggagccaugcacacagcccuaacgggcgcaacggaaauacaaacgucagguaccacaaccaucuucgcuggacaccugaagugcagguuaaagauggauaaacuaacgcuaaaaggaaugaguuaugugauguguacagguucguucaaacuagaaaaagaagucgccgagacacaacacgguaccguccuaguacagaucaaguaugagggaacggaugcuccuuguaaaauaccguucaguacucaggacgaaaagggagugauacagaacggacgccucaucacggcaaacccgauaguaaccgacaaagagaaaccggugaacauagaggcggaaccgcccuuuggcgaauccuacauaguuauaggcgcgggcgagaaagcccucaagcugucuugguucaagaaaggcuccucgauaggaaaaauguuugaggcaacugcccgcggggcgagacguauggcaaucuuaggcgauacagcgugggacuucggcagcguaggaggcgucuuuaccagcguagggaaacucguucaccaaaucuucggcaccgccuacggcguucuauucucaggcguaagcuggacaaugaagauaggaauaggaguuuuacucaccugguuaggacugaacucuagaucaacaucucuauccaugacaugcaucgcggugggacuggucacgcuauaccuuggugugauggugcaagcagacagcggguguguaauaaauuggaaaggccgagaacucaaaugcggcagcgguauauucgucaccaaugaaguccauacuuggacggaacaauacaaguuccaagccgacagcccgaaacgacugagugcugcaaucggaaaggcaugggaagagggagucugcgggauaagauccgccacccgucuugagaauaucauguggaaacaaaucucuaaugaacuuaaccacaucuugcucgaaaacgauaugaaguucacaguaguggugggggacgugguugggauacuugcucagggcaagaaaaugaucaggccacaaccuauggaacacaaguacagcuggaaaucguggggcaaagccaaaaucauaggggcagauguucaaaacaccaccuuuauaauugacggaccgaacacgccggaauguccugaugaucaacgcgccuggaacauaugggaggucgaagacuaugguuucgggaucuuuacgacaaacaucuggcucaaacucagagauuccuauacacaaguaugcgaccacaggcugaugagugcagccauuaaagacuccaaagcagugcacgccgacaugggauacuggaucgagucagagaagaaugaaacauggaaguuagcgagagcaaguuucauagagguaaaaacaugcauuuggccaaaaagccacacccuauggagcaacggcguguuagagagugaaaugaucauccccaagaucuaugguggacccaucagccagcacaacuaccguccuggauacuucacacaaacggcugggccguggcaucucgggaagcuggagcuagauuuugaccuaugugaagggaccacaguggugguugacgaacacugcgggaaccgcggaccaucccuaagaacaacuacagucacgggaaagauaauacacgaguggugcuguagaucuuguacacuaccaccguuacgcuucaaaggggaagacgggugcugguaugguauggaaauacgcccggucaaggaaaaggaggagaaccucgucaaaagcauggucucagccgggucgggagaagucgacagcuucucacuagggcuguugugcauaucaauaaugaucgaggaagucaugcgguccagauggagccguaaaaugcugaugaccgggacacucgcagucuuucuuuuacuuaucauggggcagcuuaccuggaacgaccuaauacgauuauguauuaugguuggggcaaacgccagcgaccgcaugggaauggggacgacauacuuagcacugauggccacguucaaaaugagaccgauguucgccguagggcuacuguucagaagacugacgagcagggaaguccuacuacuuacgauuggacuaagucuaguagccaguguagaacugccaaacucgcuagaggagcucggagauggccuagcaaugggaauaaugauacuaaaauuguuaacggacuuccagagucaccaacuaugggcuacacuacugagccuaacguuuauaaaaacaacucuaagccuacacuacgcauggaaaacaauggcaauggugcucagcaucguaagccuguuuccccuaugucuuuccacgacaagccagaagaccacguggcucccgguccugcucggcagccuggggugcaaaccgcucacgauguuccuaauaacugagaacaaaaucuggggaaggaaaaguuggccccugaacgagggcauaauggcagugggcgucgugagcauacuguugagcagcuugcucaaaaaugauguaccccuagcaggcccguuaauagcgggaggcaugcucaucgcuuguuauguaaucagcggguccagcgccgacuugagucuugaaaaggcagcugaaguaagcugggaagaggaggccgagcacuccggcgcgagccauaacaucuuagucgaaguccaggacgacgguacaaugaagauuaaagacgaagagagggacgacaccuuaaccauacuucucaaagccacguuacuugcgguaagcggcgucuauccacuaucaaucccagcuacgcuauucguaugguacuucuggcaaaagaagaagcaacgcucagguguucuaugggacacaccaucuccgccagagguggaacgggcaguucucgacgacgguauauaccgaaucaugcaacggggccuacuugggcgaagucaagucgguguuggcguauuccaagaaaacgucuuucauacaauguggcacguaacuagaggggcuguauuaauguaccaggggaaaagacuggagccaagcugggccagcgucaagaaagaccuaaucagcuacggaggaggcuggcggcugcaaggcucuuggaacacuggagaggaaguacaggugaucgcaguggagcccggcaaaaacccaaagaacgugcagacagcgcccggaacauucaagacaccggaaggagaaguaggggcgauagcgcuggacuucaagccaggaacgagcgggagccccauagugaaucgcgaaggcaagauagugggccuauacggcaacgggguggugacaacaaguggaacguacguaagugcaauugcgcaagcaaaagcaucacaggagggaccucugcccgaaauagaagacgaaguguuccgaaagagaaaccuaaccaucauggaccuccauccggguagcggaaaaacacgcagguacuuaccggcuauaguuagggaagcaauaaaacggaagcuaaggacccuaauccuagcacccacgcgcguaguggcgagugaaauggcggaggcgcugaagggaaugccuauccgcuaccagacgacggcagugaaauccgaacacacagggaaggaaauaguagaccuaaugugccaugcgacguucaccaugcgacuacucagccccgucagaguacccaauuacaauaugaucauuauggaugaggcgcacuuuacagaucccucaagcaucgcagcacgaggcuacaucagcacgcgagucgggaugggggaagcggccgcaaucuucaugacagcaaccccaccaggaagcgucgaagccuucccacaaucgaacgcaguaauccaagaugaggaacgagacaucccgggacgcagcuggaacagugguuacgaauggauaacggacuucccgggaaaaacugucugguucgggccaaccauaaaguccggaaacgacaucgcaaacugucuccguaaaaacgggaaaagagugauccaacuauccaggaagaccuucgacacggaauaucagaagacgaaaaauaaugacugggacuacguagggacaacugacauaagcgaaaugggugcgaacuuccgagcagaucgagucauagacccucgccgaugucuaaagccagugauccuuaaggacggcccagaacgagucauacuagcagggccgaugcccguaacagucgcuuccgcagcacagagacgaggccggaucggacgcaaccacaauaaggagggagaucaauacauauauauggggcaacccuugaacaacgacgaggaucaugcgcacuggacagaagccaagaugcuucuagacaauauuaacaccccggaaggaaucaucccugcacuauucgaacccgagagagaaaagucagccgccauagacggagaguaucgccuaagaggugaggcaagaaaaacauucguagagcuaaugcgccgaggagaucucccuguguggcuaucauacaaaguagcuagcgaaggcuuccaguacagcgaucgaagauggugcuuugacggggaaagaaauaaccaggucuuagaggaaaacauggacguugaaauauggaccaaggaaggggagcgaaagaaacuacggccgagauggcuagacgcacgaacuuacucagacccucucgcccuacgugaguucaaggaauuugcggcgggacgacgcagcguaagcggagauuugauacuagaaauuggaaagcuaccgcagcaccuaacacagcgugcucaaaaugcuuuggauaaccuaguaaugcuccauaacagugaacagggaggcagagcauacagacacgcaauggaggagcuaccagauacaauagaaacacucauguuacucgcccugaucgcgguccuaacaggagggguaacacucuucuuccuaagugguagaggccuagguaagacgucuauaggauugcucugugucauggcgaguucaguacuccuguggauggccagcguagagccacacuggauugccgcuucaauaauucuagaguucuuucucauggugcuccucauuccagagccggacagacagcgaacaccucaagauaaccaacuagcauacguagucaucggccugcuauuuaugauacugacgguagccgcuaaugaaaugggccuccucgaaaccaccaagaaagaccuagggaucggucacgucgcagucgagaaucaccaccacgccacaaugcuggacgucgacuugcacccggcauccgcguggacauuauaugcaguggcgaccaccauaauaacaccaaugaugagacacaccauagaaaacacaacagcaaauaucagccuaaccgcgaucgcuaaccaggcggccauccucaugggacuggacaaaggguggcccauaagcaaaauggacauaggcguuccacugcuggcauugggcugcuacagccaggucaauccgcuaacgcuuaccgccgcgguuuugaugcuaguggcgcauuacgcaauaauaggccccggccuacaggccaaagcaaccagagaagcccaaaagaggaccgcagcgggaaucaugaagaacccgacaguagauggcauaguggcuaucgaccuagacccaguagucuacgacgcgaaauucgagaaacaacugggacaaaucauguugcucauccucugcacgucccaaauucucuugaugcgaacaaccugggcgcucugugaaucuauaacauuggcgaccgggccccuaaccacgcucugggagggcagcccggggaaauucuggaacaccacaaucgcugucucuauggccaacauauuccgggggagcuaccuagcaggcgccggacuagcguucagucuaaugaagucuuugggcggcggacgaaggggcaccggcgcccaaggggagacacuaggggaaaaauggaaacggcaacucaaccaacucucaaaaucggaauuuaauauuuauaagcgaagcggcauuauggagguagacagaagcgaggcaaaggagggacuuaaacgcggagagacgaccaggcacgccgucagccgcggaacagcuaagcucaggugguuuguagaacgaaauuuagucaaacccgagggaaaaguaauagaucugggcugcggaagaggugguuggucguauuacugcgcgggccucaagaaagugacagaggucaaaggauacacgaagggcggaccaggccacgaagaacccaucccaauggccacauauggcuggaacuuggucaaacugcauaguggaaaggacguauucuucaccccaccugaaaaaugcgacacauugcuaugcgacauuggcgagucaucaccaaacccaacaauagaagaaggacggacucuccgugucuuaaagauggucgagcccuggcucagaggaaaccaauucugcauaaaaauccucaauccauacaugccaucuguaguagaaacacuggaacagaugcaacggaagcauggcgggaugcuaguucgaaacccccuuagucguaacaguacccacgaaauguacuggguaagcugcgggacaggaaauaucgugucagccgugaacaugacaucgagaauguuguugaaucgauucaccauggcgcacagaaagcccacauacgagcgcgacguagaccuaggagcagggacccgucacguagccguugagcccgagguggcgaaccuagacauaauaggccaacgaauagagaauauaaaacaugagcacaagucgacauggcacuacgacgaagauaauccguauaaaacaugggcguaccacggcagcuacgaagucaagccgucggggagcgcgagcaguauggucaauggcguggugaagcuacugacuaaaccgugggacgucaucccaauggucacacaaaucgccaugaccgauaccacuccauuuggacagcaaagaguguucaaggagaaaguugauaccagaacgccuaaggcgaaaagggggacagcgcaaauaauggaagucacggcgcgauggcuguggggauuucucagccguaauaaaaagccaagaauuugcacucgagaggaguuuacgaggaagguaagguccaacgcugcgauaggagccguguucguggacgagaaccaauggaacagcgccaaggaagcaguggaggacgaaagauucugggaucugggccagaaggaacgggagcuucauaagcaaggcaaaugcgcgacguguguguauaacaugauggggaagagagagaagaaacugggagaguucgguaaagccaagggaagcagggcgauaugguacauguggcugggagcacgauuccucgaguuugaagcccucggcuucaugaacgaggaccacugguuuagccgagagaacagcuuauccgguguagagggagaaggccuccauaaacugggauauauacugagagacauuaguaagauuccaggcggcaacauguacgcagacgacacagcgggaugggacacacgaauaacagaggacgaccuccagaaugaagcgaaaauaacagacauaauggagcccgaacacgcgcuccuagcaacgucaauauucaaacucacguaccagaauaaaguggugcgaguccagaggccugccaagaacggaacuguaauggacgucaucucgcgccgagaccaaagaggaaguggacaaguagggaccuacggccugaacacauucaccaacauggaggcgcaguuaaucaggcaaauggaauccgagggcaucuucuuaccguccgagcuagaaacgcccaacuuagcggaaagaguccucgacuggcuagagaaguacggugucgaaagacucaagcggauggccauaucaggggaugauuguguggucaaaccuauagacgaccgguuugccacggcacucacagcccugaaugacauggguaaaguucggaaggacaucccacagugggaacccuccaaaggguggaacgacuggcaacaggugccauucugcucgcaccacuuccaccagcuaauaaugaaggaugguagagaaaucgugguacccugccggaaccaagacgaacuggugggaagggcgcguguaagccagggggcgggcuggucccucagagagaccgccugccucggaaagagcuacgcacaaauguggcaacuaauguauuuccaccgccgcgaucuuaggcuagccgccaacgcaauuugcagugcaguaccgguagacugggucccgacaucgcgcacgaccuggucaauacaugcccaucaccaguggaugacaacagaagacauguuaagcguauggaacaggguauggauugaagaaaaucccuggauggaagacaaaacccacgucuccaguuggggagacguaccauaccucggaaagcgcgaagaccaauggugcgguagccugauaggccuaacggcacgagcgacgugggcgaguaacauucaaguagccauaaaccaagugagaagacuuaucggaaacgaaaacuaccuagacuacaugacgaguaugaaacgauucaaaaacgaaggggaccccgaaggugcucugugguga

SEQ ID NO: 24448 - RNA, 9879 nt, Artificial Sequence
  derived and/or modified CDS sequence (opt11) from DENV-1__JF937604__SS-prME
agcgugaccaugcugcucaugcugaugcccacugccuuagccuuucaccucaccacccggggcggggagccccauaugaucguauccaagcaagaacggggcaaaucccuguuguucaaaaccucagcuggggugaauaugugcacgcucaucgccauggaccugggcgagcugugugaggacaccaugacuuacaagugcccccguaucacugagaccgagcccgaugacguugacugcuggugcaacgccacggacacuugggucaccuacggcaccuguagucagacgggcgagcaccggagggauaagcggucagucgcccuggcgccgcacgugggcuuaggccuggagacccgcaccgagaccuggaugagcuccgagggagccuggaagcagauucaacgggucgagacgugggcccugcgccaccccggguucaccgugaucgccuuauuccuggcccacgcgauuggcacgucaaucacccagaaggggauuaucuucaucuuacugaugcuggugacgcccuccauggccaugcggugugucgggaucggcucucgcgacuuuguggaaggccugaguggcgcgaccuggguggauguagugcucgagcacgggagcugcgugaccaccauggccaaggacaagcccacgcucgauaucgagcuccugaagaccgaagucaccaaucccgcagugcugcgaaagcucugcaucgaggcgaagaucuccaacaccacaacagacagccgcuguccgacccagggcgaggccacucuagucgaggagcaggacgcuaacuucgucugccggcgcacguuugucgaucggggcugggguaacgggugcgggcuauucggcaagggaucucucauaacgugcgcuaaguuuaaaugcguuacaaagcuggaggguaaaaucguccaauacgaaaaccugaaguacagcgugauugugaccguucacacgggcgaccaacaccagguggggaacgaguccaccgagcauggcaccaccgccacgaucacgccccaggccccaacgaccgagauccagcucaccgacuacggggcccuaacgcuugacugcucuccccggaccggacuagauuucaacgagaugguccugcugaccaugaaagagaaguccuggcucgugcauaagcagugguuccuggaccugccgcuacccuggaccagcggugcuucgacgucccaggagaccuggaaccggcaggaccugcuggugaccuucaaaaccgcccacgccaaaaagcaggagguagugguccucggcagccaggaaggugcgaugcacacggccuuaaccggggcaacagagauucaaaccuccggcacgaccaccaucuucgccgggcaccugaagugcagacucaaaauggauaaacugacccuaaaaggcaugagcuacgugauguguacgggguccuuuaagcuagagaaagaaguggcugagacccagcacggaaccguguuagugcagaucaaguacgaggguacagaugcucccuguaagauccccuucagcacgcaagaugagaagggugugacgcagaacggucggcucaucaccgcuaauccgauagucacggacaaagagaagcccgugaacauugaagccgagccgcccuucggugaaucauacaucgugaucggcgccggcgagaaggcccugaaguugagcugguucaagaagggguccucgaucggcaagauguucgaggcuacggcccgcggggcccgucgcauggccauccuuggcgauacggcaugggacuucggguccauaggcggcguguucaccagcguggggaaacuggugcaccagacuuucggcacggccuacggaguccuguucuccgguguguccuggaccaugaagauuggcaucggggugcugcugacguggcucggacuaaauucccgcuccaccucccugagcaugacaugcauagcaguuggccucgucacccuguaccugggugugaugguccaggccgacuccgggugugucauaaacuggaaaggccgggagcugaagugcgggagcggcaucuucgugaccaacgaagugcauaccuggacggagcaguacaaguuccaggcugacagcccgaagcgccuuuccgccgccaucgggaaggcaugggaggagggcgucugcggcauccgaagcgccacgcgccucgaaaacaucauguggaagcagaucuccaacgagcucaaccacauccugcuggaaaacgacaugaaguuuacggucguggucggggacguugccggcauuuuagcgcaggggaagaaaaugauacgcccccagcccauggaauacaaguacagcuggaaguccugggguaaggcuaagaucauuggcgcggaugugcaaaacaccaccuucauaauagacggucccaacacgccggaaugccccgacgaccagcgcgccuggaacauaugggaggucgaggacuacggcuucgggaucuucaccaccaacaucugguuaaagcuccgagauagcuauacccaggucugcgaccaucgccucauguccgcggcuaucaaagacagcaaggcaguacaugcggacaugggcuacuggaucgaguccgagaagaacgagacguggaaguuagcccgggcgucauucaucgaggucaagacaugcaucuggccaaagucccacacccuguggagcaacggcguccucgaauccgaaaugaucauccccaagaucuacgggggcccuaucucacaacacaacuaucgccccggguacuucacacaaaccgccggcccuuggcaccuggggaagcuggagcuugacuucgaccugugugagggcacaacgguugugguagaugagcacuguggcaauagggggccgucccugcgcaccacgaccgugaccgguaaaauaauccacgaguggugcugccgaagcugcacccugccgccccuccguuucagaggggaagauggcugcugguacgggauggaaauccgccccgucaaagagaaggaagagaaccuggugaaguccauggucucggcugguagcggggaaguggacuccuucucucuugggcuucugugcaucuccauuaugaucgaagaggugaugcggagccgcuggucaagaaagaugcucaugacuggcacacuggcugucuucuuccuccucaucauggggcagcugaccuggaaugaucugauccgccucugcaucauggucggcgcuaacgcgagcgaucgcauggggaugggaacuacguaccuggcacugauggccacguucaaaaugcggccgauguucgccguaggauuauuguuccgccgccuaacgucucgcgagguccuccugcugaccaucggacucagccugguggcauccguggagcugcccaauagccucgaggaauugggagacgggcuggcgaugggaaucaugauacugaagcuccugacggacuuccaguccuaucagcucugggcuacacugcugagccucacauucauuaagaccacuuucaguuugcacuacgccuggaagacgauggccaugguccugagcaucgugucccucuucccccugugccugucuaccaccucccagaaaacgacguggcuccccgugcugcugggcagccucggauguaagccgcugaccauguuccugaucgcggaaaacaagaucugggggcggcgauccuggcccuugaacgaggguauuauggccgucggcauugugagcauacugcugagcucccuccugaagaaugaugugccccuggccggaccccucauagcgggcgguaugcucauugccugcuaugucaucagcggguccagcgcggauuuauccuuggagaaggccgccgagguuagcugggaagaggaggcagagcauagcggcgccagccauaacaucuugguggagguccaggacgaugggacgaugaaaaucaaagaugaggaacgggacgacacccuuacgauccuccugaaggcuacacugcuggccguguccgggguguacccgcuaagcaucccggcuacacuguucgugugguacuuuuggcagaagaagaagcagcgcuccggggugcucugggauacgcccucaccgcccgaaguggagcgggcgguucuggacgaugguaucuaccgcaucaugcagcggggacugcuggggcgcucucaggugggcgucggggucuuccaggagaacguuuuucauacgauguggcacgugacacggggcgccguccucauguaccaagggaagcgacuggaacccagcugggcguccgucaagaaagaucugaucagcuacggcggcggguggcggcuccaaggguucuggaacacgggggaggagguucaggugaucgccguagagcccgggaaaaaccccaagaacgugcagaccgcccccggaacguucaagacccccgagggcgaagucggagccauagcccuggauuuuaaacccgguaccuccggcucacccauugucaaccgugaaggcaaaauuguaggccucuauggcaacggggucgugaccacauccggcacauacgugagcgcgaucgcccaggcgaaggcaagccaggaggggccguuacccgagaucgaggaugaggucuuccggaagagaaaccugacuaucauggacuugcaucccggaaguggcaagacccggcgcuaccucccggcaauuguccgcgaagccauaaagcgcaagcugcggacgcugauucucgcccccacacgggugguggccagcgagauggccgaagcgcuaaagggcaugccaauucgcuaucagaccaccgccguuaaguccgagcauacggggaaggagaucguggaccuaaugugccacgcgacguuuacaaugcggcucuugagccccguccgcgugccgaacuacaauaugaucaucauggacgaggcgcacuucaccgaccccaguagcaucgcggcgaggggguauaucucuacgagggugggcaugggcgaggcagccgcuaucuuuaugaccgccaccccgccuggcagcgucgaggcguuuccccagaguaacgccgugauucaggaugaggagcgggacauaccugagcgaagcuggaacagugguuacgaguggaucaccgacuucccaggcaaaacggugugguuuguucccagcaucaagucaggcaaugacauagccaacugccugcggaagaacgggaagcgcgucauccagcucagccgaaagaccuucgauaccgaguaucagaagaccaagaacaaugacugggacuauguggucacgaccgauaucagcgagaugggagcaaauuuccgggcggaccggguaauagacccacgacguugccugaagcccgugauacugaaggacggccccgagagaguuauauuggcgggcccaaugccggucaccgucgcgagcgccgcccaacggcgagggcgaaucgggcgcaaccauaacaaggaaggcgaccaguacauuuacauggggcagccccuaaacaacgacgaggaucacgcccacuggacggaggccaagaugcuucucgacaacaucaacacgcccgagggcauaauccccgcccuguucgaacccgagcgcgagaaguccgccgccaucgacggggaguaccggcuucgcggugaggcucggaagacauuuguggagcucaugcgccgcggggaccugcccguuuggcugagcuacaaggucgcuagugagggcuuucaguacagcgaccgccgguggugcuuugauggugaaaggaacaaccaaguccucgaagagaauauggacguggagauuuggacaaaagagggggaacggaaaaagcugcgcccccggugguuggacgcacggaccuaugcagacccgcucgcguuacgggaguucaaagaguucgcagccggacgccggagcgucaguggggaccugauccucgagaucgguaagcugccgcaacaccuuacgcaacgcgcccagaacgccuuggacaaccugguuaugcugcauaacagcgagcaaggcgggcgagcguaccgccaugccauggaggagcugcccgacaccaucgagacacugaugcugcucgcccugaucgccgugcugaccggcggggucacccucuucuuucuguccggccggggacuuggcaaaacgucgaucggccuccugugcgugauggccuccagcgugcuccucuggauggcguccgucgagccucacuggauugccgccagcaucauacuggaguucuuccugaugguguuauuaaucccugagccggaccgccagcgcacaccccaggauaaccagcuggccuacguggucaucgggcugcuguucaugauucugacgguagccgcgaacgaaaugggccuucuggagaccacgaagaaggauuuggggaucggacacguagcugucgagaaccaccaccacgccgcgaugcucgacguggaccugcaccccgccuccgcauggacacuauacgccguggcaaccaccaucaucacgccgaugaugcgccacaccauugagaacaccaccgccaacauuucccucacggccaucgcgaaccaggccgcaauucuaauggggcuagacaagggauggcccaucuccaaaauggauaucgggguaccgcuccuggcccuugggugcuacagucaggugaacccgcucaccuuaacugcggccgugcuuaugcucgucgcccacuacgccaucauagggccgggacugcaggccaaggcgacccgugaggcgcagaagaggacggcugcuggcaucaugaaaaaccccacaguggacgggauuguggcuaucgaccuggacccggucguauaugacgcaaaauucgagaagcagcuaggucaaaucauguugcugauauugugcaccucccagauccuacugaugcgcaccacgugggccuuaugcgaguccaucacauuggcaacugggccccugaccacguugugggaagggagcccuggaaaguucuggaacaccaccaucgcaguaagcauggcuaauaucuuccggggguccuaccuggcgggagccggccuggccuucagcuuaaugaagucccucgggggagggcgccgggggacuggugcccagggugagacccugggugagaaguggaagagacagcucaaccagcuaagcaagucugaauuuaauacuuacaaaaaguccgggaucauggaggucgacagaagcgaggccaaagaaggacuaaagcgcggcgaaaccacgaagcacgccgugucccggggaacggcaaagcuccgcugguucguggagaggaaccuugucaagcccgagggcaagguuauagaccuuggcugcggccgcgggggcuggucuuacuacugcgccgggcugaaaaaggugaccgaggucaagggguacaccaagggcggccccggccacgaggagcccaucccuauggcuaccuacggguggaaccucgugaagcugcacuccggcaaggacguuuucuucauacccccugagaaaugcgauacauuacugugcgacaucggggagagcuccccgaacccgacuaucgaggagggaagaacccugcgcguccugaaaaugguggagccauggcuccgggggaaccaguucugcaucaagauccugaaccccuacaugcccagcgugguagaaacccuggagcagaugcaacgcaagcacggcggcaugcucgugcggaacccguuaucccggaacagcacccaugagauguacuggguauccugcgggacgggcaacaucguuagcgcagugaacaugaccucccggaugcugcugaaucgcuucacgauggcucacagaaaacccaccuacgagcgggacguagaccugggggccgguacgcgccacgucgccguugaaccagagguggccaaccuagacaucauuggccagaggaucgagaacauuaagcacgagcacaagagcacguggcacuaugacgaggacaacccguacaagaccugggcuuaucacggcuccuacgaagucaagccgaguggcuccgcgucauccauggugaacggggucgugaagcuccugacaaagcccugggacgugauccccauggucacgcagaucgccaugaccgacacaaccccauucggccagcagcgcguuuuuaaggagaaaguagacacgcggaccccgaaggccaagcaggggaccgcgcaaaucauggaggucaccgcuaaguggcuguggggcuuccugagccgcaacaagaaaccccgcaucugcacucgggaggaguucacccgcaaggugaggucuaacgccgcaauaggugcugucuuuguugacgagaaccaauggaacuccgccaaggaggccguggaggacgagcgcuucugggaccugguucaccgcgagcgcgaguugcacaagcaagggaagugcgcuaccugugucuacaacaugaugggcaaacgcgaaaagaaacucggggaguuugguaaggccaaggggagccgggccaucugguauauguggcugggggcacgcuuccuggaguucgaggcccucggcuucaugaacgaggaccacugguucucucgggagaacagccuguccggcguggagggcgaagggcugcacaaacuaggcuacauccugcgagacaucagccagaucccggguggcaauauguacgccgacgacaccgcuggaugggacacgcggaucacagaggacgaccuucaaaaugaggcccguaucacggacaucauggagccagagcacgcucuccuggccaaguccaucuucaaacugaccuaucagaauaaggugguccgggugcagcgcccugccaagaacgggacggugauggacguaaucagcaggcgggaccagaggggcucgggucaggugggcaccuacggccugaacaccuucacaaacauggaagcucagcugauucggcagauggagagcgaggggaucuucuccccaagcgagcuggaaacgccaaaccuugccgagagagugcuggauuggcuggagaaguacggcguagagcgucucaagaggauggcgauuuccggggacgacugcguggucaagccaaucgacgauagauucgccacagcccugaccgcccugaacgacaugggcaaggucaggaaggacaucccccagugggagccuagcaaggguuggaacgacuggcagcaggucccguucugcucccaccacuuccaccaacucaucaugaaggacggcagagagaucguggucccgugccgaaaccaggacgagcugguaggccgggcccggguuagccagggagcgggcuggucccugcgugagaccgccugccuaggaaagagcuaugcccagauguggcagcugauguacuuucaccgccgugaccugcgucucgccgcgaacgccaucugcagcgccguuccaguagacuggauccccacgucccggaccaccuggucaauacacgcccaucaccaauggaugaccaccgaggacaugcuguccguguggaaucgcguauggauagaggaaaacccguggauggaggacaagacccauaucagcuccuggggcgacguaccuuaccuggggaagcgggaggaucaguggugcgggagccucaucggccuaaccgcccgggcgacaugggccaccaacauucagguggccaucaaccaaguccgccgguugauagguaaugagaacuaccucgacuacaugacguccaugaagcgcuucaagaacgagagcgaccccgagggcgccuugugguga

SEQ ID NO: 24449 - RNA, 9879 nt, Artificial Sequence
  derived and/or modified CDS sequence (opt11) from DENV-1__JF937605__SS-prME
agcguuacaaugcugcucaugcugaugcccacggcccuggcguuccaccucaccacacgugguggggagccccacaugaucgucagcaagcaggagcgggggaagagucuucuguucaagaccuccgccggcgucaacaugugcacccucaucgccauggauuuaggcgagcuuugcgaggauacgaugaccuauaagugcccccgcaucaccgaaaccgagcccgacgacguugacugcuggugcaacgccacggauaccugggugaccuaugggaccugcucccagacgggcgagcaccggcgcgacaagcguucaguggcgcuggcuccccacguuggccugggguuggagacgagaaccgagacuuggaugagcagcgagggcgcauggaagcagauucaacggguggagacgugggcacuccgccaccccggguucacggugaucgcccuguuccuugcccacgcgaucggcacuagcaucacccagaaggggauuaucuucaucuuacugauguuaguaacaccuuccauggcaaugaggugugugggcaucggcagccgcgauuuuguugaggggcuguccggcgccaccuggguggauguggugcuggagcacgggucgugcgucaccaccauggccaaggacaagcccacgcuggacauagaguugcugaagaccgaagucaccaaucccgccguguugcggaaacuaugcauugaggcgaagaucuccaacaccacgacggacagccgauguccuacucagggcgaggcaacccugguggaggaacaggacgcgaacuucguuugcaggcgcacguuuguggacaggggcugggggaacggcugcgggcuguucgguaaggggucccucaucacgugcgccaaguuuaaguguguaaccaaacuggagggcaagauuguccaguacgaaaaccugaaauacucugugaucgugaccguccacacgggcgaucagcaucaggugggaaacgagagcacugagcacgguacgaccgccacgaucacgccccaggcgccgaccacugagauccagcucaccgacuacggugccuuaacgcuagacugcagcccccgcaccggccucgauuucaacgagaugguccuccugaccaugaaggagaaauccuggcucgugcauaagcaaugguuccucgaccugccccuccccuggaccagcggcgccagcacgcugcaggagaccuggaaccgucaggaccuguuggugacauucaaaacagcccacgccaaaaagcaagaagucguggugcugggcucccaggagggcgcaaugcacacggcccugacuggggcuaccgagauccagaccagcggaacgaccaccaucuucgcggggcaucucaagugccgccugaagauggacaagcugacucucaagggcauguccuacgucaugugcacgggcagcuucaagcuggagaaggaaguggccgaaacccaacacggcaccguucuuguccagaucaaauacgagggcaccgacgcccccugcaagauccccuuuucaacucaggacgagaagggggugacccagaauggacggcugaucaccgccaacccgaucguaacagacaaggagaagcccgucaacaucgaagccgagccgcccuuuggugagagcuacauugugaucggggccggcgagaaggcguuaaaguugaguugguucaagaaaggguccucaaucggcaagauguucgaggcuacggcucgcggggcccgccguauggcuauccugggcgauaccgcaugggacuuugggagcaucggcggcguguuuaccagcguagggaaacucgugcaccagauauucggcaccgccuaugggguguuauucagcgguguuuccuggacuaugaagaucgggaucggcguucugcucacauggcugggucugaacucacgcucgaccagucucucaaugacaugcaucgccguggggcugguuacguuauaccucggcgugauggugcaggccgacuccgggugcgugaucaacuggaagggccgggaguugaaguguggguccgggaucuuugugaccaacgaggugcacaccuggacagagcaguacaaguuccaggccgacaguccgaaacgccugagugcggccaucgggaaggccugggaggagggggucugcggcauccgaucggccaccaggcucgagaacaucauguggaagcagaucagcaacgagcuaaaccacauacuccucgagaacgacaugaaguuuacaguuguagucggggacgucgccggcauccuggcccaggggaagaagaugaucagaccccagcccauggaguacaaguacagcuggaaguccuggggcaaggccaagaucauaggcgccgacgugcagaacaccacauuuaucauugacggacccaacaccccugagugucccgacgaccagagagccuggaacauuugggaaguggaggacuacggcuucgggauauucacgacuaacaucugguugaagcugcgggacaguuacacccaaguuugcgaccaccgccugaugucggcggccauuaaggacuccaaggccguacaugcggauaugggcuacuggaucgaaagcgagaagaacgagaccuggaaguuagcgcgggcguccuucauagaggucaagacgugcaucuggcccaaaucacacacgcucugguccaacggggugcuggaaagcgagaugaucauaccaaagauauacggggggccgaucucccagcacaacuaucgccccggguauuucacacaagcugccggccccuggcaccuggggaagcucgagcucgacuuugaccugugcgaggggaccacgguagucguggacgagcacugcggcaacagagggccgagccuccggaccacuaccgugaccgggaagauaauacacgaguggugcugccggucuugcacgcugccgccccugcgauuccguggggaagacggcugcugguaugggauggagauucgccccgucaaggagaaggaggagaaccucgucaagagcaugguguccgccggcagcggcgaaguagacagcuucucucugggguugcucugcauaagcaucaugaucgaagagguuaugcggucccgcuggagccggcgcaugcugaugacuggcacccuugccguguucuucuuguuaaucaugggucagcugacguggaacgaccugaucaggcugugcauuauggucggggcuaaugccuccgaccggauggggaugggcaccaccuacuuagcccucauggcgaccuucaaaaugcgcccgauguuugccgugggccuccuguuucggcgacucaccagccgcgaggugcugcuacucacaaucgggcuaucccuggucgccucuguggaguuacccaacucgcuggaggaacugggagacggucucgccauggggauaaugauacugaaguuacucaccgauuuccaaucucaccaguugugggccacacugcugucacugacguucaucaagaccaccuuuagccugcauuacgcuuggaagaccauggcaaugguccuuucaaucgugagccucuucccguuaugccucuccacgaccagccagaagacuacguggcugcccgugcuuuuaggcucauuaggguguaagccgcugaccauguuccucauugccgagaacaagaucuggggccgccggagcuggccccugaacgaagggaucauggccgucggcaucguguccaucuuacucucuagcuuacugaagaaugacguaccccuggcagggcccuugaucgccggcgguauguugauagcauguuacguuaucuccgggagcuccgccgaccucagccuggagaaggccgccaaaguuuccugggaggaggaggccgaacauaguggggccucacacaauauccugguggagguccaagacgacgggaccaugaaaaucaaagacgaggagcgcgacgacacgcucaccauucugcugaaggccacgcuccuggccgugucaggcgucuacccguuauccauaccagcgacucuguucgucugguacuucuggcagaagaagaagcagcguagcggggugcugugggauacgcccaguccucccgagguugagcgcgccguauuggacgacggcaucuauagaaucaugcagcgcggcuuguuaggccgaagccaaguuggcgugggggucuuccaggaaaacguguuccacaccauguggcacgugacccggggcgcgguccugauguaccaggggaagcggcuggaacccuccugggcaaacgugaagaaagaccucaucagcuacggcggcggguggcgccuccagggcuccuggaacacgggggaggagguucaggucaucgcaguugagccgggcaagaaucccaagaacguucagaccgcucccgggacauucaaaacccccgagggagaggucggcgcuaucgcucuggacuucaagcccgguacgagcggcuccccgaucgugaaccgggaggggaagaucguuggacucuaugggaauggggucgugaccacuagcggcaccuacguguccgccauugcacaggcaaaggccagccaggaagggccucugcccgagaucgaggacgagguauuccgcaagcggaaccugacgauuauggaccugcauccaggcucaggcaagacccgucguuaccugccggcaaucgugcgcgaggccaucaagcgcaagcuacggacccucauccuggcccccacccgcguggucgcauccgagauggcagaggccuuaaagggcaugccuauaagauaccagacgaccgccgucaagagcgagcacacuggcaaagagaucguggaucugaugugccaugccaccuuuaccaugcgccugcugucgccaguccgggugcccaauuacaacaugaucaucauggacgaggcucacuucaccgaccccagcuccaucgcggcccgcggcuacauaagcaccaggguggguaugggggaggcagccgcuaucuucaugaccgcgacgcccccuggaagugucgaggcguucccgcaaagcaacgccgucauacaggacgaggaacgcgacauccccgagagguccuggaacagcggguacgaguggauaaccgacuuccccggcaagaccgucugguucguaccguccauaaagagcggcaacgauaucgccaacuguuugcgcaaaaacgggaagcggguaauacagcugucacgcaagacauucgauacggaauaccagaagaccaagaacaacgacugggacuacguggugaccaccgacaucagcgagaugggggcgaacuuccgugccgaccgcgugaucgacccucggcgcugucugaaacccguaauccucaaggacgggcccgagcgggucauucuggccggccccaugccaguaacggucgcguccgcagcgcagcgcagggggcgcaucggccgcaaccacaacaaagagggugaccaauacaucuacauggggcaaccgcugaacaacgacgaagaccacgcgcacuggaccgaggccaagaugcuccuagacaacaucaacacccccgaggguaucauccccgcucuguucgagccggaaagagagaagucagccgcgaucgacggggaguacagauugcgaggcgaggcccgcaagaccuucguggagcugaugagacgcggcgaccugccaguguggcucuccuacaaggucgccagcgagggguuucaauacuccgaccggcgcugguguuucgacggagagcggaacaaccaggugcuggaagagaacauggacguagagaucuggacgaaggaaggggagcgcaagaagcugagaccccgcuggcucgacgcacggaccuauucugacccccuggcgcugagagaguuuaaggaauucgccgccggaaggcgcucagucucaggcgaccucauacuggagaucggcaaacucccgcagcaucucacccagcgggcccagaacgcucuugacaaccuugugaugcuccacaacagcgagcagggcgggcgcgcguauagacacgccauggaggagcugcccgacaccaucgagacacugaugcuccucgcgcugaucgcagugcugaccggcgggguaacacuguucuuccuguccggccgcgggcucggcaagaccagcauaggccugcugugcguuauggcuaguagcgugcucuuguggauggcgucggucgagccccacuggauagcagccagcaucauccuggaguucuuccucaugguccugcugaucccagagcccgaccggcagcgcacuccccaggacaaccagcuggccuacguggucauuggacugcuguucaugauccucacggucgccgcgaaugagaugggccugcuggagaccaccaagaaggacuuggggaucggccacguggccgucgagaaccaccaccacgccgcgaugcuggacguagaccugcaccccgcguccgccuggacccucuacgcagucgccacgaccauuaucaccccaaugaugcgccauaccauagagaacacuaccgcgaacauaucacugaccgcaaucgcgaaccaggcggccauccugauggggcuagacaaggguuggcccaucuccaagauggacaucggagucccccuacuggcgcucgggugcuacucgcaggucaauccccugacccugacggcugccgugcuuaugcucgucgcccacuacgcaaucaucgguccggggcugcaggcaaaggcaaccagagaggcccagaagcgcaccgcggccggcaucaugaagaaccccacgguggacgggaucguggccaucgaccucgaccccgucguguaugacgcgaaguucgagaagcagcuugggcagauaaugcugcugauccugugcacgucacagauccugcucaugcggaccaccugggcgcugugcgagucuaucacgcuagcaacggguccccuuacgacccucugggaagguuccccgggcaaauucuggaacaccacaauagccgugagcauggccaacaucuuccgcggguccuaccuggcgggcgccggccuggcguucagccugaugaagucgcuugguggcggacggcgcgggaccggcgcccagggcgagaccuugggcgaaaaguggaaacggcagcugaaccagcuaagcaaaagcgaguuuaacaccuacaaacgguccggcaucauggaggucgaucggagcgaggcgaaggagggccucaagcgcggugagacgacaaagcaugccgugucccgcgguaccgccaagcugcgcugguucguggagcggaaucuggucaagcccgaggggaaggugaucgaccugggcugcggccgcgggggcuggagcuacuacugcgccgggcucaagaaggugacggaggucaagggcuacacgaaaggcgggcccggccacgaggaacccaucccgauggcgacguauggcuggaaccuggugaaacugcacuccgggaaagacgucuucuucaucccgccggagaagugcgacacccuccugugcgacaucggggagagcucacccaaccccaccaucgaggagggccggacgcugcgcguccucaagaugguggagcccuggcugagagggaaccaguucugcaucaaaauccugaaccccuauaugcccagcguggucgaaacccucgagcagaugcagcgcaagcacggcggcaugcugguucgaaacccgcuaagccgcaauagcacccacgagauguauuggguguccugcgggaccggcaacauugucuccgcggugaauaugacgagccggaugcuccugaaccguuucacgauggcgcaccgcaagcccaccuacgagcgggacguggaccugggugcgggcacccgacacguagccguggaaccggagguggccaaccucgauaucauuggccaacggaucgagaacaucaaacacgagcacaaaagcaccuggcacuacgacgaggacaaccccuauaagacgugggcguaccacggguccuacgaagucaagccgucgggcuccgccagcaguauggugaacggcgucgugaagcugcugaccaagcccugggacgugauccccauggucacucagauagccaugaccgauacgacccccuucggccagcagcgcguguucaaggagaagguggacacgcguaccccgaaggccaagcgugggacggcccagaucauggaggucaccgcaaagugguuauggggcuucuuaagccggaauaagaagccccgcauuugcacccgcgaggaguuuacgcgcaaggugcggagcaacgccgccauaggggccguauucguggacgaaaaucaguggaacucugcgaaagaggcgguugaagacgagcgcuucugggacuuagugcaccgugagcgggaacuccacaaacaggggaagugcgccacgugcgucuacaacaugauggguaaaagagagaaaaaguuaggggaauucggcaaggcuaaggggagccgcgccaucugguacauguggcugggcgcgcgguucuuagaguucgaggcccuggguuucaugaacgaggaccacugguucucccgcgagaacagccugagcgggguugagggcgaggggcuccauaagcuuggcuacauccugagggauaucagcaagaucccgggggggaauauguacgccgacgauacugcaggcugggacacacgcaucaccgaggacgaucuccagaacgaggcccgcaucacggauaucauggagccggagcacgcgcugcuggccaagucuaucuucaagcucacauaucagaacaaggugguccgggugcaacgcccugcaaagaacggcaccgugauggacgucaucagccgacgcgaccagcggggcuccggacagguagggaccuauggacugaacacguuuacuaacauggaggcccaacugauccgccagauggagagugaggggauauucucccccagcgagcucgagacucccaaccuggccgagcgggugcuggacugguuagagaaguacgggguugagcgucugaagcgcauggcuauuuccggcgacgacugcgugguaaagccgaucgacgaccgcuuugcuacggccuuaacggcgcucaacgacaugggcaaaguccguaaagauauuccucagugggagcccagcaagggguggaacgacuggcagcaggucccguucugcagucaucacuuucaucaauuaaucaugaaggacggccgcgagauaguggucccgugcagaaaccaggaugaauuggugggcagagccagagugucgcagggcgcgggcuggucgcuccgcgagacugccuguuuaggcaagagcuacgcccagauguggcagcugauguauuuccaccguagagaccuccggcuggccgcgaacgccauaugcagcgccgucccuguggacuggauaccuaccucccgcaccacguggucaauccacgcccaucaucaguggaugaccaccgaggacaugcuuagcguguggaaccgcguauggaucgaggagaaccccuggauggaggacaagacgcacaucagcuccuggggagacgugccguaccucgguaagcgggaggaccaauggugcggcaguuuaaucggccugacggccagggcgaccugggccaccaauauccaagucgccaucaaccagguccggagauuaauaggcaacgagaacuaccuggacuacaugacuuccaugaagcgguucaaaaacgagagcgaucccgagggcgcccugugguga

SEQ ID NO: 24450 - RNA, 9879 nt, Artificial Sequence
  derived and/or modified CDS sequence (opt11) from DENV-1__JF937608__SS-prME
ucggugaccaugcuacucaugcugaugcccacagcccuggccuuccaccuuaccacacguggcggggagccccacaugaucgugagcaagcaggaacgcggcaagagccugcuguucaagaccagcgccggugugaacauguguacccucaucgccauggacuugggcgaacuaugcgaggacaccaugaccuacaagugcccucgcaucacggagaccgaaccugacgacguggacugcuggugcaacgccaccgacaccuggguuaccuaugguaccugcagccaaacgggcgagcaccggcgcgacaagcggucgguggcccuagcgccccacgucggccugggguuagagacccgcaccgagaccuggaugagcuccgagggugcuuggaagcagauccagaagguggaaacuugggccuugcggcaucccggguucaccgugaucgcgcuguuccuggcccacgcgaucggaaccagcaucacccagaaggggaucaucuucauacuccucaugcuggugacgcccucaauggcgaugcgcugcgucggcauaggcagccgggacuucguugaggggcucuccggcgccacauggguagacgucgugcuggaacacgggagcugcgugaccacuauggcgaaggacaagccgacucuggacauugaacuccuuaagaccgagguaaccaaccccgccauucugcgcaagcucuguaucgaggcgaagaucuccaacacuacaaccgacagccggugcccgacccagggcgaggcuacccugguggaggagcaggacgccaacuucgugugcagacguacuuucgucgaccgcggcugggggaauggcugugggcuguucggcaagggguccuuaaucaccugcgcuaaguucaagugcguaacuaaguuggagggaaagauagugcaguacgagaaucugaaguacagcgucaucguaacggugcauacgggcgaccagcaccaagucgggaacgagucuaccgagcaugguaccaccgccaccauaacgccccaggcgccgacgaccgagauccagcucaccgacuacggggcccugacguuggacugcuccccccggaccggccucgacuucaacgagauggugcugcugacuaugaaggagaaguccuggcucguccacaagcagugguuccuggaccugccguugccauggacaagcggggcaucuacgucccaagagacauggaacaggcaagauuugcuggugacuuucaagaccgcacacgccaagaagcaggagguggucgugcuagguagucaagagggcgcgaugcacacggcccugacgggggccaccgagauacagaccuccggcaccaccaccauuuucgccgggcaccugaagugucggcucaagauggacaagcucacccugaaggggaugagcuacguaaugugcaccgggaguuuuaagcucgagaaggaggucgcugagacucagcacgguaccguccuggugcagaucaaauacgagggaaccgacgcgcccuguaagauacccuucagcacgcaggacgagaagggggucacgcagaacggccgccugaucaccgccaacccaauagugacggacaaggagaaacccgugaacaucgaggccgagccgcccuuuggugaguccuacaucgucaucggcgccggggaaaaggcgcugaagcucucgugguucaagaagggguccagcaucgggaagauguucgaggccacagccaggggggcacgccggauggccauccugggcgacaccgcgugggacuuugggucuauugguggcguuuucacaagcgugggaaagcugguacaccaaaucuucggcaccgccuaugggguacucuucuccggcgugucauggacgaugaagaucgggaucggcguucuguugacuuggcucggccugaacucccguagcaccucgcugagcaugaccuguaucgccguggggcuagugacucuguaccugggcgucauggugcaggccgacuccgggugcgugauuaacuggaagggccgcgagcucaagugcgggagcggcauauucgucaccaacgaggugcacaccuggaccgagcaguacaaauuccaagccgauagccccaagcggcuguccgcggccaucggcaaggccugggaggagggggugugcggcaucagaagcgccacccggcuggagaacauuauguggaaacagaucuccaacgagcucaaccacauucuguuagagaacgacaugaaguucacgguggugguuggggauguagccggcauccucgcucaaggcaagaaaaugauccgcccccagcccauggaauacaaguacagcuggaagucauggggcaaggccaagaucauuggggcagacgugcagaacaccaccuucaucaucgacgggcccaacaccccggagugcccagacgaccagcgggccuggaauaucugggagguggaggacuacggguucgggaucuucacaacgaacaucuggcugaagcugcgcgacaguuacacgcaggucugcgaccaccgacucaugucggcggccaucaaggacucgaaggcuguacacgccgacaugggcuacuggaucgaauccgaaaagaaugagaccuggaagcuggcccgcgccagcuuuaucgaggugaagacguguaucuggcccaagucccauacucuguggagcaacggcguccucgagucugagaugaucauacccaagaucuacggggggccgaucagccagcacaacuaccggcccggguacuucacccagaccgccggucccuggcaccucgguaagcuggagcucgacuucgaccugugugaggggacgaccgugguggucgacgagcacugcgggaaccgcgggcccagccuucggaccaccacugugaccgggaagaucauccacgaguggugcugucguagcugcacccucccuccccuacgguuccgcggggaggacggcugcugguacgggauggagauacgacccgugaaggagaaggaggaaaaccugguaaaguccaugguaagcgccgggagcggcgagguggacuccuucagccucgggcugcuguguaucuccaucaugaucgaagaggucaugcgcagccgguggagucgcaagaugcucaugaccgguacgcuggccguguuuuugcuccugaucauggggcagcugaccuggaacgaccucauacggcuguguaucauggugggugccaacgcgagcgaccgaauggggauggggaccaccuaucuggcgcucauggccacguucaagaugcgcccaauguucgccgucggacugcuguuccgaaggcucacaucgcgggaggugcugcugcugacaaucggccugagccugguggccuccgucgagcuccccaacucacuggaggagcugggugacgggcucgcgaugggcauuaugaucuuaaagcugcucaccgacuuccagucccaccagcuaugggcgacgcugcucucucugacuuucaucaagaccaccuuuucccugcauuaugccuggaagacgauggccauggugcucagcauagucucccuguucccacugugccuuagcaccacaucccaaaagaccacuuggcugcccgugcugcucggaagccugggcugcaagccguugaccauguuccucaucgcagagaacaaaaucuggggccgccgguccuggccucugaacgaggggaucauggccguggguaucgucagcaucuugcucagcucacugcugaagaaugaugugccccucgcugggcccuugauugcgggcgggaugcugaucgccugcuaugucaucuccggcuccagcgccgaccucucccuggaaaaggcagccgaggucagcugggaggaggaggccgagcauuccggugccagccauaacauccugguugaggugcaggacgacgggaccaugaagauuaaagacgaggagcgggacgauacgcucacuauccuacugaaggcgaccuuacuggcugucaguggcgucuauccgcugucaauucccgccacccuauucgugugguacuuuuggcagaagaagaagcagcgguccggcguccugugggacaccccaagcccgcccgagguggagcgcgccgugcuggacgacggcaucuacaggauaaugcaacgcggucugcucgggcggucgcaggucggaguggggguauuccaggagaacgucuuucacaccauguggcacgugacgcguggcgccguguugauguaccaagggaagcggcuggagcccuccugggcguccgucaagaaggaccucaucagcuacggcggcggguggaggcuacagggcucauggaacaccggggaggagguccaagugaucgccgucgagcccggcaagaaccccaaaaacgugcaaacaacccccgggacguucaagacccccgagggcgaagugggcgccaucgcccuggacuucaagcccggcaccagcggcuccccuauagucaaccgggagggaaagauugugggucucuacggcaacggaguggucaccacgaguggcaccuacgugagugccaucgcgcaggcgaaggccucccaggaggggccgcugcccgagaucgaggacgagguguuccgcaagcggaaccugaccauaauggaccuacaccccggcagcgggaagacccgaagauaccugccggccaucguccgcgaggcaaucaagcggaagcugcgcacgcuuauccucgcccccacucgcgugguggccuccgagauggccgaggcgcugaagggaaugcccauccgguaccagacaaccgcgguuaagagcgagcacacggguaaggagauuguagacuugaugugccacgccaccuucaccaugcgccuguuaucccccgugcgggucccgaacuacaacaugaucaucauggacgaggcccauuucacagaccccaguuccaucgccgcccgaggauacaucagcacgcggguaggcaugggggaggcggccgccaucuucaugaccgccaccccgcccggguccguggaggccuucccucagagcaacgcggucauacaggacgaggagcgcgacauccccgagcgguccuggaacagcgguuacgaguggaucaccgacuuccccggcaaaacggugugguucguacccuccaucaagagcgggaacgacaucgccaacugccuccgcaagaacggcaagcgggucauccagcugucccgcaagaccuucgacaccgaguaccagaagaccaaaaacaaugacugggauuauguggugacgaccgacauuagcgagaugggcgccaacuucagagccgaccgcgucaucgacccgcgacgcugccugaagcccgugauccuaaaggacgggcccgagcgggugauccucgcgggccccaugccggucacgguggccucggcagcacagcgccgggguaggaucggcaggaaccacaacaaggagggcgaccaguacauauacauggggcagccccugaauaaugacgaggaccacgcccacuggaccgaggcgaagaugcuccucgacaacauaaacacgcccgagggcauuauaccugcccuguucgagccugagcgcgagaaguccgccgcgaucgacggggaauaucgccugcggggagaggcuagaaagacuuuugucgagcugaugcggcgcggggaccugccugugugguuguccuacaagguggcuucggagggcuuccaguacucggaccggcgcuggugcuucgauggcgagcggaacaaucagguccuggaggagaacauggacguggagauuuggaccaaagagggagagcgcaagaagcuccggccacgcuggcucgaugcucggacguacucggacccccucgcucugcgcgaauucaaagaguuugccgcaggccggcgcagcguguccggggaccucauccuggagaucggcaagcuuccucagcaucucacgcaacgggcucagaacgcccuggacaaccuggucaugcuccacaacagcgagcagggcggccgcgccuaucgacacgccauggaggagcugccagacaccaucgagacccugaugcuccuggcgcugaucgccgugcucaccggcggugugacacuguucuuccuguccggccgcgggcucggcaagacgagcauaggacuccugugcgucauggccucgagcguacuccuguggauggccuccguggagccgcauuggaucgcugcgagcaucauccuggaguucuuccucaugguccugcugaucccggagccagaccggcagcgcacgccccaggauaaccaguuagccuacguggugauagggcugcuguucaugauccucaccgucgccgccaacgaaaugggccuccuggagaccacuaagaaagacuuggggaucggccacguugccguggggaaucaccaccacgcggccaugcuugaugucgaucugcaccccgccagugccuggacgcucuacgccguggcgaccacgaucaucaccccgaugaugcggcacacuaucgagaacacaaccgccaacaucagccugacggccaucgccaaccaggccgcgaucuugauggggcucgacaagggcuggcccaucuccaagauggacaucggugugccccugcuggcccuaggcugcuacagccaggucaacccucugaccuuaacagccgcugugcucaugcugguggcgcacuacgcaaucaucgggccgggccugcaagccaaggccaccagagaggcacagaagcgcaccgcggcagguaucaugaagaaccccaccgucgauggcaucguggccaucgacuuagacccaguggucuacgacgcuaaguuugagaagcagcugggccagaucaugcugcucauccugugcaccucccagauacugcucaugcggacuacgugggcguuaugugagagcaucacgcuggccaccgggccccuuaccacacugugggaaggguccccggggaaguucuggaacaccaccaucgccgugagcauggccaacaucuuccgcggcuccuaccuggccggcgccgggcucgcauucagccugaugaagucuuuaggcggaggccggcgcgggaccggcgcccaaggcgagacgcucggggaaaaguggaaacggcagcugaaccagcugucaaaaagcgaguuuaacaccuacaagcgcuccggaaucauggagguggaccggagcgaggccaaggagggguuaaaacgcggcgagaccaccaaacacgccguaucccgggggacggcgaaacugcgcugguucguggagcggaaccuggugaagcccgaaggcaaggucaucgaccugggcugcgggcgcggcggauggagcuacuacugcgccggacucaaaaaagugaccgaggugaagggguacacgaagggcggccccgggcacgaggagcccaucccgauggcgaccuacggcuggaaccuggucaagcugcacuccgggaaggacguguucuucauaccgcccgagaaaugugacacucuccugugcgacaucggcgagagcuccccgaacccgacuaucgaggaggggcggaccuugagagugcucaagauggucgagcccuggcugcguggcaaccaauucugcauuaagauccugaaccccuauaugcccagcguaguggaaacccuagagcagaugcagcgcaagcacggcgggaugcugguccggaacccgcugucccgcaacagcacccacgagauguacuggguguccugcggcacgggcaauauagugagugccgucaacaugaccagccggaugcuccugaaccgcuucaccauggcccaucgcaagcccaccuacgagcgggacguggaucuaggcgcugggacucgccauguggccgucgagccggagguagccaaccucgacaucaucgggcagcggaucgagaauauuaagcacgagcacaagagcaccuggcacuaugacgaggauaaccccuacaagacaugggccuaccacggcuccuacgaggugaagccgucaggguccgcaucgagcauggucaacggcguggucaaguugcugacuaagcccugggacguuaucccgauggugacgcagaucgcgaugaccgacaccacccccuucgggcagcagcgcgucuucaaggagaagguugacacgcggacuccgaaagccaagcgcggcacugcccagauaauggaggugaccgccaaguggcuauggggcuuccugucccggaacaagaaaccccgcaucugcacgcgggaggaguucacgcgcaagguucggagcaacgccgcgauaggagccguguucguagaugaaaaccaguggaacuccgcaaaggaggccguagaggacgagcgcuucugggaccugguucaccgggaacgcgagcuccacaagcagggcaaaugcgcgaccugcguguacaacaugauggggaagagagagaagaagcugggcgaguucgggaaggccaagggcucccgcgccaucugguacauguggcugggcgccagauuccucgaguucgaggcccuggguuucaugaacgaggaucacugguucucccgcgagaacagccuguccggcgucgaaggggagggccugcacaaguugggguacauccugcgggacaucucgaaaauccccggugguaacauguacgcggacgacaccgccggcugggacacgcgcaucaccgaggacgauuugcagaacgaggcucggauuaccgacauuauggagccggagcacgcgcugcuggcaaaguccauuuucaaguugacuuaccagaacaagguggugcgcguucagcgcccggcgaagaacgguacggugauggaugugaucucgcggagggaucaacggggauccggccagguagguaccuacgggcugaacaccuucaccaacauggaagcccagcugauccgccagauggagagcgagggcaucuucucccccagcgagcuggagacgccaaaccuggccgaacgggugcuggacuggcuggagaaauaugggguggagcgccugaagcggauggccaucuccggcgacgacugcgucgucaagccgaucgacgacagguucgccaccgcguugaccgcacucaacgacaugggcaagguacggaaggacaucccucagugggagcccaguaagggcuggaacgacuggcagcaggucccguuuugcucccaccacuuccaccagcugaucaugaaagacggucgcgagaucguggugccaugccggaaccaggacgagcuggucgggcgcgccagggugagccaaggugccggguggagccuccgagagaccgccugccugggaaaguccuacgcgcagauguggcagcugauguacuuccaccggcgcgaccuccggcuggccgcgaacgcaaucugcagcgcugugcccgucgauuggauccccaccucccgcacaaccuggaguauacaugcacaccaccaguggaugaccacggaggacaugcugucgguguggaaucgaguguggaucgaggagaacccguggauggaagacaaaacccacaucagcaguuggggcgaugucccguaccucggcaagcgcgaggaccaguggugcggcucgcugaucgggcuuaccgcccgcgccaccugggccaccaauauccagguggcgaucaaccaagugcguagauugaucggcaacgagaacuaucuggacuacaugacguccaugaagcgguucaagaacgaaagcgaccccgaaggggcccugugguga

SEQ ID NO: 24451 - RNA, 9879 nt, Artificial Sequence
  derived and/or modified CDS sequence (opt11) from DENV-1__GU131739__SS-prME
agcgugaccaugcugcugaugcugaugccuacagcccuggccuuccaccucaccacccgugggggugagccacacaugaucgugagcaagcaggagcggggcaagagcuuauuguuuaagacauccgccgggguuaacaugugcacccucaucgcgauggaccuuggggagcugugugaggauaccaugacauacaagugcccccggaucaccgagaccgagccagacgauguugacugcuggugcaacgccacggauacgugggugaccuacgggaccugcagccaaacgggggagcaccggcgcgacaagcguucuguggcccucgcgccacaugugggguuggggcucgaaacacgcacagagacguggaugucauccgagggggccuggaagcaaauccagaggguagagacgugggcccuccggcaccccggguucaccgugauugcccuuuucuuggcccacgcgauaggcaccaguaucacccagaaggggaucauauucauacugcugaugcucgugacgcccucuauggccaugcggugcgucggcaucggcagccgcgauuucguggagggguuauccggcgccaccuggguggacguagugcuggagcacgggagcugcgucacaaccauggccaaggacaagccaacgcuggacaucgagcucuuaaagacugaaguaaccaaucccgccgugcugcggaaguuaugcaucgaggcgaaaaucuccaacacaacgacugacagccguugcccgacacagggcgaggcaacccugguggaagaacaggacgcaaauuuugucugccggcgcacauucguggacagggggugggggaacggcugugggcuguuugguaaagggucccucaucacaugcgccaaauucaagugcgugaccaagcuggagggcaagauaguucaguacgaaaaccugaaguacagcguuaucgugaccguccacacgggcgaccagcaucaggucgggaacgaguccacugagcacgggacgaccgccaccaucacgccccaggcaccaaccacggagauccaacucaccgacuauggggcccugacgcuugauugcagcccccgcaccggucuugacuucaacgagaugguccugcucacaaugaaggagaaaagcuggcucguacacaagcagugguuucuggaccugccguuacccuggaccagcggagccagcacgucccaggagaccuggaaucggcaggaccugcuagugaccuucaagaccgcgcacgcuaagaagcaggaagucguggugcucggcucccaggagggcgcgaugcauacggcccuuaccggcgccacagagauccagaccuccggcacuaccaccaucuucgccgggcaccugaagugccggcucaagauggacaaacugacccucaagggcaugucuuacgugaugugcacuggguccuuuaaguuggagaaagaguuagccgaaacacaacacgggacggugcuagugcagaucaaguacgaggguacagacgcucccugcaagauccccuucuccacgcaggacgagaagggaguaacccaaaacggccgacugaucacagccaacccgauuguaaccgacaaggaaaagccggucaacaucgaggccgagccgcccuucggggaguccuacaucgucaucggcgcaggcgagaaagcgcucaagcugucaugguucaaaaaggguucuucgaucggcaagauguucgaggccacggcccgcggggcccggcgcauggccauccugggggacacugcgugggacuucggcuccaucggcgggguguucaccagcguggggaaacuugugcaccagaucuucggcacggccuacggagugcuguucuccgguguuucauggaccaugaagaucggaaucggcguccugcucaccugguugggacuaaauucccgcagcaccucccucagcaugacuuguaucgccguggggcuagugacucuauaccucggcgucauggugcaggccgacagcgggugcgugaucaacuggaagggccgggagcuuaaaugcgggagcggcaucuucgucaccaacgaagugcacaccuggaccgagcaguacaaguuucaggccgacagcccaaagcgccugagcgcggccaucggcaaggccugggaggaaggggugugcgguauucgcagugccacccgccuggagaacaucauguggaagcagaucuccaaugagcugaaccacauucugcucgaaaacgacaugaaguucacugucguagugggggaugucgcgggcauccucgcgcaggggaagaaaaugauaaggccccagcccauggaguauaaguacagcuggaaguccuggggcaaggccaaaaucauaggcgcagacguacagaacacuaccuucaucauagaugggcccaacaccccggagugucccgacgaccagcgcgccuggaacaucugggaaguggaggacuacggauucgggaucuuuacaaccaacaucuggcugaagcuccgcgacagcuacacacaggucugcgaccaccgucugauguccgccgcuaucaaggacagcaaggccguccacgcugacaugggauacuggaucgaguccgaaaagaacgagaccuggaagcuggcccgggcaaguuucaucgaggugaagacgugcaucuggcccaagucgcacaccuuauggagcaacgguguccuggaguccgagaugaucauucccaagauauacggagggccgauuagccagcauaacuaccgccccggguacuucacccagaccgcgggccccuggcaccugggaaagcucgaacuggacuucgaucugugcgagggcacgaccgugguagucgacgagcacugcggcaaccgggggccgucccuccgcaccacuacagugaccggaaaaaucauccacgaguggugcugccgcagcugcacguugccgccccugcguuuccgcggggaggacggcugcugguacgggauggaaauccgaccggugaaggagaaagaagagaaccucgucaaguccauggugagcgccggcucaggugagguggauaguuucagccuagggcugcucugcaucuccaucaugaucgaagaggucaugcggagccgcuggucccguaagaugcugaugacaggcacgcuggccguguucuuccuccugauuauggggcaacugaccuggaacgacuuaauacgccuguguauaauggugggcgcaaacgcuuccgaccgcauggguaugggcaccacguaccuggcacucauggccacguucaagaugcggccaauguucgccgucggccuacucuuccgccggcugaccucucgcgagguucugcugcucacgaucgggcuaagccugguggccaguguagaacuccccaacagccuggaagaacugggugacggacucgcgaugggcaucaugauccugaagcugcucacagacuuccagagucaccaauuaugggccacgcugcucucacugaccuucauaaagaccacguucucccugcacuaugcuuggaagacuauggcgauggugcucagcauagucucccuguucccgcugugccucucaaccaccucucagaagaccacgugguugcccgugcugcuuggcagccuggguuguaagccgcugaccauguuccucaucgcagagaacaagaucuggggccggagguccuggccccugaacgagggcaucauggccgugggcaucgucaguauccugcucucaucccuucugaagaacgauguaccacucgcggggccccuaauugccggcggcaugcugauagcaugcuacgugauaagugggucaagugccgaccucucccuggagaaggccgccgagguaagcugggaggaagaagccgagcauuccggcgcgagccacaacauacuuguugagguccaggacgacgggaccaugaagaucaaggacgaggagcgggaugacaccccuaccauucuccugaaggcgacguugcucgcugugucaggggucuacccccuuagcaucccagcuacccuguucgugugguacuucuggcagaagaagaagcagcgcuccgguguccucugggacacccccuccccgcccgagguggagcgggccguguuagacgacggcaucuaccgcaucaugcagcguggccuucuggggcgaucacagguaggcgugggggucuuucaggagaacgucuuccacaccauguggcacgugacgcggggcgcagugcuaauguaccagggaaagcgccuagagcccucaugggcguccgucaagaaggaccugauaucauacggcggaggguggaggcuccagggcuccuggaacaccggggaggagguccaagugaucgccguugagcccggcaagaacccgaagaacguacagaccgccccggggaccuucaaaacgcccgagggcgaggucggcgcuaucgcacuugauuucaagcccgggacgucuggaagcccuaucgucaaccgcgaggggaaaaucgugggccuguacggcaauggcguggucaccacuagcggcacguacgugagcgcgaucgcccaggcuaaggccucccaggaggggccccuaccugaaaucgaggacgagguauuccggaaacgcaaccuaaccauuauggauuugcacccgggcucggggaaaacccgccgguaccuccccgccaucguucgggaggccauuaagcgcaagcuccgcaccuugauccucgcgcccacgaggguaguugccuccgaaauggccgaggcguuaaagggcaugcccauccgcuaucagacaaccgccgucaagucagaacacaccggcaaagagaucguggaccugaugugucaugcuacguucacaaugcggcuccugucgccggugcgagucccgaacuauaacaugaucaucauggaugaggcucacuucaccgacccaucuaguauagcugcgaggggguacaucagcacccgaguggguaugggggaggccgccgcaauauucaugacggcuacuccgccggguaguguggaggcguucccccaguccaacgccgugauccaagacgaggagcgggacauacccgagcgcucguggaauagcggauacgaguggaucacggacuuccccgggaagaccgugugguucgugccauccaucaagucgggcaacgacaucgccaacugcuugcggaagaacgggaagcgagucauccagcucucacggaaaacguucgauaccgaguaucagaagacgaagaacaacgacugggauuaugucgugaccacugacaucuccgaaaugggcgccaauuuccgcgcggaccgggucauugacccgagaaggugccugaagcccgugauccugaaggacggucccgagcgcguaauccucgccggcccgaugccggucaccguggcguccgcggcccagagacgcgggcggauaggccgcaaucacaacaaagagggcgaccaguacaucuacauggggcagccgcugaacaacgacgaggaccacgcgcacuggacugaggcuaagaugcuucuagauaacaucaacacacccgaggggaucauaccggcccuguucgaacccgaacgcgagaaauccgccgccauugacggggaguaucggcugcguggcgaggcgcggaagacguucgucgagcucaugcgccgcggugaccugccuguguggcuguccuacaagguggccagcgagggcuuccaauacuccgaucgccgguggugcuuugacggugagagaaacaaucagguccucgaggagaacauggacguagagaucuggacaaaggagggugagaggaagaaguugcgcccacgguggcuggacgcccgcaccuacuccgacccucucgcccugcgggaguucaaggaguucgcagcgggccgccggagcgugaguggggaccuaauacuagagaucggcaagcuaccacaacaccugacccagcgcgcacaaaacgcccucgauaaccuggucauguuacacaauagcgagcagggcggccgggccuaccggcacgcgauggaggagcuccccgauacgaucgagacccugauguuacucgcccugauugccgugcugaccggcgggguuaccuuauucuuccuguccggccgggggcugggaaagacaagcauuggccucuuaugugucauggccuccagcguccuccuuuggauggccuccguugagccccacuggaucgcggccaguaucauccuugaguucuuccugauggugcuccugauaccugagccugaccgccagcgcacgccccaggauaaucagcuggccuauguggugauagggcuccuguucaugauucugaccguugcagcgaacgagauggggcuccuagagacuaccaagaaggaccuggggaucggccacguggcgguagagaaccaccaccacgcugccaugcucgauguagaccugcacccggccuccgccuggacgcuguacgccguggccacuacgaucaucacccccaugaugcggcacacgaucgaaaacaccaccgccaacauaagccucaccgccaucgcuaaccaggcggccauccugauggggcuggacaagggcuggcccaucuccaaaauggacauuggaguuccguugcuggcccuggggugcuacucacaagucaacccucucacgcucaccgccgcgguguugaugcucguggcccacuacgccaucaucggccccgguuugcaagcaaaggccacacgggaggcgcagaagcggaccgccgccggcauuaugaagaaccccacggucgauggaaucguggccaucgaccuggaccccguggucuaugaugccaaguucgagaagcagcuaggucagauaaugcugcuaauccucugcacuucucagauccugcuaaugcgcaccaccugggcccucugcgagagcaucacauuggcaacaggcccgcugaccacccucugggagggguccccagggaaguucuggaacacgaccaucgccgugucuauggccaacaucuuccggggguccuaccuagccggagcgggccuggccuucagccucaugaagagucuagggggcgggcgccgggggaccggggcccagggcgagacccuaggagagaaguggaagcggcaacugaaccagcucuccaagagcgaguucaacacuuacaagcgaucagguaucauggaaguggauaggagcgaggcaaaggagggccuuaagcgcggcgagacaaccaagcacgcgguaucccgcgggacggccaagcuccgcugguucguggagcgcaaccuugugaagcccgaagggaaagucaucgaucugggcugcggccgcgggggcuggagcuacuacugcgccgggcuaaagaaggugacggaagugaaaggcuacaccaagggcggacccggccacgaggaaccgauaccuauggccaccuacggguggaaccucguuaagcugcacagcggcaaggacguguuuuucaucccgcccgagaagugcgacacucuuuugugugacaucggggagagcuccccgaaucccacgaucgaggagggccgcacuuuacgggugcugaagauggucgaacccuggcuccgagggaaucaguucugcaucaagauccugaacccguacaugccgagcgugguggaaacucuggagcagaugcagcggaagcauggcggaaugcucgucaggaaccccuuaucccggaacucaacacacgaaauguauuggguguccugcggaaccggcaacaucgugagcgccgucaacaugacguccagaaugcugcucaaccgcuucacgauggcacaccguaagccaacauacgaacgcgauguggaccuaggagccggcacgaggcauguggccgucgagcccgaagucgccaaucuggacaucaucggccagaggaucgagaauaucaaacacgagcacaagagcacguggcacuacgacgaggacaauccuuauaaaacaugggccuaccacgggaguuacgagguuaagcccagcggcuccgccagcagcauggucaacggggucgucaagcuccugaccaagcccugggacgugauccccauggugacccagaucgcaaugacggacaccacuccguucggucagcagcgggucuucaaggagaagguggacacccgcacgcccaaggcaaagcggggcaccgcccagauuauggaggugaccgccaaguggcuguggggcuucuuaagucgcaauaagaagccccguauaugcacccgcgaggaguuuacgcggaagguccgcagcaacgcggccaucggcgcgguguucguggacgagaaccaguggaacagugccaaggaggcgguugaagacgagcgguucugggaccuggugcaccgcgaacgagagcugcacaagcaggggaagugcgcgaccugcguguauaacaugaugggcaagagagagaagaaacucggggaguucggcaaagccaaggggagccgggccaucugguacauguggcugggcgcccgcuuucuagaguucgaggcgcucgguuucaugaacgaggaccacugguuuucccgggagaacucucuguccgggguugagggcgaagggcugcacaaacuuggauacauccugcgagacaucucgaagauaccgggaggcaauauguacgccgacgacaccgccgguugggacacucggauuacggaggacgaccugcagaacgaggcccgcaucaccgauauaauggagcccgagcacgcccuccuggcgaagucuaucuucaagcugaccuaccaaaacaaggucgugcggguccagcggccagccaagaacggcaccguuauggacguaauaucgcgccgggaccagcgcggcuccggacaggugggcacauacggacucaacaccuucaccaacauggaggcccaacuuauccgccagauggagagcgaagggaucuucucacccagcgagcuggagaccccgaaccucgccgagcgcguguuagacuggcuggaaaaguacgggguggagagacucaaacgcauggccaucagcggggacgacugcgucgugaagcccauagacgaccgguuugcuacggcacugaccgcacugaacgacaugggcaaggugcgcaaagacaucccacaaugggaacccagcaagggguggaacgacuggcagcagguccccuucugcucucaucacuuccaccaacugaucaugaaggacggacgggaaauagugguaccuugccgcaaccaagacgagcucgucggccgggcccgcgugagccagggagcaggguggucgcugcgggagaccgcgugccucggcaagagcuacgcgcagauguggcagcugauguacuuccaucgccgggaccuccgccucgccgcaaacgcgaucugcagcgccgugcccgucgauuggauccccaccucccggacgaccuggagcauacacgcgcaccaccaguggaugaccaccgaggauaugcuguccguguggaacaggguuuggaucgaagagaacccauggauggaggacaagacgcacaucucguccuggggcgacguccccuaccuggggaagcgggaggaccaguggugcggcagccucaucggucugaccgcgcgggcuaccugggcuaccaacauccagguggccaucaaccagguacgccgucugaucgggaaugagaacuaucuugacuacaugaccuccaugaagcgcuucaaaaacgagagcgaccccgagggcgcccugugguga

SEQ ID NO: 24452 - RNA, 9879 nt, Artificial Sequence
  derived and/or modified CDS sequence (opt11) from DENV-1__GU131740__SS-prME
uccgugacgaugcuguugaugcugaugcccaccgcccucgcuuuucaccugacgaccagagguggggagccccacaugauagugagcaagcaggaacggggcaaaucgcugcuguucaagaccucugcgggggugaacaugugcacccugauagccauggaucugggcgaguucugugaggacacgaugacauacaaaugcccccgcaucaccgaagcugagccugacgacgucgacugcuggugcaaugccacagacacuuggguaacuuacggcacuugcagccagacuggggagcaucggcgggacaagcggagcguggcacuggccccccacguggggcucgggcuggagacgcgcacggaaacauggaugagcagcgagggcgccuggaagcagauccagcggguugagaccugggcccugcgccacccggguuucacgguaaucgcccucuucuuggcgcacgccaucggcaccagcaucacccagaaggggaucaucuucauccugcucaugcuggugacccccagcauggccaugcggugcguuggaaucggcucacgcgacuucguggagggucuguccggcgccacguggguggacgucgugcuggaacaugggagcugcgugaccaccauggccaaggauaagcccacccuggauaucgagcugcucaagacggaagucaccaaccccgcagugcuucggaaacugugcaucgaggccaagaucaguaauaccaccacggacagccgcuguccgacccaaggcgaggcaacgcucguagaagagcaggaugccaacuucgucugcagacgcaccuuuguggaccggggcugggggaacggaugcggguuguucggcaagggaucccugaucacuugcgccaaguucaagugcgugacgaagcuugagggcaaaaccgugcaguacgaaaaccugaaguacagcgugaucgugaccguccacacgggcgaccaacaccagguggggaacgagagcaccgagcauggcacuacagcuacgaucaccccccaggcccccucuaccgagauccagcugaccgacuacggggcccuaacccuggacugcagcccacggacgggucuggacuucaaugagaugguccuccugaccaugaaggagaagagcuggcuggugcacaagcagugguuccucgauuugccgcugcccuggaccuccggggccuccacuagccaggagacguggaaccggaaggaccuccuggugaccuucaagaccgcccacgccaagaagcaagaggucguggugcuggggucccaggagggcgcaaugcacaccgcccucacuggggccaccgagauccagaccucaggcaccacgaccaucuucgcggggcacuugaagugccgccugaagauggauaaguuaacauugaagggcaugagcuacgucaugugcaccgggagcuucaagcuggagaaagaaguugcggagacgcagcaugguaccguguuaguccagauaaaguacgagggcaccgacgugcccuguaagaucccguuuuccacacaggacgagaagggggucacgcagaacggccggcugaucaccgccaacccgauugucaccgacaaagagaagccugucaauaucgaagccgagccgcccuucggcgagagcuacaucguuaucggagccggcgaaaaggcgcugaagcuguccugguucaagaaagggagcuccaucggcaaaauguucgaggccaccgcccgcggggccaggcgcauggccauccucggcgacacggcgugggacuucgggagcaucggcggggucuucacuuccguagggaagcugguucaucagaucuucggcaccgccuaugggguccucuucagcggcguguccuggaccaugaagaucgggaucggcgugcuccugacguggcugggccucaacucacgcuccaccagccuauccaugaccugcaucgccgucgggcuggucacccuauaccugggcgugaugguccaggccgacagcgggugcgugaucaacuggaaggggcgggagcugaagugcgggagcggcaucuucguaacgaacgagguccacaccuggaccgagcaguacaaguuucaggcagacuccccgaagcgccucucggcggccaucggcaaggccugggaggagggggugugcggcauacgcuccgccacucgccuggaaaacaucauguggaagcagauuagcaaugagcugaaccacauccuccuggagaacgacaugaaguucaccguggucgugggggauguagccggcaucuuggcgcaggggaagaagaugauccggccccagcccauggaguacaaguacagcuggaaguccuggggcaaagccaagaucaucggcgccgacguccagaacacgacauucaucaucgacgggccgaacaccccggagugucccgacgaccaacgcgccuggaacaucugggagguggaggacuacggcuuugggaucuucaccacgaacaucuggcuaaagcugcgggacuccuacacccaggugugcgaccaccgccugaugagcgcggccaucaaagacuccaaagccguccacgccgacaugggcuacuggaucgagagcgagaagaacgagaccuggaagcucgcccgggcguccuucaucgaggugaagacaugcaucuggcccaagagccacacucugugguccaacggcgugcuggagagcgagaugaucauccccaagaucuacgggggcccgauuucccagcacaauuaccggcccggguacuucacccaaacagccggccccuggcaccucgggaaguuagagcuggacuucgaccucugcgagggaaccacggucgucguggaugagcacugcggcaaccgggggccgagucugcgcaccaccaccgucacgggcaagaucauucacgaguggugcugccgguccugcacccugcccccccugcguuucaagggggaggacggguguugguacgggauggagauacgacccgugaaggagaaggaggagaaccuggucaagagcauggugucggccgguuccggcgagguggacagcuucucacuggggcuccuguguaucagcauaaugaucgaggaagucaugcgcucccgguggagccguaagaugcugaugaccggcacccucgccgucuucuuccuucuaauaauggggcagcucacguggaacgaucugauccggcucugcaucauggugggcgccaacgcguccgaccgcauggggaugggcaccaccuaccucgcccugauggccaccuucaagaugcgcccgauguucgccgugggccuucuguuccggcgccugacgagccgggagguccuacuacugaccaucggucugucacucguggccagcgucgaacugcccaacucccuggaggagcucggcgacgggcuggcgaugggcauuaugauccugaaacuccugaccgacuuccagucucaccaguuaugggccacccuccuguccuuuacguucaucaagaccaccuucagccugcacuacgcauggaagaccauggccaugguacucuccaucguaagcuuguucccccugugccucuccacgaccucacagaaaaccaccuggcuccccguccugcucggcucccuggggugcaagccgcugacgauguuccucaucgcggagaacaagguguggggccgcaagucguggccacugaacgaggggaucauggccgugggcauaguuucgauauugcucuccagccugcucaagaacgacgugcccuuggccgggccccugaucgcuggcggcaugcugauagccugcuacgugauuuccgggagcuccgcggaucuaagucuggagaaggccgccgaggucuccugggaagaggaggccgagcacagcggcgcgagccacaauauccugguggaggugcaggacgaugggaccaugaagaucaaggacgaggagcgggacgacacccucacaaucuuacugaaggcuacccuccuugccgucucuggcguguacccgcuguccauccccgccacguuauucgugugguacuucuggcaaaagaaaaagcagcgcagcgguguccuuugggacacgcccagcccgcccgagguggagcgggcgguucuggacgacggcaucuaccgcauuaugcagcggggacuacuggggcgcagccaggucggcguagggguguuccaggagaacgucuuccacaccauguggcacgugacccggggcgccguucugauguaccaggggaagcgacuggaacccuccugggcgagcguuaagaaggaccucaucuccuacgggggcggguggcggcugcagggcagcuggaacacgggggaggagguccaggugaucgcgguggagccgggaaagaaccccaagaacgugcagaccgcccccgggaccuucaagacguccgaaggcgaggucggcgccaucgcccuggacuucaagcccgggacgucggggucgccaaucguuaaccgcgagggaaagaucgugggccucuacggcaacgggguggugacgaccuccggcaccuacgugagcgcgaucgcccaggccaaggccucccaggaggggccccugccggagauugaggacgagguguuccggaagcgcaaccugacuaucauggaccuccaccccggcagcgggaagacccggcgcuaccugcccgcgaucguccgggaggcgaucaagcgcaagcugcggacccucauccuggccccgacccgcguuguggcauccgagauggcugaggcgcuuaaaggcaugccuauccgcuaccaaacgacagccgugaaaagcgagcacaccggcaaggagauuguggaccucaugugucacgccaccuucacgaugcgacugcugucccccgugcgcguccccaacuauaacaugaucauuauggacgaagcccauuucaccgacccgagcuccaucgccgcgcggggguacauaagcacccgcgugggcaugggggaggccgccgcaaucuucaugaccgccacgccgcccggcagcauggaggccuucccccagagcaacgccguuauccaggacgaggagcgggacaucccggagcgcuccuggaauucgggguacgaguggauuacagacuuccccggcaaaaccgucugguucgugcccuccaucaaaagcggcaacgacaucgccaauugucucagaaagaacgggaagcgcgugauacagcugucccggaagaccuucgacacggaguaccagaagaccaagaacaacgauugggacuacgucgugaccacugauaucagcgagaugggcgccaacuuccgcgcggaccgggugaucgacccccgccggugucugaagccggucauccucaaggacgggccugagcgcgugauccuggcaggccccaugcccgucacgguagcguccgccgcccaacggcgcgggcggauagggcguaaccacaacaaggaaggcgaccaguacaucuacauggggcagccuuugaacaacgacgaggaccacgcccacuggaccgaggccaaaaugcuacuagacaauaucaacacccccgagggcaucauuccggcacuguucgagcccgaacgggagaaguccgccgcaaucgacggggaauaccgccuccgcggcgaggcgagaaaaaccuucguggagcugaugcgccgcggggaccugccgguauggcucagcuacaagguggccuccgagggcuuccaguacagcgaccgccgguggugcuucgauggcgagcgcaacaaccaggugcuggaggagaacauggacguagagauauggacgaaggagggggaaagaaagaagcugcgcccccgguggcucgacgcccgcaccuacuccgacccccuggcccugagggaguucaaggaguucgccgcgggccgccggagcguguccggugaccucauccuggagaucggcaagcugccccagcaccuuacucagcgcgcccagaacgcccuugacaacuuagugauguugcacaacagcgagcagggcgggcgggccuaccgccacgcgauggaggagcugccggauaccaucgaaacgcugaugcugcuagcccugaucgccguccucaccggaggggucacccuguucuuccugucaggccgggggcucggcaagaccagcaucggccugcugugcgugauggcuuccagcguccuccuguggauggccagcguggagccucacuggaucgcggcuagcauaauccuggaguuuuuccucauggugcugcugauacccgagccugaucgccagagaaccccgcaggacaaccagcucgccuacgucgugauuggacuucuguuuaugauccucacgguggccgccaacgagaugggccugcuggagaccaccaagaaggaccuagggaucgggcacgcggccguagagaaccaccaccacgccgccaugcuggacguggaccugcaccccgccuccgccuggacccucuacgccguggccacuaccauaauaacucccaugaugcgccacaccaucgagaacacuacagccaacauuagccucaccgccauugcgaaccaggccgcaauccugauggggcucgauaagggcuggccaaucucgaagauggacauuggugugcccuuacuggcacucgggugcuacagccaggugaacccccuuacccucacggcggccgugcucaugcuggucgcacacuacgccauaaucggccccgggcugcaggccaaggcgacccgggaggcccagaagcgcaccgccgccggcaucaugaagaacccgaccguagacgggaucguggccauugaccucgaccccgucguguacgacgcgaaguucgaaaagcagcugggccaaaucaugcugcucauccugugcacgucucagauccuacucaugcgcacgaccugggcccugugcgagagcaucacccuggccacaggcccccucacaacccugugggaggggucccccgguaaguuuuggaacaccacuaucgccgugagcauggccaacauuuuccgggggucguaccuggcgggcgccggccucgcauucucgcugaugaagucacuaggaggcggacgccgggggaccggcgcccagggcgaaacccucggcgagaaguggaagcgccagcugaaccagcuguccaagucagaauuuaacaccuacaagcgguccgggauaauggaggucgaccgcagcgaggccaaggagggccucaagcgcggggagacuaccaagcacgccgugucccgcggcaccgcgaagcugcggugguucguggagcgcaaccuggucaagccggaggggaaggugaucgaccucggcugcggccgcggcggguggagcuacuacugcgccgggcugaagaagguuaccgaggucaaaggguauacgaagggcggucccggucacgaggagcccauccccauggccaccuacggguggaaccuggugaagcugcacuccggcaaggauguguucuuuaucccccccgagaagugcgacacccuccugugcgacaucggggagagcucccccaacccgacaauugaggagggccgcacucuccggguccucaaaaugguggagccguggcugaggggcaaccaauucugcaucaagauccugaacccauacaugcccucaguggucgagacccuugagcagaugcagagaaagcacggcggcauguuggugcgcaacccccugucccggaacucuacccacgagauguacuggguguccugcgggaccggcaacaucguaagcgcggugaacaugaccucacgcauguugcugaaccgguucacgauggcccaccgcaagccgacauacgagcgcgacguggaccugggggccgggacccggcaugucgcgguagagcccgagguggccaacuuggacaucauaggccagcgcaucgaaaacaucaagcacgagcacaagagcaccuggcacuacgacgaggauaaccccuacaagacgugggcguaccacggguccuacgaggucaagcccucgggaagcgccuccagcauggugaauggggucgugaagcugcugaccaagccgugggacgugauccccauggucacccagaucgccaugaccgacacaacccccuuuggccagcagagaguguucaaggaaaagguggacacccgcacccccaaagccaagcgggggacggcccagauuauggaggucaccgccaagugguuauggggcuuccugucccgaaacaagaagccgcggauuugcacccgcgaggaguucacccguaaggugcgcagcaacgccgccaucggcgccgucuucgucgacgagaaccaauggaacuccgcgaaggaggccguagaggacgagcgguucugggaccuggugcaccgcgagcgggaguugcacaagcaggggaagugcgcgacgugcgucuacaacaugaugggcaagcgcgagaagaagcugggggaguuuggaaaagccaaggggagccgggccaucugguacauguggcugggcgcccgcuuccucgaauucgaggcucucggguucaugaacgaggaccacugguucagucgggagaacagccuguccgggguggagggcgaggggcuucacaagcugggguacaucuuacgcgauaucagcaagaucccggggggcaacauguacgccgacgacacggccggaugggacacccggaucaccgaggacgaucuccagaacgaggccaagaucacggacaucauggaacccgagcacgcgcugcuggccaaguccaucuucaagcucaccuaccagaacaaggucguccgcguacagagacccgcuaagaacgggaccgugauggaugucaucagccgccgcgaccagcggggcuccggccaggugggcaccuacggccugaauacguucaccaacauggaggcccagcugauccgccagauggagagcgaggggaucuucucccccagcgaguuggaaacccccaaucuggccggcagagugcuggacuggcucgagaagcacggggucgagagacugaagcggauggcgaucuccggcgacgacuguguggugaagcccauugacgaccgcuucgccaccgcccugacugcucuuaacgacauggguaaggucaggaaggacaucccgcaaugggagccgucuaagggcuggaacgauuggcagcagguccccuuuugcagccaccacuuccaucagcugaucaugaaggauggccgcgagaucgugguucccugccggaaccaggacgagcugguggggcgcgcccgggugucccagggcgcgggguggagccuccgagagaccgccugccugggcaaguccuaugcccaaauguggcagcugauguauuuucaccggcgugaccuccggcuggccgccaacgccauauguagugcagucccaguggacugggugcccaccucccgcaccacguggagcauccacgcccaccaccaauggaugaccaccgaggacaugcugucggucuggaaucggguguggauagaggagaaccccuggauggaggauaagacccacaucagcuccuggggcgacgugccuuaucucggcaagcgcgaggaucaguggugcggcucacugauugggcugacugcccgggcgaccugggccaccaacauccagguugccaucaaccaggugcgccgccucaucggcaacgagaacuaccuagacuacaugaccuccaugaagcgguucaaaaaugagucggacccggagggggcccugugguga

SEQ ID NO: 24453 - RNA, 9879 nt, Artificial Sequence
  derived and/or modified CDS sequence (opt11) from DENV-1__GU131741__SS-prME
agcguaaccaugcuacucaugcucaugcccaccgccuuggccuuucaccucacuacgcggggcggggaaccccauaugaucguuucaaaacaggaacggggcaaaucacugcuguucaagaccagcgccggggugaacauguguacucugaucgccauggauuuaggcgaguucugcgaggacaccaugaccuacaaguguccccgcauuaccgaagcugaaccagacgacgucgauugcuggugcaacgccaccgacacaugggugacauauggaacgugcagccagaccggggaacaucgccgggacaaacgguccgucgcacuagcuccccacgugggcuugggucuggagacacgcaccgaaacguggaugucaucugagggagcguggaagcagauccagcggguagaaaccugggcccugcgccaucccggguucacggugaucgcacucuuucuggcgcacgccaucggcaccucgaucacccaaaagggaauuaucuucauacugcucauguugguaacucccuccauggccaugcggugcguugggaucggcagccgcgacuucguggagggguuauccggugccacgugggucgacgucguccucgagcacggcucgugcgucaccaccauggccaaggauaagcccacccuagauauagagcugcucaagaccgagguaacuaaccccgcggugcugagaaagcuuugcauagaggccaagaucucaaauaccacgacggacucccguugcccgacccagggcgaggcgacccucguggaggagcaagacgcaaauuucgucugccggcgcaccuuuguggaccgugggugggggaacggcugcggucuguuuggcaaaggguccuuaaucacgugcgccaaauucaagugcguaacaaaacucgaggguaagaucguccaauaugagaacuuaaaguauagcgugaucgugacggugcacacaggcgaccaacaccaggugggaaacgagucgacggaacauggcaccaccgcgaccaucacgccacaagcuccuagcacggagauacagcuaacggacuacggggcacucacacuggacugcagcccgagaaccggccuggacuucaacgagaugguccuucucaccaugaaggagaaaaguuggcugguacacaagcaaugguuccucgaccugccgcugccuuggacgagcgggguguccacaagccaggagaccuggaacaggaaggaccuccuggugacguucaaaaccgcacaugccaagaagcaggagguaguaguccucggcucccaggagggcgccaugcacaccgcccucaccggggccaccgagauccaaaccagcggcaccaccacgaucuucgcugggcaccuuaaaugccggcugaaaauggauaagcugacacugaaaggcauguccuacguuaugugcaccgggagcuucaagcuggagaaggaagucgccgagacccagcaugguacuguccucguucagauuaaguaugaggguaccgacgcgcccugcaagauacccuucuccacccaggacgagaagggggugacccagaacggucgucugauaacggccaacccgaucgucaccgacaaggaaaaaccugugaacaucgaagcagagccgccauucggugagagcuacauuguuauuggcgcgggcgagaaggcgcugaagcuguccugguucaagaaggguagcuccaucgguaagauguucgaagcgaccgcccguggggccagacgaauggcaauccucggggacacugcuugggacuucggcucaauaggcggcgucuucacgaguguggggaagcugguacaccagauuuucgggacagccuaugggguacuuuucucaggcgucuccuggaccaugaagaucgggauuggagugcucuuaacauggcuaggacucaacuccagaaguacgagcuuauccaugaccuguaucgcgguaggucugguuacucucuaccugggcguaaugguccaggcugacagcgggugcgugaucaacuggaaggggcgggagcugaagugcgggagcggcauauucgugaccaacgagguccauacguggacugaacaguacaaguuccaggccgauuccccgaaacgucucagcgccgccauuggcaaggccugggaggaggggguuugcggcauccgguccgcgaccagacuagagaacaucauguggaagcaaauuagcaaugaacugaaccacauccuucuggagaacgauaugaaauucaccgugguggucggggacguggccggcauccuggcgcaggggaagaagaugauccguccccagcccauggaguacaaguacagcuggaagaguuggggcaaggcgaagauaaucggcgccgacguccaaaacaccacuuucauaaucgacgggccuaauaccccggagugccccgaugaccagcgggccuggaacaucugggaaguugaagacuacggcuucgggauuuucaccaccaauaucuggcucaagcugcgugauucuuacacucaagugugcgaucaccggcugaugagcgcugccaucaaggacuccaaagccguccacgccgacaugggcuacuggaucgaaagcgagaagaacgagaccuggaagcucgcccgggcgagcuucaucgaggugaaaacgugcaucuggcccaagucccauacacugugguccaacggcguguuagagucggagaugaucauacccaaaaucuacgguggcccuaucagccaacacaacuaccgccccggguauuucacgcagacggccggucccuggcaccucgggaagcuagaauuagacuucgaccucugcgagggcaccaccgucgugguggacgaacauugcgggaaccgggggccaucgcugagaacgaccacagucaccggaaaaaucauccacgaguggugcugucgguccugcacgcuaccgccacugcgcuucaagggggaggacggcugcugguauggaauggagauucguccgguaaaggagaaagaagagaaccuggucaagagcaugguuucugccgguaguggugagguagacagcuucucccuaggguuacuguguauaagcaucaugauagaggaggugaugcgcucacgguggagccgcaagaugcugaugaccggcacucucgcuguauucuuccuucugaucauggggcaacuuaccuggaacgaccuaauucggcugugcauuauggugggugcgaacgcguccgaucggauggggaugggcacaacuuaucucgcacucauggccaccuucaaaaugagaccgauguucgcggugggccuccuuuucaggcgccugacuucgcgggagguucuccucuugacgauaggacuguccuuagucgccucugucgaguuaccuaacucccuggaagaacugggagacggacuggccauggggauuaugauacucaagcucuugacggauuuccagagccaccaacucugggccacgcuccugucgcugaccuucaucaagacgaccuuuucgcuccacuacgcuuggaagaccauggcuaugguccuguccaucguaagccuuuucccccucugcuuaucaacaacgagccaaaaaacaaccuggcugcccguccuccugggcucccuagggugcaagccgcugaccauguuccuaaucgcggaaaacaaaaucuggggccggaaaucguggccacugaacgaggggaucauggccgugggcauagugagcauuuuguuauccagccugcucaagaacgacgucccccuggccgggccccuuaucgcgggcggcaugcucaucgccugcuacgugaucucagggagcucggcggaccugagccuggagaaggccgcggaggucuccugggaggaggaggccgagcauagcggcgccucccacaacaucuuggucgagguccaggacgaugggacgaugaagaucaaagacgaggagcgggacgacacccugacaauccuccucaaggcgacacugcuagcggugucuggcgucuauccgcucuccaucccugcuacgcuguucgugugguacuucuggcagaagaagaagcagcgaagcgggguccuaugggacacgcccagcccgccugaagucgaacgggccgugcuugacgacgggauauaucgaaucaugcagcgcgggcuacucggucggagccaggugggcguuggcguauuccaggagaacguguuccacaccauguggcacgucacacggggcgcaguguuaauguaccagggcaaaaggcucgaaccuuccugggcgagcgugaagaaggaccugauauccuacggugggggguggcgguugcagggcagcuggaacaccggggaagagguccaagugauugcuguggagcccggcaagaaccccaagaacguucagacggcccccgguacguucaaaaccuccgagggcgaggugggagccaucgcuuuagacuuuaagccugggacuagcggaucuccaaucgugaaccgcgaagggaagaucgucggacuguacgggaacggaguggugaccacauccggcaccuaugucagcgcaaucgcgcaagcaaaggccucccaggagggaccccugccggagaucgaggacgagguguuccgaaagcggaaccucaccaucauggaccugcacccggguucagggaagacccgccguuaccuacccgcgaucgugcgggaggccaucaaacgcaaguuacggacacugauucuggccccgacccgcgucguagcuuccgaaauggccgaagcucucaaaggcaugcccauucgcuaccaaaccacggcaguuaagucggagcauacaggaaaagagaucgucgaccugaugugucacgccacuuucaccaugcggcuguuaucccccgugcgcgugcccaauuacaauaugaucauaauggacgaggcccacuuuacggaccccagcuccauugccgcgagggguuacaucuccaccagggucggcaugggggaggccgccgccaucuuuaugacugccacgccgcccgggagugucgaagcguucccccaaagcaacgcaguuauccaggacgaggagcgggacauucccgagcgcuccuggaacuccggguaugaguggauaacugauuucccugggaaaaccgucugguucgugccauccaucaagagcgguaacgacauagccaacugccugaggaagaacgggaagcgcguaauccaacugucccgaaaaaccuuugacaccgaguaccagaagacuaagaacaacgacugggacuacguuguaacgaccgauaucucggagaugggcgcgaacuuccgcgccgaucgagugaucgacccacgccggugccucaaaccagugauucucaaagaugggcccgagcgcgugauccuugccgggcccaugcccgucaccguggccuccgccgcccagaggcgcggcagaaucggccgcaaccacaacaaagagggagaccaguauauauacauggggcagccgcucaacaacgaugaagaccacgcccacuggacggaggccaagaugcugcuggauaacaucaacacaccugagggcauaaucccugcccuguucgagcccgaacgggaaaaguccgccgcgaucgauggugaguauagguuacgaggcgaggcgcgaaagacguucguggagcuuaugagacgcggggaccucccggucugguuaucauacaagguagcaucagaaggcuuucaguacuccgacagacgauggugcuucgacggugagcggaacaaccaggugcuggaggaaaacauggacguugagaucuggacaaaggaaggcgaacggaagaaauuacgcccccgguggcuggacgcccgcacguacuccgauccacuggcuuugcgggaguucaaggaguuugccgccggcaggcgguccguguccggggaccugauccuggagauaggcaaauugccgcagcaccugacccagcgcgcccagaacgcccuugacaaccucguuaugcugcacaacagcgagcaaggcgggcgggcuuaccgccacgcgauggaggagcugccggacaccauugagacccucaugcugcuggccuugaucgccguccugaccggcggugugaccuuguucuuccucuccggccgcgggcucggcaagaccucgaucggucugcucugcgugauggcuucgaguguacugcucuggauggcuuccguggagccccacuggauugcggcguccaucauuuuagaguucuuucuaaugguacuacucauccccgaaccagaccgccaacggaccccgcaggacaaucaacuggccuaugucgucaucggguugcucuuuaugauccugaccguggcugccaacgagaugggacugcuugagacgaccaagaaagaccuggggaucggccaugucgcaguggagaaccaccaccacgccgcgauguuggacguugacuugcaccccgcaucagcuuggacccuguaugcggucgcgacgacaaucaucacccccaugaugcgucauacaaucgagaauacaacagccaauauaagccugacagccauagccaaccaggccgcuauccucaugggcuuggacaagggcuggccgaucuccaagauggacaucggcgugccacugcuugccuuggggugcuacagccaaguaaaucccuugacacucaccgccgcgguccugauguugguggcccacuacgcgauaaucggcccaggacuccaggcgaaggcuacucgggaggcccagaagcgcacggcagcuggcaucaugaaaaacccgaccguggacgggauagucgccauagaccuagaucccgugguguacgacgccaaguucgagaaacaguuaggacagaucaugcuccugauccuuugcacaucccagaucuugcuuaugcgcacgaccugggcgcugugcgaaaguauuacgcuagccacagggccgcugacgacccugugggaggggucgcccggcaaguucuggaauacuaccauugcagugaguauggccaacaucuuccgggggagcuaccucgccggcgcgggccucgccuuuucccucaugaagucccucgggggcgggcgccgaggcacgggggcccagggagagaccuuaggagagaaguggaaaaggcagcugaaccagcucucuaagagcgaguucaacaccuauaaacguagcgggauuauggagguagaccgcagcgaggccaaggagggucugaagcguggagagacgacgaaacaugcgguguccaggggcacagccaaacuacguugguucgucgaaagaaaucucgugaagccggaggggaaggugaucgaccugggcugcggccgcggcggguggagcuacuacugcgcggggcucaaaaaagucacggaggugaagggguacacaaagggcgggcccggccacgaggagcccaucccuauggcuacguauggguggaaucuggugaaacugcacagcggcaaggacguuuuuuuuaucccuccggagaaaugcgacaccuugcugugcgacaucggggagucuucuccuaacccuaccauugaggaaggcagaaccuuacggguguuaaaaaugguggaaccguggcuccgcgggaaccaguucugcaucaagauccucaaccccuacaugccaagcgucgucgagacgcuggagcagaugcaaagaaaacauggaggcaugcugguuagaaacccccuaucgcggaauagcacccacgagauguacugggucuccugugggaccggcaacaucguaagcgcgguaaacaugaccucccggaugcugcugaaccgauuuaccauggcgcaccgcaaaccgacguacgagagagacgucgaucucggggcuggcacccggcauguggccguggagccugaggucgcgaacuuggacaucauuggccagcgcauagaaaacaucaaacacgagcacaagucgacuuggcacuacgacgaggauaauccguacaagaccugggccuaccacgggucuuacgaagugaagcccucaggcagcgcuuccagcaugguuaacggcguggugaagcuguuaacgaagccgugggaugucauccccauggugacgcagaucgccaugacggauaccacgccauucggacaacagcggguguucaaagaaaagguugacacacggacgcccaaggccaagcgcgggacugcccagaucauggaggucacggcgaaauggcuauggggcuuccuaucccgaaauaagaagccccggaucuguaccagggaggaguucacccggaaggugcgcagcaacgcggccaucggcgccgucuucguggacgaaaaccaguggaacuccgccaaggaagcgguugaagaugagcgguucugggauuuaguccaccgcgagcgggagcugcacaagcaagggaagugcgcgacgugcguauacaauaugaugggcaagcgcgagaagaaauuaggcgaauuugggaaggcuaaggggagccgcgccaucugguacauguggcucggcgcccguuuccuggaguucgaggcgcugggcuucaugaaugaagaccauugguucucccgggagaauagccugagcgggguggaaggagaagggcuacacaagcugggguauauacuacgcgacaucucaaagauucccgggggcaauauguacgccgacgauacggcuggcugggacacucguaucaccgaggacgacuuacaaaacgaagccaagaucaccgauaucauggaacccgaacacgcguugcucgcaaaauccauauucaagcuaacguaccagaacaaggucgugagagugcagcggccagccaagaacggaaccgucauggacgucaucagccgccgagaccagcguggcucaggccaggugggcacuuauggcuugaacaccuuuacgaauauggaggcacagcucauccggcaaauggaaagcgaagggaucuuuucccccagcgaguuagagacccccaaccucgccggacggguccucgacugguuggagaagcacgggguagagcgccuaaagcgcauggcgaucuccggggacgacugcgucgucaaacccauagaugaucgauucgcuaccgcccucaccgcacugaacgacauggggaaggugcggaaggacaucccgcagugggagcccucaaagggcuggaacgauuggcagcaaguacccuucugcagccaccacuuccaucagcuuaucaugaaggacggccgggagaucgucguucccugccggaaccaggacgaguugguagggagagcccgggucucacagggcgccgguuggagucugcgcgagacugcuugucugggaaaaucuuacgcccagauguggcagcucauguacuuucaccggagggaucuccggcuggcggcuaaugcgaucuguagugccguucccgucgauugggugcccaccucucgaaccaccuggagcauccacgcccaucaccaguggaugacaaccgaagacaugcucucgguguggaaccggguguggauugaggagaaccccuggauggaggacaagacccacaucagcuccuggggcgacgugcccuaccugggcaagcgcgaggaccaguggugcggcagcuugauagggcucaccgcccgggcaacgugggcgaccaauauccaggucgccaucaaccaggugcgccguuugaucggcaacgagaauuaccuagacuacaugacaucaaugaaacgguucaagaaugagagcgacccagagggggcucucugguag

SEQ ID NO: 24454 - RNA, 9879 nt, Artificial Sequence
  derived and/or modified CDS sequence (opt11) from DENV-1__GU131743__SS-prME
agcgugacuaugcugcucaugcugaugcccacagcacuggccuuucaccucaccacccggggaggcgaaccgcacaugaucgugucaaaacaagaacgggguaagucauugcuauucaagaccagcgcgggugugaacaugugcacccucaucgcaauggaccuaggcgagcugugcgaggacaccaugacauacaagugcccccgcaucaccgagaccgagcccgacgauguggacugcuggugcaacgccacggacaccugggugaccuacgggaccugcagccaaaccggagagcaccggcgcgacaagcgcuccguggccuuagcgccacacgugggccuggggcuggagacccgcacagaaacauggaugagcucugagggcgcguggaagcagauccagcggguagagacgugggcccuccgccaccccggguuuaccgugauugcccuguuucuggcacacgccaucgguaccagcauuacccagaaggguaucaucuucaucuuacugaugcuggugacacccuccauggccaugcggugugucggcaucgguagccgcgacuucguggaaggccucuccggcgccaccuggguggacgucguguuggagcauggaucgugcgugacaaccauggccaaggacaaaccuacucuggacaucgagcuacugaagaccgaggucacaaaccccgccgugcuucggaaguuaugcaucgaggccaaaauuuccaauaccacgaccgacaguaggugcccgacccagggcgaggccacccucguggaggagcaagacgccaacuucgugugcagacgaacguuuguggaccggggcugggggaacggcugugggcuguucggcaaagggucccucaucacgugcgccaaguuuaagugcgugacgaagcuggaggggaagaucguccaguacgaaaaccugaaguacuccguuaucgugaccguccacacgggcgaccagcaccagguggguaacgaguccacagagcauggcaccaccgccacgaucacgccccaggcgcccaccaccgagauccaacucaccgacuauggggcccugacgcuggauugcagcccccggaccggacucgacuucaacgagaugguccugcuaaccaugaaggaaaagucuuggcuugugcauaagcagugguuccuggaccugccgcuuccauggaccagcggugccucuacuucacaagagaccuggaaucggcaggaccugcugguaaccuucaagaccgcccaugccaagaagcaggaggucgugguucucggcagccaggagggcgcgaugcacacagcccugacuggggccaccgagauccagacuuccggaacgaccacaauauucgccgggcaccugaagugccggcucaagauggacaagcucacacuaaagggcaugagcuacgugaugugcacgggguccuucaagcucgagaaggagguggccgagacucagcacggcaccgugcugguccagauaaaguacgaaggcaccgacgcgcccugcaagauccccuucagcacgcaggacgagaaaggugugacccagaacggcagguuaaucacugccaaccccaucgugaccgacaaggagaagccggucaacauagaggccgagccgccuuucggggaguccuacaucgugauuggcgccggcgagaaggcucugaagcucagcugguucaagaaggggucgagcaucggaaagauguucgaggccacggccagaggggcgcggcgcauggccauccuuggcgacaccgcgugggacuucggguccaucggcggcguguuuaccagcguggggaagcugguucaccagaucuucggcacugccuacgggguucuuuucucuggggucagcuggacgaugaagaucgggaucggcguuuugcuuaccuggcugggccugaacucccgaagcaccucccugagcaugaccugcaucgcgguggggcucgucacgcuguaccugggagugaugguccaggccgacuccggcugcguaaucaacuggaagggccgggagcucaagugcgggagcggaauauucgucaccaacgaggugcacaccuggacugagcaguacaaguuccaagccgauucuccgaaacgccuguccgcggccauaggcaaggccugggaggagggggucugcggcauaagguccgccacccggcuagagaacaucauguggaagcaaauauccaaugagcucaaccacauccugcuggaaaacgacaugaaguucacugugguagucggagacguugcgggcauccucgcgcagggcaagaaaaugauucggccccagccaauggaauacaaguauaguuggaaauccugggggaaggccaagauuaucggcgccgacgugcaaaacaccaccuucaucaucgaugggccaaacaccccggagugccccgacgaccagcgcgccuggaauauuugggaggucgaggacuacggcuucgggaucuucacgaccaauaucuggcugaaacugcgggauuccuacacccaggugugcgaccaccgccugauguccgcagccauuaaagacucuaaggccguacacgccgacaugggguacuggaucgagucugagaaaaacgagacauggaagcuggcccgggccagcuucaucgaaguuaagacgugcauuuggcccaagucccacacccuguggagcaacggcguguuagaguccgagaugaucauccccaagauauacgggggccccaucagccagcacaacuaucggcccggguauuucacacaggccgccggccccuggcaccuggggaagcuggagcucgauuuugaucugugugagggcacaacggugguuguagacgaacacugcggaaaucgggggccgucacugcgcacaacuaccgugacgggaaagaucauccacgaguggugcugccggagcuguaccuugccgcccuuacgauuccgcggggaggauggcugcugguacggaauggagaucagacccgucaaggaaaaggaggagaaccuggugaaguccaugguaagugccggcagcggcgaggucgacuccuucagcuuaggguuacugugcaucucuaucaugaucgaagaaguaaugcggucccguuggucccggcgcaugcucaugaccggcaccuuagccguguucuuccugcucaucauggggcagcuaacguggaacgaccugauacgauugugcaucaugguaggcgcuaacgcaagcgauaggauggggaugggcaccaccuaccuugccuuaauggccaccuuuaagaugcgcccgauguucgcagugggccuccuguuccggcgccucacgagccgggaagugcuccugcugaccaucggcuuaucacuugucgcguccguggagcugccuaauagccucgaggagcugggcgaugggcuggccaugggcaucaugauccugaagcuguugaccgacuuccaaucccaccagcucugggccaccuuauuaucucucacguucauaaaaaccacauuuucccugcacuacgccuggaagacgauggcgaugguccugagcaucgucuccuuguucccccugugucuguccacaaccucucagaagacgacguggcuccccgugcugcugggcagcuuggggugcaagccgcugacaauguuccugaucgcugagaauaagaucuggggacgccgguccuggccauugaacgaggggaucauggccgucggaaucgugagcauccugcugagcagccucuugaagaacgacguuccccuggccgguccccucaucgcgggcggcaugcucauagcgugcuacgugaucagcggguccuccgccgacuuaucucucgagaaggccgcagaagugucaugggaggaagaggccgaacacuccggcgcgucccauaacauccugguggaggugcaggacgacgggaccaugaaaaucaaggaugaggaacgcgacgauaccuuaacaauccuccugaaagccacucuacucgccgugagcggcgucuacccccugagcauucccgcgacucuuuucgucugguacuucuggcaaaagaagaagcaacgguccggggugcucugggacaccccuucgccgcccgagguggagcgagccguccuggaugacggcaucuaccgcaucaugcagcgcggccugcugggacggucccaggucggcgucgggguuuuccaggagaacguguuucacaccauguggcacgugacgaggggcgcgguacucauguaucaaggcaagcgguuggagccuucaugggcuuccgugaagaaggaucugaucagcuacggcggcggcuggcgccuucagggcuccuggaacacgggggaggagguucaagugaucgccguggagcccggcaagaaucccaagaacguucaaacggcccccgguaccuuuaaaacgccagagggcgaggucggggcuaucgcgcuggacuucaagcccgggacgagcgguucccccaucgugaaccgcgaggggaagaucgugggccuguacggcaacgguguagugaccaccagcggcaccuaugugagcgcgauugcccaagccaaggccucccaggagggcccccuccccgagaucgaggacgagguguuccggaagcgaaaccugacgauaauggaucugcaccccggcagcgggaagacccgacgguaccucccggcaaucgugagagaggcgaucaagcguaaacuacggacccucauccucgcccccacccgcgucguagccucggagauggcggaagcgcugaagggcaugccaauucgguaccaaacgacggcggucaagagcgaacacaccggcaaggagaucguggaccugaugugccacgccaccuuuaccaugcgucuccugucccccgucagagugccuaacuacaacaugaucaucauggacgaggcccacuuuaccgaccccucguccaucgcggcacgcggguacaucaguacccgggucggcaugggcgaggccgccgccaucuuuaugacagcgacgccacccggcagugucgaggccuucccgcaaagcaacgccgucauccaggacgaggagcgcgacauacccgagcgguccuggaacucaggguacgaguggaucacagacuuccccgguaagaccgucugguucguucccucaaucaagagcggcaacgacaucgccaacugucugcgcaagaacggaaagcgggucauccaacucucaaggaagacguucgacacggaguaccagaagacgaagaacaacgacugggacuacguggucaccaccgacauaagcgagaugggcgcaaacuuuagggccgaucgcguuauagacccgcgccguugcuugaagcccgugauccugaaagacgggcccgagagggucauccucgccgggcccaugcccgugaccgucgccuccgccgcgcagcgacgggggcgcauaggccgcaaucacaacaaggagggcgaccaguacaucuacaugggccagcccuuaaacaaugacgaggaccacgcgcauuggacugaggcuaagaugcugcucgacaacauaaacacucccgagggcauaauccccgcccuauuugagccggagcgggagaaauccgccgcgaucgacggugaguaucgcuugcggggcgaagcucgcaagaccuuuguggaguugaugcggcgcggugaccugcccguguggcugucguauaaggucgcuagcgagggcuuccaauauagcgacagacgcuggugcuucgacggcgagagaaacaaucaaguccucgaggagaauauggacguggaaaucuggacgaaggagggggaacgcaagaaguuacgcccccguuggcuggacgcccggaccuacuccgacccgcucgcccugcgcgaguucaaggaguucgccgccggaaggcgcagcgucuccggggaccugauacuagagaucgguaagcugccgcagcaucugacccagcgugcccagaaugcccucgacaacuuggugauguuacacaauucugaacagggagggagggcguaccggcacgccauggaagaguugcccgacaccaucgagacacucaugcugcucgccuuaauagcugugcugacgggcggggucacccucuucuuccugucgggucgugggcugggcaagaccagcaucggucuccugugcgugauggcuuccucgguguugcucuggauggcgucaguagagccgcacuggauugccgccagcauuauccuggaguucuuccuuaugguguuguuaauacccgagccggaccggcagcgcacgccccaagacaaccaacuggccuauguggucaucgggcuccucuucaugauccuuacgguggccgcaaacgagaugggccucuuagaaaccaccaagaaggaccuggggauuggccacguggcugucgagaaccaucaccacgcggcgaugcucgacguggacuugcaccccgcgagugcguggacccuguaugccguggccacgaccaucaucaccccgaugaugcgccacaccaucgagaacacgaccgccaacauuucgcucaccgcgauugcaaaccaggccgccaucuugauggggcuggacaagggcuggccgaucuccaagauggacaucggcguuccccuccuggcgcuggguugcuacagccagguaaacccgcuuacccugacggcggccguucugauguuggucgcccacuacgccaucauaggccccgggcuucaggccaaggccacucgugaggcucaaaaacguaccgcggccggcaucaugaagaacccuacaguggacgggaucguagcaauugaccuggacccaguaguguacgacgcgaaguucgagaagcagcuuggccagauaaugcugcugauucucugcacgucccagauacugcugaugcggaccaccugggcucuuugcgagagcaucacccuagccacgggcccccugaccacccucugggaggguuccccuggcaaauucuggaacaccacgaucgcagugagcauggccaacaucuuucgcggguccuauuuggcgggggccggucuggccuuuucgcucaugaagucccucggaggcgggcggcgcggaaccggggcucagggagaaacccugggcgagaaguggaaacggcagcucaaccagcuguccaaaucagaguucaacaccuauaagcgcuccggaauaauggaggucgaccgaagcgaggcgaaggaaggccugaagcgaggugagacgaccaagcaugccgugagccggggcaccgccaagcuacgcugguucguggagagaaaccucgucaagcccgagggcaaggugaucgacuuaggcugcggccgagggggcuggagcuacuacugcgcgggguuaaagaagguuaccgagguaaagggcuacacuaagggcgggcccggccaugaggagccgaucccuauggccaccuauggguggaacuuggugaagcugcacuccgguaaggacguguucuucauaccgcccgagaagugugacacccuauugugcgacauuggugagucaucccccaaucccaccaucgaggagggcaggacucugcgcguccugaagaugguugagcccuggcuccggggaaaccaguucugcauaaaaauacucaaccccuacaugccaagcguggucgagacccuggagcagaugcagcgcaaacacgguggcauguuggugcgaaauccuuuaucgcgcaacucgacccacgaaauguauuggguguccugcgggacgggcaacaucgucagcgcggugaacaugaccucccgcaugcuccuuaaccgguuuaccauggcccaccgcaagcccacguacgagcgggacguugaucugggagccggcaccaggcacgucgcuguggagcccgagguggccaaccuggacgucauaggccagcggaucgagaacaucaagcacgagcacaaauccaccuggcacuacgaugaggacaacccauacaagacuugggcguaccacggguccuacgaggugaagccaagcggcagugccagcucgauggucaacgggguagugaaguugcugaccaagcccugggacgucauccccauggugacccagaucgcaaugacugacacgacuccguucgggcagcagaggguguucaaggaaaaggucgacacccggaccccgaaggccaagcgcgggacggcccagaucauggaggugacugcuaaguggcuguggggcuuccucucgcgcaacaagaagccccgcaucugcacccgggaggaguucacccgcaaggugcggaguaacgccgccauuggcgccgucuucguggacgagaaccaauggaacucugcgaaggaggccguggaggacgagcgcuuuugggaucuaguccaccgggagagggaacugcauaaacaggggaagugcgccacgugcguuuacaacaugauggguaaacgggagaagaagcugggcgaguucggcaaggcuaagggaagccgcgccaucugguacauguggcugggcgcgcgguuccucgaguucgaagcccucggauucaugaacgaagaucacugguucucucgcgagaacagccuguccgggguggagggcgaggggcuacacaaacuuggcuauauccugcgggacaucagcaagauccccggagguaacauguacgccgacgacaccgccggcugggauacccgcaucacagaagacgacuuacagaacgaggcccguaucacggacauuauggagccggaacaugcacuacuggcuaaguccauuuucaagcugaccuaccagaacaaaguuguacgagugcagcgccccgcuaagaacgggaccgucauggacgucaucagccggcgcgaucagcggggcuccggccagguggggaccuacgguuugaacacguucaccaacauggaggcacagcugauccgccaaauggagagcgaggggaucuucucucccagcgaacucgaaacccccaaucucgccgagcggguccucgacuggcugggcaaguaugggguagagcgccucaagcggauggcgauauccggugacgacugcguggucaagccaauugacgaccgcuucgccaccgcccugacggcccugaacgacauggggaaggugcggaaagacaucccccagugggagccaucaaagggcuggaacgacuggcaacagguccccuucugcagucaccacuuccaccagcucauuaugaaggacggccgcgagaucguugugccgugccgaaaccaagacgagcuggugggucgcgcgcgggucagucagggcgcgggcuggagccuucgcgaaaccgcgugccucggcaaguccuacgcccaaauguggcagcugauguacuuccaucggcgcgaucuacgucuugccgccaacgccaucugcagcgcggugccaguggauuggauucccacaucacgcacuacguggucuauccacgcccaccaccaguggaugaccacggaggacaugcugagugucuggaacaggguguggaucgaggaaaaccccuggauggaagacaagacacacaucagcucauggggcgacguuccguaccugggcaaaagagaggaccaguggugcggcagccucauuggguugacggcccgcgcaaccugggccaccaacauccaggucgccauuaaccagguccggcgucugaucggcaacgagaacuaccucgauuacaugaccuccaugaagcgauucaagaacgaaagcgaccccgagggggcauuaugguga

SEQ ID NO: 24455 - RNA, 9879 nt, Artificial Sequence
  derived and/or modified CDS sequence (opt11) from DENV-1__JN093516__SS-prME
agcgugaccaugcuguugaugcugaugcccaccgcgcuggcauuccaucucacgaccagagggggugaaccgcacaugaucgucuccaagcaggaacggggcaaguccuuguuguucaagaccagcgccggaguuaacaugugcacccucaucgccauggaccugggcgaguucugcgaggacacuaugaccuacaaaugcccgcgaauuaccgaggccgaaccagacgacguggacuguuggugcaacgccacggacacgugggugaccuacgggaccugcagccaaacgggcgaacacaggagggacaagcgguccguugcacuggcgccucacguggggcucggguuagagacgcgcaccgagaccuggaugagcuccgagggugccuggaagcaaauccaaaaaguggagaccugggcacugcggcacccgggguuuacgguuauagcccucuuucuugcucacgcgaucgguaccuccauaacccagaaggggaucaucuucauacugcucaugcuggugacccccuccauggccaugcgaugcguuggcaucggaagccgggacuucguggaggggcugucuggcgccacauggguggacgucgugcuugagcacgggagcugcgucaccaccauggccaaggacaagcccacucuggauaucgagcugcugaagacugagguuaccaacccugcgguuuuacgcaaacuuugcaucgaagcaaagauaucaaacaccacaaccgauagccguugcccgacacagggcgaggccacccucguggaagaacaggaugccaacuuugugugccgaaggaccuucguggauaggggaugggggaacggcugugggcuguucgggaaggggucgcugauuacgugcgccaaguucaaaugcgugaccaaacucgaggggaagaccguccagcaugagaacuuaaaguacucaguuauaguaaccguacauaccggggaucaacaccaaguggguaacgagucuaccgagcacggaaccacugcgacuaucacgccucaggcccccucuaccgagauccagcugaccgacuauggagcuuuaacacucgacugcagcccccggacaggccuggacuucaacgaaaugguccuccugaccaugaaagagaagucuuggcuggugcacaaacaaugguuccuagacuugccgcugcccuggaccagcggggccagcacuucgcaggagacauggaaccgcaaggaccuccucgugaccuucaagaccgcccacgcgaagaagcaggaggugguggugcugggcucccaggagggcgccaugcacaccgcccugacgggcgcaacugagauucaaaccagcggcaccacgaccauauucgccggucacuuaaagugucggcuaaaaauggacaagcucacccuuaagggcauguccuacgucauguguacuggcuccuuuaagcuggaaaaggaaguagccgagacgcagcauggcaccgugcucguccagauaaaguaugagggaacagacgcgccaugcaagaucccauuuuccacccaggaugagaaggguguaacgcagaacggccgccucaucaccgccaauccgauagugacagacaaggagaagcccguaaacaucgaggccgaaccgcccuuuggagagagcuacaucgugaucggcgccggugaaaaggcacuaaagcugagcugguucaagaaagggucaucgaucggcaagauguucgaggccaccacgcgcggggcccgacggauggcuaucuugggcgacaccgcaugggacuuugggagcaucgguggcguguucacguccgugggcaaacucgugcaccaaauauucggcaccgccuacgggguccucuucagcggggucagcuggacgaugaagaucgggaucgggguacuacugaccuggcugggccucaacagccgcuccaccucucugaguaugaccugcaucgccguggggcucgucacgcuuuaccuaggggugauggugcaggccgacagugggugcguaaucaauuggaaaggacgcgagcugaagugcggauccgggaucuucgugacaaacgaagugcacacuuggacggagcaauacaaguuccaggcagauuccccgaaacgacuaagcgcugcaaucggcaaggcaugggaagagggugucugcggcauccguagcgccacccggcuggaaaacaucauguggaagcagaucagcaacgagcugaaucauauccuccuggaaaacgacaugaaguuuacagugguagucggggauguugccgggauccuugcgcaagggaagaagaugauccggccccaacccauggaguacaaauacagcuggaaguccuggggcaaagcgaagauaaucggagccgacgugcaaaauaccacuuucaucauugacggacccaacaccccggaaugucccgacgaccagcgggcuuggaacaucugggagguggaggacuacgguuucgggauuuucacgacuaacauuuggcucaagcuccgcgacuccuauacccagguaugcgaccaccgacugaugagcgcggcaaucaaggacucgaaggccguacacgccgacaugggauauuggaucgagagcgaaaagaaugagacguggaagcucgcccgcgcguccuuuaucgaggucaaaacgugcauuuggcccaaaagccauacacugugguccaauggcgugcuggagagcgagaugaucauacccaagauauacggcggcccgaucucccaacacaacuaucggccuggguacuucacucagaccgccggccccuggcaccucgggaaauuggagcuagacuuugaccucugugagggcacaaccgugguugucgaugagcacugcggcaacagagguccuucccuucguacuaccacugugacagguaagauuauccaugaguggugcugccgcuccugcacgcugccuccccugcgguucaaaggugaggacggcugcugguauggaauggagauucgcccaguuaaagagaaagaggagaaccuggucaagagcauggugucggccggcuccggcgaaguagacaguuucucgcugggccuucuauguaucagcauaaugaucgaggaggugaugcggucccgcuggagccgcaaaaugcugaugacgggcacacucgccguuuucuuucugcugauaauggggcagcuuacguggaacgaccugauccgucugugcaucauggugggcgcaaacgcguccgaucggauggggaugggcaccaccuaccucgcgcuaauggcuacguucaagaugcgcccgauguuugcaguggggcugcuguuccgccgguuaacuucacgcgaggugcuccucuuaacgaucggacugagcuuagucgccagcguagagcugcccaacucccuagaggaguugggcgacggccuagcgaugggcauaaugauccugaagcugcugaccgacuuccagagccaccaacugugggccacgcuccugucccugacguucauuaagaccaccuucucgcuacacuacgccuggaagacaauggcuaugguccuguccaucgugucacuguucccccucugccuguccacuaccagccagaagacgacguggcugccugugcuccugggcucccuggguuguaaaccgcucacuauguuucugaucgcggaaaacaagauuugggggcgcaaaagcuggccacugaacgaggggaucauggccgucggcaucgucucgauacuacuguccagccuguuaaagaacgaugugccacuggcggggccucugauugcgggcggcaugcuuauagcuugcuaugucaucucgggaaguucugccgaccugagccuggagaaggccgcggagguguccugggaggaggaagccgagcacagcggcgccucccauaacauccuuguggagguacaggaugaugggaccaugaagauaaaggacgaggagcgcgacgauacgcucaccauucugcucaaagcgacacuccuggccgugagcggcguauacccgcugaguaucccugccaccuuguuugucugguacuucuggcagaagaagaaacaacggagcgguguccugugggauaccccuagcccuccggagguggagcgcgccgucuuggacgacgggaucuaccggaucaugcagcgcggccugcuggggcggucucaggugggcgugggggucuuucaggagaacguguuccacacaauguggcacgucacgcgcggagccguccuuauguaccagggaaagcgacucgagccuuccugggcgagcguaaagaaggaccugaucaguuacggcggcggcuggcgccugcaaggguccuggaacaccggcgaagagguacaggugaucgccguggagcccgggaaaaaucccaagaacgugcagaccgcccccggaaccuucaagacauccgagggcgaggugggugccauagcccucgauuucaaacccgggaccagcggcucuccuaucgugaaccgggaagggaagaucguggggcuguacggaaacgguguugugaccacaucaggcacguauguuagcgccaucgcccaggccaaggccagccaggagggaccccugccggagaucgaggaugagguguuccgcaagcggaaccucaccauuauggaccugcauccuggcagcgggaagacccgccgcuaccugccggcgaucgugcgcgaagccaucaagcgaaagcuccgcacgcugauacuggccccaacaaggguggucgccuccgagauggccgaagcucucaaaggcaugccuauccgcuaccaaacaacugccgugaaaagcgagcacaccggaaaggagaucgucgacuuaaugugccacgccacguuuaccaugcgacugcucuccccugugcgugugcccaacuauaacaugaucauaauggaugaggcccacuucaccgacccgagcuccaucgcggccaggggauacaucagcacuagagugggcaugggggaagccgcugccaucuucaugacugccacgccucccgggucggucgaagcauuuccucaaaguaacgccgugauccaagacgaggaacgugacaucccggagcgguccuggaacagcggguacgaguggauaacggacuuucccggaaagaccgugugguucguccccuccauuaaaagcggcaacgacaucgccaacugcuugcggaagaacgguaagcggguaauacagcuuagccgcaaaacauuugacacggaguaccagaagaccaagaauaacgacugggacuacguagucaccacggacauaagcgagaugggcgccaacuuccgcgcugaccgcguaaucgauccgcggcgaugucuuaaaccggugauccucaaagacgggccagagcgcgucauccuggccggccccaugccggugacuguugcaagcgcagcccagcgccgggggcgcauaggucgcaaccacaacaaggagggcgaccaauauaucuacauggggcagccccugaacaacgacgaggaccaugcccacuggaccgaagcgaagauguuguuagauaacaucaacacccccgagggcaucauccccgcccucuuugaacccgagcgcgagaaguccgccgccaucgacggggaauacaggcuccggggcgaggcgaggaagacguucguugagcucaugcggcgcggggaccuccccguuuggcugaguuacaaagucgcauccgagggcuuucaguacucagaccggcguuggugcuuugacggugaacgaaacaaccagguacuugaagagaacauggacguggagaucuggacaaaggaaggggaacgcaagaagcuccggccccgauggcuggacgcccggacguacuccgacccucuggcgcuccgggaguucaaggaguuugcagcgggucggcgcagcgucuccggugaccucauacuugagaucgguaagcucccccagcaccuuacucagcgggcgcagaaugcccuggauaaccucgucaugcugcacaacagcgagcagggcgggcgcgccuaccggcaugcgauggaggagcugccggacacgauagagacccuaaugcugcuggcccucauagcgguacugaccggcggggucacacucuucuuucucaguggcagggggcugggcaagacaagcaucgggcugcucugcgugauggcguccucugcccugcucuggauggcauccguggaaccucacuggaucgccgccagcaucauccuagaguucuuccugauggugcugcucauccccgagcccgaccggcagcgcacgccacaggauaaccagcuugcauacgugguuaucgggcuucucuuuaugauucugaccgucgcugcaaacgagauggggcuuuuagagaccacaaagaaagauuuagggaucggccacgucgccguggagaaccaucaccacgccacgaugcuggacgucgacuuacaccccgccuccgcuuggacccuguaugcggucgccaccacaaucaucacgcccaugaugcggcacacaaucgaaaacaccaccgccaacauaagccugacggccaucgccaaccaagcggccauacuuaugggacuugauaaaggcuggccgaucuccaagauggacaucggcgugccccugcucgccuuagggugcuacagccaggucaacccccucacucucaccgcugcaguucugaugcuaguggcccacuacgccaucauuggcccuggauugcaggccaaggccacccgcgaagcgcagaaacgaacggcagcuggcauuaugaagaauccgaccguagacgggaucgucgccaucgaucuggaccccguaguuuacgaugccaaauucgaaaagcaacuaggccagauaauguugcucaucuuauguaccagccagauccugcugaugcgcacuacgugggcauuaugcgagaguaucacccucgcuacaggcccuuugacgacccugugggaggggucacccggcaaguucuggaacaccacaaucgcuguguccauggccaauauauuccgugggagcuaccuagccggcgcuggccuggccuuuagccugaugaagucccucgggggcgggcguaggggaacuggggcccagggcgagacacuaggcgagaaguggaagcgacaacugaaucagcugaguaaaagugaguuuaacacguauaagcgcuccggaaucauggagguugaccggagcgaggcuaaggaaggccugaagcgcggggagaccaccaaacacgccgucuccagaggcaccgccaaauugcgcugguuugucgagcggaaccucgugaagccggaagggaagguuaucgaccugggcuguggcagagggggauggagcuacuauugcgcaggacugaagaagguuaccgaggucaagggcuacacgaagggcgggcccggccacgaggagcccauucccauggccacauacggguggaaccucgugaagcuccauaguggcaaagauguguucuucauuccgcccgaaaagugcgacacacugcuuugugacaucggggagagcucgccaaacccgacaaucgaggagggccggacccucagaguacuaaagaugguagagccuuggcugcgagguaaccaguucuguauaaagauccucaaucccuacaugcccuccguaguggagacccuggagcagaugcagcggaagcacggcgguaugcugguccggaaccccuugucccgcaauuccacccacgaaauguacuggguguccugcgggaccggaaacaucguuagcgcugucaacaugaccucacgcaugcuguuaaaccgcuucaccauggcgcaccggaagccgacuuacgagcgcgacguugaccucggggccggcacgcggcacguugccguggaacccgagguugcgaacuuggacaucaucggccagcggaucgagaauauaaagcacgagcacaaaagcaccuggcacuaugacgaagauaaccccuacaaaaccugggccuaccauggguccuacgaggugaaacccucaggcucggcguccagcauggucaauggcguggucaagcucuugacaaagccgugggacgugauccccauggugacgcagaucgcaaugacggacacaacccccuucggacagcagcgcgucuuuaaggagaagguggacacucggacccccaaggccaagcgggggaccgcccagauuauggaagugacagccaaguggcuuuggggcuuccugagccgaaauaagaaaccgagaauuuguacgcgggaggaguucacccgcaaaguccguucuaaugcggcgaucggcgccguguucguggacgagaaccaauggaacucggccaaggaggcggucgaggacgagcgcuucugggaccucguucaccgggagcgcgaauuacauaaacaggggaagugcgcuaccugcguguacaauaugaugggcaagcgggagaagaagcuaggagaguucggcaaggccaaggggagccgcgccaucugguacauguggcucggugcaagguuccuagaguucgaggcccugggauucaugaacgaggaccacugguucuccagagaaaacucgcucagcggagucgaaggcgaggggcugcacaagcugggcuauauccuccgggacaucagcaagaucccaggaggcaacauguacgcagacgauaccgccgggugggacacgaggauaaccgaggaugaucuacaaaacgaggcgaagaucacggacaucauggaaccggagcacgcccugcucgcgaagaguaucuucaagcugacguaccagaacaaggugguacgcguccagcgcccggccaagaauggaacgguuauggaugugaucagccggcgcgaccagcgggggagugggcaaguggguaccuacggacugaauaccuucaccaacauggaagcacagcuaauccggcagauggagagcgaggguaucuuuaguccuagcgagcuugagacucccaaccuugccgggcgcgugcucgacuggcuagagaaacauggaguggagcggcuaaagcgcauggccauauccggcgaugacugcgucguuaagcccaucgacgauagguucgccaccgcccucaccgccuuaaacgacaugggcaaggugcggaaagacaucccgcagugggagcccucgaaaggauggaaugauuggcaacaggugcccuucugcagccaccacuuucaccaacugaucaugaaggacggccgggaaaucgucguuccuugccgcaaccaggacgagcuugucggccgggcucgcgucagucagggcgccggguggagccuccgggagaccgcgugccuaggcaagucguacgcccagauguggcagcucauguacuuucaucgccgcgaucugcgccuggcggccaacgcaaucugcagcgccgucccggucgaauggguaccaaccucccggacaacuuggagcauucacgcccaccaucaguggaugaccaccgaggacauguuaucagucuggaaccgugucuggaucgaggagaaucccuggauggaagacaagacgcacaucucuagcuggggcgaugugcccuaccugggcaagcgcgaggaccaguggugcgguucucugaucgggcucaccgcaagagcgaccugggcgacgaacauccagguggcaaucaaccaggugaggcgccugaucgggaacgaaaacuaccuggacuacaugaccucuaugaagagauucaaaaacgagagcgacccggagggggcccucugguga

SEQ ID NO: 24456 - RNA, 9879 nt, Artificial Sequence
  derived and/or modified CDS sequence (opt11) from DENV-1__GU131746__SS-prME
agcguuacuaugcugcuaaugcugaugcccaccgcccuggcuuuucaucucaccacccgggguggugaaccccacaugaucguuagcaagcaggaacgaggcaagagcuuacuguucaagaccucagccggggugaauaugugcacccucauagcgauggaccugggggagcugugugaggacacaaugacauacaaaugcccccgcaucaccgagaccgaaccagacgauguggauuguuggugcaaugccacggacacguggguaaccuaugggacuugcagccaaacgggcgagcaccgccgcgacaagcgauccguggcccucgcuccgcacguaggacugggccucgagacccgcaccgagaccuggaugagcagcgagggagccuggaagcagauccagcgggucgagacgugggcccuccgccaccccggauucaccgugauugcccuguuucuugcucacgcaaucggcaccagcaucacucagaaggggaucaucuucauucugcucaugcuggugacccccuccauggcgaugcggugugucgguaucggcagccgcgacuucguggaggggcucuccggagcaacguggguggacgucguccucgaacacgggagcugcguaaccaccauggccaaggacaagcccacguuggacauagaacuucugaagacugaggucaccaaccccgccguucugcggaagcucugcaucgaagcaaaaauaucgaauaccacuacagacucccgcugcccgacccagggcgaggccacccugguagaggagcaggacgcuaacuucguuugccggaggacguucguugacagaggaugggggaacggcugcgggcuguucggcaaagggagucuuaucacaugcgccaaguucaaaugcguaacaaaacuggaaggcaagaucguccaguacgagaaucugaaguacucuguaauagugaccguacacacgggcgaccagcaccagguaggaaaugagaguaccgaacacgguaccaccgccaccaucacgccccaggcgcccacuaccgagauccagcucaccgacuacggggcgcugacgcuggacugcagccccaggacuggccucgacuucaaugagaugguccugcuuaccaugaaggaaaagucguggcucgugcauaagcaaugguuccuggaccugcccuuacccuggaccagcggcgccaguacaucccaagagaccuggaaccggcaagaucugcucgugaccuucaagacagcccacgcgaagaagcaagaagucguagugcucggcucgcaagagggagcgaugcacacagcccugacuggggccacggaaauccagaccagcgguacgaccacaaucuucgccgggcaucugaagugucgccucaagauggacaagcucacccugaagggaaugagcuacgucaugugcacgggguccuucaaauuggagaaggagcuggccgaaacccagcauggcaccguucucgugcagaucaaguacgagggcacagacgcgccaugcaaaauccccuuuucgacgcaggacgagaaagggguuacccaaaauggccggcugaucaccgccaaucccauugugaccgacaaagaaaaacccgugaacaucgaggcugagccgcccuucggggagucauacauagucaucggcgcgggugagaaggcuuugaaacuuagcugguucaagaagggaucgucgauaggcaaaauguucgaggcgacugcucgaggggccagacgcauggccauccugggcgacaccgcuugggacuuuggaaguaucggcggcguguucacuagcguggggaagcuaguccaccaaaucuuuggcacagcguacgggguguuauucuccggcgugagcuggacgaugaagaucggcaucggugugcugcugacguggcugggccugaacucccgcagcacgucccucagcaugaccugcaucgccguagggcuggugacccuguaccucggagucauggugcaagcugauuccggaugcgugaucaacuggaagggccgggaguugaaguguggcucgggaauuuucgucaccaacgaggugcauaccuggacugagcaguauaaguuucaggccgauaguccaaagcgacugucugcagccauuggcaaggccugggaggagggggugugcggcauucggagcgccaccagacucgaaaacaucauguggaagcagaucuccaacgaguugaaccacauccugcucgagaacgauaugaaguucacaguuguggugggcgacgucgccgggauccucgcccaggggaagaaaaugauccggccgcagccaauggaguacaaguauucuuggaaaucguggggcaaagcuaaaauaaucggcgccgauguccaaaacaccaccuucaucauugacgggcccaacacaccggagugcccagaugaccagcgagccuggaacaucugggagguggaggauuacgguuucggcauuuucacgaccaauauauggcugaaacuccgggacagcuacacacaggugugugaccaccgccucaugagcgcggccaucaaggacagcaaagccgugcacgcagauaugggcuacuggaucgaguccgagaagaacgaaacguggaagcuggcccgggccagcuucauugaggugaagacguguaucuggccaaagucccacacccucugguccaacgguguucuggaauccgaaaugauaaucccaaagaucuacggagggccgaucucacaacacaacuacaggcccggauacuucacccagaccgcgggcccauggcaccuggggaagcucgaguuagauuucgauuugugcgagggaacgacggucguggucgacgagcacuguggcaaccgggggccgucccuccgcaccaccacggugaccggcaaaaucauccacgaguggugcugccggucaugcacccugccuccucugcgcuuccggggagaagauggaugcugguaugggauggagauccgccccgucaaggagaaagaggaaaaccucgucaagaguauggugagcgccggcucaggcgagguggacuccuucagccugggguugcugugcaucucuaucaugaucgaagagguuaugaggucccgcuggucacggaagaugcuuaugaccggcacacuggccguguucuuccuccugauaaugggucaguuaaccuggaacgaucucauccgccuguguauuauggugggcgccaaugcgagugacaggauggggaugggaaccacauaccuggcccucauggccacuuucaagaugagaccuauguucgcggucgggcuguuauuccgccgguuaacuuccagggaggugcuucugcugaccaucgggcugagccugguggccagcgucgagcuacccaauagccuggaggagcugggcgacgggcucgcuauggguauaaugauucuuaagcugcuuaccgacuuucaaucucaccagcugugggcaacgcugcuuagccugacauuuauaaagaccaccuuuucccugcacuacgccuggaaaacgauggccaugauacucaguaucgugagucuuuuuccccucugccuaagcaccacgucccagaagaccacguggcugcccguacugcucggcucucuggggugcaagccucugacuauguuucucauugcggagaauaagaucuggggccggcgcucauggccucugaacgaggggaucauggcugugggcaucgugagcauccugcugagcucccuacugaagaacgacgucccgcucgcgggaccucuuauugcaggcggcauguugaucgccuguuacgugaucagcggguccagcgccgaccucucccuagagaaggcugccgaggugagcugggaggaggaggcggaacacucuggcgcgagccacaacauccuggucgaggugcaggacgaugggaccaugaaaauaaaagacgaggagcgggaugacacccucacgauccuucugaaggcaacguugcuggccguguccggggucuacccgcugagcauccccgccacccuguucgugugguacuuuuggcagaagaagaagcagcggucggggguccugugggauacccccaguccgcccgaggucgagagggccguguuagacgacgggaucuaccguaucaugcaacggggccuuuuagggcgaucccaagugggcgucggaguauuucaagagaacguguuccacacuauguggcaugucacccgcggcgccguacucauguaccaggggaagcggcuggaaccuagcugggcguccguuaagaaagaccucaucucuuacggcggcggguggcgccugcaaggcuccuggaacaccggggaggagguccaagugaucgcaguagaaccaggcaaaaaccccaaaaacgugcaaaccgccccaggaacguuuaaaacgcccgagggagaggugggcgccaucgcccuagauuucaagcccggcacaaguggcagccccaucguuaacagagaggggaagaucgucggccucuacggcaauggggucgugacaaccagcggcacguacgucucagcgaucgcccaggccaaagccucucaggaggggccgcuacccgagaucgaagaugaaguauuccggaagcgcaaucugacuauaauggaccuccaccccgguucugggaagacccgccgguaccuuccggcgaucguacgggaggccaucaagcggaaauuacgcaccuugauccuggcucccacgcgggucguggccuccgaaauggccgaggcgcuaaagggcaugcccaucagauaucagaccaccgccgucaagagcgaacacacgggcaaggagauaguggaucucaugugucacgccacguucacaaugcgauuacuguccccggugcgagugccuaauuacaacaugaucaucauggacgaggcacacuucaccgaccccagcucaauagccgcgcgggguuauaucagcacucgcguaggaaugggggaagccgccgccaucuucaugaccgccacgccucccggcuccguggaagccuuuccccagagcaaugccgugauccaggacgaggagcgggauauccccgaacguucguggaacagcggguacgaguggaucacggacuuucccggcaagaccguaugguuuguccccaguaucaagagcggaaacgacaucgccaacugcuuaagaaagaacgggaagcgcgugauccaacugucccgcaaaacguucgauaccgaauaucagaagaccaagaauaaugacugggacuacguuguuaccacggacaucagcgagaugggcgccaacuuccgagccgaccgggugaucgacccgcggagaugcuuaaagccuguaauacuuaaggauggacccgagcgggucauccucgccggcccgaugccagugacugucgcguccgccgcccagcgcagggggaggauuggacguaaccacaacaaagaaggugaccaauacaucuacaugggacagccccucaacaacgaugaggaccaugcgcacuggaccgaggcgaaaauguuacuggacaacaucaauaccccagagggcaucauccccgcuuuauucgagccugagcgcgagaaguccgcggccaucgauggggaauauaggcuccggggcgaggcgcggaaaacguuuguagaguugaugcgccguggcgaccugcccguguggcucaguuacaaagucgccagcgaaggguuccaguacagcgaccgccgguggugcuucgauggagagcgcaauaaccagguacuggaggagaacauggacgucgagaucuggaccaaggagggggaacggaagaagcuccggcccaggugguuggacgcccgcacuuacagcgacccccuggcccuccgggaguucaaggaguucgccgcgggucgccggucugugaguggagaccucauccuagaaaucggcaagcugccgcagcaccuaacccagaaggcacagaacgcauuggacaaccuggugauguuacauaauagugagcagggugggcgcgcguaccgucacgcgauggaggagcugcccgacaccauagagacccucauguugcuggccuuaaucgcaguccucaccggcggggugacgcuguucuuccuuuccggccgcggcuuaggcaaaaccucaaucggcuuacugugcgugauggccucgaguguacuccuguggauggccuccguggagccccacuggaucgcugcuaguaucauacuggaguucuuccucauggugcugcuaaucccagagcccgaccggcagcgcaccccgcaggacaaccaacucgccuacguaguaaucgggcugcuauucaugauccucaccguggccgcaaacgagaugggccugcuagaaacuacgaagaaggaccucggcaucggccaugucgccgucgagaaucaccaccacgccgcgauguuagacguggaucugcacccagccuccgcauggacgcuuuacgcggucgccaccacgaucaucaccccgaugaugcggcacacgauugaaaacacaaccgcaaacaucagccugacugccaucgcuaaucaagcggccauccugauggggcuagacaagggguggcccaucuccaagauggacaucggggugccuuuauuagccuuagguugcuauucacaggugaauccccugacccuuaccgcagcugugcugaugcugguggcacauuacgcaauaaucggcccggggcugcaggcaaaggcgacccgcgaggcgcagaagcguacggcggcuggcaucaugaagaaucccacgguugacgggauagucgcgauugaucucgaccccgugguauacgaugccaaauucgagaaacagcugggccaaauuaugcugcucauucugugcacaucccagauccuucucaugcggaccaccugggcgcugugcgaaagcaucacccuagcgaccggcccccuuacuacccugugggagggguccccgggaaaauucuggaacacgaccaucgcggugucgauggccaauauuuuucggggcuccuaccuggccggcgcgggccucgcguucucgcugaugaaaagccuaggugggggccggcgcgggaccggggcgcagggagagacccucggcgagaaauggaagcggcagcugaaccagcuguccaagagcgaguucaauaccuacaaacgcuccgggaucauggagguggaccggucagaagccaaggagggacucaagagaggggaaaccaccaagcacgcuguuucgcggggcaccgcaaaacugcgcugguucgucgagcguaaccugguaaaacccgaggggaaaguuaucgacuugggcuguggacgcggggguuggagcuacuauugugccggguuaaagaaggucacggaagugaagggcuauaccaaaggcggcccgggucacgaggaaccuaucccaauggccacauacggauggaaccuugugaagcugcacucuggcaaagacgucuucuuuauaccacccgaaaagugugacacucuucugugcgacaucggcgagucuagccccaacccgacgaucgaggagggccggacacugcgcguucucaagaugguggaacccuggcuucgcgggaaccaguucugcaucaagauccugaacccguacaugccgagcguaguugagacccucgagcagaugcaacgcaagcacggcgguauguugguccgaaacccguuaagucguaauucgacccacgagauguacugggucuccugcgggaccggcaacaucgugagcgcagugaacaugacgucccggaugcuacugaaccgguucaccauggcgcaccgcaaacccaccuacgagcgugaugucgaucugggagcugggacacgccacguggccguggagccggaggucgcgaaccuagauauuauuggccagcggaucgaaaauaucaagcacgagcacaagagcacguggcacuacgacgaggacaacccguacaaaacaugggccuaucaugguucguacgaggugaagccgucaggcagcgcgagcagcauggucaacgggguugucaaacuccugacuaagccgugggaugucauucccauggugacacagaucgccaugacggacaccaccccguucggucagcaacguguguucaaggagaaggucgacacccggacuccaaaggccaaacgcgggacggcccagaucauggaggugaccgccaaguggcucuggggcuuucugucccggaacaagaagccacggaucuguacccgggaggaguucacucgcaaggugcggagcaacgcggcuaucggcgcagucuuuguggacgagaaccaguggaacuccgccaaggaggcuguggaggaugaacgcuucugggaccugguccaucgcgagcgcgaacuacacaagcaggggaagugugcgaccugcguauacaacaugaugggcaaacgggaaaagaagcugggggaguucggaaaggcgaagggaagccgcgccaucugguacauguggcugggcgccagauucuuagaguuugaggcucugggcuuuaugaacgaggaccacugguucagucgcgaaaauucgcugagcggcgucgagggcgaggggcuucacaaguuggguuacauccugcgcgacaucagcaagauaccgggcggaaacauguacgccgaugacacugcuggaugggacacccggauaacggaggacgaccuccaaaacgaagcacggaucacggacaucauggagccugagcacgcgcuguuagcgaaguccauuuucaagcucaccuaccaaaauaagguuguacgcgugcaaagacccgcaaagaauggcacuguaauggacgucauuagcaggcgggaucagcgcggauccggccagguagguacuuacgggcugaacaccuucacaaacauggaggcgcagcugaucaggcagauggagagcgagggaaucuucuccccaagcgagcuugaaaccccaaaucuggcagagcggguccuggacuggcucgagaaguacggcguugagagacugaaacggauggccaucagcggggaugacugcguggucaagccgauagaugaccgcuuugcgacugcacugaccgcacucaacgacaugggaaaggugcggaaggacaucccccagugggagcccagcaagggguggaacgacuggcagcaagucccguucugcucgcaucacuuucaccagcucaucaugaaggacggccgcgaaauaguagugccuugucggaaccaagacgaacucgugggccgcgcccgggucagccaaggggcgggcuggucacuccgcgagaccgcgugccuggguaagagcuacgcccagauguggcaacugauguauuuccacaggcgcgaccuaagacuggccgccaacgcgauuuguagcgccguaccgguggacuggaucccaacauccaggacuaccuggucuauccacgcccaccaucaguggaugaccaccgaggacaugcucuccgucuggaaucggguguggauagaggagaaccccuggauggaagauaagacacacaucagcaguuggggcgacgugccguacuuggggaaacgcgaagaccaguggugcggcagccugaucggucugaccgcccgcgcaaccugggcgaccaauauucagguggcuaucaaccaggugcggcgccucauaggcaacgagaacuaucuggacuacaugacgucuaugaagcgguucaaaaacgaaagcgauccagagggagccuugugguag

SEQ ID NO: 24457 - RNA, 9879 nt, Artificial Sequence
  derived and/or modified CDS sequence (opt11) from DENV-1__JF937609__SS-prME
agcgugacuaugcugcucaugcugaugcccacggcccuggccuuucaccucacgacacggggcggggaaccccauaugaucgugagcaagcaggaacggggcaagagccuguuguucaagaccagcgccggggugaacaugugcacccucaucgccauggaccugggggaacugugcgaggacaccaugacguacaagugccccagaaucaccgagaccgagccugacgacguggacugcugguguaaugccaccgacaccugggugacauaugguaccugcagccagacgggcgagcacagacgagacaaacgguccguggcccucgcaccccacgugggccugggccuggaaacgcgcacagagacauggaugagcuccgagggcgccuggaagcaaauccagagggucgaaaccugggcgcugcgccaccccggguuuaccgugaucgcccuguuccuggcucaugcuaucggcacaaguaucacccagaaggggaucaucuuuauccuccugaugcuggugacgcccucaauggcgaugcggugcgucggcaucggcagccgcgacuucguggaggggcuguccggggcaaccuggguggauguggugcuggagcacgggagcugugugaccacuauggccaaagacaagcccacgcuggacaucgagcuccugaaaaccgaggucacuaaccccgcgauccugcggaagcucugcauagaagccaagauuuccaacaccacgaccgacagccgcugucccacacaaggcgaggccacacugguggaggagcaggacgccaauuucgugugccggcgcacguucguagaccgggggugggggaacggcugcgggcuguucggcaaggggucccucauaacgugcgccaaguucaaaugcgugaccaaacucgagggcaaaauugugcaguacgagaaccuuaaauacagcgucaucguaaccgugcacacgggggaccagcaccagguagggaacgagucaaccgagcacggcaccaccgcaaccaucacgccucaggcgcccaccaccgagauccagcucacggacuacggggcgcugacgcuggacugcagcccccgcacuggacucgauuucaacgagauggugcugcugacgaugaaggagaagaguuggcugguucacaagcaaugguuccuggacuugccgcuccccuggaccucuggggccagcacaucgcaagagaccuggaaccggcaagaccuucuggugacguuuaagaccgcccaugccaagaagcaggaagucgucgugcucggcagccaggaaggcgcgaugcacacggcucugacuggcgcgacugagauacaaaccuccggcacgaccaccaucuuugccggacaucugaagugccgccucaagauggacaaguugacccucaagggcaugagcuacgugaugugcacgggauccuucaaacucgagaaagagguggcggagacccaacacggcaccgugcugguacaaauaaaguaugagggcacagacgcgcccugcaaaauccccuucagcacgcaagacgagaagggggucacccagaacgggaggcugauaaccgccaacccgauugugaccgacaaagagaagccggugaacaucgaagcagagccgccuuucggggaauccuacaucgucaucggugccggugagaaagcgcugaagcugucgugguuuaagaagggguccagcauaggcaagauguucgaggccacggccagaggggccaggcggauggcgauccucggcgacaccgcgugggacuucgggucaaucggcggcguauucaccucaguggggaagcuaguccaccaaauauuugguaccgccuacgggguccuuuucuccggagucagcuggacgaugaaaaucgggauaggcguacugcugaccuggcucggccugaacucccggagcacguccuuaucgaugacuugcauugccguggggcucgugacgcucuaucugggcgucauggugcaagccgacuccgggugcguuaucaacuggaagggacgggagcucaagugcgggagcggcaucuucgucaccaacgagguucacaccuggacagaacaguacaaauuccaggccgacagcccgaagcgccuguccgcggccaucggcaaggccugggaagagggggugugcggcauaaggagugccaccagguuggaaaauaucauguggaagcaaaucucgaaugagcugaaccacauccuguuagagaaugacaugaaauucacggucguggugggcgacgucgccggcaucuuggcucagggcaagaagaugauccggccccagccuauggaauacaaguacucguggaaguccuggggcaaggccaagaucaucggagccgacgugcagaacaccaccuucauuaucgauggucccaacaccccggagugcccugacgaccagcgcgccuggaacauuugggaaguggaagacuauggguucggcaucuucacgaccaacaucuggcugaaacugagagacagcuacacccagguuugcgaccaucgccucauguccgcggccaucaaggacagcaaggccgugcacgccgacaugggcuacuggaucgaguccgagaagaacgaaaccuggaaguuggcccgggcgagcuuuaucgaggugaagacgugcauauggcccaagucccacacccugugguccaacggcguccucgaauccgagaugauaaucccgaaaauuuacgggggcccgauaagccagcauaacuaccgccccggguacuucacccaaaccgccggccccuggcaccuggggaagcuggaguuagauuucgaccugugcgagggcaccaccguggugguagacgagcauuguggcaaccggggcccgucccuucgcaccaccacggugaccggcaagauaauccacgaauggugcugucggagcugcacccugccgccgcuccgcuuccgcggggaggacggcugcugguacggaauggagauccgaccggugaaggagaaggaggagaacuuggucaaauccauggugagcgccggcagcggcgaaguggauucuuuuagccucggccuguugugcauaucaaucaugauagaagaggucaugcggagccgcugguccagaaaaaugcucaugaccggcacgcuugccguguuccugcuccuaaucauggggcagcugaccuggaacgacuugauccgucucugcaucaugguuggggccaacgccagcgaccgcauggggaugggcaccaccuaccuggcacucauggccacguucaaaaugcggcccauguucgccgucgggcugcuguuccgccgucuaaccucacgggaggugcugcugcuuacaaucgggcugagccuggucgcguccgucgaacuccccaauagccuagaggagcugggcgauggacuggcgaugggaaucaugauacugaagcugcugaccgacuuccagucucaucagcugugggccacgcugcucagccugaccuucaucaagaccaccuucucccuccacuacgccuggaagacgauggcaauggugcucagcauugucuccuuauucccucugugccucagcaccaccagucagaaaaccacguggcugccagugcuucugggcagccuggggugcaagccgcucacgauguuccucauugccgaaaauaagaucuggggccggagguccuggccgcugaacgaggggaucauggccgugggcaucgucaguauacugcuuagcucccugcuaaagaacgacguaccacucgccgggccccugauagccggcggcaugcugauugccuguuacguaauaagcgggucuucugcggaccucucccuggagaaagccgccgaaguaagcugggaagaggaggccgagcacuccggagcgucucacaacauccugguggaggugcaggacgacgggaccaugaagauaaaagacgaggagcgcgaugacacgcucaccauccuguugaaggcgacccuccuggccgucuccggcguguacccguuaagcauccccgccacccucuucgugugguacuucuggcagaagaagaagcagagaucuggcguccucugggauacccccagcccgcccgagguagagcgggcagugcuggacgauggaaucuacagaaucaugcaacggggccuccucgggcgcucccaggugggugugggggucuuccaggagaacguguuccacaccauguggcaugugacgcgaggggcaguccugauguaccaggggaaacgccuggagcccagcugggcguccgucaaaaaggaucucaucaguuacggcggaggguggcggcugcagggaucauggaacaccggggaggagguacaggugaucgccgucgagcccgguaagaaccccaagaaugugcagaccacuccagggacguucaaaacccccgagggcgaggugggcgccaucgcccuggacuuuaagcccgggaccagcggcagccccauagucaaccgcgaagggaagaucgugggccucuacgggaacggggucgucacgacgagcggcaccuacgugagugcuaucgcgcaggcuaaggcgagccaagaggggccgcugcccgagaucgaagacgaggucuuucggaagcgcaaccuuaccaucauggaccuccaccccggaagcgggaagacacgacgcuaccuuccggccaucgugagggaagcgaucaaacgcaaacugaggacgcucauucuggcucccacucgagugguggccuccgaaauggccgaggcucugaagggcaugcccauucguuaccagaccaccgcgguaaagagcgagcauaccggcaaagagaucguggauuugaugugucacgccaccuuuacgaugcgucugcugucccccgugcgcguuccgaacuacaacaugaucaucauggacgaggcccacuuuaccgacccuagcuccaucgccgcacggggguauaucucgacgcgcgugggaaugggggaggcggccgcgauauuuaugaccgccacgccacccggauccguggaggccuucccacagagcaacgcgguaauccaggacgaggagcgggacauccccgagcgcucuuggaauagugguuacgaguggaucacggacuuccccggcaagacggugugguucgugcccuccauuaagagcggcaacgacaucgccaacugccuccguaaaaacggaaaacgcgucauacaguugucccggaagacguucgacaccgaguaccagaagaccaagaacaacgacugggacuaugucgugacgacggacaucagcgagaugggcgcaaacuuccgcgccgaccgggucaucgauccacgccggugccugaagccugugauccucaaggacggccccgaacgcgugauacuggccggccccaugcccguaaccguggcguccgcggcccagcggcgcgggcggaucggccguaaccacaacaaggagggcgaucaguacaucuauauggggcagccucugaacaaugacgaggaucacgcccacuggaccgaggcgaaaaugcuccuugacaauaucaacacgccagaggguauaauucccgcccuguucgagccggaacgcgaaaagucugcagccaucgacggggaguaccgucugcgaggcgaggcccgcaagaccuucgucgaacugaugcgucgcggcgacuuaccgguguggcuuuccuacaagguggcguccgagggcuuucaguauagcgaccgccgguggugcuucgacggagagcgcaacaaucagguccuggaggagaauauggacguagagauuuggacaaaggagggcgagcggaagaagcugagaccccgguggcuggacgcccgcaccuacuccgacccccuggcgcugcgggaguucaaagaguucgcggcuggcaggcggucgguguccggggacuuaauccuggaaaucgggaaacugccccagcaccucacucagagagcgcagaacgcccuagauaaucuggucaugcuccacaacagugaacagggcgggcgcgccuaccgccacgccauggaggagcugcccgauacuauagagacccugaugcuuuuggcgcugauagcaguccucaccggaggggugacgcuguucuuccuguccgggcgggggcuaggaaagacgagcauaggauugcugugugucauggccuccagcguguugcuauggauggccucggucgagccucauuggauugccgcgucaaucauucuggaguucuucuuaaugguguugcuaauccccgagccggaccgccaaagaacgccccaggauaaucagcucgccuacguggugaucggguuauuguucaugauucucaccgucgcggccaacgaaaugggccuccuggaaaccacgaagaaggaucucgggauaggccacguggccguggggaaccaccaccaugcggccaugcuugacgucgaucugcaccccgcgucugccuggacccucuacgccguggcgaccaccauuaucacgccaaugaugcgccacaccaucgagaauacgaccgccaacauuucgcugacggccaucgccaaccaggccgccauccugauggggcucgacaagggguggcccaucucaaagauggacauaggagugccucuucuggcccucggcugcuacagccaggucaacccccugacccuaacagccgcaguacucaugcugguugcacacuaugcaaucaucggcccgggccugcaggcgaaggccacccgcgaggcgcagaagcggacggcugccgggaucaugaagaacccaaccgucgacgguaucguggcaaucgaccucgacccugucgucuaugacgccaaguuugagaaacagcugggucaaauaaugcuguuaauacugugcaccagucaaauccugcucaugcgaacaacgugggcccuuugugagucaaucacccuggcgaccgggcccuuaacuacgcugugggaggggaguccggggaaauucuggaacaccaccaucgcugugucgauggccaauauauuccggggguccuaccuggccggcgcagggcucgcguucagccugaugaagucucugggcggaggccgccggggaaccggcgcacagggcgagacgcucggggagaaguggaaacgccagcugaaucagcuuuccaagagcgaguucaacaccuacaagagguccggcaucauggagguggaccgcuccgaggcgaaggaggggcuaaaacgcggggaaaccaccaagcacgccgucucacgggggacggcgaagcuccggugguuuguggagcgcaaccuugugaagcccgagggcaaggucaucgaccugggcugcggccggggcggguggucuuacuacugugccggacugaagaaaguaaccgaagugaagggguacacgaagggcggccccgggcacgaagaaccaauccccauggcuaccuauggcuggaaccuggucaaguugcauuccgggaaggacguguucuucaucccucccgagaaaugcgacacgcuccugugcgacaucggcgaauccaguccuaaccccacuaucgaggaggggcgcacccugcgggugcucaagauggucgagcccuggcugcgcggcaaucaguucugcauuaagauccugaaccccuacaugcccucugucguggagacccucgagcagaugcagcguaaacacggagggaugcugguucgcaacccgcuguccagaaacagcacucacgaaauguacugggugucaugcggcacggggaacaucgugagugcggucaacaugaccucccgcauguugcugaacagguuuaccauggcccaccggaagcccaccuacgaacgcgauguggaccugggcgcggggacccggcauguggccgucgagcccgagguggcuaaccucgacaucaucgggcaacgcaucgagaauauaaagcacgagcacaagagcacuuggcacuaugaugaggauaacccauacaagaccugggcuuaccacggauccuacgaggugaagccgagcggguccgccagcucgauggucaacgggguugucaaacugcugaccaagccuugggacgugauaccgauggugacgcagaucgcgaugaccgacaccacccccuucgggcagcagcgggucuuuaaggagaaaguggacacacgcaccccaaaggccaagcggggcaccgcccagaucauggaagugaccgccaaguggcucuggggcuuucugucccgcaauaagaagccccggaucugcacgcgcgaggaguuuacccggaagguccgcaguaacgccgcgaucggagcaguuuucguggacgagaaucaguggaacuccgccaaggaggcaguggaggacgagagauucugggaccuuguucaccgcgagcgcgagcuccacaagcagggcaaaugugcgaccugcguguacaacaugauggggaagcgcgagaaaaaguugggcgaguucgguaaggccaaggggagcagagccaucugguacauguggcugggcgcacgcuuccuggaguucgaggcccugggauucaugaacgaagaccacugguucuccagggagaacucccucuccgggguggagggggagggccuccacaaauuaggguacauccugcgcgacauaagcaagauccccggcggcaacauguaugcggacgacaccgccgggugggacacgcggauaaccgaggacgaccuccagaacgaggcucgaaucaccgacauuauggagcccgagcacgcccugcuggccagaaguaucuucaagcugaccuaccagaacaaaguggugcgcguccagagaccggcgaagaauggcacggugauggacgugaucagccggcgcgaccagcggggguccggccaggucggcaccuacgggcugaauaccuucaccaacauggaggcccaacugauucggcagauggagagugagggaaucuucucucccucugagcuagagacgccgaaccucgccgaacgggugcuggacuggcuugagaaguacgggguggagcgucugaagcggauggcaauauccggggacgacugcgucgugaagccuaucgacgacagauucgccaccgcucugaccgcccuaaacgacauggggaaggugagaaaggacaucccccagugggagcccaguaagggcuggaaugauuggcagcagguucccuucugcucgcaccacuuccaccagcugaucaugaaggauggccgcgagauuguggugccaugccggaaccaagacgagcuggucggccgugcccgggugucccagggcgccggguggagccuccgcgagacagcuugccugggcaagucguaugcgcagauguggcagcugauguacuuccaccggcgcgaccuccggcuggccgcgaacgccaucugcagcgcagugccugucgacuggauccccacgucccgaaccaccuggucaauacaugcgcaucaccaguggaugaccacggaggacaugcugucaguuuggaaccgcguguggaucgaggagaauccguggauggaagacaagacccacauuagcuccuggggcgacgucccguaccuaggcaagcgggaagaccaguggugcggcagccugauugggcucaccgcacgcgccacgugggccaccaacauccaaguggcgaucaaccaggugcggagacucaucggcaacgagaacuaccuugacuauaugacgucaaugaagcguuuuaagaacgagucugaccccgaaggggcccugugguga

SEQ ID NO: 24458 - RNA, 9879 nt, Artificial Sequence
  derived and/or modified CDS sequence (opt11) from DENV-1__KF921949__SS-prME
ucggucaccaugcuucucaugcugaugccuacagccuuagccuuccaucucacgacacgaggcggggagccucacaugaucgugagcaagcaggaacggggcaagagcuugcuguucaagacgucugccggggucaacauguguacccugaucgccauggaccugggcgagcugugcgaggacaccaugacauacaagugccccagaauaaccgaaaccgaacccgacgauguggacugcuggugcaacgccacagauaccugggucacguacgggacgugcagccagacaggcgagcaccggagggacaaacgguccguagcccucgcgccgcaugugggccugggucuggagacuaggaccgagaccuggaugagcucugagggggcuuggaagcagauccagagggucgagacgugggccuugcgucaccccggguucaccgugauugcacuguuucuggcccaugcgaucggcaccaguaucacccagaaagggaucauuuucauccuccugaugcuggugacgccuucaauggcaaugcggugcgucgguaucggcagccgcgacuucguggagggccucuccggggccaccuggguggacguagugcuggagcacggcuccugcgugaccaccauggcuaaggauaagccaacguuggacaucgagcuccugaagaccgaggucaccaaucccgccgugcugcggaaauuauguaucgaggcuaagaucuccaauaccacgaccgauagcagauguccgacccaaggcgaagccacccugguugaagagcaagaugcaaacuuugugugucggagaacguucguggacagaggaugggguaacggguguggucuguucgguaaggggucccucauaacgugcgccaaguucaagugugugaccaagcuggagggaaagaucguccaauacgaaaacuugaaguacuccgugaucgugaccguccacacuggcgaccaacaccagguggggaacgaauccacagagcacggcaccaccgcaacaaucacgccccaggcccccacgaccgagauucaacucaccgacuacggggcucugacgcuggacuguucgcccagaaccggccucgacuucaacgagaugguccuguugaccaugaaggaaaagaguuggcucguucacaagcagugguuccuggaccugccgcucccguggaccagcggggccucuacgucccaggagacuuggaaucggcaggaccuucuggugacauucaagaccgcccacgccaagaagcaggaggucguggugcucggcucucaggaaggcgcgaugcacaccgcccugaccggggccaccgaaauucagacauccggcacgaccaccauuuucgccgggcaucuaaagugccgccucaagauggauaagcugacccugaagggcaugaguuacgugaugugcaccgggagcuucaagcucgagaaggagguagccgagacccagcacggcaccgugcugguccagaucaaguacgagggaacggacgcgccauguaagauccccuucaguacgcaggacgagaagggggugacccagaacggccggcugauaacagcgaacccgaucgugaccgacaaggaaaagccggucaacauugaggcggagccgcccuucggagagucguacaucgugauaggcgccggugagaaggcguugaagcucuccugguuucgcaagggauccagcaucgggaagauguuugaagcgacggcucgcggggcccgccgcauggccauucugggugacaccgcgugggauuucggcuccauaggcggcguguucaccagcgucgggaagcugguucaccaaauuuuuggcaccgcauacggugugcuguucuccggcgucagcuggacgaugaaaaucgggaucggcgugcuguuaacuuggcucggccugaacucacgcaguaccucgcuguccaugaccugcaucgccguggggcuggucacguuauaccugggcguaauggugcaagccgacagugggugcgucauaaacuggaagggccgagaacucaaaugcggguccggcauuuucgugaccaaugaagugcacacguggaccgagcaauauaaauuccaggcggacagcccgaagagacucagcgcagccaucggcaaggcgugggaggagggagucugcggcaucagaagugccaccaggcuggagaacauuauguggaagcaaaucuccaacgaacugaaccacauccuauuagaaaaugacaugaaguuuaccgugguggucggcgacguaaccggaaucuuggcccaggggaagaagaugauccgcccccaaccgauggaguauaaguauucauggaaguccugggguaaagcgaaaaucaucggugcagacgugcagaauaccaccuuuaucaucgacgggcccaacacgcccgaaugccccgacgaccaacgggccuggaacaucugggaggucgaggacuacgguuucgggaucuucacaaccaacauuuggcuaaagcuacgcgauagcuauacccagguaugcgaccaccggcugauguccgcagcuauuaaggacucgaaggccgugcacgcugauaugggcuauuggaucgaaagugagaaaaacgagaccuggaagcuggcccgcgcgagcuucaucgaggugaagaccugcaucuggcccaagagccacacccugugguccaauggugugcucgagagcgaaaugaucauccccaagaucuacgggggcccgaucagccagcauaacuaccggccgggauacuucacacagacugcgggccccuggcaccuagguaaacuugaguuagauuucgaccuaugcgagggcacgaccguugucguggacgagcauugcggcaauagggguccgagccugcggaccaccacugugaccggcaagauaauccacgagugguguugccgcagcuguaccuugccuccccuccgguuccgcggggaggacggcugcugguaugggauggaaauccggccagucaaggagaaggaggagaaucuggugaaguccauggugagcgccggcagcggcgaggucgacuccuucaguuuggggcugcugugcauauccaucaugaucgaggaggugaugcgcagccgguggagucgcaagaugcucaugaccggcacuuuggcuguguuucugcuccucaucauggggcagcugacguggaacgaccugauccgccugugcauuaugguaggggcgaacgcaagcgacaggauggggaugggcaccacguauuuggcgcucauggccaccuuuaagaugcgaccgauguucgccgucggccugcuguuccggagacucaccuccagggaggugcuucugcucaccaucgggcugucacuggucgccuccguagagcuccccaauucacuggaggagcuaggagaugggcucgcgaugggcaucaugauccugaagcuacucacagacuuccagucccaucagcugugggcgacccugcugagccugaccuucaucaagaccacauucucccugcacuacgcguggaagacgauggcuaugguccuaagcaucgugucccuuuucccccugugucucagcaccacaucacaaaagacgaccuggcuccccgugcuccucggcucacugggcugcaagccgcuaaccauguuccucauagccgaaaacaagaucuggggacgccgguccuggccccugaacgaggggaucauggcggugggcauagucagcaucuuguuaagcucccugcugaagaacgacgugcccuuggccggcccucuuaucgccggcggaaugcuuaucgcgugcuacgucaucucggggaguagcgccgaccucucccuagaaaaggcggccgaggugagcugggaagaagaggccgagcauucaggcgccagucacaacauucuaguagaaguccaagacgacgggaccaugaaaaucaaggaugaggagcgcgacgacacccucacgauccugcugaaggccacccuccuggcgguguccgguguuuacccguuauccauccccgccacgcuauucgucugguauuucuggcagaagaaaaaacagcgguccggagugcugugggauacccccagcccucccgaaguggaacgcgccguccuggacgacggcaucuauagaaucaugcagcgcgggcugcucggacggucccagguaggcgugggggucuuccaggagaauguguuccauacaauguggcacguaacccgcggcgccgucuuaauguaccaagggaagcgucuggagcccucuugggccucggugaagaaagaccucaucagcuacggcggcggguggcgcuugcagggcaguuggaacacgggggaggaagugcaggucaucgcgguugaacccgguaagaaucccaaaaacguacagaccgcccccgguacguucaagacacccgagggcgaggucggagccauagcgcuggauuuuaagcccgggacuucuggaucgcccaucguaaaucgggagggaaagauugucggccucuaugguaacggcgucgugaccacuagcggaaccuacgugucggcaaucgcgcaggccaaggcuucacaagaagggccucugccggagaucgaggaugaggucuuucgcaagaggaaucucaccaucauggaccuucauccggguagcgggaagacgaggcgauaccuaccugcuauaguucgcgaggcgaucaagcgcaagcugcgcacccucauccuggcccccacccgcgugguggccuccgagauggccgaggcccugaagggcaugcccauccgguaccagaccacugcgguaaagagcgagcacacgggcaaggagaucguggaccucaugugccacgccacuuucaccaugcgccugcugucccccguucggguuccgaacuacaacaugaucauaauggacgaggcccacuucaccgaccccuccuccaucgccgcccguggguacaucagcacucgcgugggcaugggagaagccgcugccaucuucaugacggccacgccgcccgguuccgucgaagccuuuccgcaaucuaaugcugucauacaagacgaggaacgcgacauaccugagcgcuccuggaauagcggcuaugaguggaucacagacuuccccggaaagacagucugguuugugccuuccaucaagagcggcaacgacauugcaaacugccuccgcaaaaaugguaagcgugugauccaacugucgcgcaagaccuucgacacagaguaccagaaaacuaagaacaaugacugggacuacguggucacgaccgacaucuccgagaugggcgccaacuucagggcagaccgggugaucgacccgcggcgcugccugaaacccgugauccucaaggacgguccugagcgggucauucuggcgggcccaaugccagugaccgucgccuccgcagcccagcgccgggggcgcauuggccgcaaccacaacaaagagggcgaccaguacauauauauggggcagccccugaacaacgacgaagaucacgcgcacuggaccgaagcgaagaugcuccuggacaauaucaauacgcccgaggguaucaucccggcccuauucgaaccggaacgggagaagucugccgccauagacggcgaauaccgcuugcggggggaggcacgcaagacguucguggaguugaugcggcgcggggaccugccagucuggcucuccuacaagguugcaucugagggcuuucaguacucagaucgucguuggugcuuugacggcgagcggaacaaccagguccuggaggagaacauggacguggagauuuggacaaaggagggcgagcgaaagaaacugcggccccgcuggcuagacgcgcggacuuacagugacccccuggcacugcgcgaguucaaggaguuugccgcaggcagacggagcgugucaggcgaucucauccuggagaucggcaagcugccgcagcaccucacgcagcgagcgcagaaugcccuggacaaccugguaaugcuccauaacagcgaacaaggcgggagggcuuaccggcaugccauggaggagcugcccgauaccaucgagacccugaugcuccuggcgcuaaucgcggugcuaacgggcggggucaccuuguucuuucugucaggcagagggcucggcaagacaaguaucggacugcugugcgugauggcuuccucgguccucuuguggauggcauccguugagccccacuggaucgccgcgagcaucauucuggaauucuuccucaugguucugcugaucccggagcccgaccggcagcgcacgccccaagacaaucaacucgcuuacguggucaucgggcuucuguucaugauccucaccguagcagcgaacgagaugggccugcuggaaacuacgaagaaggauuugggaauuggucacgucgcgguggagaaucaccaccacgccgcgaugcucgauguggaccugcaccccgcguccgcauggacccucuacgccguggcgacaaccauaaucacgcccaugaugaggcacaccauagagaauaccaccgccaauauuagccugacagccaucgccaaccaggccgccauccugauggggcucgacaagggguggcccaucuccaagauggacaucgggguuccacuacuggcccucgggugcuacagucaagugaacccucuuacgcugaccgccgcagugcucaugcuggucgcgcauuacgccaucaucggucccggucugcaggccaaggccaccagggaggcccaaaaacgcacagcugccggcaucaugaagaacccgacugucgaugggaucgucgccaucgaccucgacccuguaguauacgacgccaaguucgagaaacagcuggggcagaucaugcuccucaucuugugcacaucccagauccugcuaaugagaacuacuugggcccuaugugagagcaucacccucgcgacaggcccccucacgacgcugugggagggguccccgggcaaguucuggaacaccacgaucgccgugaguauggccaauaucuuccgcggaagcuaccuggccggcgccggucucgcguucagccugaugaagucguuggggggcgggcgcagagggaccggagcucagggcgaaacgcucggcgagaaguggaaacggcaacugaaccagcuguccaagucagaguucaacaccuacaagagaucggggaucauggaggucgaccggucagaggcaaaggagggccuaaagcgaggggagacgaccaagcacgccgugucccgaggcacggcaaagcuucgcugguucguggaacggaaccuagucaagcccgagggaaaggucauagaccugggcugcggccgcgggggcuggagcuauuacugcgccggguugaagaaggugacugaggucaaaggcuacaccaagggagggccuggccacgaggagccaauuccaauggccaccuacgguuggaaccuggugaaguuacacucugggaaggacguguucuucaucccccccgaaaagugugauacgcucuuaugugauaucggagagaguucccccaacccgaccaucgaggagggccggacacugcgcguccucaagauggucgagcccuggcuccgcgggaaccaguucugcaucaaaauccugaacccuuauaugccuuccgugguagagacccucgagcagaugcagcgcaagcacgguggcauguuagugcggaauccccugucccgcaacagcacccacgagauguacugggugucuugcggaacgggcaacaucgucagcgccgugaacaugaccucccgcaugcuccuuaaccgauucacuauggcccaccggaagcccaccuaugagcgggacguggaccugggagcgggcacacgucacguagccguggaacccgagguggcaaaccucgacaucaucggucagcggaucgagaacauuaagcacgaacacaagagcaccuggcacuacgacgaagacaacccauacaagaccugggccuaccacggauccuacgaggugaagccgagcggguccgccagcagcauggugaacggcguugugaagcugcugaccaagcccugggaugugaucccaauggucacgcagaucgcgaugaccgacaccacccccuucggccagcagcggguuuuuaaagagaagguggacacaaggaccccgaaggccaagcgcggcaccgcccagauaauggaggugacggccaaaugguuauggggcuuccuaucccgcaacaaaaagccccgcaucuguacgagggaagaguucacaaagaaggugagaucaaacgccgcgaucggcgccguguucgucgacgaaaaccaauggaacuccgccaaggaggccguggaggacgaacgauuuugggaucuugugcaccgcgagagggagcuccacaagcagggcaagugcgccacgugcgucuacaacaugauggguaagcgcgaaaagaaguuaggggaguucggcaaggccaaggggagccgugccaucugguacauguggcugggagcucgguucuuagaauucgaggcccuggguuucaugaacgaggaccauugguucucucgggaaaacagccugagcggaguggagggcgaggggcuccacaagcuaggcuacauccugcgagacaucucuaagauccccgggggcaacauguacgcagacgacaccgccggaugggacacgagaaucaccgaagacgaccuccagaacgaggcaaggaucacggacaucauggagccagagcacgccuuacucgccaaguccaucuucaagcugaccuaccaaaacaaggugguccgcguccagagacccgcgaagaacgggacggugauggacgucaucagccgccgggaccaacgcggguccggccaggugggcacguacgggcugaacaccuuuaccaacauggaggcccagcugauacgucagauggagagugaggguaucuucucccccuccgagcucgagacgcccaaccuggccgagcgcguguuagacuggcucgagaaguacggcgucgagcggcugaagcgcauggccauuucuggugacgauugcguggugaagccgaucgacgaccgguucgccacugcacugacggcccuaaacgacaugggcaaagucaggaaggacaucccccagugggagccgagcaagggcuggaaugacuggcagcagguccccuuuugcagucaucacuuucaccagcugaucaugaaagacggucgagaaaucguggucccgugcaggaaccaggacgagcuggugggccgggccagagugagccaaggagccggcuggagcuuacgggagaccgcuugucuggggaagagcuacgcgcagauguggcaguugauguacuuccaccgccgggacuuacgccuggcagccaacgccaucugcagcgcgguacccguugacuggauccccacgucccggaccacuuggagcauccacgcccaccaccaguggaugaccacggaggauaugcuguccguguggaaucgcgucuggauagaagagaacccuuggauggaagacaagacgcauaucucguccuggggggaugugccguaccucgggaagcgagaggaucagugguguggcucucugaucggccugacggcgcgggcuacuugggccaccaauauccaaguugccauaaaccagguccgcaggcucaucgggaacgaaaauuaucuagacuacaugacauccaugaaaagguucaaaaacgagagugaucccgagggggcccugugguga

SEQ ID NO: 24459 - RNA, 9879 nt, Artificial Sequence
  derived and/or modified CDS sequence (opt11) from DENV-1__GU131747__SS-prME
agcgugacuaugcugcugaugcugaugcccaccgcccuggccuuucaccucaccacccgcggcggggaaccccacaugaucgugagcaagcaggaacggggcaagagcuugcuguucaagaccucugcggggguaaacaugugcacccucauagcgauggacuugggcgaacugugugaagacaccaugaccuacaagugcccgagaaucaccgagaccgaacccgacgacguggacugcuggugcaacgccacggacacgugggucacauacgggaccugcagccagacuggcgagcaccggcgcgacaaacgguccguggcguuggcaccccacgugggccucgggcuggagacccguaccgagacguggaugagcuccgagggcgcguggaagcagauccagcggguugagaccugggcacuccggcacccaggguucaccgugaucgcccuauuccuggcgcaugcuaucggaaccucaaucacccagaaagguaucauuuuuaucuugcugaugcucgugacgccaucuauggccaugcggugugucgguaucgggagccgcgacuucguugagggguugucgggcgccaccuggguagacgucgugcuggagcacgggagcugcguaaccacaauggccaaggauaagcccacgcuggacaucgagcuucugaaaaccgaagugaccaaccccgcuguacugcggaagcucugcaucgaggcgaagaucaguaacaccacuaccgacagccgcugcccgacacagggcgaagccacgcuaguagaagaacaagacgccaacuucguuugccggcgcacguuuguggaucguggaugggggaauggaugcgggcuauucggcaagggcucccucaucacgugcgcuaaauucaagugcgugaccaagcuggaaggcaagaucguccaguacgagaaccugaaauacagcgugauaguaaccgugcacacgggcgaccaacaccaggugggcaacgaguccaccgagcacggcacaacggcuaccaucaccccacaggcgcccaccaccgagauccagcucaccgacuacggggcccugacucuggauuguucuccccguacugggcucgauuucaaugaaauggucuuacucacaaugaaggagaaauccuggcucgugcacaagcagugguuccuggaccugccccuccccuggacuagcggagccagcacaucccaggagaccuggaaccggcaggauuuacugguaaccuucaaaacagcccaugccaagaagcaggaagugguagugcucggcucacaggagggcgcuaugcacacggcgcuuacgggggcuacggagauccaaaccuccggcacgaccacaauauucgcagggcacuugaaaugccgccuaaaaauggacaagcugacucugaagggcaugagcuacgucaugugcacgggguccuucaagcucgagaaggagcuggcggagacccaacacggcaccgugcuagugcagaucaaguaugaaggcacggacgcgcccuguaagauccccuuuucaacacaggacgagaagggugucacacagaacggccggcugaucacggcuaauccgaucgugacugacaaggagaagcccguaaacaucgaggccgagccgcccuucggggaguccuacaucgucaucggcgccggcgagaaggcgcucaagcugagcugguucaagaaggguuccucgaucgguaagauguucgaggccacggcgcgcggugcccggcgcauggcaauccucggagacaccgcgugggacuucggaaguaucggaggaguguucaccagcgccgggaagcuagugcaccagauauuuggcaccgcuuacgggguccuguucuccggcgugagcuggacgaugaagaucgggauuggcguacugcucacaugguugggccugaacuccagaagcaccuccuuaagcaugaccugcaucgccguggggcugguaaccuuguaccucggcgugaugguccaggccgacucggggugcgugaucaauuggaagggcagagaacugaagugcgggucgggcaucuucgugacaaacgaaguccacaccuggacggagcaguacaaguuccaggcggacagcccgaagcgccugucugccgccaucggcaaggcuugggaggagggggugugcggcauacgcagcgcaacucgccucgaaaacaucauguggaagcagaucuccaacgagcuaaaccauauccuacucgagaacgacaugaaguuuacgguggucgugggggauguggcugguauccuggcccaggggaagaaaaugauccgaccucagcccauggaauauaaguauaguuggaagucuuggggaaaagcuaagauaauuggugccgacguacagaacaccaccuucauaaucgaugggccuaauaccccagagugccccgaugaccagcgagcauggaacaucugggagguggaggauuacggcuucggaaucuucacgaccaacaucuggcugaaguuacgggauagcuauacucaggugugcgaccauagacugauguccgcugccauuaaggacagucgggccguucacgccgacaugggcuacuggaucgaauccgagaagaacgagacauggaagcuggccagggccagcuucauagagguaaagacgugcaucuggcccaaaucucacacccucugguccaacggcgugcucgagucagagaugaucauccccaagaucuacgggggcccgauaagccagcacaauuaucgcccaggguacuucacccagaccgccggccccuggcacuuagggaagcucgagcuggacuuugaucuaugcgaaggcaccaccgucgugguugacgagcacugcggaaaccggggcccgucccuccggaccaccaccgucacugggaaaauuauccacgaguggugcugccgcucuugcacccugccuccccugcgauuucgaggggaagacggcuguugguacgggauggagaucagacccgugaaggagaaagaggagaaccuagugaaguccauggucagcgccgguagcggcgagguggauuccuucagccugggguuacucugcaucucuauaaugaucgaggaggugaugcguagccgguggucccguaagaugcugaugaccggcacgcuugcggucuucuuccuccucaucauggggcaguuaacguggaacgaccucauccgacuguguaucauggugggcgcgaacgccagcgaucggauggggauggguaccaccuaccuugcccucauggccacuuuuaagaugaggccgauguucgccguaggccugcuguuccggcgccuuaccagccgugagguccugcuccuuaccaucgggcucagccuggucgcuuccguggagcucccaaacagucuggaggagcugggagacgggcuugccauggggaucaugauacugaagcuguugaccgauuuccaaagucaccagcuaugggccacucugcucagccugaccuucaucaagaccaccuucucccugcauuacgccuggaagacgauggcgaugguccuuagcauagugucccuguuucccuugugcuuaagcaccaccucccagaaaaccacguggcugcccgucuuucugggcagccuuggauguaagccacugaccauguuccugaucgcagagaacaagaucuggggcagacgguccuggccccuaaacgaagggaucauggcggugggcauuguuucaauccugcuuagcucccuccugaagaacgaugucccccuggccggaccccugaucgccggcggaauguuaaucgcgugcuacgugauuagcggguccagcgccgaccucuccuuggagaaggcugcggaaguaucuugggaggaggaggccgagcauagcggcgcgagccacaacauucugguugaggugcaagaugacgggacaaugaaaaucaaggacgaggagcgcgacgacacucugaccgugcuccugaaggccacacugcucgccguuuccggcguguacccgcugagcauucccgccacccuguuugucugguacuucuggcagaagaagaagcagcgguccgggguccuuugggacacccccagcccgcccgagguagagcgcgcagugcuggacgacggcaucuaccggaucaugcagaggggccuuuuggggcggagccaggucggaguggggguguuccaggagaacgucuuccauaccauguggcacguuacucgcggcgcggugcuuauguaccaggggaagcgucuggagccguccugggccuccgugaagaaagaccucaucagcuacggcggugguuggcgacuccagggcuccuggaacaccggggaggaaguccagguuauugcugucgagccuggcaagaaccccaagaacgugcagaccgcccccggaaccuucaagacuccagagggcgaggucggugcuaucgcgcuagacuuuaaaccugggacaucaggcucgccuaucgucaaccgggaagggaaaaucgugggucuguacggcaaugguguggucacaaccagcggaaccuacgugucugcaaucgcacaggccaaggcaucccaggagggcccgcuccccgagaucgaggacgaggucuuccggaagcggaaccugacaauuauggaccugcaucccggcuccgggaagacccgucgcuaucucccggccaucgugagggaggccauaaagaggaagcugcggacucugauacucgccccgacgcgcguaguagccuccgagauggcggaggcucuuaagggaaugccgaucagauaccagaccaccgccgucaagagcgagcacaccgggaaggagaucguggaccucaugugccacgcuacauucaccaugcgccuccugucaccagugcgagucccaaacuauaacaugaucauaauggacgaggcacacuucacggacccaagcucaaucgccgcccgcgguuacaucagcacccgggugggcaugggggaggccgccgccaucuucaugacggcuaccccgcccggcuccguugaggccuucccgcagagcaacgccguaauccaggacgaggagagggacauccccgagcgguccuggaacuccggguacgaguggaucaccgacuucccgggcaagaccgugugguucgugcccuccauaaaguccggaaacgauaucgccaacugccugcgaaagaacgguaagcgagugauccagcugucccgcaagacguucgacacagaguaucaaaagacgaagaacaacgacugggacuauguagugaccacugacaucagcgagaugggcgcgaauuuccgugccgaccgugugaucgacccccggcgcugccugaagcccguaauucuuaaggacgggcccgagcgggugauccucgccggccccaugcccguuaccguggccucggccgcgcagcgccgggggagaaucggcagaaaucacaauaaggagggggaccaauacaucuacaugggacagccccucaacaacgacgaagaccacgcgcacuggaccgaagccaagaugcugcucgacaacauaaacacccccgaaggcauaaucccagcgcuuuucgagccagaacgggagaaguccgcagcgaucgacggagaguaccgucugagaggggaagcucgaaagacguuugucgagcucaugcggcgcggggaccugcccguguggcugaguuauaaaguggccagugaaggcuuccaguacagcgaccggcgaugguguuuugacggcgagagaaacaaccagguacuggaggaaaacauggacguggagaucuggacaaaggaaggggagagaaagaaguugcggccuagauggcuggacgcccggaccuauuccgauccccuggcccugcgcgaguucaaggaguucgcggcaggccggcggucgguauccggggaccugauucuggaaauugggaagcugccgcagcaccuaacccagcgggcccagaaugcccucgacaacuuggucaugcugcauaacucggagcagggcgggcgagcguaccggcacgcgauggaggaacucccagacacgauagaaacccugaugcuccucgcccugaucgccgugcugaccgguggggugacccucuucuuccugucuggccggggguuagggaaaaccagcaucggccuccugugcgucauggccucuagcguucugcucuggauggcguccguggaaccacacuggauagccgccagcaucauccuggaguucuuccuaaugguccuccugauccccgagccggaccgccagcgcacgccucaggacaaccagcuggccuacgugguaaucgggcuacucuucaugauccugacagucgccgcgaacgagaugggacuccuggagacuaccaaaaaggaccuggggaucggucacgucgccguggagaaucaccaucacgccgcaauguuagacgucgaccuucaccccgccuccgcauggacgcuguaugccguggccaccaccauaauuaccccgaugaugcgccauacgauagagaacaccacugccaacaucagccucaccgccaucgccaaucaggccgccauucucauggggcuggauaagggauggcccaucuccaagauggacaucggggugccucuauuggcccuaggguguuacagccagguuaacccccucacgcuuaccgcggccgugcugaugcucguugcccauuacgccauaaucggcccgggguugcaggccaaggcuacccgggaagcgcaaaagcgcaccgcggcaggcauuaugaagaaccccacggucgauggcaucguagcgaucgaucuagaccccgugguguacgaugcgaaguucgagaagcagcucggccagaucaugcuguuaauucucugcaccucccaaauccuguuaaugagaacuaccugggcccucugcgaaaguaucacucuggcuaccggcccccugaccacguuaugggaggguuccccgggcaaguuuuggaauacgaccaucgccgugucuauggccaacaucuuucgcggcuccuacuuggcuggagccggccuggccuucucucucaugaagagucuagggggcgggcggcgcgggaccggggcccaaggugagacucugggugaaaaauggaagcggcaguugaaccagcucuccaagagcgaguucaacacguacaagcgcuccgggaucauggagguggacagaagcgaggcaaaggagggccugaaacgcggggagaccacuaaacacgccgucucgcggggcaccgcuaagcugcgcugguuuguggagcggaacuuggugaagccugagggaaaggugaucgauuugggcugcggccgcggaggcuggagcuacuacugcgccgggcugaagaaggucacagaggugaagggauacaccaagggcggacccggccacgaagaacccauaccaauggccacauacggguggaacuuggucaagcugcacaguggcaaggauguguucuucaucccuccggagaagugcgacacccuacucugcgacauuggggagagcucccccaacccgacgaucgaagagggccgaaccuuaagaguuuugaagaugguggagccguggcucagaggaaaccaauucugcauaaagauccugaaccccuauaugcccucuguaguagaaacacuugagcagaugcagcgcaaacauggcggcaugcucguucggaaccccuuaucacgcaauuccacccaugagauguacuggguguccugcgggaccgggaauauaguaagcgcagucaacaugacuuccaggaugcugcucaaucgauuuaccauggcccaccgcaagccgaccuacgagcgggauguagaccugggggcgggcacccgccacguggccgucgagccugagguggcuaaccuggacaucauuggccagcggauagagaacaucaagcaugagcauaagagcacuuggcacuacgacgaggacaaccccuauaaaaccugggccuaccauggguccuaugagguuaaaccgagcggcuccgccagcagcaugguaaacgguguggucaagcuccugacaaagccaugggacguaauccccauggucacccagaucgcgaugacugacaccacgcccuucggccagcagcgcguauuuaaggagaagguggacacucggacgccgaaggccaagcgagggaccgcccaaauuauggaggugaccgcaaaguggcuguggggcuuucucuccaggaacaagaagccacgcaucugcacccgggaggaguucacgcgcaaggugcggucuaacgccgcgaucggagccguguucguggacgagaaccaguggaacuccgcgaaggaggcgguagaggacgaacgcuucugggaccuuguucaccgggagcgggagcugcacaagcaagggaagugugcaacgugcguguacaauaugaugggcaagcgggagaagaaacucggcgaguucggcaaagccaaggggagccgcgccaucugguacauguggcuuggcgcccgguuccucgaguucgaggcccucggcuucaugaaugaggaucacugguucucccgugaaaacagccucuccggggucgagggcgaggggcugcacaaguugggguacauccugcgggacauuagcaagauccccgggggcaacauguacgccgacgacacggcuggcugggacacccggaucacggaggacgaccuucagaacgaggcccgcaucaccgacauaauggaaccagaacacgcacuccuggccaaguccauuuuuaagcugacuuaccaaaacaagguggugcggguccagcggcccgccaagaacgggaccgugauggacguuaucagccgucgcgaucagcggggcuccgggcaagugggcacguacgggcucaacacauucaccaacauggaagcucagcugauccgccagauggagagcgaaggaauauucucgccaagcgaguuagagacccccaaccuagcagagcggguguuagacuggcuugaaaagcacggcguggagcgccucaaacggauggcgaucagcggagaugacugugucgugaagcccaucgacgaucgcuucgccacggcgcugacugcccugaaugacaugggcaaaguccggaaggacaucccgcaaugggagcccagcaagggauggaacgacuggcagcaggucccguucugcucccaccauuuccaucagcucauaaugaaggacggacgugaaaucguggugccaugccguaaccaggacgagcugguuggacgcgccaggguaucccagggggcaggcuggucacugcgcgagaccgccugccucgggaagucguacgcccaaauguggcaacuaauguacuuucaccgucgcgaucuucggcucgccgcgaacgccauauguagcgcagugcccguggacuggauccccacguccaggacgacguggucgauccacgcccaccaucaguggaugaccaccgaggauaugcuguccguguggaaucgcguguggaucgaggaaaauccguggauggaggauaagacgcacauuagcuccuggggugacgucccuuaccuggggaagagagaggaccaguggugcggcucacucauugggcugaccgcacgugcaacgugggccaccaacauccagguggccaucaaucaggugcggcguuugaucggaaacgaaaacuacuuggacuauaugaccuccaugaaacgguucaagaacgagagcgacccagagggcgcccugugguag

SEQ ID NO: 24460 - RNA, 9879 nt, Artificial Sequence
  derived and/or modified CDS sequence (opt11) from DENV-1__GU131748__SS-prME
ucuguuaccaugcuguucaugcucgugcccacagcccucgccuuucaccugaccacccggggcggggagccccacaugaucguguccaagcaggagcgaggcaagucacucuuauucaagaccucggccggggugaacaugugcacccugaucgccauggacuuaggagagcugugcgaggacaccaugaccuacaagugcccccguaucaccgagaccgagcccgaugacguggacugcuggugcaacgcgaccgacaccugggugacauauggcaccugcagccagaccggugagcaucggcgggacaagaggucaguugcccuggcgccgcacgucggccuugggcucgaaacccgcaccgagaccuggaugagcuccgagggcgccuggaagcagauccagcggguggagacgugggcccugcggcaccccgguuucaccguaaucgcacucuucuuggcccacgcgaucggcaccucaaucacucagaaggguaucauauucauccuacuaaugcucgugacgcccuccauggccaugcguugcguaggcaucggcagccgcgacuucguggaaggacuguccggggccaccugggucgacguggugcuagaacacgguagcugcgucacuaccauggccaaggacaagcccacgcuggacaucgaacugcucaagaccgaggucaccaacccggcagugcugcggaagcuuugcaucgaggcgaagaucuccaauaccacgaccgacagccgcugcccuacccaaggagaggccacccucgucgaggagcaggacgccaauuucgugugucggcgcacguucguggaccgggguugggggaacggcugugggcuguucggcaaggggucccugaucacgugcgcaaaguucaagugcgucaccaaguuggagggcaagaucgugcaauaugaaaaccugaaguacuccgucaucgucacugugcacacgggcgaccagcaucaggucggaaacgaguccaccgagcauggaacgaccgccaccaucacaccucaagcgcccaccacggagauucagcuaacggacuacggggcccucacccuggacugcagcccccgcaccggccuggacuuuaacgagauggugcuccugaccaugaaggaaaaguccuggcuggugcacaagcaaugguuucuagaccugccccugcccuggacaagcggggccagcacgucgcaggaaaccuggaaucgacaggaccuucuggucaccuuuaaaaccgcccacgccaagaagcaggagguggugguccugggcagccaggagggcgcgaugcacacggcccucaccggggccaccgagauccagaccucuggcacgacgaccaucuucgccggucauuugaagugccgacugaaaauggacaagcugacccucaaaggcaugagcuacgugaugugcacggggucuuucaagcuagagaaggagguggccgagacccagcacgggaccgucuuagugcaaaucaaauacgaaggcaccgacgcgcccugcaagauccccuuuuccacgcaggacgagaagggggugacccagaauggcagauuaaucaccgccaacccaauugugaccgacaaagagaagcccgugaauaucgaggcagagccgccuuucggggaguccuauaucgugaucggugccggcgagaaggccuuaaagcugagcugguucaagaagggauccuccauaggcaagauguucgaagccacggcccguggagcccgucgcauggccauauuaggggacaccgcaugggacuucggguccaucggcggcgucuucacaagcguggguaagcuggugcaccagaucuucgggaccgcguauggggugcucuucuccggggugagcuggacaaugaagaucgggaucggcguucuccugaccuggcugggccucaauuccagguccaccucucugagcaugacuugcaucgccgucggucuggugacgcucuaccuuggcgugaugguccaggcugacuccgguugcgugaucaacuggaaaggacgggaguugaaaugcgggagcggcaucuuuguuaccaacgagguacacaccuggaccgaacaguacaaguuccaggccgacucuccgaagcgccucuccgcagccaucggcaaagccugggaggaaggggugugcgggauccggagcgccacccgccuggagaacaucauguggaagcagaucagcaacgagcugaaucacauccuccuggagaaugacaugaaauuuaccguuguaguaggagauguggccggcauccuugcccaggggaagaagaugauccgcccccagcccauggaguacaaguauagcuggaagagcuggggcaaggccaagaucaucggcgccgacguccagaacaccaccuucaucauagacggucccaacaccccggaaugccccgacgaccagcgcgcauggaacaucugggaaguggaggacuacggcuucgggaucuucaccaccaacaucuggcucaagcuucgggacuccuauacccaggucugcgaccauaggcugauguccgcugccaucaaggauagcaaggccguccacgccgauaugggcuauuggauagagucggagaagaacgaaacguggaagcucgcgcgggcgagcuucaucgaggugaaaacuugcauauggccaaaaucccacacccuguggagcaacggcgugcuagaaagcgagaugauaauucccaagaucuacggaggaccgaucagccagcauaacuaccgcccgggguacuucacucagacugccgguccuuggcaccucgggaaguuggagcuggacuucgaccucugugagggcacuacugucgugguggacgagcacugcggcaaccgggggccgucccugcggacuaccacgguaacaggcaagaucauccacgaguggugcugccggagcugcacccugccgccacugcgcuuccgaggggaggacgguugcugguaugguauggagauacgacccgugaaggagaaggaggaaaaccuagugaagucaauggucagcgcaggcagcggcgagguugacucuuucagccugggacuucugugcaucaguauaaugaucgaggagguuaugcggucucgcugguccaggaagaugcuaaugaccggcacgcucgccguguucuuccugcugaucaugggacaacucaccuggaacgaccugauccgccuguguauaaugguaggcgcaaacgcgagcgacagaauggggaugggcaccacauaccucgcucucauggccacguucaagaugcggccuauguuugcggugggccuccuguuucgccggcugaccucccgugagguccugcuccugaccaucggcuuaagccucguggcguccgucgagcuacccaacucccuggaagaguuaggggacgggcuggcgaugggaauaaugauccuuaaauuguugaccgacuuucagucucaucaacugugggccacgcuuuuaucacugaccuucauuaagacaaccuucagccuccacuacgccuggaagacgauggccauggugcugagcaucgugucucucuuuccccucugccugagcaccaccucccagaagacgaccuggcuaccggugcuccuggggagccuggggugcaagcccuugaccauguuccugaucgcggagaacaagauaugggggcggcgcuccuggccccugaacgaggggaucauggcggugggcaucgugagcauccuccugaguucccugcucaagaacgacgucccgcuggcugggccccugauugccggcggcauguuaaucgccuguuacgugaucagcggauccagugcggaucuguccuuagagaaagccgccgaggugagcugggaagaggaggccgagcacucaggggccagccacaacauccuagucgaggugcaggaugacgggaccaugaagaucaaggacgaagagcgggaugacacccugaccauccugcugaaggcgacgcuacucgcaguauccggcgucuacccgcuaagcauccccgccacccuguucguuuggcacuucuggcagaagaaaaagcagagauccggggugcugugggacacccccagccccccagaggucgagcgagccgugcucgacgacggcauauaucgcauaaugcagcguggccuguuagggcgcucccagguaggcguagggguguuccaggaaaacguguuccauaccauguggcacgucacgcgaggcgccguccugauguaccaaggaaagcgccuagaaccuagcugggcguccgugaagaaggaccugauaucauauggcggcggguggagacugcagggcucguggaacaccggggaagaaguccaggugauagccguggaacccggcaaaaauccaaagaauguccagaccgcccccgggacguucaagacacccgagggggaagugggcgccaucgcccucgacuucaagccggggacuagcgguuccccuauuguaaauagagaggggaagaucgugggccuguauggcaacgggguugugaccaccucaggcacguacguaagcgcgaucgcccaggcgaaagccucccaagaagggccgcugccagagaucgaggaugagguguuccgaaagcgaaaccucaccaucauggaccuacaccccggcuccgggaagacccggcgauaccugcccgcgaucguacgugaggccaucaagcgcaaacuccgaacccuaauacuggcgcccacaagagucguggccuccgagauggcugaggcgcucaaaggcaugcccauccgcuaccagaccaccgccgucaaaucggaacacaccggcaaggagaucgucgaccugaugugccacgcuacguucacgaugcggcugcucucgcccgugcgcgugccgaacuacaacaugaucaucauggacgaggcccacuucaccgaccccaguuccaucgccgcgcggggguacaucuccacccgcgucggcaugggggaagccgcugccaucuucaugaccgccacgccgcccggguccguggaggccuucccgcagagcaacgccgugauccaggacgaggagcgggacauccccgagcgcucuuggaacagcggguacgaguggaucaccgacuuccccgggaagacggucugguucgugcccuccaucaagagcggcaaugauaucgcgaauugccugaggaagaacgguaagcgugugauccagcugucccggaagacuuucgauaccgaguaucagaagacuaagaacaaugacugggacuacguggugaccacagauaucagcgagaugggugccaacuuccgcgcggaccgggugaucgacccgcgccggugccucaaacccgucauacugaaggacgggcccgagagagugauucuagccggccccaugccgguaaccguggccucagccgcccagcgucgcgggcggaucggccgcaaccacaacaaggagggcgaccaguacaucuauauggggcagccgcucaacaacgacgaagaucacgcgcacuggaccgaggccaagaugcugcuggauaacaucaauacccccgaaggcauaauacccgcccuauucgagccggagcgcgagaaguccgccgccaucgacggugaauaccgauuacguggcgaggcccgaaagaccuucguggaacugaugcgccgcggggaccuaccugucuggcuuagcuacaagguugccucugagggcuuccaguauucugaccgccgguggugcuucgacggcgagcgcaacaaccagguguuagaagagaacauggacguggagaucuggaccaaggagggggagcggaaaaaacucagaccccguuggcuggacgcccgcaccuacuccgauccccuugcccuccgggaguucaaggaguucgccgcgggccgccggagcgugaguggggaucuaauucuggagauaggcaagcuaccacagcaccugacacagagggcccagaacgcccuggacaaucuugugaugcuccacaacagcgagcagggcgggcgcgccuaucgccacgcgauggaggagcugcccgacacgaucgagacucucaugcuccuggccuuaauagccguccugaccggcggggugacccuguucuuccucaguggucgggggcugggcaagacuagcauugguuuacuuugcguaauggccucaucgguccuguuauggauggccucgguugagccccacuggaucgcggccucuaucauacucgaauucuuccugauggugcugcuuauucccgagccggaccgccaacggacgccccaagacaaucagcuggccuauguggucaucgggcucuuguucaugauccugaccguggcagccaaugagaugggucugcucgagacgaccaagaaggaccuggggaucggucacgucgcgguggagaaucaccaccaugccgccaugcucgauguggaucuccaccccgccagcgccuggacccuguacgcggucgcuaccaccauuaucacccccaugaugcgccacacgaucgagaacacaaccgcgaacauaucgcuuaccgccaucgcuaaccaagcagcaauccugaugggguuggacaaaggcuggcccaucuccaagauggacaucggcgugccgcugcucgcccugggcugcuacagccaggucaacccacugacgcucacagcagcgguccugauguugguugcccacuacgccaucaucggcccggggcuccaggccaaggccacccgggaggcccaaaagcgcacggccgccggcauaaugaaaaauccuacaguggacgguaucgucgccauagaccuagaucccgugguguaugaugccaaguuugagaagcagcuggggcaaaucauguuacugauccucugcaccucccaaauccuccugaugcgcaccaccugggcgcugugcgagagcaucacgcucgccaccggcccccugaccacccugugggaggggucuccgggcaaguucuggaacacuacaaucgccgucagcauggccaacauauuccgggguuccuaccucgccggugcggggcuggccuuuucucugaugaagucccucggcggggggcgccgaggcaccggggcccagggcgagacucugggcgagaaguggaaacgccagcugaaccaacucuccaagagcgaguucaacacguacaagcgauccgggaucauggaaguugaucgcagcgaggccaaggagggccucaagaggggggaaaccaccaagcacgcgguaucccgcggcaccgcaaaauuacggugguucguggagcgcaaccucguaaagcccgaggggaaggugauagaccugggcuguggccgcggcggguggagcuacuacugcgcugggcugaagaaggucacggaagugaagggauacaccaagggagggcccggacaugaggagcccaucccgauggccaccuacggauggaaccucgucaagcuccacuccggcaaagacgucuuuuucaucccaccagagaagugugacacccugcugugcgacaucggggagagcucacccaacccgacgaucgaggaggggcggaccuugcggguucuaaagaugguggaacccuggcugcgcgggaaucaguuuugcaucaaaauccugaaccccuauaugcccagcgucguggaaacccuggagcagaugcagcggaaacacggagggauguuagugcgcaacccucucucccggaacaguacacaugaaauguauugggucuccugugggaccggcaacaucgugagcgccgugaacaugacgucccgcaugcugcugaaccgcuuuaccauggcgcaucggaagcccaccuacgaacgcgaugucgaucucggggccggcacccggcacguugccguggagccagaggucgccaaucuggacaucaucggccagcgcaucgagaacauaaaacacgaacauaagagcacguggcacuacgacgaagacaaccccuauaagaccugggccuaccacgguuccuacgagguuaagccgagcggcuccgcgaguucuauggucaacggaguagugaagcugcucaccaagcccugggacgugaucccgauggugacacagaucgccaugacggacaccacccccuuugggcagcaacggguauuuaaggagaaggucgacacccgaacgccaaaggccaagcgggggacugcccaaauaauggaggugacugcaaaguggcuguggggcuuccuuucccgcaacaaaaaaccccguauaugcacccgcgaggaauucacccgcaaagugaggucaaacgcugccaucggcgccguguucguugacgagaaccaguggaacuccgccaaggaggcgguagaggaugagcgcuuuugggaucuaguucaccgggaacgggagcugcacaaacaagggaagugugcuacuugcguauauaacaugaugggaaagcgcgagaagaagcugggggaguucggcaaggccaaggggagccgggccaucugguacauguggcucggcgcucguuuccuggaguucgaggcgcugggcuucaugaacgaggaucacugguucagcagggagaacucauugucggggguugagggcgagggccugcacaagcuaggguacauccugcgagacaucucaaagauccccgggggcaacauguaugcugacgauacugccggcugggacacccggaucacggaggacgaccuucaaaacgaggcccgcauuaccgacaucauggagccggagcacgcccuguuggcaaaauccaucuucaagcugaccuaccagaacaagguggugcgcgugcagcgcccagccaagaacgguaccguuauggaugucaucagccgccgagaccaacgcggcuccggccagguugggacauacggccugaacaccuucaccaacauggaagcucagcucauccggcagauggagagcgaagggaucuuuucccccagcgagcuggagacccccaaccuggcagaacgggugcucgacuggcuggagaaauacggcgucaagcggcugaagcgcauggccaucuccggcgacgacugugugguuaagccgauugacgaccgauucgcgacggcccuaaccgcccugaacgauaugggcaaagugcgcaaggacaucccccagugggagccgucuaagggguggaacgacuggcagcagguuccauucugcucccaucacuuucaccagcugaucaugaaggacggccgugagaucguagugccgugccggaaucaggacgaguuagugggccgagcccgcguuagccagggggccggauggagcuuaagggaaaccgcgugccucgggaagagcuacgcccagauguggcagcuuauguacuuccaccgcagagaccuacgcuuagcagccaacgccaucuguagcgccgugcccguggacuggauccccacuucacggacgaccuggagcauccacgcccaccaccaguggaugaccaccgaggauaugcucuccguguggaaccgcgucuggaucgaggagaaccccuggauggaagauaagacccauauaagcuccuggggagaugugccguaccuggggaagagggaggaccaguggugugguucacugaucggccucaccgcccgggccaccugggcgaccaacauccaggucgccaucaaucaagugcgccgguuaaucgggaacgagaacuaccuagacuauaugacauccaugaagcgcuucaagaaugagagcgaccccgagggagcacucugguga

SEQ ID NO: 24461 - RNA, 9879 nt, Artificial Sequence
  derived and/or modified CDS sequence (opt11) from DENV-1__GQ868615__SS-prME
uccgugaccaugcugcugaugcugaugcccaccgcacuggccuuccacuugaccacacggggcggagaaccccacaugaucgucagcaaacaggagcggggcaagagccugcuguucaagacauccgccggggugaacaugugcacccucaucgcaauggaccucggagagcuuugcgaggacaccaugaccuacaagugcccucgaaucaccgagaccgagcccgacgauguggacuguugguguaacgcgacugacacuuggguuaccuacggcacaugcagccaaacgggcgagcaucgccgggacaagcgguccguggcccucgcgccccaugugggccuagggcucgagacccgaacugagaccuggaugagcuccgagggcgccuggaaacagauccagcggguggagacgugggcacuccggcacccgggguucaccgugaucgcccuguuccuggcccacgcaaucggcaccagcaucacccagaaggggaucauuuucauccuccugaugcuggugacgcccuccauggccaugcgguguguaggaaucggcagccgcgacuucguggaggggcuuagcggcgccaccuggguggacguaguacuggaacacgggagcugcguuaccaccauggccaaggacaagcccacgcuggacauagagcuuuuaaagaccgaggucaccaaccccgcgguucugcggaaacucugcauugaggcgaagaucuccaauaccacuacagacucgcgcugcccuacccaaggcgaggcgaccuugguggaggaacaagacgccaacuucguuugccggcguacauuuguggaccggggcugggggaacggcugcggucuguucgguaaagggucccucaucacgugcgccaaauucaaaugcguuacaaagcuggaaggaaagaucguucaguacgagaaccugaaguacucugugauugugaccguccacacgggggaccagcaccagguggggaacgagucgaccgagcaugguaccacugccaccaucaccccgcaagcccccaccaccgagauccaacuaacugacuacggggcccucacccuugauugcaguccucgcaccggccucgauuuuaacgaaaugguccugcuaaccaugaaggagaaauccugguuaguccauaaacagugguuccuggaccuuccccugccguggacaagcggcgccagcacgucccaggagaccuggaaccggcaggaccuucugguaaccuucaagaccgcccacgccaagaagcaagaggucguggugcuugggagucaagaaggggccaugcacacggcucucaccggcgcuaccgagauccaaaccuccggcacaaccacuauuuucgccggucaccugaagugccgccucaagauggacaaacuuacccugaagggcaugagcuacgucaugugcacgggguccuucaagcucgagaaggagcuggccgagacccagcacggcacggugcuuguacagaucaaguacgagggcaccgacgcgcccugcaagauccccuucucuacacaggacgagaaggggguaacccagaauggccgccugauaacugccaaccccaucgugaccgacaaggaaaagcccgugaacaucgaggccgagccgccguucggcgaauccuacauagucaucggcgcgggcgaaaaagcgcucaagcugagcugguuuaagaaggguuccucgaucggcaagauguucgaggccacggcccgcggggcccggcgaauggcgauuuugggcgauacugcaugggacuuugguuccaucgguggcguguucaccagcgugggcaagcucguucaccagaucuucggaaccgccuacggaguacuguuuuccggcgugucauggacgaugaaaaucggaaucggcguccugcucaccuggcugggucucaacucccgcagcacauccuugucuaugaccugcaucgccguggggcuggugacccuguaccucggcgucauggugcaagcagacuccggcugcgugaucaacuggaaaggccgggaacucaagugcggaagcggcaucuucgucaccaacgaggugcacacuuggaccgagcaguacaaguuccaggccgacagcccgaaacgccuguccgcggccaucggcaaggccugggaggagggcgugugcggcauccggagcgccacccgcuuggagaacauaauguggaagcagauuagcaacgagcugaaccacauccugcucgagaacgacaugaaguucacggucguggugggggacgucgcaggcauacuggcgcaggggaagaagaugauccggccccagcccauggaguacaaguacagcuggaaguccuggggcaaggccaaaaucaucggcgccgacguacagaacacgaccuuuaucaucgacgggcccaacaccccggaaugucccgacgaccaacgcgcauggaacaucugggagguggaggacuacgguuuugggaucuucacgaccaauaucuggcuuaagcuccgggacaguuauacccaggucugcgaccaccgccugauguccgcugcuaucaaggacagcaaggccgugcacgccgacaugggcuacuggaucgaguccgagaagaacgagaccuggaagcuggcccgggcaagcuucaucgaggugaagacguguaucuggcccaagucucacacccucuggagcaacggaguccuggaaucagaaaugaucauccccaagaucuacgggggucccauaagccaacacaacuaccgacccgguuacuucacgcagaccgccggccccuggcaccuggggaagcucgagcuggacuuugauuuaugcgagggaacgacagucguggucgacgagcacugcggcaaucgugggccguccuuacgcaccacaacggugaccggcaagauuauccacgaguggugcugccggagcugcacccugccgccccugcgcuuccgcggggaggacggcuguugguacggcauggaaauccgccccgucaaggagaaggaggagaaccucguaaaguccauggugagcgcaggcagcggggaaguggacuccuucagccugggucugcuaugcaucuccauaaugaucgaagagguaaugcggagccgcugguccagaaagauguuaaugaccggcacgcuggccguguucuuccuccuaauuauggggcagcugaccuggaaugaccucaucagacuaugcaucauggugggcgccaaugcgucggaccgcauggggaugggcaccaccuaccuggcccugauggccacguuuaagaugcggccgauguucgccguaggucugcucuuucggcggcucaccucccgagagguauuacugcugacgaucgggcugagcuugguggccuccgucgaacugccgaacagccuugaggagcugggcgacgggcuagcgaugggcaucaugauccuuaaguuacucaccgacuuccagagucaucaguugugggccacuuuacucagccucaccuucaucaaaaccaccuucuccuuacacuaugccuggaaaacgauggccaugauccuuuccaucgugagccuuuuccccuuaugucucuccaccaccucccagaagaccacguggcugccaguacugcucggcagucugggguguaagccacugaccauguuccuuaucgcggagaacaaaaucugggguagacgcuccuggccacugaacgaggggauuauggcaguggguaucgugagcauccugcucagcucccugcugaagaacgacgucccccucgcggggccucugaucgccgggggcaugcugaucgccugcuaugugaucagcgguuccucugcggaccucucccuggagaaggccgccgaggugagcugggaggaagaggccgagcacucuggcgccagccacaacauccuggucgaggugcaggacgacgggaccaugaagaucaaggacgaggagcgugacgacacccucacaauccugcugaaggcgacgcugcuggccguguccggugucuacccgcugagcaucccggcaacgcucuucgugugguacuucuggcagaagaagaagcagcgcucuggggugcugugggacacccccucuccacccgaggucgagcgggccgugcuggacgacggcaucuaccgcauaaugcagcggggccugcucgggcgcucccaggugggcgucgggguguuccaggagaacguguuucacacaauguggcacgucacgcggggugcugugcugauguaccagggaaagaggcuggagcccagcugggcgagcgugaagaaggaucucaucagcuacggcggcggguggcggcugcagggcuccuggaacacaggggaggagguccaagugaucgccguggagcccgggaagaaccccaagaauguccagaccgcacccgggacguucaagacacccgaaggggaggugggugccaucgcccuggacuucaagccugggaccagcggcucccccaucguuaaccgcgagggcaagaucgucggacucuacggcaacggaguugugaccaccagcggaacguacgucucagcgauugcacaagccaaggcuucccaggagggaccgcugcccgagaucgaggacgagguguuccggaagcgcaaccugacuaucauggacuugcaccccggcagcgggaagaccaggcgcuaccuaccggccaucgugcgggaagccaucaagcgcaaguugcgcacccuaauccuggcccccacgcgagugguugccagcgagauggcggaggcgcugaagggcaugcccauccgcuaccagaccacugccgucaaaucagagcacacgggaaaggaaaucgucgaccucaugugccacgccacguucacuaugcggcugcugagccccgugcgggugccgaacuacaacaugaucaucauggacgaggcccacuucacggacccgucaaguaucgccgccaggggguacaucagcacccgcgucggcaugggggaggccgccgcaauauucaugacggccacgccuccuggcaguguugaggcguucccgcaaucuaaugccguaauccaggaugaggagcgggacauccccgagcgcuccuggaauagcggguacgaguggaucaccgauuuccccggcaagaccguaugguucgugccauccaucaagagcggcaacgacaucgccaacugccuacggaaaaacgggaagcgcgugauucagcugucacggaagacguucgacacagaguaccagaagaccaagaacaacgacugggauuacgucgugaccacggacaucucagagaugggcgccaacuuccgcgcggaccgggucaucgacccucgccggugucugaagcccgucauccucaaggacgggcccgaacgugugauccuagccggccccaugcccgugaccgucgccucggcagcccagcggcgcgggcgcaucggccgcaaucauaacaaggagggcgaccaguacaucuacauggggcagccgcugaacaaugacgaggaucacgcacacuggaccgaggccaaaaugcuccuggacaacaucaacacccccgaggguaucauccccgcccuguucgagccggagcgcgagaagucggccgccauugacggagaauaccggcuccgcggggaggcgcggaagacguucguggaacugaugcgccguggggaccugcccguauggcuguccuacaaaguagccagcgagggcuuccaguacagugaccgccgguggugcuucgauggcgagcgaaacaaccaagugcucgaggagaacauggacgucgagauuuggaccaaagagggggagcggaagaagcuucgcccccggugguuagacgcccgcaccuacuccgacccccuggcucugcgggaauucaaggaguucgccgccggacgccggagcgucucgggggaccucauccuggaaauaggcaaacugccgcagcaccucacccagcgggcccagaaugcccuggacaaccuggugaugcuccacaacagcgagcagggcgggcgggccuaccgccacgcgauggaggagcugcccgauacgaucgagacccucaugcugcuagcccugaucgcaguccucacggggggggugacccuguuuuuucuguccggucgcggucucggaaaaaccagcaucggccugcugugugugauggcguccagcguccuccuguggauggccuccguggaaccccacuggaucgcggccagcaucauccuggaguucuuccucauggucuuacugauccccgagccggaccgccagcggacgccccaggacaaccaacucgcuuacgucguuaucgggcuucucuuuaugauccucacuguggccgccaacgagaugggccugcuggaaaccaccaagaaggaccucgggaucggccacguugcgguggaaaaccaccaccacgcggcgaugcuggacgucgaucugcaucccgccucugccuggacgcuguacgcggucgccaccaccaucaucaccccgaugaugcgccacacgaucgagaacaccaccgccaacaucagccugaccgccaucgcgaaccaggcggcuauccugaugggacucgacaagggcuggcccauauccaagauggacaucggcguaccgcugcuagcccucggcugcuacagccaggugaacccccugacgcuaaccgccgcggugcucauguugguggcccacuacgccauuaucggcccgggguuacaagcaaaggccacgcgcgaggcacagaagcggacugccgccggcauaaugaagaaccccacggucgacgggaucgucgccauugauuuggacccagugguguacgaugccaaguucgagaaacagcuggggcagaucaugcugcucauccugugcaccucccagauacugcucaugcgcacaaccugggcgcugugcgagagcaucacgcuggcuacgggcccucucacaacccugugggaggguuccccuggcaaauucuggaacacgacuaucgcggucagcauggcaaacauauuccggggcuccuaccucgcaggcgcgggccucgcauuuagccugaugaagucacucgggggugggcgccgggggaccggggcccagggcgagacccucggcgagaaguggaagcgccagcuaaaccaguuguccaagagcgaguucaacacguacaagcgguccgggaucauggaaguggaccgcagcgaggccaaagagggccucaagcgcggggagaccaccaagcacgcggugucccgcggaaccgccaagcuucgaugguucgucgagcggaacuuggugaagcccgaggguaaggugauagacuugggcugcggccgugggggguggaguuacuacugcgcgggccucaagaaggucacggaggugaagggcuacaccaaaggcgggccuggccacgaggagcccaucccgauggccaccuacggguggaaccucgucaaguugcauuccggcaaagacgucuucuucaucccgccugagaagugugauacccuccugugcgacaucggggagaguucccccaacccgacgaucgaggaaggccguacccugcgggugcucaagaugguggagcccuggcuucgcgggaaucaguucugcaucaagauccugaacccuuacaugccgucggucguggagacccucgagcagaugcagcggaaacauggcggcauguuggugcgcaacccgcugucccggaacagcacccaugagauguacugggucuccugcggaaccggcaacaucguuagugccgugaacaugacgucccgcauguuauuaaaccgcuucaccauggcgcaccggaagcccaccuacgagcgcgacgucgaccugggggccgguaccagacacgucgccguggaaccagaggucgccaaccuugacaucaucggccagcgcaucgagaacaucaagcaugagcacaagagcacguggcacuacgacgaagacaaccccuacaaaaccugggcuuaccacggguccuacgaggugaagcccagcggcuccgcguccagcauggugaaugguguggugaagcugcugaccaagcccugggacgucauccccauggugacccagaucgccaugacugacaccacccccuucggccagcagcggguuuuuaaggagaaggucgacacucgcacgccgaaagcaaagcggggcaccgcccagaucauggaggugaccgccaaguggcucuggggcuuccugucccgcaacaagaagccucgaauauguacccgugaggaguucacgcgaaagguccgcagcaacgcggccaucggcgccgucuucguggacgaaaaccaauggaacuccgccaaggaggcgguggaggacgagcguuucugggaccugguccaucgcgagcgggagcuccacaagcaggggaagugcgccaccugcguguacaacaugaugggaaagcgcgagaaaaagcugggggaguucggcaaggcaaaggggagccgggcaaucugguacauguggcugggcgcccgcuuccucgaguucgaggcccugggcuucaugaaugaggaccacugguucucccgggagaacagccuguccgggguggaaggcgaggggcuccacaagcugggcuacaucuugcgcgauauuagcaaaauccccgggggcaacauguacgccgacgacaccgccggcugggacacccggaucacggaggacgaccuccagaacgaggcgcguaucaccgacaucauggagccggagcacgcccugcuggcgaaguccaucuucaagcucaccuaccagaacaagguggugcgcgugcagaggccagccaagaacgggaccgucauggaugugaucucgcgucgagaccagcgcggguccgggcaggugggcacguauggccugaacaccuucaccaauauggaggcccaacugauucggcagauggagagcgaagggaucuucucccccagcgagcucgagacccccaaccuggccgagaggguccuggacuggcucgagaaguacggaguggagcgucuaaagcgcauggccaucuccggggacgacugcguggucaagccgaucgacgaucgguucgcaacugcccugaccgccuuaaaugacaugggcaagguacgcaaggacaucccccagugggagcccagcaagggguggaacgacuggcagcaggugcccuucugcucccaccacuuccaccagcugaucaugaaagacgggcgggagaucgucgugccgugccgaaaccaagacgagcucgugggacgggcccgcgucagccaaggggccggcuggucacuccgggagaccgcgugucugggaaaguccuacgcccaaauguggcagcucauguacuuccacaggcgggaccugcgccucgccgcgaacgcgaucugcagcgccgugcccguggauuggauccccaccucccggacgaccuggagcauacacgcccaucaccaguggaugaccaccgaggacaugcuguccgucuggaaucggguguggauagaggagaaccccuggauggaggacaaaacgcacaucagcuccuggggcgacgugccguaccucgggaagcgcgaagaccaguggugcggcagccugaucggccugaccgcccgggcaaccugggcgaccaacauccaggucgccaucaaccaggugagacgacucaucgggaacgaaaacuaccuggacuacaugacgucuaugaagcgcuucaagaacgagagcgaucccgagggugcccugugguaa

SEQ ID NO: 24462 - RNA, 9879 nt, Artificial Sequence
  derived and/or modified CDS sequence (opt11) from DENV-1__GU131749__SS-prME
agcgugaccaugcuguuaaugcugaugcccaccgcccuggccuuccaccucaccacccgggggggggagccccacaugaucgugucuaagcaggagcgggguaagagccugcuauucaagacaagcgccgggguaaacaugugcacacuuaucgcuauggaccugggcgagcugugcgaggacacgaugaccuacaagugcccccggauuacugaggcugagccagaugacguggacugcuggugcaacgccaccgauacgugggucaccuacgggaccugcagccagaccggcgagcaccggcgcgagaagcgguccguggcgcucgcgccccacgugggucugggucuggagacgcgcaccgagaccuggaugagcagugagggugccuggaaacagauccagcgggucgagaccugggcccucaggcacccgggguucacggugaucgcccuguuccuggcgcacgccaucggcaccagcaucacccagaaggggauuauuuucauccuccugaugcugguuacccccaguauggccaugcggugcgucggcaucggcagccgcgauuucguggaagggcucuccggggccacguggguggauguagugcuggagcacgguagcugcgugaccaccauggccaaggacaagcccacccuggacaucgaacuccugaagacggaggucacuaaucccgcggugcugagaaagcucugcaucgaggccaagaucuccaacaccaccacggacagccgcugccccacccagggcgaagccacccugguagaggagcaggacgcaaacuucgucugccggagaacuuucguagaccggggcugggggaacggcugcgggcuguucggcaagggcucccuucugacgugcgccaaguucaagugugugaccaagcucgaaggcaagaucguccaguaugaaaaccucaaguacagcgugaucgucacaguccacaccggagaccagcaccagguagggaaugaguccacggagcacggcaccacagcaaccaucacgccgcaggcccccacgaccgagauccagcugaccgacuacggagcccugacccuggacugcagcccccgcacgggccuggacuucaacgagauggucuuacucacuaugaaggagaagucguggcuggugcacaagcagugguuccuggaccucccccugcccuggaccagcggggccagcaccucccaggagacguggaacagacaggaccuguuagugacuuucaagaccgcccacgcgaaaaagcaggaggucgugguccugggcagccaggagggugccaugcacaccgcgcugacgggggcaaccgaaauccagacauccgguacaacuacgauauucgcugggcaucucaagugccgccugaagauggacaagcugacguugaagggcaugagcuacgucaugugcaccgggagcuucaagcuggagaaggaaguggcggagacgcagcacggcaccguacugguccagaucaaguacgagggcaccgacgcccccugcaagauccccuucagcacccaggacgagaagggggugacgcagaauggacggcugaucacugcaaauccgaucgugaccgauaaggagaagcccguuaacaucgaggccgagccgcccuucggagaguccuacaucgugaucggcgcgggcgagaaggcgcucaagcugucgugguucaagaagggguccagcaucggcaaaauguucgaggccaccgcccgcggggcccggcgcauggcgauccugggcgacacggccugggacuucgggucgaucggcggcguguuuaccagcgucggcaagcucgugcaccagauauucggcaccgccuaccgcgugcuguucuccggggucagcuggaccaugaagaucggcaucggggugcugcuuacguggcugggcuuaaacagucggucuaccucccugagcaugacgugcaucgccgugggccuggucacccucuaccucggggugaugguucaggccgacuccggcugcgucauuaacuggaaggggcgcgagcugaaaugcggcagcgggauuuucgugacgaacgaaguccacaccuggaccgagcaguacaaguuccaggcggacagcccgaagaggcuguccgccgccaucggcaaggccugggaggagggcgucugcgggauccgcuccgcaacccggcucgaaaacaucauguggaaacaaaucuccaacgagcugaaucacauccugcucgagaacgacaugaaguuuaccgugguggucggcgacguggcggggauccuggugcaaggcaagaagaugauccgcccccaacccauggaguacaaguacagcuggaagagcugggggaaggccaagaucaucggcgccgacguccagaacagcacguucaucauagacggccccaacacccccgagugccccgacgaccagcgggcguggaacaucugggagguggaggacuacggguucgguaucuucaccaccaacaucuggcugaagcuccgggauucauauacacaggugugcgaccaccggcugaugagcgcggccaucaaggacuccaaggcgguccacgccgacaugggguacuggaucgaguccgagaagaacgagaccuggaagcuggcacgcgcguccuucaucgaggugaagaccugcaucuggcccaaaucucacacccucuggucuaacggcgugcuggagagcgagaugaucauccccaagauccacggcgggccgaucucccagcacaacuaccggcccggcuacuucacgcagaccgccgggccauggcaccugggcaagcucgagcuggacuucgaccuuugcgagggaaccaccgucguaguggacgagcacugcggcaaccgcggcccgagccuccggacgaccacagucacugggaaaaucauccacgaguggugcugucgcucaugcacgcugccgcccuugcgguucagaggagaggaugguugcugguauggcauggagauccggcccgugaaggaaaaggaggagaaccucgucaaguccauggucagcgccgggagcggagaggucgacagcuuuucccugggccugcucuguauuagcauuaugaucgaagaagugaugcgcucccgcuggagccgcaagaugcugaugaccggcacccuggccgucuucuuucuacugaucaugggccaguugaccuggaacgaccucauccgccugugcauuauggucggggccaacgcguccgaccggaugggaauggggacgaccuaccuggcccucauggcaaccuucaagaugcgcccaauguucgccgugggccuccuguuccggcgccucacgagccgggagguccugcugcucacgaucggccugucccuaguggccagcgucgaguuacccaacuccuuggaggagcugggggacggcuuggcgauggggaucaugauccugaagcugcucaccgacuuccagagcuaccagcugugggccacccuccucucgcugaccuuuaucaagacgaccuucagccugcacuacgccuggaagaccauggccauggugcucuccaucgugagcuuguucccccugugccucuccaccacgagccagaagaccaccuggcugcccgugcugcucggcucccugggaugcaagccgcugacaauguuccucaucgcggagaacaagaucuggggacgcaagagcuggccccugaacgagggcaucauggccguggggaucgugagcauccugcucaguagccugcugaagaacgacgucccuuuggcgggcccucugaucgccgggggcaugcucaucgccugcuacgugaucuccggcagcucggcggaccucagccuggagaaagccgccgagguuuccugggaggaagaggccgagcauagcggggccucccacaacauccuggucgaggugcaggacgacggaacaaugaagaucaaagacgaagagcgggacgacacacucacgauccugcugaaagcgacccucuuagccgugagcggggucuauccgcuguccauccccgccacucucuucguguggcacuuuuggcagaagaagaagcaacgcucgggcguguugugggacacgcccagcccccccgagguggagcgggccgugcucgacgacggcaucuaccggaucaugcagcggggccugcucggaaggagccagguggggguuggcguguuccaggagaacgucuuccacaccauguggcacgucacacgcggggccgugcugauguaccaggggaagcgccuggagccuaguugggcgagcgugaagaaggaccuaaucuccuacggaggcggcuggcgcuuccagggguccuggaauacuggcgaggagguccaggugaucgcaguugagcccgggaagaaccccaagaacguccagacggcccccggcaccuucaaaacccccgagggggaggugggugccauagcccuggacuucaagccggguaccuccgggagccccaucgugaaucgcgagggcaagaucguggggcuguacggcaacgggguggucacgacgagcgggaccuacguuuccgcgauagcccaggccaaggccucgcaggagggcccgcucccagagaucgaggacgaggucuuccgaaaacgaaaccugaccaucauggaccugcaccccggguccggcaagacgcggcgcuacuugccggcgaucgugcgggaagccaucaagcgcaagcugcgcacgcugauccucgcucccacccgagucguggccucugagauggccgaggcgcugaagggcaugcccauccgcuaccagaccacggccgugaaaucugagcacaccggcaaggaaaucgucgacuugaugugccacgccaccuucaccaugcgacuccucagccccguucgcguaccaaacuacaacaugaucaucauggacgaggcccacuucacggaccccaguucgaucgcggcgcggggcuacaucuccacccgcgucgggaugggugaggccgccgccaucuucaugacggccacgccgcccggcagcauggaggcguucccgcaguccaacgccgucauccaggaugaagagcgggacauccccgagaggagcuggaacuccggcuacgaauggaucaccgacuuucccgggaagaccgucugguucgugcccucuaucaaggccggcaacgacaucgcaaacugccuucggaagaacggcaagcgcgugauccaguuaucccggaagaccuucgacaccgaguaccagaagacgaagaacaacgacugggauuacguggucaccaccgacauuagcgagaugggggcgaacuucagggccgaccgggugaucgacccuaggcgcugccugaagccugugauacugaaggauggccccgagcgugucauccucgccgggcccaugccgguuaccguggcauccgcugcccagcggcgcggucggaucgggcgcaaucacaacaaggagggcgaccaauauaucuauaugggccaaccccugaacaacgacgaggaccacgcccacuggacggaggccaaaaugcugcucgacaacaucaacacucccgaggggaucauccccgcccuguucgagccggagcgcgagaaguccgccgcgauagacggcgaguaccggcugcgcggggaggcccggaaaaccuucguagagcucaugcgccggggcgaccuccccguguggcuguccuacaagguggccagcgagggguuccaguauagcgaucgccgguggugcuucgauggcgaacgcaacaaccaggugcucgaggagaacauggacguggagaucuggaccaaggagggcgagagaaagaagcugcgcccccgauggcuggacgcccguacguacuccgacccccucgcguugcgggaguucaaggaguuugcagccgggcgccggagcgucuccggcgaccugauccucgagaucgggaagcugccgcagcaccugacccagcgcgcacagaaugcccuggacaaccuagugaugcugcacaauuccgagcaggggggucgggcguaccgccacgccauggaggaacucccggauaccauugaaacccugaugcuguuagcccucaucgccgugcugaccggcggugucacccuauucuuucugucagggaaggggcuggggaagaccagcaucggccuccugugcgucauggccagcagcgugcugcucuggauggcgagcgucgagccgcacuggaucgccgccucuaucaucuuggaguucuuccugauggugcuucugaucccagaaccggaccggcagcgcacgccccaggacaaccagcuggcguacgugguuaucggccuccuguucaugauccugacuguggccgcgaacgagaugggucuccuggagacgaccaagaaggaccugggcaucgggcacguggcugucgagaaccaccaucacgccgccauguuggacguggaucuccaccccgcguccgcguggacccuauaugccguggcgaccacgaucaucaccccgaugaugcggcacaccaucgaaaauaccacggccaacaucagccucacagcaaucgcgaaccaggcggccauccugaugggucuggacaagggguggcccaucuccaagauggacaucggcgugccccuucuggcccugggcugcuacagccaggugaacccccuuacccugaccgcggccguguugaugcucguggcccacuacgccaucaucgggccgggccuucaggccaaggcgacgcgcgaggcccagaagagaaccgccgccgggaucaugaagaaccccaccaucgaugguaucguggccaucgaucuggaccccguggucuacgacgcgaaguucgagaaacagcucggccagaucauguugcugauccucugcaccucccagauucuacucaugagaacgaccugggcacucugcgagagcaucacucuggccaccggcccccugacgacccucugggagggcucgccggggaaguucuggaacaccaccauugccgugucuauggccaacaucuuccgcggaagcuaccuggcgggggccggccucgccuucagccucaugaagucccuaggcgggggccggcgcgggacuggcgcccaaggagagaccuugggcgagaaauggaagcggcagcucaaccagcuguccaagucggaguucaacaccuacaagcgcuccggcaucauggagguggaccggucagaggcaaaggaggggcugaagcgcggcgaaacgacgaagcacgccguuucccgggggaccgcuaagcuccgcugguuuguugagcggaaccuugugaagcccgagggaaaggucauagaccuggggugcggccgcggcggguggagcuauuacugcgccggcuugaagaaggugacagaggugaagggguauaccaagggcgggcccggccacgaggagccgaucccgauggccacguacggcuggaaccucgucaagcugcacagugggaaggacguguucuucaucccgcccgagaaaugcgacacccugcucugcgacaucggcgagagcucccccaacccuacaaucgaggaagggcggacccugcgcgugcucaagauggucgaaccauggcuccggggcaaccaguucugcaucaaaauccugaaccccuacaugcccagcgugguggagacgcuagagcagaugcagcggaaacacgggggcaugcucguccggaacccgcugucccgcaauagcacccacgagauguacuggguguccugcgguacuggcaacaucgugagcgcgaucaacaugaccucccggaugcugcugaaucgcuuuaccauggcccaccgcaagccuacguaugaacgggacguggaccugggcgccgggacccgccacguggccgucgagcccgaagucgccaaccuggauaucaucggccagcggaucgaaaacauuaagcacgagcacaagucaaccuggcacuaugaugaggacaaccccuauaagaccugggccuaccacggguccuacgaagugaagccgagcggguccgccagcagcauggugaacggcguagugaagcuccugacgaagcccugggacguaauccccaugguuacgcagaucgccaugaccgacaccacgcccuuugggcagcaacgcguguucaaggagaagguugacacccggaccccgaaggccaagcgcggcaccgcccagauaauggaggucacggcgcggugguuguggggguuccucucccgcaacaagaagccgaggaucuguacacgagaggaguucacccggaaggugcguagcaacgccgccaucggcgccgucuucguggacgagaaccaguggaacuccgcgaaggaggccguggaggacgaccgguucugggaccugguucaccgcgagcgggagcugcacaaacaggguaagugcgcgaccugcguguacaacaugauggggaagcgcgagaagaagcucggcgaguuugggaaggccaagggcagccgggcgaucugguacauguggcucggggcgcgauuccuggaguuugaggcccucggcuucaugaacgaagaccacugguucucgcgggagaacagccuguccggaguggagggggagggccugcacaaacucggauacauccuucgcgacaucagcaagauccccggcgggaacauguacgccgacgauaccgccggcugggacacccggauaaccgaggacgaccuacagaacgaggccaagaucaccgacaucauggagccggagcacgcgcuccuggccaaguccaucuuuaagcugacguaccagaacaaggucgugcgcgugcagcgccccgcuaagaauggcaccgucauggacgugaucagccgcagggaccagaggggauccggccagguggggaccuacggcuugaacaccuucacgaacauggaggcccagcugauccgccagauggagagcgagggaaucuuccugcccaacgaacucgagacccccaaucucgcugggcggguccucgacuggcucgagaaguacggcguggagcgccugaaacggauggcgaucucuggggacgacugcguggucaagccgauagacgaccgcuucgccaccgcacugaccgcucucaacgacaugggcaaggugcggaaggacaucccccagugggagcccagcaaaggcuggaacgacuggcagcagguccccuucugcucccaccacuuccaccagcugaucaugaaggacggucgcgagaucgucgugccgugccggaaccaggacgagcuggugggucgcgcccgcgucagccagggggcaggcuggucccuccgcgagacggccugccugggcaagagcuacgcccaaauguggcagcugauguacuuucaccgcagagaccuccggcuggccgcgaacgcuauaugcagcgccgugcccguggacuggguccccaccucccggaccaccuggagcauccacgcucaucaccaguggaugacgaccgaggacaugcuguccguguggaacagaguguggaucgaggaaaacccguggauggaagacaagacccgcaucagcucaugggaggacgucccguaccuuggcaagcgcgaggaccaguggugugggagccuaaucggccugacggcccgggccacgugggccaccaacauucagguggccaucaaucagguccgccggcuuaucggaaacgagaacuacagugacuacaugaccagcaugaagcgcuucaagaacgaaucugagcccgagggggcccugugguga

SEQ ID NO: 24463 - RNA, 9879 nt, Artificial Sequence
  derived and/or modified CDS sequence (opt11) from DENV-1__GU131750__SS-prME
agcgugaccaugcugcucauguuaaugccuacugcacuggccuuccaucucaccacucgaggcggagagccacacaugauagugagcaaacaggagcgcgggaagagccugcuguucaagaccagcgccgggguaaacauguguacccucaucgcaauggaccucggcgaacugugugaggauaccaugacauacaagugcccccggauuacagagacugaacccgacgacguggauugcuggugcaacgccaccgacaccugggugaccuauggaacuugcucucagacaggcgagcaccggcgcgacaagcgguccguggcccucgcgccccacgugggccuggggcuugagacccgaaccgagaccuggaugaguuccgagggcgcauggaagcagauccaacggguggaaaccugggcccuccgccaccccggauucaccgugauugcucuuuuccuggcccacgcgauugggaccagcaucacucagaaggggaucaucuucaucuugcugauguuagucacgcccuccauggccaugcggugugucggcauagguagccgcgacuuuguggagggacucuccggcgccacguggguggacgucguacuggagcacgggucuugcguuaccaccauggccaaggacaagcccacacuggauaucgaacuccuuaagacagaggucaccaaucccgccgugcugcguaaguuaugcauugaggccaaaaucuccaacaccacuaccgacagcaggugcccgacucagggagaggccacccuggucgaggagcaggacgcaaacuucgugugccggcgcacguucguggaccggggcugggggaauggcugcgggcuguucggcaaggggucccucaucacgugcgccaaguucaagugugugaccaagcucgaaggcaagaucguccaguacgagaaccucaaguacagcgugaucgugaccguacacacgggagaccagcaccaagucggaaacgaguccaccgagcacggaaccaccgccaccauaacgccccaggcgcccaccaccgagauccaacugaccgauuacggggcucugacgcuggacugcucuccacgcaccggucucgacuucaacgagaugguccugcugaccaugaaggagaaguccuggcucguacacaagcagugguuccuggacuuacccuuacccuggaccucgggcgccagcacgucucaggaaaccuggaaucggcaggaccugcuugugacauucaagaccgcccacgcgaagaaacaagaggucgucgugcucggcucccaagaaggcgcgaugcacacggcccuaacgggggcaacugagauccagaccuccgguacgaccaccaucuuugcugggcauuuaaaaugccgccucaagauggacaaguugacccuaaagggaaugagcuacgucauguguacaggauccuuuaaacuugagaaggagguagcagagacgcaacacgggaccguauuaguccagaucaaguacgagggcaccgacgcgccauguaagauccccuucagcacgcaggaugagaagggcgugacccagaacggccggcugaucacagccaacccgaucgugaccgauaaggaaaagcccgucaacauugaagcugagccgcccuucggugagaguuacaucguaaucggugccggcgagaaagcgcuaaagcugagcugguucaagaagggaaguagcaucggcaagauguuugaggccacggcccggggggcccggcgcauggccauccugggcgacaccgcgugggacuucggguccauaggcggcgucuucacgagcgucgggaagcuggugcaccagaucuucggcaccgcauacgggguccuguucuccggagugagcuggacuaugaagaucggcaucggugugcuucugaccuggcucggccugaacucucgcuccaccucccugagcaugacgugcaucgccguagggcucgucacucuguaccuggguguuauggugcaggccgacuccgggugcgucaucaacuggaagggccgggagcucaagugcgggagcgguaucuuugugacaaacgaagugcacaccuggaccgagcaauacaaguuccaggccgacucgcccaagcggcugagugcggccaucggcaaggccugggaagaaggggucugugguauccgaagcgccacucgacuugagaauaucauguggaaacagauuaguaacgagcucaaccacauauugcuggagaacgacaugaaguucacggugguggucggggaugucgccggaauccucgcgcagggcaaaaagaugauccgcccucagcccauggaguacaaguauagcuggaaaagcuggggcaaggccaaaaucaucggcgcagacgugcagaacaccaccuucauuauugacgggcccaacaccccggagugucccgaugaccagcgcgcguggaauaucugggaagucgaggauuauggcuucgggaucuucaccacgaauaucuggcuuaaacugcgugacagcuacacccaggugugcgaccaccgccuuauguccgcggccauaaaggacagcaaggccguucacgcggacaugggcuacuggaucgaguccgagaaaaacgagacauggaagcuugcccgggcgagcuucaucgaagugaaaacgugcauuuggcccaagagucacacacuguggagcaauggcgugcucgaguccgagaugaucauccccaagaucuacggagguccgaucagccaacacaacuacagacccggguacuucacgcagaccgccggccccuggcaccuggggaagcuagagcucgauuucgaccugugcgagggcacgaccguggucguggacgagcacuguggcaaccgggggcccucgcugcgcacgaccacggugaccggcaagauaauccacgaauggugcuguaggagcugcacccugccgccccuccgcuuccgcggggaggacggcuguugguacgggauggaaauccgacccguaaaggagaaggaggagaaccuggugaaguccauggugagcgccggaucaggcgagguggacucauucagccucgggcugcuuugcauuucgaucaugaucgaggaggugaugcguucccgcuggucccguaagauguugaugaccggcacccuggccguguucuucuuacucaucaugggccaacugacauggaacgaccucauccgacucugcaucauggucggcgcuaacgcaucugaccgcauggggaugggaaccaccuaccuagcccugauggccacuuucaaaaugaggcccauguucgccguggggcuccucuuccgcagacuuaccucacgcgaagugcuccugcugaccauaggccucagccuagucgccuccgucgaguugcccaauucccucgaggagcuaggcgacgggcuagccaugggcaucaugauccucaaacugcugaccgacuuccaaucgcaccagcucugggccacucugcugagccucacauuuaucaagacgacguucucccugcacuacgccuggaagacgauggcuaugguacugagcaucguaucgcucuucccccugugccucagcaccacgucccagaagaccacuuggcuaccggugcugcuggggagccuagggugcaagccgcugaccauguuccugaucgcggaaaacaagauuuggggucggcgguccuggccccucaaugaggggauaauggccgucggcaucgugagcauccugcugagcucacugcugaagaacgacgugccccuggccgggccccucaucgcagguggaaugcugaucgcaugcuacgucaucagcggguccagcgcggaccuguccaucgagaaagccgcagaggugucaugggaggaggaggcagagcacuccggcgccucgcacaacauccucguagagguccaggacgacgggacuaugaagaucaaggacgaggagcgggaugauacccugaccauccugcucaaggcgacgcugcuggccguguccggcguguacccgcuuucaauccccgccaccuuauucgucugguacuucuggcagaagaagaagcaacgcucuggcguccucugggacacccccagcccgccggaggugggacgggccguucucgaugacggaaucuacagaaucaugcagagggggcugcugggcagaucccaggugggggugggcgucuuccaggagaacguguuucauacaauguggcacguuacucgcggggccguccugauguaccagggcaagcgucucgagccaagcugggcuucggugaagaaggauuuaaucagcuacggcgggggauggcgguugcaaggcaguuggaacacaggggaggaggugcaagucaucgcgguggagcccgguaagaacccaaagaacguucaaacugcgccugggaccuuuaaaacgccagagggcgaggucggggccauugcccucgacuucaagcccggcaccagcgguucccccauugugaaucgcgaaggaaaaaucguuggccuguacgggaacggcgucguaaccacguccgguacguacgugucugcuaucgcccaggccaaggcuucccaggaagguccuuuacccgagaucgaggacgagguauuccggaagcgcaacuuaaccauuauggaccugcauccggggucgggaaagacccggcguuaccugcccgcgaucgugcgcgaggcuaucaagaggaagcuccgcacccuaauccuggccccgacgcggguggucgccuccgagauggccgaggcguugaaggggaugcccauccgauaccaaacuaccgcuguaaagagcgaacacacggggaaggagaucgucgaccugaugugucacgccacguucaccaugcggcuguuaucgcccgugcgcgugccgaacuacaacaugaucaucauggacgaggcccacuucacggacccaagcuccaucgccgcgcggggguauaucagcacccgcgugggaaugggagaggcagccgcaaucuuuaugacagccacaccgcccggguccgucgaggcguuuccgcaaagcaacgccgugauccaggacgaggagcgggacauccccgaaagauccuggaacagcggcuacgaauggauuaccgauuuucccggcaagacgguuugguucgucccauccaucaagagcgggaacgauauagcgaacugccugcggaagaacggaaagcgcguuauccagcucaguagaaaaacguucgacacagaauaccagaaaaccaagaacaaugacugggacuacguggucaccacggauauuucggagaugggggccaacuuucgcgcggaccggguaauugacccgcgccgaugucucaagcccgugauacugaaggacggccccgagcgggucauccuggccgggcccaugccggugaccgucgccucugcagcccagcggcgcggccggauaggccguaaccacaauaaagaaggggaccaguacauuuacaugggccagccccucaacaaugacgaggaccacgcccacuggaccgaggccaagaugcuucuggacaacaucaacacccccgaggguaucauccccgcccucuucgaaccggagcgcgagaaguccgccgccauagacggcgaguaucggcuacgcggggaggcgcggaagaccuucguggagcugaugcgacguggugaucuccccgucuggcuguccuacaaggucgcuagcgagggcuuccaauacucagaccgacgauggugcuucgacggggagaggaauaaucagguucuggaggagaacauggauguggagaucuggaccaaagagggcgagcggaagaagcuccgcccgcgguggcuggacgcucgcaccuacuccgacccccuggcccuccgggaguucaaggaauucgccgcggggcgccggagugucuccggcgaccucauccuggaaaucggaaaguuaccgcagcaccugaugcagcgcgcccagaacgcccuggacaaccucgugaugcugcacaacagcgagcagggcgggcgcgccuaccgccacgcuauggaagaguugcccgacaccaucgagacgcugaugcugcuggcccucaucgccguccugacagggggcgucacgcuguucuuccucuccgggagaggccugggcaagaccagcaucgggcuucucugcgugauggccuccagcgugcugcuguggauggcuuccgucgagccccauuggaucgcagccagcaucauccucgaauucuuccugauggugcugcucauacccgagccugaccgccagcggacgccucaggacaaccaacuggccuaugugguuaucggccucuuauuuaugauccugacgguggcugccaacgagaugggccugcucgaaacaaccaagaaagaccucgggaucgggcacgucgccgucgagaaccaccaccacgccgccauguuggacguggaccugcauccggcgucagccuggacucuguacgcggucgccacgacaaucaucacgccgaugaugcgacacacgaucgagaacacaacugccaauaucagccuuaccgccauugccaaccaggcggccauccucaugggauuggacaaaggcuggcccaucuccaagauggacaucggcgucccccugcucgcccuggggugcuauagccaggugaacccccugacccuaacagccgcggugcugaugcuggucgcccauuacgcuauaaucgggccgggccuccaggcuaaagccacgcgggaggcgcagaaacggacggccgccggaauuaugaagaaucccaccguggacggcaucguugccaucgaccuggacccugucguguacgacgccaaguuugagaagcagcugggccagauaaugcuacugauccugugcacgucccagauccuucugaugcgcacaaccugggcgcugugcgagaguaucacccucgcaacgggaccccugaccacucugugggaaggguccccggggaaguuuuggaacacaacgaucgccguuagcauggccaacaucuuccggggcucauaucuggccggcgcaggacuggcuuucagccucaugaaguccuugggcggugggcgccgagggaccggcgcgcagggcgagacacugggugagaaguggaaacgccaauugaaccagcucuccaagagcgaauucaacaccuacaagcggucaggcauuauggagguugaccguagcgaagcaaaggaggggcugaagaggggugagacgaccaagcacgcggugucccgcgggacggccaagcugcggugguuuguggagcgcaaucuggugaagcccgaaggaaagguaaucgaccugggaugcggucggggcggguggagcuacuauugcgccggccugaagaaagugaccgaagucaagggcuauacuaaaggcgggccagggcacgaggagccuaucccgauggccaccuacggcuggaaccuggugaaguugcacucagggaaagacguguucuucauaccgcccgagaagugcgacacccugcugugugauaucggcgaaagcucccccaacccgacuauagaggaggggcggacgcuccggguccugaagaugguugagccuuggcugagaggcaaucaguucugcaucaagauucucaaccccuauaugcccagcguggucgagacccuggagcaaaugcaacgcaagcacggcgggaugcuggugcgcaacccgcucucccggaacuccacacacgaaauguacugggucuccugcggcaccgggaacaucguuagcgccgugaacaugaccucccgaaugcugcugaaccgcuucacgauggcacaccggaagcccaccuacgagcgcgacguagaccucggcgccggcacccggcacgucgccguggaacccgagguggcuaaccuggauaucauagggcagagaaucgagaacauaaagcacgagcacaaaagcaccuggcauuacgaugaggacaaucccuacaagacuugggcauaccacggguccuacgaggucaaaccgucgggauccgcguccucgaugguaaacggcguggugaagcugcuuaccaagccgugggacgugauccccaugguuacccagaucgccaugaccgacaccacccccuucgggcaacaacgggucuucaaggagaagguagacacccgcacucccaaggccaaacggggaacggcccagaucauggagguuaccgccaaguggcuguggggcuuccugagccguaacaaaaagccacguaucugcacacgcgaggaguucacccggaagguacgcucgaaugcggcuaucggggccguguucgucgacgagaaccaguggaacagugcaaaggaggccguggaggacgagagauuuugggaccucgugcaucgagaacgagaauugcauaagcagggcaaaugcgcgacgugcgucuacaacaugauggguaagagggagaagaagcucggagaguucgguaaggccaagggcagccgugccauuugguacauguggcucggcgcccgcuucuuagaauucgaagcgcugggauucaugaacgaggaucauugguucagucgggagaauagccucuccggaguggagggggagggacugcacaagcugggguacauucuccgcgauaucaguaagaucccuggaggcaauauguacgccgacgacaccgcuggcugggauacccggaucaccgaggacgaucugcagaacgaggcucgaaucacagacacgauggagccggaacacgcccugcuugcaaaguccauauucaagcuuacauaccaaaacaaggugguccgugugcagcggcccgcaaagaacggcaccgugauggacguuaucagccgacgggaccagcgcggguccggccaagugggcacguacggauuaaacacuuucacuaacauggaggcccaacucauacggcagauggagagcgagggcaucuuuagcccaagugagcuggagaccccgaaccuggccgagcgcgugcucgacuggcuggagaaauacggagucgagaggcugaagcgcauggccaucuccggggaugacugcgugguaaaaccaauagacgaccgauucgcgacggcccucaccgcccugaacgacauggggaaaguccguaaggacaucccccagugggaaccuucuaagggcuggaacgacuggcagcagguccccuucuguagucaccauuuucaccagcugaucaugaaggacggccgggagaucgucgucccaugccgcaaccaagaugagcucguggggcgggcccgcgugagccagggcgccggguggagccugcgggagacugcaugccugggaaaguccuaugcgcagauguggcagcuaauguacuuccacagacgggaucugaggcuggcagcaaacgcgauaugcuccgccguccccguggacuggauccccaccucacggacaaccuggucuauccacgcccaccaccaguggaugacaaccgaggacaugcucucuguguggaaccgggucuggaucgaagaaaaccccuggauggaggauaagacccacaucagcuccuggggcgacgugccguaccugggcaaacgcgaggaccaauggugcgguucccugaucgggcucaccgcccgugccacuugggcgaccaacauccagguggccaucaaccagguccgcagacucauuggaaaugagaacuaccuggacuacaugaccuccaugaagcgcuucaagaacgagagcgacccagagggugcccucugguag

SEQ ID NO: 24464 - RNA, 9879 nt, Artificial Sequence
  derived and/or modified CDS sequence (opt11) from DENV-1__GU131751__SS-prME
agcgucaccaugcuucucaugcugaugccaaccgccuuggccuuccaccugaccacccgagguggggagccccauaugauugugagcaaacaggagcguggcaagucacugcuguucaaaacaagcgccgggguuaacaugugcacccuaaucgccauggaucugggggaguuuugcgaggacacgaugaccuauaagugccccagaaucaccgaggcagagccagacgauguggauugcuggugcaacgcaacggacaccugggugaccuaugggacuugcagccagaccggggagcaccggcgcgacaaacgguccguagcccuggcgccccacguggggcugggacuggagacgcguaccgagaccuggaugagcagcgagggggccuggaagcagauccagcggguggagacaugggcccuucgccacccuggguucacugugauugcucuguucuuagcgcaugcaaucggcaccagcauaacgcagaagggaaucauauucaucuugcucaugcuggugaccccuucgauggccaugcgaugugugggcauuggcagcagagacuucgucgaagggcuaagcggcgccaccuggguggacguaguucucgagcacggcagcugcgugaccaccauggccaaagacaagcccacauuggacaucgagcuucucaaaacggaggucacaaaucccgcggugcuucggaagcugugcaucgaggcaaaaaucuccaacaccaccacugacucccgaugcccuacccaaggcgaggccacccuaguggaggagcaggacgccaacuucgucugccggcggaccuucguggacagaggcugggggaacggcugugggcuguuuggcaagggaucccugauaacaugcgccaaguucaagugcgugacaaagcucgagggcaagaucguccaauacgagaaccugaaguacagcgugaucgucaccguccauaccggugaccagcaucagguggggaacgagucaacagagcacggcaccaucgcgaccaucacgccacaggcuccgagcaccgagauacagcucacagacuacggggcacucacccuggacugcucuccccgcaccggccuggacuucaacgaaaugguccugcuaaccaugaaggaaaaguccugguuaguacauaagcagugguuccuugaccugccgcucccauggacuaguggggcaaguaccagccaagaaaccuggaaccggcaggaucugcuaguaacauucaagacagcgcacgcaaagaagcaggaggucgugguccuggggucccaggagggagccaugcacaccgcccucaccggcgccaccgagauccaaacgagcggcaccaccaccaucuucgccggacacuugaagugccgccugaagauggacaaauuaacgcuaaagggcaugaguuacgugaugugcacugggagcuucaagcucgagaaggagguggcugagacccagcacggcaccgugcucguacagauaaaguacgaaggcacggacgcccccugcaagauucccuucuccacccaggaugaaaaggggguaacucagaauggccggcugauaaccgccaauccgauugugacugacaaagagaagcccgucaacauagaagccgagccacccuuuggggagagcuacaucgugaucggagcgggcgaaaaagcccugaagcuguccugguucaaaaaggggagcagcauaggcaagauguucgaggccaccgcgcgcggggcccgaagaauggccauucuaggggacacggcaugggauuucgggucuaucggcggcguuuucaccuccgucgggaagcuuguucaccaaaucuucggaacggccuacggcguuuuguuuucuggcguuagcuggaccaugaagaucgggaucggugucuugcuuaccugguugggcuugaacagucgcucgacaagccugaguaugacgugcauagcugugggacuagucacgcuauaccugggcguaauggugcaggccgauagcgggugcgucaucaauuggaagggccgggaacugaaauguggcagcgguaucuucgugaccaaugagguucacaccuggacggaacaauacaaguuccaggcggacucuccuaagagacugagugccgccaucggcaaggccugggaggagggggucugcggcauccgguccgccacccgcuuagagaacaucauguggaagcagaucagcaacgagcugaaccauauuuuacuagagaaugauaugaaauucaccguggugguaggggauguagcgggcauccuggcgcaaggcaagaagguuauucggccacagccaauggagcauaaguacagcuggaaguccuggggcaaggccaagauaaucggcgccgacgugcagaauacgaccuuuaucaucgacgggcccaacacgccggaaugccccgacgaccaacgugcguggaacaucugggagguggaggacuacggcuucgggaucuucaccacaaacaucuggcucaagcugcgggacagcuacacgcaggugugcgaucaccgccugaugagcgcagccauucgggacuccaaggccguccaugcugacaugggcuacuggauagagagcgagaaaaacgagacuuggaaacuugcgcgcgccucguuuaucgaggugaagacaugcaucuggcccaagucacauacccuguggucuaacggugugcuggagagcgagaugauuauccccaagaucuacgggggcccgaucucgcagcauaacuaccggccaggcuacuucacccaaacggccggucccuggcaucucggcaaacuggaguuagacuucgaccucugcgagggcacaacuguugugguggacgaacacugcggcaaccgcgguccaagccugaggacaacaaccgucaccgggaagaucauacacgaguggugcugucgauccugcacccugccaccccugcgguuuaaaggcgaggacggcugcugguacgggauggagauccgccccgugaaagagaaagaggagaaucuagucaaguccauggucagcgccggcuccggugagguagacucauucucucuaggccuccugugcauuagcaucaugaucgaggaaguaaugcgguccaaauggagccgcaagauguuaaugacgggcacccucgccguguucuuccucuugaucauggggcaauuaaccuggaacgaccugauacgacugugcauaaugguaggcgcgaacgccuccgaucggauggggaugggaaccacguaccucgccuugauggccaccuuuaaaaugcgcccgauguucgcugugggccuccuguuccggcgccugaccagccgggagguccuguugcugacgaucggucugucccuaguggcgucggucgagcugcccaacuccuuagaggaauuaggagauggguuggccauggggauuaugauccugaagcuccugacggauuuccaaagucaccaacucugggccacccuccuuucccugaccuucauuaagacaacauucagccuccacuacgcguggaagaccauggcaauggugcuguccaucgugagccuguuuccucuaugccuguccaccaccagccagaagacgaccuggcuuccaguccuccugggcucccuaggcugcaagccgcucaccauguuucugaucgccgaaaacaagauuugggggcgcaaaucauggccccugaacgaggguauaauggccguaggcauagugagcaucuugcuguccagcuugcuaaagaaugacguccccuuggccgggccgcugaucgccggcggcauguugaucgcguguuacgugaucuccgggagcuccgcagaccugagcuuagagaaggccgccgaagucaguugggaagaggaagcagagcauagcggcgcgucccacaacauucuugucgaggugcaggacgacgggaccaugaagaucaaagaugaggagcgggacgacacgcugacgauccugcucaaagccacgcugcuggcuguaagcggcguauauccgcucuccauccccgcgacccuguucgugugguauuucuggcagaagaagaagcaacgcagcgggguucucugggacauccccagcccgcccgaggucgagcgggccgugcucgaugaugggaucuaucgcaucaugcagcggggucugcugggccguagccagguuggcgucgggguguuccaggaaaacguguuucacacaauguggcacgucacgcggggcgcgguucucauguaccaggggaagaggcucgagccguccugggcuagugugaagaaagaccuuauuuccuacggcggcggguggcggcugcagggcucuuggaacaccggggaagagguucaggugaucgcaguggagccuggaaagaaucccaaaaauguccagaccgcccccgggaccuuuaaaacgucugagggagagguaggggcuaucgccuuagacuucaagcccgggaccagcggcagucccaucgugaaccgcgaagggaagauuguugggcuauacggaaacggggucgugaccaccagugggacguacgucagcgccauugcccaggcuaaggcuagucaagaggggccccucccggaaaucgaggacgagguguuuaaaaaacguaaccuuacaaucauggaccugcauccaggcagcgggaaaacccgcagguaccugccagccaucguacgcgaggccauuaagcggaagcucaggacccugauccuagccccgacucgggucguggccucugagauggcggaagcccuuaagggcaugcccauccgauaccagaccaccgccguuaagagcgaacacaccgguaaggagaucgucgaucugaugugccacgccacguucacgaugcgccugcucucccccgugagagugcccaacuacaacaugauaauuauggacgaggcccacuucacggacccgagcucuaucgcggcccggggauacauuagcacccggguaggcaugggggaggccgccgccaucuucaugaccgcgaccccgccagguuccguugaggcauucccccagagcaacgcaguuauacaggacgaggagcgcgacauuccggagagguccuggaacagcgguuaugaauggaucaccgacuuccccggcaaaaccgucugguucgugcccucaaucaagucagggaaugacaucgcaaauugccugcgcaagaacggaaagcgugugauccagcuuucacgcaaaacguucgacaccgaguaccagaagaccaagaacaacgacugggauuacgucgugacaaccgacaucagcgagaugggcgcgaacuuccgggccgacagagugaucgacccgcgccgcugccucaaaccggucauccugaaggacggaccugagcgggugauucuggccgggccaaugcccgucaccguggcuucugccgcucagcgacggggacguaucggcagaaaccacaacaaagagggcgaccaguacaucuauauggggcaaccgcucaacaacgacgaggaucacgcacacuggaccgaggcaaagaugcugcuggacaacauuaacacucccgaaggcaucaucccggcccucuucgaacccgagcgcgagaaguccgccgcgaucgacggcgaguaccggcugcgcggugaagcccgaaaaacguucguggagcugaugcgaagaggugauuugccggucuggcugaguuacaagguggccuccgaaggauuucaguauucagaccggcgcuggugcuuugacggagaacgcaacaaccaaguucuggaggagaacauggacguugagaucuggaccaaggagggagagcgcaagaagcuccggccccgcuggcuggacgcgcggacauacuccgacccgcucgcccuccgcgaguucaaggaauuugccgccggcaggcgcagcguguccggggaccugauccuggaaaucgguaaauuaccccagcaccugacccagcgggcacagaacgcccuggacaaccuggugaugcuucauaauagcgagcaaggcgggcgcgcguaccggcacgccauggaggagcugccggacacgaucgaaacccucaugcugcuggccuuaaucgcaguauugaccgguggaguuacacuguucuucuuguccggcagggggcugggaaaaacgagcauagggcugcucugcguuauggcuuccucgguacugcuauggauggccuccguggagccccacuggaucgccgccaguauuaucuuggaguucuuccugauggugcugcucauccccgaacccgaccgccagcgcacgccucaagauaaccaacuggccuacgucgugaucgggcucuuauuuaugauccucacaguugccgcgaacgagaugggucugcucgagacuacuaagaaagacuuggggaucggccacgucgccguugagaaccaccaucacgccgccaugcuggacguggacuugcaucccgccuccgcguggacccuguaugccgucgcuaccaccaucaucacccccaugaugcggcacacgauugagaauacuaccgcuaacaucucgcugaccgcaaucgcgaaccaggccgcuauccucaugggguuagacaaaggcuggccgaucaguaagauggacauaggcgugccccugcucgcccugggaugcuacagccaggugaaccccuuaacgcucacggcgaccguccugaugcugguggcccacuacgcaauuaucggccccgggcuccaggccaaggccacccgcgaggcgcagaagcggacggccgccgggaucaugaagaauccgaccguggacgggaucguggcuaucgaccuggaccccguuguguacgacgccaaguucgagaagcaauugggucagauuauguugcugauucugugcaccucccagauacucuugaugcguacaacgugggcgcugugcgagucaauaacucuggccacuggcccccucacgacgcugugggaggggaguccuggcaaguuuuggaauaccacuaucgccgucagcauggcaaacaucuuucgcgggagcuaccucgccggugccgggcuggccuucucccugaugaagucccucgggggcgggcggcgcggcaccggggcucagggugagacgcugggugagaaguggaagcggcagcugaaccagcuauccaaaagcgaguucaacacguacaagagguccgggauaauggaaguugaccggucagaggccaaggagggccugaagcgcggagaaacgaccaagcaugcugugucccggggcacggccaaacugcgcugguucgucgagcggaaccucgugaagccggaagggaaaguaaucgaccuugggugcggccgcgggggcuggagcuacuacugcgccggacugaagaaggucaccgagguaaagggcuacaccaagggcggccccggccacgaggagccgauucccauggccaccuacggguggaaccuggugaagcugcacucggggaaggacgucuucuucaucccgccugaaaagugcgacacgcugcugugcgacauaggugagaguucccccaacccaacgaucgaggagggccggacccuccgcguccucaagaugguggagccguggcugcggggcaaucaauucugcauuaagauucucaaccccuacaugcccagcgucguugaaacccuggaacagaugcagcgcaagcacggcggcauguuagugcggaacccccucucccgaaacucuacccacgagauguacugggucuccugcgggaccggaaauaucguuagugccgucaacaugaccucccggaugcugcugaaccgauuuaccauggcgcaccgaaagccgacguacgagcgcgacgucgaccucggagccggcacgagacacguggcgguggagcccgaggucgcgaaccuggauauuaucggacaacggauugaaaauaucaagcacgagcacaaaagcaccuggcacuacgaugaagacaacccauacaagaccugggcauaccacggguccuacgaggugaagcccaguggcucagcguccagcauggucaacggcguggugaagcuguuaaccaagccgugggacgucauccccauggugacgcaaauagccaugaccgauacgaccccauucggacagcagagggucuucaaggagaaagucgauacgcgcaccccgaaagcaaagcgcgguacggcccaaaucauggagguuaccgcuaaauggcuguggggcuuccugucccggaacaaaaaaccgcgcaucugcacgcgugaagaguuuacccggaaggugcggagcaacgccgccaucggcgccgucuuuguagacgaaaaccaguggaacuccgccaaagaggccguggaagaugagcgcuucugggaucucguccacagggagagagagcugcacaagcaggguaagugugcgaccuguguuuacaauaugaugggaaagcgggagaagaagcugggggaguucggcaaggcgaaagggagccgcgccauaugguacauguggcuuggcgcccgguuccuggaauucgaagcgcugggcuucaugaacgaagaucacugguucagucgcgagaacagccucuccgggguggaaggcgaggggcugcauaagcuggguuauaucuugcgggacaucagcaaaaucccugggggcaauauguacgcggacgacaccgcaggcugggacacgcguaucacggaggacgaccuacagaaugaagcaaagaucaccgacauuauggaaccugagcaugcucugcucgcgaaguccauuuuuaagcugaccuaccagaacaaggucgugcgggugcagaggccggcaaagaacggaacagucauggacgugaucagccggcgagaccagagggguuccggccaggugggcaccuacggcuugaacaccuucaccaacauggaggcccagcucauccgccaaauggagagugaggggauauucuccccgagugagcuggagacccccaaucuugccggccgaguccucgacuggcuggaaaaguacggcguugaacggcuaaagcgcauggcuaucagcggggacgauugcguaguuaaaccgaucgacgaucgguucgcuacugcacucaccgccuugaaugacaugggcaaggugcguaaggacaucccgcagugggaacccaguaagggauggaacgacuggcagcaggucccauucuguagccaucacuuucaccagcugaucaugaaggacggccgggagaucgucgugccgugccgcaaccaggaugagcucguggggcgggcccgcgucucucagggugccggcuggucucugagggagaccgcgugccugggcaaguccuacgcucagauguggcaacucauguacuuccaccgcagggacuuacggcuggcggccaacgccaucuguagcgccguaccgguggacuggguccccacgagucggacuaccuggaguauucacgcccaccaccaauggaugaccacugaagacaugcuguccguauggaaccgcguauggaucgaggagaaccccuggauggaggacaagacccacauuuccucauggggugacguuccuuaccucggcaagcgggaggaucaguggugcgguagccuuaucggguuaacagcucgcgccaccugggcaacgaacauccaggucgccauuaaccagguccggcgauuaauuggaaaugagaacuauuuggacuauaugaccuccaugaaacguuucaagaacgagagcgacccggagggggcccuaugguga

SEQ ID NO: 24465 - RNA, 9879 nt, Artificial Sequence
  derived and/or modified CDS sequence (opt11) from DENV-1__GU131753__SS-prME
agugugaccaugcugcucaugcugaugcccaccgcccuggccuuccaccucaccacccggggcggcgaaccacacaugaucgugaccaagcaagagcgggguaagagccuacucuucaagacuagcgccggggugaacaugugcaccuuaaucgccauggaccugggagagcugugcgaggacaccaugacuuacaagugcccccgcauuaccgaggcugagcccgacgacguggacugcuggugcaacgccacugacaccugggugaccuaugggaccugcagccagaccggugaacaccggcgcgauaagcggagcguggccuuggcgccucacgugggucuggggcuggagacccggaccgagaccuggauguccucagagggggccuggaaacagauccagcgcgucgagacgugggcccuccgccaucccggguuuaccgugacggcccuguuccuggcgcaugcuaucggcaccucuaucacucagaaggggauuaucuuuauucuccugaugcuggucaccccuagcauggcuaugcggugugucggcaucggcagccgcgacuucguggaggggcucagcggcgcgaccuggguggacguaguacuggaacacggcuccugcgugaccacgauggccaaggacaagcccacccuggacaucgagcuccucaaaacugaggucaccaaccccgcggugcugcggaaacucugcaucgaggccaaaaucagcaacacgaccaccgacuccagaugucccacccagggugaggccacguuaauggaggagcaggacgccaacuucgugugccgucgcaccuucguagaccggggcugggggaacggcugcggccuguucggcaaggggagccucauuaccugcgccaaguuuaagugcguaaccaaguuagaaggcaagaucgugcaguacgagaaccugaaauauagugucaucguuacaguacacacuggcgaccagcaccaggucgguaacgagagcaccgagcacggcaccaccgcgacgaucacgccccaggcacccaccuccgagauccaacucaccgacuacggggcccucacgcuggacugcucgccccguaccggccucgauuucaaugaaauggugcugcucaccaugaaggagaagaguuggcugguccacaagcagugguuccuggaccugccgcugcccuggaccagcggcgccagcacgucccaggagaccuggaaccggcaagacuuguugguaacguucaagaccgcccacgccaagaaacaggagguggucgugcucggaagccaggagggagccaugcacacggcccugaccggagcaaccgagauccagaccuccggcacgaccacgaucuucgccgggcacuugaagugccgccucaaaauggacaagcugacccugaagggcaugagcuacgugaugugcacgggguccuucaaguuggagaaggaggucgcggagacucagcauggcaccgugcugguccagauaaaguacgagggcacugacgcgccguguaagauccccuucaguacucaggacgagaagggugucacacagaacggccggcugaucaccgccaaccccaucauuacagacaaggagaagcccgugaacaucgaggcagagccgcccuucggggaguccuauauugugaucggcgccggcgagaaggcccugaagcucagcugguucaaaaagggguccuccaucggcaagauguucgaggcgacggcacgcggagcccggcguauggccauacucggcgacaccgcgugggauuucggauccauaggaggggucuucaccagcaucggcaagcugguccaucagaucuuuggcaccgccuacggugugcuguucuccggagucagcuggacgaugaagauugggaucggcgugcugcugaccuggcucggacugaacucccgcaguacaucccucuccaugaccugcaucgccgugggccucgucacguuguaccugggcgugauggugcaggccgacaguggcugcguuaucaauuggaagggccgagagcugaagugcgggagcggcaucuucgugacuaacgaagugcacacauggacagagcaguauaaauuccaggcggauuccccgaagcgcuuaucggccgccaucggcaaagccugggaggagggggucugcgggauccggagcgccacccggcuggaaaacaucauguggaagcagaucuccaacgagcucaaucauauucuguuagagaacgauaugaaguucacggugguggucggcgacgucgugggcauacucgcgcaggggaaaaagaugauacggccccaacccauggagcacaaguacagcuggaaguccuggggcaaggccaagaucauaggcgccgacguacagaacacgaccuucaucaucgacgggcccaacacuccggagugcccugacgaucagcgcgccuggaacaucugggagguggaggacuauggcuucgggaucuucacgaccaacaucuggcugaagaugcgggacagcuauacucaagugugugaccacagacugauguccgcggccaucaaagacagcaaggccguccaugcagauaugggauacuggaucgaguccgagaaaaacgagaccuggaagcucgcccgggcuucuuucaucgaggugaagacguguauauggccuaagagccacacucuguggagcaauggcgugcuggaguccgagaugaucauuccuaagaucuacgggggcccuaucagccagcacaauuaccgccccggguacuucacccagacagcuggccccuggcaucucggcaagcuagaacuggauuucgaccuuugcgagggcacgaccgucguaguggacgagcauugcggcaaccggggaccgucccugcggaccacaacggucacagggaagaucauacacgaguggugcugccggagcugcacccugccaccccuccgcuucaagggggaggaugggugcugguaugggauggagauccggcccgugaaggagaaggaagagaaccugguuaaauccauggucagcgccggcagcggcgagguggacucuuucagccugggcuuacugugcaucuccaucaugauagaggagguuaugcgcagccgguggucacguaagaugcugaugaccggcacgcucgcgguguuucugcuacucaucauggggcaguugaccuggaacgaccugauucggcucuguauaauggugggcgccaacgcaagcgaccgcauggggaugggcaccaccuaccuagcccucauggccacguuuaagaugcgccccauguucgccgugggccucuuauucaggaggcugaccucccgggagguccuucugcugaccaucgggcucagccugguugccuccguggagcugcccaauagccucgaggagcugggugacgggcuggcgaugggcaucaugauccucaaacugcugacggacuuccagucacaccagcucugggcuacguugcugagucucaccuuuaucaagaccacacugucccugcacuaugccuggaagacgauggccaugguccucucaaucgugucauugaucccccugugccucagcaccaccucccaaaagaccaccuggcugcccgucuuacucggcagccuggguugcaagccguuaacgauguucuugaucgcggaaaacaagauuuggggccgcaagucguggccccugaaugaggggaucauggccgugggcguuguuagcauucuguuaucguccuuguuaaagaacgacgugccccuagccgggccgcugaucgccggcggcaugcugaucgccugcuaugugaucucgggguccagcgcggacuugucccuggagaaagccgcugagguuagcugggaggaggaagcggagcacucaggcgcaagccacaacauccugguggaggugcaggacgacgggaccaugaagaucaaggaugaggagcgggacgacacccugaccauucugcugaaggcgacgcuccuggccgucuccgguguguauccgcugagcauaccugcgacccucuucgugugguacuucuggcagaagaagaagcagcguuccgggguccugugggacaccccuagcccgcccgaggucgagcgugccguccuagacgacggcaucuaccgaaucaugcagcggggccugcucgggcgcagccaagucggcguggggguguuccaggaaaacgucuuccacaccauguggcacgugacgcguggagcaguucugauguaccaggggaagaggcuggagcccaguugggcguccgucaagaaggaccucaucagcuacggaggaggguggcggcugcaaggaucuuggaacaccggugaggagguccaagugauugccgucgagcccggaaagaacccuaagaaugugcagaccgcccccgggaccuucaagacccccgagggcgagguaggcgcaaucgcccuggacuuuaaacccgggacaaguggcucccccaucgucaaccgcgaggggaagaucgugggccucuacggcaacgggguagucaccacuagcggcacguacgugagcgcuaucgcccaggccaaggccucccaggaggggccacugcccgagaucgaagacgaaguguuucggaagcgcaaccugaccaucauggaccuccaccccgguagcgggaagacccgccgauaccugcccgcgauaguccgggaggccaugaagagaaaacuuagaacccucauucuggcgcccacgcggguggucgccuccgagauggccgaggcgcugaagggaaugcccauccgcuaucagaccaccgcugucaagagcgagcacaccggcaaggagauaguggaccucaugugccacgcgacguucaccaugcggcugcugucacccguucgcgugccgaacuacaacaugauaaucauggacgaagcccauuucaccgacccgagcuccaucgccgcgcggggguauauuagcacccgugugggcaugggggaggccgcggccaucuucaugaccgccacgccgccuggcuccguggaggcguucccgcaaagcaacgccgucauccaggaugaggaacgcgauauccccgagcgcuccuggaacagcggguacgaauggaucaccgacuuucccggcaagacggugugguuugugcccuccaucaaguccggcaacgacauugccaacugccuccggaagaacgggaagagggugauucagcugucuagaaagacauuugacaccgaguaccagaagacgaagaacaacgacugggauuauguagugaccacggacaucagcgagaugggcgccaacuuccgcgcggaucgcgucaucgacccgcgccggugccugaagcccgucaucuugaaagaugggccagagcgcgugauuuuagccggccccaugccggucaccguggccucggccgcccagcggcgcgggcggaucggccggaaccacaauaaggagggcgaccaguacaucuacauggggcagccccugaacaacgacgaggaccacgcucacuggaccgaggccaagauguuacuggacaacaucaacacgcccgaaggcaucauccccgccuuauuugagccggagcgggagaaauccgccgccaucgacggggaauaccgcuugcgcggcgaggcgcggaagacauucgucgagcugaugcgccgcggggaccugcccguguggcucucauacaagguggccuccgagggauuucaguauagcgaccgucgguggugcuucgacggcgagcgcaacaaucagguccuggaagaaaauauggauguggagauuuggaccaaggagggggagcggaaaaagcugcgccccagauggcucgaugcccgcaccuauuccgacccgcuggcccugcgggaguucaaggaguucgccgcuggccgccggagugucuccggcgaucucauccuggagaucgggaagcugccgcagcaccugacccagcgcgcccagaacgcccuggacaaccuggucaugcuccacaacuccgagcaaggagggcgggccuaucgccacgcgauggaggaacugcccgacacgaucgagacccugaugcuccuggcccugaucgccgugcucaccggcggggugacccuguucuuccuguccggccggggacucggcaagaccagcauuggucugcugugugucacggcuuccagcgucuuacuguggauggcaaguguggagccccacuggaucgccgcguccaucauccuagaguucuuccucaugguucugcugauccccgagccggaccgccagcgaacaccccaggacaaccaacuggccuacguggugaucgggcugcuguuuaugauccugacagucgccgccaacgagaugggccuguuggaaaccaccaagaaggaucucgggauaggacacguggcaguggagaaccaccaucacgccacuauguuggauguagaccugcacccggccuccgccuggacucuguacgccguggcgaccacaaucaucacaccgaugaugcgccacaccaucgagaacaccacggcaaacauuucgcugaccgccaucgccaaccaggcagcgauccugaugggguuggacaagggcuggcccaucuccaagauggacaucggcgucccccugcuggcauuggggugcuacagccagguaaacccccuuacacugaccgccgccgugcucaugcugguggcgcacuacgcuauaaucggcccggggcugcaggccaaggcaacgcgggaagcccagaaacgcaccgcggccggcaucaugaaaaacccuaccgucgacggaauaguagcaaucgaccucgaccccguggucuaugacgccaaguucgagaagcagcugggccagaucaugcugcucauccugugcaccucacagauccugcugaugcgcacgaccugggcccuuugcgagagcauaacccuggcgaccggcccccucacaacccugugggagggguccccgggcaaguucuggaacacuacaaucgccgugucaauggccaacaucuuccgggggucauaccuggccggugccgggcucgcguucagccugaugaagucccucggaggcgggagacgggggacuggggcucagggggagacccuuggcgagaaguggaagcgucagcugaaucagcuguccaagagugaguucaauaucuacaagcggucuggcaucauggagguggaccgcagcgaggccaaggagggccucaagcgcggggagaccacgaagcaugccgucucccgcgguacagcgaaguugcggugguucguggagcgcaaccucgugaagcccgaggggaaggucaucgaucuggggugcggccgcggcggguggagcuacuacugcgcagggcucaagaaggugacggagguuaagggguacaccaagggcggacccggccacgaggagcccauuccgauggccaccuacggguggaaccuggucaagcugcacucaggcaaggacguguuuuucacgccgccugagaagugcgacacgcugcugugcgacaucggggagagcuccccuaauccgaccaucgaggagggccgcacacugcggguccucaagauggucgagccuuggcugcgcgggaaccaguucugcaucaagauccuaaaccccuacaugccuagcgugguggagacccucgagcagaugcagcggaagcacggcggcaugcugguccgcaacccacuaucccggaauagcacgcacgaaauguacugggugaguugcgggaccggcaacaucgugagcgcagucaacaugaccagccggaugcuccuaaaucgguuuaccauggcccaucgcaagcccacguaugagaaagacguggaccugggggcaggcaccagacauguggccgucgagcccgaggucgccaaccucgacaucaucggccagcggaucgagaacaucaaacacgaacacaagagcacuuggcacuacgacgaggacaaccccuacaaaaccugggccuaccacggguccuaugaggucaagccgucgggcuccgccagcagcaugguaaacgggguggucaagcugcugacgaagcccugggacgugauccccauggugacccaaaucgcgaugacugacaccacuccuuucggccagcagcgcgucuucaaagaaaaaguggacacccggaccccgaaggcgaagcgcgggacugugcagaucauggaggucacggcccgguggcucuggggcuuccucagccguaacaagaagccccgcauuugcacucgcgaggaguuuacccggaaggugcgcagcaacgccgccaucggcgcgguguuuguggacgagaaccaguggaacucugccaaggaggccguggaggacgagcgguuuugggaccugguuaagaaagagcgagagcuccauaagcaggggaaaugcgcgaccugugucuacaacaugaugggaaagcgagagaagaaacugggggaguucggcaaggcgaaagggucucgcgcgaucugguauauguggcugggagcccgguuccucgaguucgaggcccugggcuucaugaacgaggaccacugguuuucccgugagaacagccugucaggaguggaaggcgaggggcuacacaagcugggcuacauccugcgcgacaucagcaagauccccggagggaauauguacgcagacgacacagcgggaugggacacccgcaucaccgaggaugaccuccagaacgaggccaagaucaccgacaucauggaaccggagcacgcucugcuugcgacguccaucuucaagcucaccuaccaaaauaaggugguccgggugcagcgacccgccaagaacgggacgguaauggacgucaucagccggcgugaccaacgcggaaguggccagguggggaccuacggccugaacacguucacaaauauggaggcgcaguugauccggcaaauggaaagcgaagggaucuuccuccccuccgagcuggaaacccccaaccuugccgagcgcguguuugacuggcucgagaaguacggcgucgagcggcucaagcggauggccauaagcggggacgacugcgucgugaaaccgaucgacgaccgguucgccaccgcacugacggcgcucaacgacaugggcaagguacgcaaagauaucccacagugggagcccuccaagggauggaacgacuggcagcagguccccuucugcagccaccauuuccaccagcugauuaugaaggacggccgggaaaucgugguccccugccgcaaccaggacgagcuggugggucgggccagagugucccagggggccggcuggagucucagggagacggccugucucggcaagagcuacgcccagauguggcagcuaauguauuuccaccgccgggaccucagacuggcggccaacgccaucugcucggccguacccguggacugggugcccaccucccgaaccacgugguccauccaugcgcaccaccaguggaugacuacagaagacaugcugagcgucuggaaccgcguguggauugaggaaaaccccuggauggaagacaagacccacgucaguagcuggggagacgucccguaccucgggaagcgugaggaccaguggugcgggucccugaucggccugaccgcccgcgcaacgugggccagcaacauccagguugccaucaaccaggucagacgccucaucgggaacgagaacuaccuggacuacaugacguccaugaaacgcuucaagaacgagggcgacccagagggggcgcuuugguag

SEQ ID NO: 24466 - RNA, 9879 nt, Artificial Sequence
  derived and/or modified CDS sequence (opt11) from DENV-1__GU131754__SS-prME
agcgugacaaugcugcuaauguugaugccuaccgcccuggccuuccaccucacgacccgcggcggggaaccgcacaugaucgugucuaagcaggaacguggcaagucacuguuguucaagaccuccgccggggugaacaugugcacccuaauugccauggaccugggcgaguucugcgaagauaccaugaccuacaagugcccccgcaucaccgaggccgagccggacgacguggacugcuggugcaaugccacagacacaugggugacauacgggacuugcucucagaccggcgagcaccggcgggauaagcgguccguggcccucgcgccccacgugggccucggucuggagacccguacggaaaccuggaugagcuccgaaggcgcauggaagcagauccagcggguggagaccugggcccuacgccauccgggguucacugugaucgcccucuuccuugcucacgccauugggaccucgaucacccagaaagggaucaucuucauacugcucaugcuggugacccccucgauggcgaugcggugcguuggcaucggcagccgcgacuucguugaggggcuauccggggcuacguggguagacgucgugcucgagcacgggagcugcgugaccacgauggcaaaggacaagccuacccuggauauagagcugcucaaaacggaaguaaccaaccccgcggugcugcggaaacuuugcaucgaggccaaaaucucuaacaccacgaccgacagccgcugcccgacgcagggcgaggccacccucguggaggagcaggacgccaacuucgucugccggcgcaccuucguggaccggggcuggggcaacggcugcgggcuguucggaaaggggucauuaaucacgugcgccaaguucaaaugcgucacgaagcuggagggaaagaucguccaguaugagaaccugaaauacucggugaucgugaccguccacaccggcgaucagcaccagguggggaacgaguccacggaacacggcaccacggcgaccaucacgccccaagcccccagcacggagauccaacucaccgacuacggagcccucacccuugacuguucuccccggaccggccuugacuuuaacgaaaugguucuccugacgaugaaggaaaagaguuggcuggugcacaaacagugguuucucgacuugccgcuacccuggacaagcggggccuccaccagccaagaaacguggaaccggcaggaccuccuggucacguucaagaccgcucacgcgaagaagcaggaaguaguggugcuuggcucccaagagggcgccaugcacaccgccuuaaccggggccacggagauccagacaucuggcaccacuacgauauucgcggggcaucuuaagugucgucugaaaauggacaagcucacguuaaaggguauguccuacgucaugugcaccgggagcuucaaacuggagaaggaaguugcggagacucagcauggcacggugcucguccagaucaaguacgagggcaccgacgccccuuguaagauccccuucuccacccaggacgagaagggggugacccagaacggccgguugaucacggcgaaccccaucguaaccgacaaggauaagcccguuaacaucgaggccgagccgccguucggugagucauacaucgugaucggagccggggagaaggcuuuaaagcuguccugguuuaagaagggcagcuccauagguaagauguucgaggccaccgcccgcggugcccggcgcauggcgauacucggagacaccgccugggacuucgguagcauaggaggcguguuuacguccgucgggaagcuggugcaccaaaucuucgguaccgcguacgggguacuguucagcggagucuccuggaccaugaagauagggaucggcgugcuucugaccuggcugggccucaacagccgauccacgagucuguccaugaccugcauugccguggggcuggucacccucuauuuaggcgucaugguacaggcugauagcggcugcgucgugaacuggaagggccgagagcugaagugcgggagcggcaucuucguaaccaaugagguccacacguggacagagcaauacaaguuucaagcggacuccccgaagcgucucagcgccgccaucggcaaagccugggaagagggaguaugcggcauccggagcgcaacacgccuggaaaauaucauguggaagcagauuucaaacgaacugaaccacauccugcuggagaacgacaugaaguuuacagugguagugggcgauguugcgggcauccuggcucaggggaagaaaaugauccggccccagcccauggaauacaaguacuccuggaagucuuggggcaaggccaagauuauuggcgccgauguccagaauacuacguucaucaucgacgggcccaacacaccggaaugucccgacgaccagagagcguggaauauaugggaggucgaggacuacggguuugggaucuucaccaccaacauauggcucaaguugcgggacaguuauacccaagugugcgaccaccgccucauguccgccgccauuaaagacaguaaggccguacacgcugacaugggcuauuggaucgagagcgaaaagaacgaaaccuggaagcucgcucgggcauccuucaucgaggugaagaccugcaucuggcccaagagccacacacugugguccaauggaguucuggagucugagaugaucauccccaaaaucuaugguggcccgauuucccagcauaacuaccgccccgguuacuucacgcagacagcaggccccuggcacuuggggaagcuggaguuagacuucgaccuuugcgaggggaccaccgucgugguggacgaacacugcggcaaccgggguccgucacugcgcacgaccacagucaccggcaagaucauccacgaguggugcugucgguccugcacgcugccaccccuucgcuucaaaggggaggacggaugcugguacggaauggaaauccggcccguuaaagaaaaggaggagaaccuggugaaguccaugguaucagccggcuccggcgaaguggacagcuucucucugggucucuugugcaucagcauuaugaucgaagaagugaugcgcuccagguggagcaggaaaaugcuuaugacugggacuuuagccguguucuuucugcugaucauggggcagcucaccuggaacgaccugaucaggcugugcauaauggugggcgcgaacgccuccgaccgcauggggaugggaacuacuuaucucgcccugauggcaaccuucaaaaugcgccccauguucgccgucggauugcuguuccgucgccugacaagccgggagguccuucuccugacaauugggcugucccuuguggcuuccguugagcuucccaacucccuggaggagcucggcgacgggcuggcgaugggcauaaugauucugaaauuguugacagacuuucaaagccaccagcugugggccacccuccugagccugacuuucaucaagacgaccuucucccuccauuacgcguggaagaccauggcuauggugcuaucaaucgugucucuguuucccuugugcaugucgaccacgucucagaagaccaccuggcugcccguccugcucggcuccuuaggguguaagccgcugaccauguuucucaucgcagagaacaagauuuggggccgcaagagcuggccccugaacgaggggauaauggccguggguauuguaagcauccuccucaguagucugcucaaaaaugacgugccguuggccgggccccucaucgccgggggcaugcugaucgcgugcuauguuaucuccggguccagcgcagaccucagccuggaaaaggccgcggaggugucuugggaggaggaggccgagcacagcggcgcgucccacaacauccuggucgaggugcaggacgacggaacaaugaagauaaaggaugaggagcgggacgacacccucaccauccugcugaaagccacucuucuagcggugagcggcgucuacccguuaaguauucccgccacccucuucgugugguacuucuggcagaagaagaaacagcgcaguggugugcugugggacacacccagcccgccugagguggagcgugcuguucuggacgacggcauauaccgcaucaugcagcggggccuccuggggcguagccaaguaggcgucgguguguuccaggagaacguguuccacaccauguggcacguuacgcggggcgcggugcugauguaccaggggaagcgccuggagcccuccugggccucggucaagaaagaccucauuucguaugguggaggguggcggcuacaggggagcuggaauaccggggaggaaguccaggugaucgcuguggagcccgggaaaaaccccaagaacguucagacggcuccagggaccuuuaaaaccucugagggagaaguaggcgccauagcucuagauuucaagcccggcacaagcggcagccccaucgugaaucgcgaagggaagaucguggggcucuacggcaauggaguggucacuacauccgggaccuacguuagcgcuaucgcccaggccaaggcgagucaggaggggccacugccggagaucgaggacgagguguuccggaaacgcaaccugaccauaauggaccuacaccccggcucugggaagacacggcgcuauuuacccgcuaucguucgagaggccaucaagcgcaagcugcggacucucauccuggccccaacacgcgugguugcguccgagauggcggaagcccucaagggcaugcccauacgcuaccagacgacggccguaaagagcgagcauaccggcaaggagaucgucgaucucaugugccacgcgaccuucaccaugcggcugcugucccccguacguguccccaacuacaacaugaucauaauggacgaagcucauuucacggacccaucaaguaucgcggcccggggguauaucagcacucgcgucggcaugggugaggccgcagccauuuucaugacugcgacgccacccggcucgguggaggcauucccacagagcaaugccgugauccaggacgaggagcgggacaucccggagcgcuccuggaacagcggguacgaguggauaacggacuuccccggcaagacagucugguucgugccgucuaucaaaucaggaaacgacaucgccaacugccugcggaagaacggcaaacgcgugauccagcuauccaggaagacauucgacaccgaguaccagaagacgaagaacaacgacugggacuacgucgugaccaccgauaucucugagaugggcgcgaacuuccgcgcagaccgggugaucgacccucgacggugccuuaagccgguuauccucaaagacgggcccgagcgcgugauucuggcugggccaaugcccguuaccgucgccuccgcagcgcagcggcgcgggcggauagggaggaaccacaacaaggagggcgaccaauacguguacauggggcagccucucaacaacgacgaagaccacgcccacuggacugaggcgaagaugcugcuggacaacaucaacaccccagaggggaucauacccgccuuauucgagcccgagcgggagaagucagcggcgaucgacggggaguaucgccucaggggcgaggcccggaagaccuucgucgaacucaugcgccgcggggacuuaccgguguggcugaguuacaagguggccucggagggcuuccaguauagugaccggcgcuggugcuucgacggcgagagaaauaaucagguauuagaagaaaacauggacgucgagaucuggaccaaggagggggagcggaagaagcucaggccccggugguuagacgcacggacauauuccgacccccuggcuuuacgggaguucaaggaguucgcggccggccgccggagcguuuccggggaccucauacuggagauuggaaagcugccacagcaccucacgcagagagcccagaaugccuuggauaaccuggucaugcugcacaacagcgagcaagggggacgugccuaccgccacgcaauggaagaacugccggauacaauagaaacgcugaugcuccuggcccuuaucgccgugcucacaggcggcgugacccuguucuuccuuucgggccggggguuagggaagacaagcaucggccuguugugcgucauggccuccagcgcgcuccuuuggauggccucaguagaaccgcacuggaucgcggcuucuauaauacuggaguucuuccucauggugcugcugaucccggaacccgaccgccagcgcaccccucaagacaaucaguuagccuaugucgugaucggauuauuguucaugauccucaccguugcggcuaaugaaaugggccugcuagagaccacuaagaaggaccucggcauuggucacguugcaguggagaaccaccaucacgcagccaugcuggacguugaucuccaucccgcuuccgccuggacccuauaugccguugccaccacgauuauuacacccaugaugcgccacacuaucgagaauaccacugcgaacaucagucugaccgcgauagccaaccaggccgccauccuuauggggcucgacaaaggcuggccgauuaguaaaauggacaucggagugccgcugcuggcucuaggguguuacagccagguaaauccucucacccuuaccgccgccguccucaugcugguggcucacuacgccauuaucggacccgggcuccaggccaaggccacgcgggaggcgcagaagcgcacagccgccgggaucaugaaaaauccgaccguggacgggaucguggcgaucgaccucgacccaguuguuuacgacgccaaguucgagaagcagcugggccagauuauguuguuaauauuaugcaccucccagaucuuacucaugcgaaccaccugggcccugugcgagaguauaaccuuagccaccggcccacucacgacccugugggaggggagccccggcaaguucuggaauaccacaaucgcaguaaguauggcuaacauuuuccggggaagcuaccucgccggcgccggcuuagccuuuucacugaugaagaguuuaggggguggacgucggggcacuggggcgcagggcgagacccucggggagaaguggaagcgccagcugaaccagcuuuccaagagcgaguucaacacuuacaagcgguccgggaucauggagguggaccgcagcgaggccaaagagggccuaaagcgcggggagacaacgaagcacgcugugucacgcggcaccgccaaauugaggugguucgucgaacgcaaccucgugaagccggaggggaaggugaucgaccugggaugcgggcgcggaggguggagcuacuacugugccgggcugaagaaagucaccgaggugaaaggguacacgaagggcgggccgggccacgaggagccaaucccgauggcuacauacggguggaaccuggucaagcuccacuccggcaaagacguguucuucauaccaccugagaaaugcgacaccuuauugugcgauaucggggaaagcucccccaauccuaccauugaggagggccgcacuuugcgggugcucaagaugguagagccgugguuacgcgggaaucaguucugcauaaagauccugaaccccuacaugcccuccgucguggaaacguuagagcaaaugcaaaggaagcacggcggcaugcuuguucgcaaucccuugucccggaacagcacgcacgagauguacuggguguccugcgggacaggcaauaucguguccgccgugaauaugacgucccggaugcucuugaaccgguucacgauggcccaccgaaagcccacuuacgagagggacguagaccuuggggccggcacccggcacguugccguagagccggaggucgcgaaccucgauaucauuggucaaaggaucgagaauauaaaacacgagcauaaaagcaccuggcacuacgacgaggacaacccguauaagaccugggccuaccacggguccuacgaggugaagcccagcggcagcgccuccagcauggucaaugguguggugaaacugcugacgaagccgugggacguaauccccaugguuacccagauagcuaugaccgacaccaccccuuucggccaacagagggucuucaaggagaaggucgacacccgcacgcccaaggccaagcgggggaccgcgcagaucauggaagugacggccaaauggcuuuggggcuuccugucacgcaacaagaagccgaggaucugcacucgcgaggaguucacccggaaggugcgaagcaacgcagccaucggcgcgguauucguggacgagaaccaauggaacuccgccaaggaagccguggaggacgagcgguucugggaccugguccaccgagagcgggaguuacacaagcaggggaagugugcgaccuguguguacaauaugauggggaaacgcgagaagaaauuaggggaguucggcaaggcgaaggggagccgggcgaucugguacauguggcugggcgcccgauuccucgaguucgaagcgcugggguucaugaaugaggaccacugguucaguagagagaacucucugucggguguggagggcgagggccuccacaagcugggcuacauccugcgcgauaucagcaagaucccagggggcaacauguacgccgacgauacggcgggaugggacacccggauaaccgaggacgaccuccagaacgaggcgaagaucaccgacaucauggagcccgagcacgcccuacuggccaaauccauauucaaacucaccuaccagaacaagguggugcgcguacaacggcccgccaaaaacgggaccgucauggacgugaucucacgccgggaccagcggggauccggccagguggggacguacggccuaaauaccuucacaaacauggaagcacagcugauccgccagauggagucugaagguaucuuuucccccagcgagcucgagacccccaaccuggccggccgcguucuggauuggcucgagaagcaugggguugagcggcugaagcguauggccauuagcggcgacgacugcgugguuaagccgaucgacgaccgcuucgcgaccgcccugacugcccucaacgacauggggaagguacggaaggauaucccgcagugggagccaaguaagggcuggaacgacuggcagcagguccccuucugcagccaccacuuccaccaacuaaucaugaaagauggacgcgagaucguaguacccugccggaaccaggaugaguugguuggacgcgcacgggucucccagggcgccggguggagccuccgcgagacggcaugccugggcaaguccuaugcccaaauguggcagcugauguacuuccaccggcgcgaccuccgacuggcagcaaacgcaauaugcagcgcugugccgguggacuggguccccacuucucgcaccaccuggagcauccacgcccaccaccaguggaugacgaccgaagacaugcuguccguauggaaccguguauggauagaggagaacccuuggauggaggacaagacccauauaagcucguggggugauguucccuaccuuggaaagcgugaagaccaguggugcggcagucuaaucgggcuuaccgcgcgggccacgugggcuaccaacauucagguggccaucaaccagguacgccgguugaucggcaacgaaaacuaccuugacuacaugacauccaugaaacgguucaagaacgagagcgaccccgagggggcgcugugguaa

SEQ ID NO: 24467 - RNA, 9879 nt, Artificial Sequence
  derived and/or modified CDS sequence (opt11) from DENV-1__GU131755__SS-prME
agcgugaccaugcugcucaugcucaugccgaccgcccuggccuuccacuuaaccacccggggcggggagccccacaugauagugucaaagcaggagcggggcaagagccugcuguucaagaccagcgccgggguuaacaugugcacccuuaucgcuauggaccugggcgaguugugcgaggacaccaugaccuacaaguguccccggaucaccgagacggagccggaugacguagacugcuggugcaacgcgacugacaccugggugaccuacgggaccugcagucagacgggugagcaucggcgggacaagcggucaguggcccucgcgccccacgugggccuggggcuggagacccggaccgagaccuggaugagcuccgagggcgccuggaagcagauccagcgggucgaaacgugggcccuccgccaucccggguucaccgugaucgcccuguuuuuggcccacgcgaucggaaccucuaucacccagaaggggaucaucuucauccuccugaugcuggugacgcccaguauggccaugcggugcgucggaaucggcagccgcgacuucguggaggggcucuccggcgcaaccuggguggacgucgugcuggagcaugggagcugcgugaccaccauggcuaaggacaagcccacguuggauaucgagcuccugaagaccgaggucaccaaccccgccgugcugcggaagcucugcauugaggcgaagaucuccaacaccacgaccgacagccgcugcccgacccaaggcgaggcaacccugguggaggagcaggaugccaacuucgucugccggcgcacguuuguggacagaggcugggggaacggcugcgggcuguuuggaaaagggucccucaucacgugcgccaaguucaagugcgugaccaaguuggaggguaagaucguacaauaugagaaccugaaguacagcgugaucgugaccguccacacgggugaucagcaccagguggggaacgaaagcaccgagcacgguaccaccgcaaccaucacgccccaggcccccaccacggagauccagcucaccgauuacggggcccugacgcuggacuguagcccccgcaccggcuuagacuucaacgagaugguccugcugacaaugaaggaaaaauccuggcucgugcacaaacagugguuccucgaucugccccuccccuggaccagcggcgccucgacaucccaagagaccuggaaccggcaggaccugcuggugaccuucaagaccgcccacgccaagaagcaggaggucguggugcucggaagccaggagggcgcgaugcauacggcgcugacaggggccaccgagauccagaccuccggcacgacgaccaucuucgcugggcaccugaagugcaggcucaagauggacaagcugaccuugcggggcaugucauacgucaugugcacgggguccuucaaacucgagaaggaggucgccgagacccagcacggcaccguucugguacagaucaaguacgaagguacugacgcgcccugcaagauccccuucagcacucaggacgagaagggggugacucaaaacggacgccugaucaccgccaacccgaucgugacagacaaggagaagcccgucaacaucgaagccgagccacccuucggcgaguccuacaucgugaucggcgccggcgagaaggcgcugaagcucagcugguucaagaagggguccagcauuggcaagauguucgaggccacagcccgcggggcccgcagaauggccauccugggugacaccgcgugggauuucggguccaucggcgguguguucaccucggucgggaagcuggugcaccagaucuucggcacugccuacggggugcuguucucaggcgucagcuggacgaugaagaucgggaucggcguacugcugaccuggcucgggcugaacucccggagcacaagucuaucgaugaccuguaucgccguggggcucgucacgcuguaccuuggcgugauggugcaggccgacuccgggugcgucaucaacuggaagggccgcgaacucaagugcgggagcggcaucuucgugaccaaugaggugcacaccuggaccgagcaguacaaguuccaggccgacagcccgaagcgacuguccgcggccaucggcaaagccugggaagagggggucugcggcauucggucggcuacccggcuggagaacauuauguggaagcagauuuccaacgagcucaaccacauccuguuagaaaaugacaugaaguucacagugguggucggagacguggccggcauccucgcgcaggggaagaagaugauccgcccccagccaauggaguacaaguacagcuggaaguccuggggcaaggccaagauaaucggcgccgacgugcagaacaccaccuucaucaucgacgggcccaacacucccgagugccccgacgaccagcgcgccuggaacaucugggaggucgaggacuacggcuucggcaucuucaccacuaacaucuggcugaagcugcgcgacucguacacccaggugugcgaccacagacucaugucagcggccaucaaggacagcaaggcugugcacgccgacaugggcuacuggaucgaguccgagaagaacgagaccuggaaacuggcccgcgcgagcuucaucgaggucaaaaccuguaucuggcccaagucccacacccuguggagcaacggcgugcucgagagugaaaugauuauccccaagaucuacgggggcccgaucagccagcacaacuaccggcccgguuacuucacccagaccgccggcccuuggcaccucgggaaacuugagcucgacuucgaccugugcgagggcacgacaguugugguggacgagcacuguggcaaucgcgggccgucccugcggaccaccacuguuacaggcaagaucauccacgaguggugcugccgcagcuguacccugccgccuuugcgguuccgcggggaggacggcuguugguacggcauggagauacggcccgucaaggagaaggaggagaaccuggugaaguccauggugagcgcgggcucgggcgaggucgacuccuucagccucgggcugcugugcauuucaaucaugaucgaggaggugaugcgcagucgcugguccaggaagaugcucaugaccggcacgcuggccguguucuuucugcucaucauggggcagcugaccuggaacgaccugauccggcucugcaucauggucggcgccaacgcgagcgaccggauggggaugggcaccacguacuuggcgcugauggcgacguucaagaucaggccaauguucgccgugggccuccuguucagacgccugaccucccgggaggucuuacugcugaccaucgggcucagccuggucgccucuguggaguuacccaacagccucgaggagcugggcgacgggcuugcgaugggcauaaugaucuuaaagcuacuaaccgauuuucagucccaucagcucugggccacacuacugagcuuaaccuucaucaaaaccaccuucucccugcacugugccuggaaaacgauggccaugguccugagcaucgugucccucuucccccugugucugagcaccaccucccagaagaccacguggcuccccgugcugcugggcagccugggcugcaagccccugaccauguuccugaucgcggagaacaagaucuggggccgcagguccuggccacucaacgaaggaaucauggccguuggaauagugagcauccugcugagcucacuacugaagaacgacgugccccuugccgggccgcucaucgccggcggcaugcugaucgccugcuacgugaucagcggguccagcgcugaccugucccucgagaaggccgccgagguaucgugggaggaggaggccgagcacuccggagccagccacaacauccugguggagguccaggacgacgggacaaugaagaucaaggacgaggagcgcgacgacacccugaccauccuacugaaagcgacgcugcucgccguguccggcguguacccgcucagcauccccgccacccuauucguaugguauuucuggcagaaaaagaagcagcgguccgggguccucugggacacccccagcccgcccgagguagagcgcgccguucuggacgacggcauuuacaggaucaugcagcgcggccugcuggggcgaucccaggugggcgugggggucuuccaagagaacguguuccacaccauguggcacgugacgcgcggcgccguccucauguaccaggggaagcggcuggagcccagcugggcguccgugaagaaggaucugaucagcuacggcggcggguggcgccuccagggcucguggaacaccggggaagaagugcaggucauagccguggagcccggcaaaaaccccaaaaacgugcagaccgcccccgggaccuuuaagacgcccgagggcgaggucggcgccauagcccuggacuucaagcccgggaccucgggcucgcccaucgugaaccgggaggggaaaauugugggccuguacggcaauggggucgugaccaccagcggcacguacgugagcgcgaucgcgcaggcgaaagccucacaggagggaccgcuccccgagaucgaggacgaggucuuucgcaagcggaaccugaccauaauggacuuacaccccggcagcgggaagacccggcgcuaucuaccggcgauagugcgcgaggccaucaagcgcaagcugcggacacugaucuuggcucccacgcgcgucgucgccuccgagauggccgaagcgcugaagggcaugcccauccgguaccagaccaccgcagucaagagcgaacacaccggcaaggagaucguggaccugaugugccacgcaacuuucaccaugcgccuccugucccccguccggguaccgaacuacaacaugaucauuauggacgaggcccacuucacggaccccagcuccaucgccgcgcgcggguacaucagcacccggguggguaugggggaggccgccgccaucuucaugacggccacgccgcccggcuccgucgaggcuuucccgcagagcaacgccgugauccaggaugaggagcgcgacauacccgagcguagcuggaacagcggguacgaguggaucacagacuucccuggcaagaccgugugguucguucccuccauaaagagcggcaacgacauagcaaacugccugcggaagaacgggaaaagggugauccagcucucccgcaagacguucgauaccgaauaccagaagacgaagaacaacgauugggauuacguggugacgacggacaucagcgagaugggcgccaacuuccgagcggaccgcgugauagacccgcggcgaugccugaagcccgugauccugaaggacgggcccgagcgcgucauccucgccggccccaugccgguuaccgucgccucggccgcccagcgcagggggcgcaucggccgcaaucacaacaaggagggagaccaguacaucuacaugggccagccccugaauaacgacgaggaccacgcgcacuggaccgaagcaaagaugcugcucgacaauaucaacacccccgagggcaucaucccugcccuauuugagccggaacgggaaaaguccgccgccaucgacggggaguaccgccugcguggcgaagcacgcaaaacguucguggagcucaugcggcgcggcgaucugcccguguggcuguccuacaaggucgccucagagggcuuccaguacagcgaccggcgcuggugcuuugauggggagcggaacaaccaggugcuggaggagaauauggacguggaaaucuggaccaaggagggggagcgcaagaaacugcggccccgcuggcuggacgcccggaccuacuccgacccucucgcccugcgcgaguucaaggaauucgccgcgggacggcgaagcgucuccggggaccuaauucucgagaucggcaaacugccgcagcaccugacccagcgggcccagaacgcccucgacaaucuggugaugcugcacaacucagagcagggcgggcgcgccuaccggcaugcgauggaggagcuccccgacaccaucgagacacugaugcugcucgcucugaucgcugugcugaccggcggaguuacccucuuuuuccuguccggccgcgggcuaggcaagaccagcaucggccuccuuugcgugauggccuccagcgugcugcucuggauggccuccgucgagccacacuggauagcggccagcauaauccuggaauucuuccugauggugcuccugauccccgagccugauaagcagcgcacaccccaggacaaccagcuggccuacguggucauugggcugcuguucaugauucugaccguggccgccaacgagaugggccuacuugagaccaccaagaaagaccuggguauaggacacguggcgguagaaaaccaccaccacgccgccaugcucgacguggaccuucacccugccuccgccuggacccuguacgcggucgccaccaccaucaucaccccgaugaugcgccacacuauugagaacacaacggccaacaucagccucaccgcuauagccaaccaggcagcgauccugauggggcuggacaagggcuggccgaucuccaagauggacaucggcgucccccuccuggcccuggggugcuacagccaggugaaccccuugacgcugacagccgcgguacugaugcucgucgcgcacuacgccaucaucggaccggggcugcaggccaaggccacccgcgaggcgcagaagcggaccgccgccggcauuaugaaaaaccccacgguggaugggaucguggcgaucgaccuggaccccgucguguacgaugccaaguucgagaaacaacucggccagaucaugcugcugauccucugcaccucccaaauccuucugaugaggaccaccugggcacucugcgagagcaucacgcuggccaccggccccuugaccacucuuugggaggguucaccgggcaaauucuggaauacaaccaucgccgugagcauggccaacaucuuucggggguccuaccuggccggcgcgggccuggcguucagccucaugaagucccuuggaggcgggaggcgggggaccggggcccagggcgagacccugggcgagaaauggaagcgccagcucaaccagcuguccaagagcgaguuuaacacguacaaacgguccgggaucauggaggucgaccgcuccgaagccaaggagggccugaagcgcggggagaccaccaagcaugcggugucccgcggcacggccaagcuccgaugguucguggagcgcaaccugguuaaacccgaggggaaagugaucgaccugggcugcggccgcggugguuggagcuacuacugcgccgggcugaagaaggugacugaggucaagggcuacacuaagggcggacccggccacgaggagcccaucccgauggcgacuuacggguggaaccucgugaaacugcauuccggcaaggacguguucuucaucccacccgagaagugcgacacccugcucugcgacaucggggagagcucccccaacccgacgauagaggagggacgcacccugcgcgucuugaagaugguggagcccuggcuccgcgggaaccaguucugcaucaagauccugaaccccuacaugccuagcguggucgagacauuagagcagaugcagcggaagcacggcggcaugcucgugcgcaacccgcugucccggaacagcacccacgagauguacuggguguccugcggaaccggcaacaucgucagcgcugugaacaugacgagccgcaugcugcucaaccgcuucacuauggcgcaccguaagccaacuuacgagcgcgacguggaccuuggggcaggcacccggcacgucgccgucgagccagagguggccaaccuggacauuaucggccagcgcaucgagaacaucaagcacgagcacaagucgacguggcacuaugacgaggacaaccccuacaaaaccugggcuuaccacggcucauacgagguuaagccgucuggcuccgcgagcagcauggugaacggcgucgugaagcuccugacaaagcccugggacgugauccccauggucacccagauagccaugacggacaccacccccuucggccagcagcggguguuuaaggagaaggucgacacccgcacgccgaaggccaagcggggaaccgcgcaaaucauggaaguaaccgccaaguggcuuuggggcuuccucucccggaacaagaagccgcggaucugcacccgcgaggaguucacacguaaggugcgcagcaacgcggccaucggcgccguguucauagacgagaaccaguggaacuccgccaaggaagcggucgaggacgagcgguucugggaccugguucaccgcgagagggaguuacacaagcagggaaagugcgcaaccugcguguacaacaugaugggcaagcgcgagaaaaaacucggggaguuuggcaaggccaaggggagccgggccauuugguacauguggcugggcgccagguuccuggaauucgaggcgcucggguucaugaacgaggaucacugguucucccgggagaacagccuguccggggucgagggcgaggggcuucacaagcuagguuacauccugcgcgacaucagcaagauccccgggggcaacauguacgcagacgacacugccggaugggacacccggaucacggaggacgaccugcagaacgaggcccgcaucacugacaucauggagccggagcacgcccuccuggccaaguccaucuucaagcugaccuaucagaacaaggugguacgcguccagcgaccugccaagaacgguaccgugauggacgugaucagccgccgggaccagcgcggcuccggccaggucggcacguauggccugaacaccuuuaccaacauggaggcccagcugauccggcagauggagagcgaggggaucuucuccccgagcgagcuggagacccccaaccucgcagagcgcgugcuggacuggcuggagaaguacggcguagaacggcucaagaggauggccaucucaggggacgacugcgucgugaagccgaucgacgaccgguucgcgacggcguuaaccgcgcuuaacgacaugggcaagguccgcaaggacauaccccaaugggagcccagcaagggcuggaacgauuggcagcagguccccuucugcucccaccauuuccaucagcucaucaugaaggacggccgggagaucguggugccaugccgaaaucaggacgaguuggucggccgggcccgcguaagccagggggccggauggagccugcgagagaccgcgugcuuggggaaguccuacgcccagauguggcagcugauguacuuccaccggcgggaccugcgcuuagcggccaacgcgauaugcagcgccgugcccgucgacuggauccccaccucccggaccaccuggagcauccacgcccaccaccaguggaugaccaccgaggacaugcugucaguguggaauagaguguggaucgaggaaaaccccuggauggaggacaagacgcacaucagcaguuggggcgacgucccuuaucuggggaagcgcgaggaccaguggugcggcucauugaucggccugaccgcucgggccacaugggcgaccaacauacagguagccauuaaccaggugcgccggcugaucgggaacgagaacuaccuagauuacaugaccuccaugaagcgcuucaaaaacgagucugaccccgagggugcccugugguga

SEQ ID NO: 24468 - RNA, 9879 nt, Artificial Sequence
  derived and/or modified CDS sequence (opt11) from DENV-1__GU131756__SS-prME
aguguaaccaugcuucugaugcuaaugccgacugcgcuagccuuucauuuaaccacccgcggcggggaaccccacaugaucgugucaaaacaggaaagaggaaaaucacuacuuuucaaaacuucggcuggagugaacaugugcacgcuuaucgcgauggaucuaggcgaguucugcgaagacacaaugacguacaaauguccucgcauuacagaagcugaaccggacgacguagacugcuggugcaacgccacagacacaugggucacauacgguacaugcucgcaaacaggcgaacaccggcgggauaaacguucagucgcucuugcaccgcacguaggacuaggucuggaaacuaggacggaaaccuggaugucaagugaaggcgccuggaaacaaauucaacgagucgaaacgugggcacuucggcacccagguuucacagucaucgcccuuuucuuagcacacgcaauuggaacaucaaucacgcagaagggaauaauauucauccuccuuauguuggucacaccaaguauggcuaugcgaugcgucggaaucgggucacgcgacuucgucgaagguuuaucaggggcuacuugggucgacguugugcucgaacacggcuccugcguaacaaccauggccaaagacaaaccuacgcuagacauagaacuccugaaaacugaagucacgaacccagccguccuccgcaaauugugcaucgaagcuaaaaucagcaacaccacgaccgacagccgauguccgacacagggggaagcgacacuuguagaagaacaagaugccaacuuuguauguagaagaaccuucguagaccgcggcuggggaaacggaugcggacuauucggaaaaggaagccuaaucacgugcgcuaaauucaaaugcguuaccaaauuggaaggcaagaucguccaauacgaaaaucuaaaauacucugucaucguaaccgugcacacaggggaucaacaccaagugggaaacgaaucaacagagcacggaacaacggccacaaucacaccccaagcaccgaguaccgaaauccaacuuaccgacuauggugccuuaacccuagacugcucgccucguacaggccuggacuucaaugaaaugguccuuuuaaccaugaaggagaaaaguuggcuagugcacaaacaaugguuccucgacuuaccccuuccauggacuuccggcgcgucaaccagccaggaaaccuggaaccgacaagaccugcuggucacauucaaaaccgcucaugcaaagaaacaggagguugugguucugggcagccaggaaggggcgaugcacaccgcacugaccggggcaacggagauacagaccaguggaacaaccacaaucuucgcaggacaucuuaaauguagacucaagauggacaagcucacgcuaaagggaaugagcuacguaaugugcacaggcagcuucaaacucgagaaagaagucgcggagacgcagcaugggacgguauuggugcaaauaaaauacgagggcacagacgcaccgugcaaaauaccauucucgacacaggacgaaaagggcguuacacagaacgggcggcucaucaccgccaacccgauagugaccgauaaggagaagccggugaacaucgaggcggaaccacccuucggagaaagcuacauaguaaucggugcaggagagaaggcacucaagcuauccugguucaagaaagggagcagcauaggcaaaauguuugaagcgacagcccgaggagcuagacgaauggccauccucggagacacggccugggacuucgguucaauaggaggagucuucacuuccguuggaaagcugguacaccagauuuuuggcaccgcguacggaguucucuuuuccggaguaagcuggacaaugaaaauagguaucgggguauuacuaaccuggcuuggacuaaacucacggucaaccucccuaucuaugacgugcauagcagugggacucgugacacuauaccuaggcguaauggugcaagcggacuccggcugcguaaucaacuggaaaggccgcgaauuaaagugcggaagcggcauuuucguaaccaacgaagugcacacguggacagagcaguacaaauuccaagcggacuccccaaaacggcucagcgccgcaauuggaaaagccugggaagaaggagugugcgggauccggucggcgacuagacucgaaaacaucauguggaaacaaauaagcaacgaacucaaccauauacuccucgaaaacgacaugaaacuaacgguagucgugggggacgucgcgggaauacucgcccagggcaagaaaaugauacguccccaaccaauggaauacaaauacucauggaaguccuggggcaaggcuaaaaucauaggugcugacguucagaacaccacguucauaaucgacgggccuaacacaccagaaugcccagaugaccaacgugccuggaacauaugggaagucgaggacuacggcuucggaaucuucacuaccaacauuuggcuaaaauugagggacagcuauacccaaguuugugaccacaggcuaaugucagcggcgaucaaagacagcaaggcggugcaugccgacaugggauacuggauagagucggagaaaaaugagacauggaaauuagccagggcaucauucaucgaagucaaaacuuguauauggccaaaaucccacacacucuggagcaaugguguucucgaauccgagaugaucaucccaaaaaucuacggagggccgauuucgcaacacaacuaccggccaggauauuucacgcaaaccgcaggacccuggcaccuggguaagcuggagcucgauuuugaucucugugaagggaccaccgugguagucgacgagcacugcggaaacaggggaccaucgcuaagaacgaccacaguaacuggaaaaauuauucacgaauggugcugucgaagcugcacacucccgccgcuccgauucaaaggggaagacggaugcugguacggcauggaaauaagaccgguaaaggagaaggaagagaaucucgugaaguccaugguaagugccgguuccggcgaagucgauagcuuuucccuuggacuacuuugcaucucuaucaugauugaggagguuaugcgaucacgauggucgcgaaagaugcugaugaccggcacacucgccgccuuuuuccuacuaauaaugggccaauuaaccuggaacgaccuaauaagguuauguauaauggugggggcgaacgcaucagaccgaauggggaugggcaccaccuaccuugcacucauggccacauuuaaaaugagacccauguucgccgugggacugcuguucagacgccuaaccucacgcgagguccuacugcugacaauagggcucagccuaguugccuccguggaacucccaaacucauuggaagaacuaggagauggguuagccauggguauuaugauacugaaacugcugaccgacuuccaaagucaccagcucugggcaacccugcucucacuaacuuucauccgaacaaccuucucccuacacuacgcauggaaaacuauggcgauggucuuauccaucgugaguuuguucccucuaugccucaguacgacaagccagaagaccacguggcugccgguacuccugggcagccuaggcugcaagccgcugacaauguucuuaaucgccgagaacaaaauauggggaagaaagagcuggccacuaaacgaagggauaauggcgguaggcaucgucagcauacuucucuccucgcuacugaagaacgacguuccacuagcggggccccugauagcgggagggauguuaaucgcauguuacgugauuucagggagcucggcugaccuaaguuuagaaaaagcagcuguagugaguugggaagaagaggcagaacacagcggcgcaucccacaacauauuggucgagguacaagacgacggaaccaugaagaucaaggacgaagaacgugacgacacauuaacuauccuguuaaaagcgacguuacuggccgugagcggcguauacccccuaaguauccccgcuacgcuuuucguaugguacuucuggcagaagaagaaacagcgcagcgggguacugugggacaccccuucgccaccugaaguggaacgcgccguacuggacgacggaauauacaggauaaugcaaaggggguugcuggggcguucccagguuggcguugggguauuucaggagaacguauuccacacaauguggcacgugacacguggugccguacucauguaccaagguaagagauuagaaccgucgugggcguccgucaagaaagaccucaucagcuacggaggcggauggcgucugcaagggagcuggaacaccggcgaggagguucaaguaauagcuguggaaccggggaagaauccaaagaacguccagaccgccccugguaccuuuaagaccagcgaaggcgagguaggcgcgaucgcccuggacuucaaacccgggacuuccggcucgccaaucgugaauagagaaggaaaaaucgugggauuguacggcaauggggucguuacgacaaguggaacuuaugugagugccaucgcccaagcaaaggccagccaagagggcccccucccggaaauagaagacgaagucuuuagaaaacguaaucuaacgaucauggauuuacaccccggcuccggaaagacccgacgauauuugccagcaaucguaagggaagcgauaaaaagaaaguuacgcacccugauccuggccccaacaagaguagucgcaagcgaaauggcggaagcacuaaaggguaugccaauccgauaccaaacgaccgcagugaaaagcgaacauacggggaaggaaaucgucgaccucaugugucacgcaacauucaccaugcgacugcuaucgccgguccgcgucccaaacuacaacaugauuauuauggacgaggcccacuucacugauccuagcucaauugccgcccggggauacaucagcacacgcguuggcaugggugaagcugccgcgauuuucaugacggcuacgccgcccgguuccgucgaagcauuuccucaaagcaaugccguaauacaagaugaagaaagagacauaccagagcgcagcuggaacucgggauacgaauggaucaccgauuucccgggcaaaacagucugguucgugccaucaaucaagagugggaacgauauagcuaacugucugaggaaaaauggcaaaagagucauccagcuaucgcguaagaccuuugacaccgaauaccagaaaacaaagaauaacgacugggacuacguaguaacgaccgacaucagcgagaugggagcgaauuucagggcggacagggucauugacccgcgacgcugcuugaagcccguaauacuuaaagacggaccagaaagagugaucuuagcgggcccgaugcccguaacaguggcuuccgcagcccaaaggagaggccgaaucggucguaaccacaauaaagagggagaucaguacaucuacaugggccagccgcugaacaaugaugaggaccacgcucacuggacugaggcaaagaugcuacucgauaacauuaauacgcccgaaggaauuaucccagccuuauucgagcccgagcgggaaaagagugcagccaucgacggggaauaucgccugcguggcgaagcacgcaagacguuugucgaacuuaugagaagaggggaccuaccaguauggcucaguuacaaggucgcuagcgaaggcuuccaauacucagaccggcguugguguuucgacggugagcgaaacaaccagguccuggaggaaaacauggacguugagaucuggacaaaagagggcgaaagaaagaaacucaggccccgcuggcuugacgcgcggaccuacagcgauccgcucgccuuaagggaguucaaagaguucgccgcgggacggcgaucaguguccggagacuuaauauuggagaucggaaaacugccacaacaccugacacaacgcgcgcaaaacgcauuagacaacuuaguuaugcugcacaacagcgaacagggagggagagcguaucgacacgcaauggaagaacugccggacacgauugagacccuuaugcugcucgccuuaauagccguacugaccggagguguaacccucuucuuucucagcgggcggggucucgguaaaaccucgauagggcuacugugcguaauggcuagcuccgugcuacuguggauggccucagucgaaccccacuggaucgcggcgagcaucauacuagaguucuucuuaauggugcuucugauccccgaaccggaccgacaacgaacgccucaggacaaccaauuggcguacgucgucauuggacugcucuuuaugauauuaacgguggcggcaaacgagaugggacucuuggagacaacgaagaaagaucucggcauaggacauguugcugucgagaaccaucaucacgcggcaaugcucgauguggaccuacacccagccucagccuggacacucuacgcgguagccacaaccauaauaacacccaugaugagacauacaaucgaaaacacgacugccaacauaucacugaccgcgauugcgaaccaggcugccauauugaugggauuagacaaaggcuggccuauuaguaaaauggacauuggcgucccgcuccuagcgcucgguuguuacucacaaguuaacccacucacguugacugcagccguacugaugcuggucgcccacuacgcaaucaucggacccggguuacaggcaaaagcuacacgggaggcacaaaagagaacagcagcaggaaucaugaaaaacccaacugucgaugggauaguggccauagaccucgacccaguugucuacgacgcaaaauucgaaaaacaacucgggcaaauuaugcuccuaauauuguguacaagccagauucuccucaugcgaacaacuugggcccucugcgagucaaucacacuggcaacaggcccucucacuacacuuugggaaggaaguccaggcaaauucuggaacacgaccauagccgucucuauggcuaacauuuucagagggaguuaccucgccggcgcaggccuugcauucagccugaugaaguccuuggguggcgggaggcguggaacuggcgcccaaggagaaacgcugggcgaaaaauggaaaagacagcuaaaccaacugagcaaaagcgaguucaacacauauaagcgaucuggcauaauggaagucgaucgcucagaggcaaaagaagggcucaagagaggagagacuacgaaacacgccgucaguagagguacagcaaaacuccgcugguucguagaacggaaucuaguaaagcccgaaggcaagguaauagaccugggaugcggacgaggcggauggagcuacuacugugcaggacucaagaaaguaacagagguuaagggauacacaaaaggaggacccgggcacgaagaacccaucccaauggccaccuauggcuggaaccugguuaaguugcacucaggcaaggacguuuucuucaucccaccagaaaaaugugacacucucuugugcgacauuggagaaucuagcccgaacccuaccaucgaagagggucgcacucugcggguccugaaaauggucgaaccguggcuccgagguaaucaauuuuguaucaaaauccuaaauccauacaugcccagugucguugagacucuagagcaaaugcaaaggaaacauggagggaugcucguccggaaccccuugucgcgaaacuccacacaugaaauguacugggugucaugcggaacagggaauauagugagugcggucaacaugacgucgcggauguuauugaaccguuucacaauggcacaccgcaaacccacguacgaacgagacguggacuuaggggcagggacaaggcauguagcggucgaaccggaaguagcgaaccucgacauaaucgggcagcgcauagaaaacauaaaacacgagcacaaaagcacauggcauuacgacgaagacaaccccuacaagacaugggcguaccauggaucauacgaaguaaaaccaaguggaucggcuuccagcauggucaacggcguugucaaauugcuaacaaagccaugggacguuauaccaaugguaacgcaaaucgcaaugaccgacacaacacccuucgggcagcagcguguguuuaaagagaagguagacaccagaacaccaaaagcuaaacgaggcacugcccaaauaauggaaguuacagcaaaaugguuguggggguuccuuucaagaaauaagaaaccgcgcauauguacgcgagaagaguucacaagaaaggucagauccaacgcugcuaucggcgccguguucgucgacgagaaccaauggaacucagccaaagaagccgucgaagacgagagauucugggaccucgugcaccgcgagcgagaacuccacaagcagggcaagugcgcaacuugcgucuauaacaugaugggaaaacgggagaagaaacugggcgaguucgggaaggccaaaggaagucgcgcgaucugguacauguggcuaggagcccgcuuccuggaauuugaggcccucggcuucaugaacgaagaucacugguucucaagagagaacagccuuagcggaguggagggggaagggcuccauaaacucggcuacauucugagagacauaagcaaaaucccaggagguaauauguacgcggacgacacagcggggugggauacccgcauaaccgaagacgaccugcagaacgaagcaaaaauaacggauauaauggaaccggaacacgcgcuacuagcgaaaucaauuuuuaaauuaacguaucaaaacaagguagucaggguacaacgcccagcaaagaaugguacugucauggacguuaucucacgcagagaccagcgaggcuccgggcagguagggaccuacgggcugaauacauuuacgaauauggaagcgcagcucaucagacaaauggaaucagaagguauauucucgccauccgaauuggaaacgccuaaccuggcuggcagagugcucgacuggcuggagaaacacggcguggagcguuuaaagcgcauggcgaucucaggggaugacugcgugguuaaaccaauugacgaucgcuucgcgacagcacuaacagcauuaaacgauaugggaaagguccgaaaagauauuccgcaaugggaaccaagcaagggauggaaugacuggcaacaaguccccuuuugcagccaccauuuccaccagcucauaaugaaagacgggcgcgaaaucgucgugcccugcaggaaccaagacgagcucguaggacgagcacgaguaucccaaggcgcgggauggucacugcgcgagacagcuugccugggcaagucauacgcccaaauguggcagcuaauguacuuccaucgaagagaccuccgacuggccgccaacgccaucuguagcgcagucccuguagacugggugccaacaagcagaaccacaugguccauacacgcucaccaccaguggaugaccacugaagacaugcucucuguauggaauaggguguggaucgaagagaacccauggauggaagacaagacccacauaucaagcuggggagacguucccuaucuaggcaaaagggaagaucaguggugcggaagucuaaucggucugaccgcgcgagcaacuugggccacaaacauacagguugcaauaaaccaagugcgacgccugcucgguaacgagaacuaccucgacuacaugaccucaaugaagcgauuuaagaacgaaucagacccggaaggggcauugugguag

SEQ ID NO: 24469 - RNA, 9879 nt, Artificial Sequence
  derived and/or modified CDS sequence (opt11) from DENV-1__GU131758__SS-prME
agcgugacaauguugcucaugcugaugcccaccgcacuggccuuccaccucaccacccgaggcggggagccccacaugaucgugucaaagcaggagcggggcaaaucgcugcucuuuaagacaagcgcgggagugaauauguguacgcuuaucgccauggaccugggcgaguucugcgaggacacgaugaccuacaagugcccgcgcaucaccgaagcugagccugacgacgucgacugcuggugcaaugccaccgauacgugggucacuuacggcacaugcagccaaaccggcgagcaccggcgugacaagagaagcguggcccuagcaccccacgugggccuagggcuggagacccgcacugagacguggaugagcuccgagggcgccuggaagcagauccagagaguugagacuugggcccugcgccauccagguuucacagugaucgcccucuuucuggcgcacgccaucgguaccagcauuacccaaaaggggaucaucuuuauccugcucauguuggugaccccguccauggcaaugaggugcgucggcaucggcucucgagacuucguagaggggcugagcggcgccacguggguggaugucgugcuggaacacgggucaugugugaccacaauggccaaggacaagcccacccuggacauugagcuccucaagacagagguuaccaaccccgcggugcuucggaaacugugcauagaggcuaagauuagcaacaccacaacggauagccgcugcccaacccaaggcgaggcaacccucguggaagagcaggacgccaauuucgucugccggcgcaccuucguggaucgggguuggggcaacggaugcgggcuguucggaaaggggucccugaucacgugugccaaguuuaagugcgugaccaagcucgagggcaagaccguccaguacgagaaucucaaguacagcgugaucguaaccgugcacacgggcgaccaacaccaaguaggcaacgaauccaccgagcacggcacuaccgcgaccaucacuccccaggcucccaguaccgaaauacagcugaccgauuacggcgcccuaacucuugacugcagccccagaacaggccuggacuucaacgaaaugguccuuuugaccaugaaggaaaagucguggcuggugcauaagcagugguuccucgaccuacccuugcccuggaccagcggggcuaguacgagucaggagacuuggaauagaaaggacuuacuggugacauucaagacagcccaugcuaagaaacaggaggucgucguacucggcucccaagagggcgccaugcacaccgcacucacgggggccacugagauccagacgagcggcaccacgaccauauucgccggccaccuaaagugccgccuaaaaauggacaagcugacgcugaagggcaugucauacgucaugugcacagggagcuucaagcuggaaaaggagguugcggagacgcaacacggcacuguauuagugcagaucaaguacgagggcacugacgugcccugcaaaauccccuuuuccacacaggacgaaaaaggggucacacagaacggccgguugaucacggccaacccgauugucaccgacaaggagaagcccgugaacauugaggccgagccgcccuucggcgaguccuacaucguuauaggcgcgggcgagaaggcguugaagcucucaugguucaagaagggaucuuccaucggcaagauguucgaggcaacagcgcguggggcccggagaauggccauucucggugacacagcgugggacuucgggucaaucggaggcgucuuuacgucgguagggaagcuggugcaccagaucuuugggacugccuaugggguguuguucucgggcguuuccuggacuaugaagaucgguaucggcgugcuccugaccuggcugggucucaacagccgguccacuucacugucgaugaccuguaucgccgucgggcugguuacccuguaccugggcgugaugguccaggccgauagcgggugcgucaucaacuggaagggacgggagcugaagugcgggagcggcauauuugugacuaaugagguccacaccuggaccgagcaguacaaauuccaagcggacucaccgaagagacucagcgcggccaucggaaaagccugggaagagggaguuugcggcauccguucggccacccgacuggagaacauaauguggaagcaaauaagcaaugagcugaaucacauuuugcuagagaacgauaugaaguucaccguggucgucggcgacgucgccggcauucuagcucaggggaaaaagaugauccggccccagccaauggaguauaaguacucuuggaaguccuggggcaaggccaagauaaucggugccgacguucagaacacgaccuucauaaucgacggcccgaacacaccggagugccccgacgaucaaagagccuggaacaucugggagguagaggauuacggcuucgggaucuuuaccacgaacaucuggcucaagcugagagacagcuauacucaagugugcgaucaccgccugaugagugcggcgauuaaggacucaaaagccguccaugccgacaugggcuacuggaucgaaagcgaaaaaaacgaaaccuggaaacucgcccgggcauccuucaucgaggucaagacaugcauuuggccgaagagccacacacugugguccaauggaguucuagaaagcgagaugaucaucccgaagaucuaugggggcccgaucucccagcacaacuaucgccccgguuauuucacucagacggccggccccuggcaucucggcaagcuggagcuggacuucgaccuaugcgaaggcacaacggucgucguggacgagcacugcggcaaucgggggcccucgcugcgcacgacgacagucacggggaagaucauccacgaguggugcugucgauccugcacccuuccgccucugcguuucaagggagaagacggcuguugguacgguauggaaaucaggcccgucaaggagaaggaggagaaucuggucaagaguauggucagcgcgggcuccggcgaaguugacucuuuuucccuggggcucuuaugcauuagcaucaugauagaggaggugaugcguagccgguggagucgcaaaaugcugaugaccggcacgcuggcgguuuucuuucugcuuauaauggggcaacucacguggaaugaccucauucgucuaugcauuauggugggcgccaacgcgagugaccguauggguaugggcaccacuuauuuggcccugauggcuaccuuuaagaugcgcccgauguucgccgugggcuuacuguuccggcgccuaacgagccgggaggucuugcuccugacgaucggucugucgcugguggcgagcguugaacugccgaacucccuggaggagcucggcgauggacucgcgaugggcaucaugauucugaagcuccucacugauuuccagagucaucaguuaugggccacccucuugaguuucacguucaucaaaaccaccuucagccuucacuacgccuggaagaccauggccauggugcugagcauugugucgcuuuucccacucugccuuuccaccaccagccagaagaccaccugguugcccguccugcucgguucccucggguguaagccgcuaacgauguuccugaucgcggagaacaaaguguggggccggaagucguggccucucaaugaggggauuauggcggugggaaucguuucgaucuuguugucuucguuauuaaagaaugacguuccccucgccgggccucuaaucgcaggcggcauguuaaucgcuugcuaugugaucucugguagcuccgcagaccucucgcuggagaaagcggccgaggucaguugggaggaggaggccgagcacucuggcgccucccacaacauccugguggagguacaggacgacgggaccaugaagauaaaggacgaggagcgggaugacacccuuacuauucugcuaaaggcgacccuccucgccgucucuggcguuuacccgcuguccaucccagcuacccucuucguaugguacuuuuggcagaagaagaagcagaggagcgggguucugugggacacccccucaccucccgaggucgagcgggccguucuagacgauggcaucuaccgcaucaugcagcggggacugcuggggcgcagucaagucggcguggggguguuccaagagaacgucuuccacacgauguggcacgugacgcggggggcagugcugauguaccaggggaagaggcuggagcccaguugggcgucugucaagaaggaccuaaucuccuaugguggcggguggcggcugcagggcuccuggaacacgggggaggagguccaagugauugccgucgaaccuggaaagaaccccaagaacguacaaaccgcccccgggacguuuaagaccuccgagggcgaggugggcgcaaucgcccucgacuucaaacccgggacgagcgguagccccaucgucaaccgcgaagggaaaauaguagggcucuacggcaacgguguggucaccaccuccgguacguaugucagcgcgaucgcgcaggccaaagcgucccaggaggggccccugccggaaaucgaggacgagguuuuuaggaaacgaaaccugacgauuauggaccuccaucccggcagcgggaagacccggcgcuaccucccagcgaucgugcgggaggccauaaagcguaagcugcguacgcucauccuggcgccgacuaggguaguggccucagagauggccgaggcgcuuaagggcaugcccauacgcuaucagacaaccgccgugaagucggagcacacggguaaggagaucguggaccucaugugucacgccaccuucacgaugcggcugcugaguccagugcgcguucccaauuacaacaugaucaucauggacgaggcgcacuucaccgacccaucgagcauagccgcucggggguacaucucgacccgggugggcaugggugaggccgcagcaauuuucaugacagccacgccgccuggcuccguagaggcguucccccagucaaacgccguuauucaggacgaggagagggauauuccagaacgcucauggaacuccggguacgaauggaucacugauuuccccgguaagaccguaugguucgugcccuccaucaaaagcggcaacgauaucgcaaacugccuccggaaaaauggaaaacgcguaauucagcugucccgcaagacauucgacacggaguaccaaaagacuaagaacaaugacugggacuacgucgugaccaccgauaucucagagaugggcgcuaacuuucgcgccgaccgggucaucgacccacgccggugccuaaagccugugauccuaaaagaugggcccgagcgcgugauccuagcagguccuaugcccgugacgguggccuccgccgcgcagcggcgagggagaaucggacgcaaccacaacaaggagggcgaccaguacauuuacaugggacaaccgcugaacaacgacgaggaucacgcgcacuggacggaagccaagaugcuccuggacaacauuaauaccccggaaggcaucauuccagcuuuauucgagccggagcgggaaaaguccgccgcuaucgacggugaauaccggcuccggggcgaggcccguaagaccuucgucgaacugaugcgccgcggagaccugccggucugguuaucauacaagguggccuccgagggauuccaguacagcgaccgaagguggugcuuugacggcgagcgcaauaaucaagugcuggaggagaauauggauguggaaaucuggacgaaggagggggaacggaagaagcugcgcccgcgcuggcuugacgcacgcaccuacuccgacccccuggcucugagagaguucaaggaauucgccgcgggccgcagaagcguguccggcgacuugauccuggagauagguaaacugccccagcaccucacccagagagcccaaaacgcccuggacaaucuggucaugcuccacaacagcgagcaggguggccgggcuuaccgccacgcgauggaagagcuaccggacacaaucgagacacuuaugcuccuggcccugauugccgugcugaccggaggggugacccucuucuuccuguccggucggggccucggcaagaccagcauaggacugcugugugucauggccagcucaguguugcuguggauggccucugucgagccucacuggauagccgccuccaucauccuagaauucuuccuuaugguacuguuaauacccgagccggaccgccagcggaccccgcaggacaaccaguuagccuacguggugaucggccugcucuucaugauucucaccgucgccgcaaaugagaugggccugcuggagacuacgaaaaaggaucugggaaucggccacgcggccguggagaaccaucaccaugccgcuauguuagauguugacuuacacccggcuucagcguggacccucuaugccgucgccacuaccaucaucaccccuaugaugcgccacacuaucgaaaacacuaccgccaacaucucucugaccgcgaucgcgaaccaagcggccauccugauggggcuugacaagggauggcccaucagcaagauggacaucggcguaccccugcuggcccucgguugcuacagccaggugaacccccuuaccuugacggcggcuguccucaugcuggucgcccacuaugccauuaucgggccaggacugcaggccaaagcgacuagagaggcccagaagcgcacagccgccgggauaaugaagaacccgaccguggaugggaucgucgcuaucgaucucgaucccgugguauacgacgcgaaguucgaaaagcagcuaggccagaucaugcugcucauccucugcacgagccagauacugcuaaugcgcacaaccugggcccugugcgagagcaucacacuggccacaggaccgcuaacaaccuuaugggaggguucccccggcaaauucuggaacaccacgaucgccguaagcauggcuaacauauuccguggguccuaccuggccggagccgguuuggccuucucauuaaugaaaucccucgggggcgggcgccgggggacgggugcucagggagagaccuugggcgagaaguggaagcgccagcugaaccaauuauccaagagcgaauuuaauaccuacaagcgguccggaauaauggagguggaucggucggaggcgaaagaagggcucaagcgcggcgagacaaccaagcacgcggugucucggggcacagccaagcugcgaugguucguagagcgcaaccugguaaagcccgaggggaaagucauugaccucggcugcggucgcggcggguggagcuacuauugcgcagggcugaagaaagucacggaggugaaaggguacaccaaaggcgggcccggccacgaagagcccaucccaauggccacguacggguggaaccuggugaaauuacauucaggcaaggacgucuuuuucaucccgcccgaaaagugcgauacccuccugugcgacauaggggagagcucccccaacccaacuauugaggagggccgcacucugcgggugcucaagaugguggagccauggcugcgggggaaccaguucuguauaaagauccugaaccccuacaugccuagcguaguagagaccuuggagcagaugcagcggaaacacgguggcaugcucguacggaacccccuaucccggaauagcacacaugagauguacugggucuccugcggcacaggcaacauugugagcgcugugaauaugaccucuaggaugcuccuaaacagguucacgauggcccaccguaagccaaccuacgagcgcgacgucgaccugggggcgggcacacggcaugucgccguggaacccgaggucgccaaccuggacauuaucggccagcggaucgagaacaucaagcaugagcacaagagcaccuggcacuaugacgaggacaacccuuacaaaaccugggccuaucacgguuccuacgagguaaagcccucuggcagcgccuccagcaugguaaacgggguggucaaacugcugacaaagccgugggacguuauccccaugguaacccagauagccaugacagauacaacucccuuuggucagcagcggguuuucaaggagaaggucgacacccgcacccccaaggcuaaacgcggaacggcccagauuauggaggugaccgcgaaauggcuuuggggcuuccugucccgcaacaagaagccgcgaaucuguacccgcgaagaguucacccggaaggugcgaagcaaugcagccauaggcgccgucuucguggacgagaaucaguggaacuccgcgaaagaagcuguggaggacgagcgguucugggaccuggugcaccgcgagcgugagcugcacaagcaagggaaaugugccacgugcguuuauaacaugauggguaaacgugaaaaaaagcugggggaguucgguaaggcaaaggguagccgagccaucugguacaugugguugggggcuagguucuuggaguucgaagcccugggcuucaugaacgaggaccacugguucucucgggaaaauagccucuccggcguagagggcgaggggcuccacaagcuggguuacauccugcgcgacaucagcaagauacccggcggcaacauguaugccgacgacacugcgggcugggacaccaggaucaccgaggacgaccuccagaacgaagccaagauuacggauaucauggagcccgagcaugcacuccuggcgaagucaauauuuaagcucacauaucagaacaaagucguccguguucagcggccggccaagaacggcaccgucauggacgugaucagccgccgcgaccaacggggcucuggccaggucgggaccuauggucuaaacaccuuuacaaauauggaagcucaacugauucggcaaauggagagcgaggggaucuucucccccucggagcuggagaccccaaaccuggccggccggguacucgacuggcuggaaaagcacgggguggagcggcuaaaacggauggcgauaaguggcgacgacuguguggucaagcccaucgacgaccgcuucgcaaccgcccugacggcccucaacgacauggggaaggugcguaaggacaucccgcaaugggagcccagcaagggauggaacgacuggcagcagguccccuucugcucucaucacuuccaccaguuaaucaugaaagauggccgggaaaucgucguucccugccguaaccaggaugagcuaguggggcgggcccgcgugucccagggcgcgggcuggagcuugagagagacagcuugccuggggaagagcuacgcccaaauguggcagcugauguacuuccaucggcgcgaccuacgccuggcugcgaaugcuaucugcagcgccgucccgguggacuggguaccgaccucucgcaccacguggucgauacaugcacaccaccaguggaugaccacugaggacaugcucucaguauggaaucgcguguggauugaggagaaccccuggauggaggauaaaacccacaucuccuccuggggcgauguccccuaccucggaaagcgcgaggaucaaugguguggcagcuugaucggacuaaccgcccgagcgaccugggcuacgaacauacaaguggccaucaaccagguacgaaggcucauagggaacgagaauuaucuggacuacaugaccagcaugaaacgguucaagaacgagagcgacccggagggggccuuaugguga

SEQ ID NO: 24470 - RNA, 9879 nt, Artificial Sequence
  derived and/or modified CDS sequence (opt11) from DENV-1__GU131759__SS-prME
agcgugacgaugcugcugauguuaaugccuacggccuuagccuuccaccucacgacucgggguggggagccgcacaugaucgugagcaagcaggagagggguaagucgcuacucuucaagacaagcgcugggguaaacauguguacccucaucgccauggaccugggcgaguucugcgaggacaccaugacguacaaguguccccgcaucaccgaggccgagcccgacgacgucgauugcuggugcaaugccacagacacuugggugaccuacgggaccuguucgcagacaggcgagcaccggcgggacaaacgcucgguagcccuggcgccccacgugggucucggacucgagacgcguaccgaaaccuggaugagcucggagggcgcguggaaacagauccagcgaguagaaaccugggcucuccggcacccagguuucacggugaucgcucucuuccuggcacacgcuaucggcaccucuaucacccagaaggguaucaucuucauucugcuuaugcuggugacccccuccauggcaaugcgguguguaggcaucgggagcagggauuuuguggagggguuguccggggccacguggguggacgucguacuagagcacggaucaugcgugaccaccauggccaaggacaagccaacccuggacaucgagcuucucaagacggaagucacaaaccccgcgguauuacggaagcugugcaucgaggccaagaucuccaacaccaccacggacagccgcugcccgacgcaaggugaggccacccucguggaggaacaggacgccaacuucguuugccggaggaccuucguggaccggggcuggggaaacggcugcggucuguucggcaaggguucacuaaucacgugcgcuaaguuuaagugcgugacuaagcucgagggcaaaacaguccaguacgaaaaucugaaguacagcgugauagugaccguccacacaggcgaccaacaccaggucgggaacgaguccacugagcacggcacgaccgccaccauaacgccccaggcccccagcaccgagauccagcugaccgacuacggggcacucacccuggacugcucaccccggaccggccuggacuucaacgagaugguccugcugacaaugaaggagaaguccuggcuggugcauaagcagugguuccucgaccugccgcuucccuggaccagcggggccucgaccucacaagaaacguggaaccguaaagaccucuuggugaccuucaagaccgcacacgcgaagaaacaggaggucgugguguuagggucccaggaaggcgccaugcacaccgcccucacgggggccacagagauacagacgucgggcacaacgaccaucuucgcaggacaucugaagugccgccugaagauggacaaacucaccuuaaagggcauguccuacguuaugugcacgggcagcuucaagcuagagaaagagguggcggagacacagcauggaacggugcucguccagaucaaguacgagggaacugaugcgcccugcaagauccccuuuucuacacaggacgagaagggcgugacgcagaacggccggcuuauuacggccaacccuaucguuaccgacaaggagaagcccgucaacaucgaagccgagccaccuuucggggagagcuacaucgucauaggcgccggugaaaaggcgcugaaguuaagcugguuuaagaaggggagcuccaucggcaagauguucgaagccaccgccagaggggcucgucguauggccauccucggugauacugccugggacuucgggagcaucggcggcguguucaccuccguugggaaacucguucaccagaucuucggaaccgcauacgggguguuguucuccggagucuccuggaccaugaagauuggcauuggaguucucuugacguggcugggguugaacagccgcuccaccagccucuccaugacuugcaucgcgguagggcuggucacccucuaccugggggugauggugcaggccgacagcgggugugucauuaacuggaagggccgggagcugaagugcgguagcggcauauucgugacgaacgaggugcacaccuggacggagcaguacaaguuucaggcggacagcccgaagcgccucagcgccgccauaggcaaggccugggaggagggcgucugcggcauucgguccgccacccgccucgagaacaucauguggaagcagaucagcaacgaacugaaccacauuuuacuggagaacgacaugaaguucaccgugguggucggggauguagcgggcauacuggcccaggggaagaagaugauccgaccccagcccauggaauacaaguacuccuggaaguccuggggcaaggccaagaucaucggcgccgacgugcagaacaccaccuucaucaucgaugggcccaacacuccggagugucccgacgaccagcgcgcguggaacaucugggaggucgaggacuacggcuucggcaucuuuaccacgaacaucuggcucaaguugcgggacuccuacacccaggugugcgaccaccgccucaugagcgccgccauuaaagacuccaaggcgguucacgcggacaugggauacuggaucgagucugagaagaaugaaaccuggaagcucgcucgggccuccuucaucgaggucaagaccugcaucuggcccaaaucgcauacccuguggagcaacggcgugcuggagagcgaaaugaucauccccaagaucuacggggguccgaucucccaacauaauuaccgccccggguacuucacccagacagccggucccuggcaccucggcaagcuagagcuggacuucgacuuaugcgagggcacuacagugguaguggacgaacacugcggcaaucgggggcccucccugcgcaccaccacggugacgggcaagaucauucacgaguggugcugucgguccugcacccugccgccccuucgcuuuaagggggaggaugguugcugguacgggauggaaauacggccagucaaggagaaggaggaaaaucugguuaagagcauggugagcgcgggcucgggcgaaguugauagcuucucccuggggcuacugugcaucagcauaaugaucgaggaggucaugcgcucccgguggagcaggaagaugcugaugaccggcacccucgccguguucuuccugcugaucauggggcagcuuacguggaacgaccugauccggcugugcaucaugguuggugcgaacgccuccgaucgcaugggcaugggcacuaccuaccucgcccuaauggccaccuucaagaugcgcccgauguucgccgugggccuccuguuccgucgccugacgagccgggagguacugcuccugaccaucgggcugagcuuggucgcaagcguagagcugcccaacagccuggaggagcugggcgauggacuggccaugggcaucaugauccugaagcuguuaacagacuuccagagccaucagcugugggccacccuccuguccuucacguucaucaagaccaccuucagccugcacuacgcguggaagaccauggcaaugguccucuccaucgugucacuuuucccguugugcuuauccacaaccucucagaagaccaccuggcuuccugugcugcucggcagccuggggugcaagccacugacaauguuccucaucgccgaaaacaagguguggggcagaaagagcuggccccugaacgaggggaucauggccgugggcaucgucucuauccugcucucaagccugcugaagaacgaugucccccucgccgggccccuaauugcuggaggcaugcugaucgcgugcuacgugaucucugggagcuccgccgaucucucucuggagaaggcugccgaggugucaugggaagaggaggccgagcacagcggggcgucccacaacauccugguagagguacaggacgaugggaccaugaagauuaaggaugaagaaagagacgauacucucaccaucuugcugaaggccacccucuuagccgugucuggcgucuauccucuuuccaucccggccacccucuucgugugguacuuuuggcagaagaagaagcagcgcagugguguccugugggauacccccagcccgccggaggucgagcgcgccguguuagacgacgguauuuaccgcaucaugcagcgggggcugcuggggcgcagccaggugggcgucgguguauuucaggagaaugucuuccauaccauguggcacgucacacguggcgcggucuuaauguaccaggggaagcgcuuggaacccuccugggcgagcgugaagaaggaccucaucucauacggcggaggauggcggcugcaggggagcuggaacaccggcgaagaaguucaagugauagccguggaaccuggcaagaaccccaagaacguccagaccgcccccgggacguucaaaacuuccgagggcgaggugggcgcuaucgcacuggacuuuaaacccggcacgagcggaucgcccaucgugaaccgcgaggggaagaucgugggucucuacggcaacggaguggugaccaccucugguacuuacguuagcgcgaucgcccaggccaaggcgucccaggaggggccccugccggaaaucgaggacgaaguuuuccggaagagaaaccugacgaucauggaucuccacccagggagcggaaaaacccggcgguaccugccagccaucguucgggaggcaaucaagcguaagcugcggacuuuaaucuuggcccccaccagggugguggccuccgagauggcggaagcccuuaagggaaugcccauccgcuaccagacgacugccgugaaguccgagcacaccggcaaggagauagucgaucuaaugugucacgccaccuucacgaugcggcugcuuucccccgugcguguaccuaauuacaacaugaucauuauggacgaggcacauuucaccgauccgagcuccaucgcggcucggggguacaucucuacccgcguaggaaugggagaggcggccgccaucuucaugaccgcgaccccgcccgggucaguggaagccuuuccgcagagcaacgccgugauccaagaugaggagcgggacauccccgagcgcuccuggaauagcggguacgaguggaucaccgacuuccccggcaagaccgucugguuugugccguccaucaaaagcggcaacgacaucgccaacugccuccggaagaacggcaagcgcgugauccagcugucccggaagacguucgacacggaguaccagaagacgaagaacaacgacugggacuacgucgugacgacggauauaucggagaugggcgcuaauuucagagccgaccgggugaucgacccccgacggugccugaagccggucaucuuaaaggacgggcccgagcgagucauccuagccggccccaugcccgucacaguggccuccgcagcgcaacgucgcgggcggaucgggcgcaaccauaacaaggagggggaucaguacaucuacaugggucagccacuaaauaacgaugaggaccacgcccauuggaccgaggccaagaugcugcuggacaacaucaacacccccgagggcaucauccccgcccuguucgagcccgagcgggagaagucggccgccaucgacggggaguaccgccuccgcggcgaggcucggaagaccuucguggagcucaugcggcgcggugaccugccggucuggcucagccacaagguggcuuccgagggcuuccaguacucugaccgccgcuggugcuucgauggcgagcgcaauaaccaggugcuggaggagaacauggacguugagaucuggacgaaggagggggagcggaaaaagcugcgcccccgguggcucgacgcccgcaccuacucggacccucuggcccugcgagaguucaaagaguucgcagccggccgccguucuguguccggggaccucauacuggagauaggcaagcugccccagcacuuaacccaacgcgcgcaaaacgcccuggacaacuuggugaugcuucacaacagcgaacagggcgggcgcgccuaucgccacgcaauggaggaacugccggacaccaucgaaacgcugaugcuucuggcgcugauugccguccucaccggcggggugacgcuguucuuucuguccgggcgggggcucgguaagaccagcaucggcuuacugugcgugauggccucaagcguccucuuauggauggcuuccguggagccucacuggaucgcagccagcaucauccuggaguucuuccugauggugcugcugauccccgagcccgaccgccagcggaccccgcaggacaaucaacucgccuaugucgucaucgggcugcuguucaugauccucacgguggccgcaaacgagaugggccuguuggagaccaccaaaaaggaucucgggauaggccacgccgccgucgagaaccaccaccaugccgcaauguuagacguggaccugcaccccgcguccgccuggacccucuacgccguggccacgaccaucaucaccccgaugaugcgccacaccaucgagaacacuaccgccaacaucagccugacagcgaucgccaaucaagccgccauccucauggggcucgauaagggcuggccgaucuccaagauggacaucggcgucccccuguuagcucuuggauguuacagccaggugaacccccugacacugacggccgccguucucaugcucgucgcccacuaugccaucaucggccccgggcuacaagcgaaggccacccgggaagcccagaagcgcaccgccgcgggcaucaugaagaacccgacggucgacgguauugucgcgaucgacuuggaccccgugguguacgacgcgaaauucgagaagcagcugggccaaauuaugcugcucauccugugcacgucccagauccuguuaaugcgcaccaccugggcccugugcgagagcaucacauuagccacaggcccccucacgacucuuugggaggguucccccggaaaguucuggaacaccaccaucgcuguuagcauggcuaacaucuuucggggcucauacuuagccggagccggccucgccuuuucccuuaugaaaucccucggaggcgggcgacgggggaccggcgcgcagggcgagacccucggggagaaguggaagcgccagcuaaaccagcugagcaagucggaguucaacaccuacaaacggucagggaucauggaggucgaccgcagcgaggccaaggagggucucaagcgcggugagacgaccaagcacgcugugucccgcggcaccgccaaacugcguugguucguagagcgaaaccugguuaagccggaaggaaaggugaucgaccucggcuguggccgcgggggaugguccuacuacugcgccggacugaagaaggugaccgaagucaaagguuacaccaagggcgggcccggccacgaggagcccauucccauggcgacuuacggguggaaccuggugaaguuacauagcggcaaggacguuuucuucaucccgcccgagaagugugacaccuugcugugcgauaucggggaguccucccccaacccuacgaucgaggagggacgcacacugcggguacucaagaugguggagcccuggcuucgcgggaaccaguucugcauaaagauccuaaaccccuacaugcccucuguugucgagacccucgagcagaugcagcggaagcacgguggcaugcuugugaggaacccccucucuagaaauucuacccacgaaauguauuggguuuccugcgggacuggcaacaucguuagcgcagugaacaugaccucccgcaugcuccuaaaccgguucacaauggcccaccgcaagccgaccuacgagagagacguggacuugggggccggcaccaggcacgucgccguggagccggagguggcgaaccucgacauaaucggccagcgcaucgagaacaucaagcacgagcacaagaguacguggcauuacgacgaagacaaccccuacaagacaugggccuaccacgggaguuacgaggugaagccuucaggcagcgccuccagcauggugaacggcgucgugaaacuguuaaccaagcccugggacgugaucccaauggugacccagaucgccaugaccgacacgacccccuucggccaacagcggguguucaaggaaaagguagacacccgcacccccaaagccaagcgggggacggcgcagaucauggaggucaccgcgaaguggcucuggggcuuccuuucccgcaacaagaaaccgcggaucugcacccgcgaggaguuuacccggaaggugagauccaacgccgcgauaggcgccguguucguagacgaaaaccaguggaacucggccaaagaggccgucgaagacgagcgguucugggaccuggugcaccgugagcgugagcuccacaagcagggcaagugcgccacgugugucuauaacaugaugggcaagcgcgagaagaagcugggggaguucggcaaggccaaggggagccgggcgauaugguacaugugguugggcgcccgcuuccuggaguuugaggcccugggguucaugaaugaggaccacugguuuucucgggagaacagcuuguccgguguggagggcgagggauugcacaaguuaggcuacauccugagggauaucagcaaaaucccaggagggaacauguacgcggacgacaccgccggcugggacacccggauaaccgaggacgaucugcagaacgaggcgaagaucacggauauuauggagccggagcacgcacuucuggccaaguccaucuuuaagcucaccuaccagaacaaggugguccgcguccaacggccggcaaagaacgggaccguuauggacguuaucagcaggcgcgaccagcggggcagcggacaggugggcaccuacggccugaacacguucacgaacauggaggcccagcugauccgccagauggaaucagaggggaucuucuccccuuccgagcucgagaccccgaaccuggcgggucgggugcuggacuggcucgagaagcacggcgucgagcgccuaaagcggauggcgaucuccggcgacgacugcguggucaagcccaucgaugaucgcuucgccaccgcccugacggcgcugaacgacauggggaaaguccgcaaggacaucccgcagugggagcccagcaagggauggaacgacuggcagcaaguucccuucugcagccaccacuuccaccaacugauaaugaaggacggucgggagaucguggugccgugccggaaccaggaugaacugguggggcgcgcgcgagugucacagggcgccggguggucguugcgcgagaccgccugccuugggaaguccuacgcucagauguggcagcugauguauuuccaccgucgcgaccuccgucuggcggccaacgcgaucugcagcgcggucccgguggacugggugccaaccucccgcacgacguggagcauccacgcccaccaucaauggaugaccaccgaggacaugcuguccgucuggaaccgaguuuggaucgaagagaaucccuggauggaggacaagacccacaucagcucauggggcgacgugccguaccucggaaaacgcgaagaccaguggugcggcagccugaucgggcugacggcgcgggccacaugggcuaccaacauccaggucgccauaaaccaggugcgccgccuaauuggcaacgagaacuaccuugacuauaugacauccaugaagcgguuuaagaacgagucggacccggagggggcccugugguga

SEQ ID NO: 24471 - RNA, 9879 nt, Artificial Sequence
  derived and/or modified CDS sequence (opt11) from DENV-1__GU131761__SS-prME
agcgugacgaugcuucuaaugcuaaugccgaccgcgcuagcguuccaccuaacaacuagaggaggggaaccccacaugaucguaagcaaacaagaacgggggaaaagucuccuguucaaaacguccgcagggguaaacaugugcacucucauagcaauggaccuaggggaacugugcgaagacaccaugacguacaaauguccgaggauaaccgaaacagaacccgacgacgucgacugcugguguaaugccacagacaccuggguaacauacggaacaugcucacaaaccggggaacaucgaagagauaaaaggagcguagcccuugcaccacacgucggacugggccucgaaacacgaacugaaacauggaugucgagcgaaggcgcuuggaaacaaauccagcgaguagaaaccugggcguuacggcacccagguuucacugucauagcccucuuccuagcccaugcgauuggcacguccauuacccagaaaggcaucaucuucauccuacuaaugcuagucacaccauccauggccaugcgaugcgucggcaucggaucacgcgacuucgucgaaggccuguccggagcaacauggguugauguaguacucgagcacgguagcugugucacgacgauggcuaaagacaaaccaacauuagacauagagcuacugaaaaccgagguuacgaaccccgcggugcuacggaagcucuguaucgaagcgaagauauccaacacaacgacggacaguaggugcccaacacaaggagaagccacccuaguggaagaacaagacgccaacuuuguaugccgucggacauuuguggaucguggauggggaaacgggugcggacuauucgguaagggcagccugauaacaugugcaaaauucaaaugcguaacaaagcucgagggcaagauugugcaauacgaaaaccugaaguacucagucauaguaaccguccacaccggcgaucaacaccaggugggcaaugaguccacagagcacggaacaacagcgaccaucacaccccaagcgccgacaacagaaauacaacucacggacuacggagcucugacccuagacuguaguccacguaccggacucgacuucaaugagaugguacuacucacaaugaaggagaagaguuggcucguacacaaacaaugguuuuuggaucucccacugccguggacaaguggggccaguaccucccaagaaaccuggaaccgacaagaccuacucgucacuuuuaagacggcacacgcaaagaaacaagaagucguggugcucgguucccaagaaggcgcgaugcacaccgcccuuaccggagcuacagaaauucagacgucaggcacaacuacgaucuucgccggacaccucaagugccgccuaaaaauggacaaacugacacugaagggcaugucauaugucaugugcacgggauccuucaaacucgaaaaagaacuggccgagacccagcacgggacaguccuagugcaaauaaaauaugagggaacagacgcgccuugcaaaauucccuuuagcacacaagaugaaaaaggcguaacacaaaauggucgacugaucacugcaaaccccauagucacggacaaggagaaaccagucaauauagaagccgagccacccuucggcgaaagcuauauagugauaggugcaggcgaaaaagcucucaagcucucaugguucaagaaaggcaguagcaucggcaaaauguuugaagcaacagcgcguggcgcgcgacggauggcaauccucggggauaccgccugggacuucgggagcauagggggagucuucaccuccguuggcaaguuaguucaccaaauauucgggacggcguacggcguacuauucucgggcguguccuggaccaugaaaauagguauagggguauugcuaaccuggcuagggcuuaauucucggagcacaagccuaaguaugacuugcauagcaguagggcuugugacgcuauacuugggugugaugguacaagcagacagcggaugcguaauaaacuggaaagggagagaauugaaaugugguucaggcauauuugugacaaacgaaguacacaccuggaccgaacaauacaaguuucaagcggauucgcccaaaagacucagcgcagcuauuggaaaagcaugggaagaaggcguaugcggaauaagaagugcgacccgacuagaaaauaucauguggaaacagauaagcaacgaguuaaaccacauccuacuggaaaacgacaugaaauucacuguuguagugggcgacguagccggaauccuggcacaagggaagaaaaugauccgcccucaaccgauggaauacaaauacucguggaaaaguugggggaaagccaaaauaauaggcgcagacguacaaaacaccacauucaucaucgacgguccuaauaccccagagugcccggacgaccagagagcauggaacauuugggaaguagaagauuacggauucggaaucuucacaacgaacauauggcucaaacuaagagacagcuacacacaggucugcgaucaucgacugaugagcgccgcaaucaaagauuccaaagccguacacgcagauaugggguauuggaucgaaagcgaaaagaacgaaaccuggaaacucgcgcgggcgagcuucauugaagugaagacgugcaucuggcccaaaagccacacccuuuggucuaacggcguacucgaauccgagaugauaaucccgaagauauacggaggcccaaucucacaacacaauuauagaccuggauacuucacacaaacggcagggccauggcaccuagguaaacuagaacuagacuucgaccucugcgaaggcaccacuguagucguggacgagcauugcgggaaucgugguccuucacuacggaccacaacagugaccggaaaaauaauccaugaaugguguugccgaucaugcacucugcccccacuuagauuucgcggagaggacggaugcugguacggcauggaaauacguccggucaaagagaaagaggaaaauuuaguaaagaguaugguaucggcgggauccggcgaaguggacagcuucucacugggacugcucugcaucucgauaaugauagaggagguaaugcggagccgcuggagcagaaagaugcucaugacgggcacgcuggcagucuuuuuccuauuaauaauggggcaguugacguggaacgaccugauuagacugugcauuauggucggggcgaacgcaagcgaccgaauggggaugggaacgacguaccuggcgcugauggcaacauucaagaugcggccuauguuugcgguuggacuucucuuucgcaggcuaacuagccgcgaagucuugcuucucaccauaggccuaagucuaguggcaagcguagaacuaccaaauucucuggaagaacucggagacggacucgcaaugggaauaaugauuuuaaaacuacugacugauuuccagucacaccaauuaugggcuaccuuacucucacucaccuucauaaaaaccacguucagccuucacuaugcuuggaagacuauggcuaugauacuuagcauagucucacucuucccacucugccugagcacgacgagccagaaaacaacguggcucccugugcuccuggguagccucgguugcaaaccccucacgauguuucucaucgcagagaauaaaauaugggggcgaagauccuggccacuaaacgaaggcauaauggcaguaggcaucguuaguaucuugcugaguucccuccucaaaaaugacgugccccuagccggccccuugaucgcgggugggauguuaauagcguguuacguaauaucaggcagcucagcagaccucucacucgagaaagcggcagaagucucgugggaggaagaggccgaacacagcggugccagccacaacauccuaguagaggugcaagacgacgggacgaugaagauacaagacgaagaaagagacgacacacuaaccauccuacuaaaagccacacuccuggccguuagcggaguauacccauugaguaucccagcgacccucuucgucugguacuuuuggcagaagaagaaacaacgaagcgggguacuuugggacacucccagcccgccagaagucgaaagggcuguacuagacgacgggaucuaccgcauaaugcaacguggacugcucggcaggagccaagucgggguaggagucuuucaagaaaacgucuuccacacaauguggcaugugacgcgaggagcgguccucauguaucagggcaaacgacuggagcccucaugggcguccgugaaaaaggaccucaucucauacggcggagguuggcgacuacaaggaaguuggaacaccggggaggaaguucaaguaauugcaguagagccagggaaaaaucccaagaacgugcagaccgccccgggaacuuuuaagaccccggaaggcgaagugggcgcuauagcacuugacuucaaaccagguacgucggggucccccaucguuaauagggaaggaaagauaguuggacucuaugggaacgggguaguuacaaccucgggaacguaugugagcgcaauagcacaggcaaaagcaagccaggaaggaccgcugccggaaaucgaagacgagguauucaggaagcgaaaccugacgaucauggaccuacacccaggaagcggaaaaacccgacguuaucugcccgcuaucgugagagaggccaucaaacggaagcuccggacacuaauccuggcgccgacacggguuguagcguccgaaauggcagaggcccuuaagggcaugccgauacgcuaccaaaccaccgcaguaaaaucggaacacacggguaaagaaaucguagaucuuaugugccacgccacauucaccaugagacuguugagcccaguccguguaccaaacuacaauaugauaauuauggaugaagcccacuucaccgauccgucaagcauagcagcgaggggcuacaucucgacgcggguugguaugggagaagcugcggccaucuucaugacagcaacacccccgggcagcgucgaagcauucccacaaaguaaugcuguaauccaagacgaagagagggacauuccggagagaagcuggaacucagguuacgaauggauuacagauuuccccgguaagaccgugugguucguucccaguauaaagucggggaacgacaucgcaaacugccucagaaagaauggaaaaagagugauacagcuuagccgaaaaacauuugacacggaauaccagaaaacaaagaacaacgauugggauuacgucgugaccacggacaucagcgaaaugggcgccaacuucagagcggaccgggucaucgacccgcgacgaugccuaaaacccgucauucuuaaagacgggccugagagaguaauauuggcgggacccaugccuguaacaguugcuagcgcagcacagcgacgcggucgcaucggucggaaccauaacaaagaaggagaccaauacauauacaugggacagccccuaaacaacgaugaagaccacgcacacuggacggaagcaaaaauguuguuagacaacaucaauacgccagaaggcauaauaccugcgcuuuucgaaccagagcgcgagaaguccgccgcaauagauggagaauacaggcuccggggagaagcgcggaaaaccuuuguugaauugaugagacggggagaccugccugugugguuaaguuacaagguagcuuccgaaggauuccaguacagcgauaggcgguggugcuuugacggcgagagaaacaaccagguccucgaggaaaacauggauguggaaauauggacaaaagaaggggaacggaaaaagcucagaccucgguggcucgacgcgcgcacguacagcgacccacucgcccugcgcgaguuuaaagaauuugcggccgggaggaggagcguauccggcgaccugaucuuagaaaucggcaaauuaccacaacacuuaacgcaacgagcucagaacgcucuggacaaccucguaaugcuccacaauagcgaacagggagggagagcauaucgacacgcaauggaagaauugcccgacacgauugaaacacuaaugcuucuagcgcucauagcaguacugacugggggcguaacacuuuucuuucugucgggccgaggcuuaggaaagaccaguaucggacuacuaugcgugauggcaaguucggugcuccuauggauggcauccguagaaccacacuggaucgccgcgucaauaauccuggaguucuucuugaugguguuauugauccccgaaccagaccgacagcggaccccacaagacaaucaacuggcauacgucgugauuggccuccuguucaugauacuaacaguugcagcgaacgagauggggcuauuagagacaaccaagaaagaccucgggaucggucacgucgcaguagaaaaccaccaucacgcagcaaugcuggaugucgaccuacacccggcaucagccuggacacuauacgcuguagcaacaaccauaauuacccccaugaugcgacacaccauagagaauacaacggcgaacauaucccuaacagcgaucgcaaaccaagcagcgauauuaauggggcucgacaagggcuggccgauaagcaaaauggacaucggcguaccucugcuagcauugggguguuacagucagguaaacccacuaacacuaacggcagcgguacucaugcucguagcccacuaugccauuauugggccaggccuucaagcaaaggcgacacgggaagcccagaaacgaacagcggccggcauaaugaagaacccaacaguagacggaauaguagcaaucgaccucgacccagugguguacgacgcaaaauucgaaaaacagcuugggcaaaucaugcuccugauacugugcacaagccaaauacuacugaugcgaaccaccugggcacuaugcgagagcaucacccuugcaacaggcccgcucacgacacuuugggagggaagcccagggaaauucuggaacacgacgaucgcagugaguauggcgaauaucuucagagggucauaucuagcaggcgcgggccuagccuucagucucaugaaaagccucggcggcggcagacggggaacaggggcacagggggaaacucugggcgagaaauggaaaagacaauuaaaccagcucuccaaaucggaauuuaacaccuauaagcgcagcggcauaauggaaguagacaggagcgaagcaaaagaggggcugaaacgaggugagacuacuaaacaugcaguauccaggggcacagcgaagcuacgcugguucgucgagaggaauuuagugaaaccggaggguaaagucauugaccuuggaugcggccgcggaggauggucuuacuacugugcgggccucaagaaaguaacagaggucaaagguuauacaaaaggcgggccuggccacgaagaacccauuccgauggcuacguauggauggaaccuggugaaacuacacaguggaaaggacgucuucuuuauaccacccgagaaaugcgauacccuguugugcgacaucggggaaucgagccccaaccccacaauugaggagggccgaacacuccggguccucaagaugguagaaccguggcugcgcgggaaccaauuuuguauaaaaauccugaaucccuacaugccgucugucguggaaacacuagaacagaugcaaaggaagcacgggggaaugcucguccgaaauccacugucuagaaacucgacgcacgagauguacugggucagcugcgguacaggaaacaucgugucagcagugaacaugacgagccgaaugcuccuaaaucgcuucaccauggcccaucgcaagccaacguacgagagagacgucgacuuaggcgcuggaacgaggcacgucgcuguagaacccgaaguagccaaccuagacaucauaggacagagaauugagaacaucaagcacgaacacaaaagcacauggcauuacgaugaagacaaccccuacaaaacgugggccuaccacggcagcuacgagguaaaaccuucgggaucggccucgucuauggugaacggggucguaaaacuccuaacaaaaccaugggacgugauccccaugguaacacagauugcaaugaccgacacgacgccauucggacagcagagaguguucaaagaaaaaguggacacucgaacccccaaagcaaaacggggaacggcccaaauaauggaagugacagcuaaguggcucuggggauuccuaucucguaauaagaaaccgcgaauauguacacgggaagaguucacuaggaaaguccggagcaaugccgccauaggagcggucuucguagacgagaaccaauggaacucggccaaagaagccguugaagaugaacgauucugggaccuaguccaucgagaacgcgagcuacauaaacagggaaagugugcaacaugcgucuacaacaugauggguaagcgcgaaaagaaacugggugaguucggcaaagcaaaaggcagcagagccauaugguacauguggcuaggcgcucgauucuuggaguucgaagcacugggcuucaugaacgaggaccauugguucucaagggagaacagccucuccggcguggaaggcgagggcuugcacaaguugggguacauucuccgagacauaaguaagauaccaggggguaacauguacgcagacgauacagcgggcugggauacacgaauaacagaagacgaucugcaaaacgaagcacgaauaacagacaucauggaacccgaacacgcgcucuuggcaaaguccaucuucaaacucacguaccaaaauaaagucguuagagugcaacgcccggcgaaaaacgguacagucauggaugucauaagccgacgugaccaaagaggcucagggcaggucgggacguauggucucaacaccuucacgaauauggaagcgcaacuaauacgccaaauggagucugaaggcaucuucuccccuagcgaacuagaaacgccuaaccucgcagaaaggguauuagacugguuggagaaauacggcgucgaacgauugaagcgaauggcaaucucaggggacgacugcguugugaaaccaaucgacgacagauuugccacugcccuaacagcgcuaaacgacaugggcaaggugcguaaagauauuccgcaaugggaacccuccaaaggguggaacgauuggcaacagguuccauuuugcagccaccacuuccaccaauuaauaaugaaggaugguagggagauaguugugccgugcagaaaccaagacgaacuugucgggcgagcgcgcgucagccagggggcaggguggagccuaagggagacagcuugccucggaaagaguuacgcccagauguggcaauugauguacuuucaccgaagagaccucagacuggcagcaaacgccauuuguagcgcgguaccgguagacuggauaccgacaucucgcacaacguggucuauacacgcucaccaccaguggaugaccacagaagacaugcuaucaguauggaaccgcgucuggauagaagaaaacccauggauggaggauaaaacccacaucagcagcuggggagacgucccauaccucggaaagcgcgaagaccagugguguggaucacuaauaggacucaccgcccgagcaacgugggcaaccaacauccaagucgccauuaaucaaguacggcgauugaucgggaaugagaacuaccuggacuauaugacaucaaugaagcgauucaaaaacgagucagauccagagggggcacugugguag

SEQ ID NO: 24472 - RNA, 9879 nt, Artificial Sequence
  derived and/or modified CDS sequence (opt11) from DENV-1__GU131762__SS-prME
ucagugaccaugcuguuaaugcucaugccuacugcccuggccuuccaucucacuaccagaggcggggagccucauaugaucguaucgaagcaagagcggggcaagucucugcuauucaagacaucagccggaguuaacauguguacgcugauugcaauggaccugggcgaguucugugaggacacgaugaccuacaaaugcccgcgcaucaccgaggccgagcccgaugauguggacugcuggugcaacgccacugacaccugggugacguaugggacaugcagccagaccggagagcaccggcgggacaagcggagcguggcccuagcgccgcacgugggacucggacuagaaacgcgcacggagacguggaugucuagcgagggcgccuggaagcagauucaacgaguggaaacaugggcccugcgccacccgggguucaccgugaucgcccucuuccuggcucacgcuaucggcacaucuauaacccagaagggaaucaucuuuauccugcucaugcuugugacucccuccauggccaugcgcuguguggguaucggcucacgagacuucguggagggucuuuccggcgccacguggguggacguugugcuagagcacgggagcugugugaccaccauggccaaggacaaacccaccuuggacaucgaacugcucaagaccgaaguuacaaaccccgcggugcugagaaagcugugcaucgaggccaaaaucucaaacaccaccacggacagccgcuguccgacccagggcgaagcuacccucguggaggagcaggacgccaacuucgugugccggagaaccuucguggacaggggcugggggaacggcugugggcuguucggcaaaggcucccugaucacgugcgcgaaguucaagugcguaaccaagcucgagggcaagauaguccaauacgaaaaccugaaauacucagugaucguaaccguacacaccggugaucagcaucaggugggcaaugagaguaccgagcacggcacgacagcgacuauaacgccgcaagcgcccaguacggagauccagcuuacagacuacggagcacucacccuggacuguagccccaggaccgggcuggacuucaaugaaauggugcuguuaacgaugaaggagaagucuuggcugguccacaagcaaugguucuuggaucugcccuugcccuggaccuccggggcguccacaagccaggaaaccuggaaucggcaggaccuccuggugacauucaaaacugcccacgcaaaaaagcaagagguagugguguuaggcagucaggagggcgcgaugcacacggccuuaaccggggccacugagauucagacguccgggacaaccacgaucuucgccgggcaccuuaagugccggcugaagauggauaagcuaacucugaagggcauguccuacgugaugugcaccgggagcuucaagcuggaaaaggaaguggccgagacccaacacggcacuguccucguucagauuaaguaugagggcaccgaugcccccugcaagauccccuuuuccacucaggacgaaaaaggggugacacagaauggccggcuaaucacggcgaauccgauaguuaccgacaaggagaagcccgucaauaucgaggccgaaccgccauucggugagagcuacaucgugaucggcgcaggcgagaaagcccugaagcucaguugguucaagaaggggagcaguaucggcaagauguucgaggccaccgcgcgcggggcccggcgcauggccauccucggcgacaccgccugggauuucggaagcaucggaggaguguucacauccgucgggaagcugguccaccaaaucuucgggacagccuaugguguguuauucucggguguuuccuggacaaugaagauugguauuggcgugcucuuaacuuggcuaggccucaacagucgguccaugucccugaguaugaccugcauagccguagggcugguuaccuuauaccugggggugauggugcaggcagacagcgggugcgucaucaacuggaagggccgagagcugaagugcgguagcgggaucuuuguuacuaacgaagugcacacguggacggaacaguacaaguuccaggcggauucccccaaacgccucuccgccgcaaucggaaaagccugggaggaaggggucugcggaauccggucagcgaccagacuggagaacauuauguggaagcagauuagcaacgagcugaaccacauucuccuggaaaaugacaugaaguucacuguuguggucggggacguggcggguauccuggcucaggguaagaagaugaucagaccucagcccauggaguacaaauacucuuggaaguccuggggcaaggccaaaauuaucggugcggacguucaaaacacuacuuucauuauagaugggcccaacacgccggagugccccgacgaucagcgcgcauggaacaucugggagguagaggacuauggcuucggcaucuuuacaaccaacaucuggcucaagcugcgcgacucuuacacccagguaugcgaucaucgccugaugagcgccgcaaucaaggacuccaaggccgugcacgcagacaugggcuacuggaucgagagcgagaagaacgagacguggaaguuagcgagggccucauucaucgaggucaagaccugcaucuggcccaagucgcacacacuguggucaaacggcguccuggagagcgagaugauuauaccaaagauuuacggaggucccaucucgcaacauaacuaccgcccuggguacuuuacccagacggcgggccccuggcaccucgggaaguuggagcuggacuuugaccucugcgaggguacgaccgucgucguggacgagcauugcgggaaccgaggaccgagucugcgcaccaccaccgugaccggcaagaucauccacgaguggugcuguagguccugcacucucccgccccugcgguucaagggggaggacgguugcugguauggcauggaaauccggcccgucaaggagaaggaggagaaccucgucaaguccauggugagugccggcuccggggaggucgauagcuuuucccuggggcuccugugcaucagcaucaugaucgaagaggugaugaggucccgguggagcagaaagaugcugaugacaggcacccucgcuguauuuuuccuguugauuauggggcagcucaccuggaacgaccugauccggcuuugcaucauggucggcgccaaugccucugaccgcauggggauggguaccacuuaccuugcccucauggccaccuucaaaaugcgcccgauguucgccgugggccuccuguuccggcgccugacgagucgggaggugcugcuccugaccauagggcuaagcuugguugcgucaguagaacuuccuaacucccuggaggagcucggcgacgggcuugcuaugggaaucaugauccugaagcuccugacugacuuccagucacaccaguuaugggccacccuucugagccuuacguucaucaaaaccacguucucucugcacuaugcauggaagaccauggcaaugguccuauccaucgugagccuguuccccuuaugucuguccaccaccagccagaagacgaccuggcugcccguucuacuaggcucgcuggggugcaagccguuaaccauguuucugauugccgaaaauaagaucuggggacgcaagucuuggccccucaacgaggguauuauggccgucggcaucgugagcauacuccuguccagccugcugaagaacgacguucccuuagcuggcccccugaucgcaggcggcaugcucaucgcgugcuacgucaucucuggaucauccgcugaucugagccuggaaaaagccgccgagguuucgugggaggaagaagccgagcacagcggcgcgucucauaacauccucguggagguccaagacgacgggaccaugaagaucaaggacgaagagcgagacgauacccucacuauauuacucaaagcgaccuugcuggcuguuagcggcguauauccgcuuuccauucccgccacgcuguuccugugguacuucuggcagaaaaaaaagcagcgcucgggaguccucugggacacccccaguccucccgagguugagcgggccguacuggacgacggcaucuacagaaucaugcaaagaggcuuacuggggagaagccaagucggaguugggguguuccaagaaaauguuuuccauacaauguggcacgugacccguggggcggugcuaauguaccaggggaagagauuagagccguccugggccagcgugaagaaggaucucauauccuacggcggcggguggagacuccagggcagcuggaauacgggggaagaaguccaggugaucgcugucgagcccgguaagaacccgaaaaacgugcaaaccgcccccgggacauuuaaaaccucggagggcgagguaggcgcaauagcucuggauuucaaacccgggaccagcggcucgcccaucgucaaccgcgaggguaagaucgugggccuauacggcaaugggguugucacgaccucaggaaccuacguauccgccaucgcacaggccaaggcgucccaggaggggccccucccggagauagaagacgagguauuccggaagcgcaacuugacaaucauggaccugcauccgggcucggguaagacccgucgguaccuacccgccauaguacgggaggccauuaaacgcaaacugcggacgcugauccucgccccgacccgcgucguugcgagcgaaauggcugaggcccugaagggcaugcccauccgcuaucaaacuaccgccgucaagucagagcacacggggaaggagaucguggaccugaugugccacgccacguuuaccaugagacugcugaguccgguucggguccccaauuacaacaugaucaucauggacgaggcccacuuuaccgaucccaguuccauagcggcacgggguuauaucuccacgcgaguaggaaugggggaagcagcggccaucuucaugacagcaacuccaccuggcuccguggaagcuuucccccagagcaaugcaguuauccaggacgaggagcgggacauaccggagcgcuccuggaacagcgguuacgaauggauuaccgacuuccccggcaaaacggugugguucgugcccuccaucaagucggguaacgacaucgcuaacugucuaagaaagaacgguaagcgagucauccagcuaucccggaaaaccuucgauaccgaguaccagaaaaccaagaauaacgacugggauuaugugguuacgaccgacaucagcgagaugggcgcuaacuucagagccgaccgggucauagauccucgccggugccugaagccugugauccuaaaagacggccccgagcgugucauccucgcuggccccaugcccguaaccguugccuccgcagcccagcggcgcggccggauaggaaggaaccacaauaaggaaggcgaccaguacauuuacaugggucagccacugaacaacgacgaggaccaugcgcacuggaccgaggccaagaugcuauuggacaacaucaacacucccgaggggaucaucccagccuuguucgaacccgaacgagaaaaguccgccgcaaucgacggggaguaccgucucaggggcgaggcccgaaagacauucguagagcuuaugcgccgcggugacuuaccgguguggcugucuuacaagguggcaucggagggcuuucaguacagcgaccgcagauggugcuucgacggcgagcgcaauaaucagguucucgaggagaacauggacguggagaucuggaccaaggaaggcgaacggaaaaaauugcgcccucgguggcuggacgcgcgcguuuacuccgacccccucgcccuacgggaguucaaggaguucgcggccggccggcgguccgucucgggagaucugauccuagagaucggaaaacugccccagcacuuaacucaacgcgcucagaaugcccucgacaacuuggugaugcugcacaacucugagcagggcgggcgugcguaucggcacgcuauggaggaauuaccggacacuauugagacgcugaugcugcucgcccuaaucgccgugcugaccggagggguuaccuuguucuuccuguccggccggggguugggcaagacgucuauaggacuccugugcgugauggccuccagcguguuguuguggauggcuagugucgagccccacuggaucgccgcgucgauaauccuggaguucuuccugauggugcuccugauccccgaacccgaucggcagcggacaccgcaggacaaccaacuggccuacgucgucaucggccuccuguucaugauccugaccguugcagcgaaugagauggggcuccuggagaccaccaaaaaggaccuggggaucggccacguggccgucgagaaccaucaucacgccgccaugcucgacguggaucugcaccccgccuccgcuuggacguuguacgccgucgcgacgaccaucaucaccccuaugaugcgccauacgaucgaaaacaccacagcaaacaucucacucacggccaucgccaaccaggcggccauucucaugggccuggauaagggcuggccgaucuccaagauggauaucggaguucccuugcuagcauuggguugcuacucucagguuaacccgcucacgcugaccgcggccguguuaauguuaguagcccacuacgcuauuaucggcccaggacugcaggcuaaggcaacccgggaggcccagaagcgcaccgccgccggaaucaugaagaacccgacgguugaugggaucguagccaucgaccuggaccccgucguauacgacgcgaaguucgaaaaacagcuuggccagaucaugcugcugauucucugcacuagucagauacuacugaugagaaccaccugggccuugugugaaagcaucacguuggcaaccgguccucugaccacccuuugggagggauccccuggcaaguucuggaauacgaccauugcggugaguauggccaacaucuuccggggaagcuaccuggcgggugccggacuggccuuuucccucaugaagucacucggcggagggcgucgggggaccggggcucagggggagacccugggugagaaguggaaacgccagcucaaucaguuguccaagagcgaguucaacacguacaaacggucgggaauaauggaggucgaccgcagcgaggcgaaagaaggcuugaagaggggggagaccaccaagcacgccgugagccgcggcacggccaaguuacguugguucguggagcggaaccuggugaaaccggagggaaaagugauugaccuagguugcggccgcggcggcuggagcuacuacugcgccggauuaaagaaggucacagaggucaagggguacacgaagggggggccaggccacgaggagcccauccccauggcuaccuauggguggaaccuagugaagcuucauuccggcaaggacguguucuucaucccgccagagaagugcgauacucugcugugcgacaucggggagagcucgcccaaccccacgaucgaggaaggacgcaccuuacggguccugaagaugguggagccauggcuacgcgguaaccaguucuguaucaagaucuuaaaccccuacaugcccucagugguugagacucuggagcagaugcagcggaagcacggcggcauguuaguccgcaauccccucuccagaaacucgacacaugagauguacuggguuuccugcggcacaggcaauaucgucucggcuguaaacaugaccucacguaugcugcucaacagguucaccauggcacaccgaaagccaaccuacgagcgagacguggacuugggggcggguacccggcacgucgccgucgagcccgaaguagccaaucuggacaucauuggccagcgcaucgagaacauuaagcaugagcacaagagcacguggcacuacgacgaagacaaccccuacaagacuugggcguaccacggcucauacgaggucaagcccucgggguccgccuccagcauggugaauggagucguuaaguugcucaccaagccgugggaugugauccccauggucacccagaucgccaugacggauaccacacccuucggacagcagagaguguucaaagagaagguagacacaagaacgccuaaggccaagcgggguacagcucagaucauggagguuaccgcgaaauggcucuggggguuccuuuccagaaauaaaaagccgcggauauguacacgcgaggaguucacgagaaaaguucgcagcaacgccgcgauaggcgcaguauuuguagacgagaaccaguggaauuccgcuaaggaagccguggaggacgagcgguuuugggaucucguucaccgcgagcgugagcugcacaagcaaggcaaaugcgcgaccugcgucuacaauaugaugggaaagagagagaagaagcuuggggaauuuggcaaggccaagggaagccgggcgauuugguacauguggcugggugcacgcuuccuggaauucgaggcucucggcuucaugaaugaagaucacugguucagucgugaaaacagccuguccggggucgagggcgaggggcuacacaagcuaggcuacauccuccgggacaucuccaagauccccggagguaacauguacgccgacgacacagccggaugggacaccaggauuacggaggacgacuugcagaacgaagccaagaucacugauaucauggagcccgagcacgcgcuccuggcuaaguccauuuuuaaauuaaccuaccagaauaaagugguccgcguacaaagaccggccaaaaacggaaccgugauggacgucaucagccgucgcgaccagcguggcagugggcagguuggcaccuacggacucaacaccuucaccaauauggaggcacagcugaucaggcagauggagagcgagggcaucuucucccccagcgagcuggagaccccaaaccucgcgggccggguccuggacuggcuggagaaacauggugucgagcgccucaaacgaauggccauauccggggaugacugcgugguuaagcccaucgacgaccgcuucgcuacggcgcugaccgcacugaacgauauggggaagguucggaaggacauaccgcagugggaacccucaaagggcuggaaugauuggcagcaggucccuuucugcucccaccacuuccaccagcucaucaugaaggacggccgugagaucgugguccccugccgaaaccaggacgagcugguggguagggcacggguaucccaaggcgccggcuggagccugcgcgagaccgccugucucggcaaaucguacgcucagauguggcaacugauguacuuucaccggagagaccugagacuugccgcgaacgccaucugcuccgcggucccuguggacugggugcccaccuccagaacgaccuggucaauccaugcccaccaccaguggaugacuaccgaggacaugcuguccguuuggaaccggguguggauugaggaaaaccccuggauggaggacaagacgcauauaagcuccuggggcgaugugcccuaccuggguaagagggaggaccaguggugcggcagucuaaucggguugaccgcccgggcgacuugggcuaccaacauccagguagccaucaaccaggugcgucgccugauuggcaacgagaacuacuuagacuacaugaccucuaugaagcgcuucaaaaacgagucagacccggagggugcucugugguga

SEQ ID NO: 24473 - RNA, 9879 nt, Artificial Sequence
  derived and/or modified CDS sequence (opt11) from DENV-1__GU131763__SS-prME
agcgucaccauguuacucaugcugaugcccacggccuuggccuuccaucugacgacccgcggcggggagccccacaugaucgugaccaagcaggagcgggguaaaucccugcuguucaagaccagcgcuggcguaaacaugugcaccuuaaucgccauggacuuaggugagcucugcgaggacaccaugacuuacaagugcccucggaucaccgaggccgagccugacgauguugacuguuggugcaacgccacagacaccugggucaccuacgggaccuguucgcaaaccggcgaacaccggcgcgacaagcggagcguggcccucgcgccccacgugggccuugggcuggagacccgcaccgagaccuggauguccagcgagggagccuggaaacagauucagcgggucgaaacgugggcccuccgccaccccggcuuuacggugaucgcccuguuccuugcgcacgccaucggcaccucuauaacccagaaggggaucaucuucauacugcugaugcuggugacgccaagcauggcaaugagguguguaggcaucggcucccgcgacuucguagaagggcucagcggcgcaaccuggguggaugucguacuugagcacggguccugcgugacgaccauggccaaagacaaaccuacgcuugacaucgagcuacugaagacagagguuaccaaccccgcggugcugcggaaacucugcaucgaggccaagaucagcaacaccacgacagacucacgcugccccacccaaggcgaggccacccugauggaggagcaggaugccaauuucgugugccggcguacguucguggaccggggcuggggcaacggcugcggauuauucgguaagggaucgcucaucacgugcgcgaaguucaagugcgugaccaagcuggagggaaagauugugcaauacgagaaccuuaaguacucagucaucgucacuguacacacaggugaccaacaucaggucgggaacgagagcaccgagcacggcaccacggccacgaucacgccacaggcccccaccuccgaaauacaguugaccgacuacggggcccuaacccucgacugcagcccccgcacgggcuuagauuuuaaugagauggugcugcuuacuaugaaggagaagagcuggcucguccacaagcagugguucuuggaccucccucugcccuggaccagcggggcaagcaccucccaagaaacuuggaaccggcaggaucugcugguuaccuucaaaaccgcacacgcgaagaagcaggagguugucguacucggcagccaagagggcgccaugcacaccgccuuaacaggggccaccgaaauccagaccucaggcaccacgacgauauuugccgggcaccuaaagugccgguugaagauggacaagcugacccuuaagggcaugucauacgugaugugcaccggguccuucaagcucgagaaggaagucgcggagacccagcacgguaccgugcuggugcagaucaaguacgagggaaccgacgcccccugcaagauacccuucagcacccaggaugagaaggggguuacgcaaaauggccgacuaaucacugcgaacccgaucgugaccgauaaggaaaagccggugaacaucgaggccgagccgcccuucggggaauccuacaucguaaucggcgcgggcgagaaggccuuaaagcucagcugguucaagaaggggucgagcauuggcaagauguucgaggccaccgcccgaggagccagacgcauggcgauauuaggcgacacggccugggacuucggauccauugguggcguguucaccucuguggguaagcugguccaccagauuuucggcaccgcuuauggagugcuguucuccggcgugagcuggaccaugaagauagggaucgguguccugcugacguggcucggccugaacucccgcagcacuagucuaucuaugaccugcaucgccguugggcucgugacccuguaccugggcguaauggugcaggcugacuccgggugcgugaucaacuggaagggacgggagcucaagugcgggucuggcaucuucgucacgaaugagguccacaccuggacagaacaguacaaauuucaggcggacagcccgaagcgccugagugccgccaucggcaaggccugggaggagggcguaugcgggauccgauccgccacacgccuggagaacauuauguggaagcagaucuccaacgagcucaaccacauccugcuggaaaaugauaugaaauuuacugucguugugggggacgucgugggcauccucgcgcaagggaagaagaugauacggccccaacccauggagcacaaguacagcuggaaaucauggggcaaggccaagaucaucggcgcggacgugcagaacacuaccuuuaucauagacgggcccaacaccccggagugucccgacgaucagcgggccuggaauaucugggaggucgaggacuacggcuucgggaucuuuaccacgaacaucuggcugaagcugcgggauucuuacacccaggucugugaccaucgccucaugucugcugcgauaaaggacucgaaagcugugcaugccgacaugggcuauuggauugaauccgagaagaacgagaccuggaaacuggcccgcgcgagcuucaucgaagucaaaacgugcauauggcccaagucccacacucuguggagcaacggagugcucgaaucagagaugauuauccccaagaucuacgggggaccgaucagucagcacaauuaucgccccggguauuuuacccagaccgccgggccguggcaccuggggaagcuggagcucgacuucgauuugugcgagggcacuacaguggucguggaugagcacugcggcaaccgggggcccagccugcgcaccacgacagugacggguaagaucauucacgaguggugcugcagaucaugcaccuugccgccacuccgcuucaagggggaagacggcuguugguacggcauggagauuagacccgucaaggagaaggaggagaaccuggugaaguccauggugagcgccggucucggcgaggucgacagcuucagccugggucugcucugcauuagcauaaugauugaagaggugaugagaucaagauggagccguaagaugcugauggccggcacccuagcaguguuuuugcugcugaucaugggccaacucaccuggaacgaccugauccgguuaugcauuauggugggagccaacgcuagcgaucggauggggaugggcacgaccuacuuggcgcugauggcaacguuuaagaugcgucccauguucgccgugggccuccuguuccggcggcugacaagccgggaggugcugcuccugacgaucggguuaucgcucgucgcgagcgucgagcuucccaacuccuuggaggagcucggcgaugggcuggcgaugggcaucaugauuuuaaaacuccugaccgacuuccagagccaccaacugugggccacccucuuaucccugaccuuuaucaaaacgacccucagcuuacacuacgccuggaaaaccauggcgaugguccuguccaucguuagccucuucccucuaugccuguccaccacgucgcagaagaccaccuggcucccggugcuguuggggucacuugggugcaagccgcugaccauguuccugaucgcggagaacaagauauggggccguaagucuuggcccuuaaacgaggggaucauggcagucggcguuguguccaucuugcugagcagccuacugaagaacgaugucccccuggccgggccccucaucgccggcgggaugcugaucgcaugcuacgugauauccggaucguccgcggaccugagccucgagaaggccgcagaggucuccugggaggaagaagcugaacacagcggcgccucccacaacauccuggucgaggugcaggacgaugggacgaugaagaucaaggaugaggagcgagacgacacccugaccauccuccugaaggccacccugcucgccauaagcggcguguauccgcugucuauccccgccacgcuguucgucugguacuucuggcaaaagaagaagcagcgcuccgggguucuaugggacacgcccagcccacccgagguggagcgggcgguccucgacgacggcaucuaccgcaucaugcagcggggccuccuggggcgcagccaggugggcgugggggucuuccaggagaacguguuccacaccauguggcacgugacucggggcgcgguccucauguaucaggggaagcgccuggaaccuuccugggccagcgugaagaaggaccucauuuccuacgggggcggauggcggcuccagggcucguggaacaccggggaagaggugcaggucauagccguugagcccggcaagaaccccaagaacguucaaacggcacccggaaccuuuaagacgcccgagggagaggucggcgccaucgcgcuggauuucaagcccgggacguccgggagccccaucgugaaccgcgaaggcaagaucguggguuuguacggcaacgggguggugacgaccagcgggaccuacguguccgccaucgcccaggcuaaggcgagucaagaggguccacuccccgagauugaggaugaggucuuccggaagcggaaccugacuauaauggaccugcaccccggcuccgggaagacacgccguuacuuaccagccaucguucgggaggccaucaagaggaagcuccggacucugauccucgcccccacccgaguggucgcaagcgagauggcggaggcccugaaaggcaugccuauacgcuaucagacuaccgccgugaaauccgaacacaccggcaaggagauaguggacuugaugugucacgccaccuucacgaugcgacuccugagcccuguacgcgugccgaacuacaacaugaucaucauggacgaggcccacuucacugaccccaguucuauugcggcgcggggguacaucuccacccgcguggggaugggggaggcugccgccaucuucaugaccgcgacgccgcccggcagcgucgaggccuucccgcaguccaacgccguaauccaagaugaggaacgggacaucccagagcgcagcuggaacuccggguacgaguggauuacggacuuucccggcaagaccguuugguucguccccagcaucaaguccggcaacgauaucgcaaacugccugcggaagaacggcaagcgcgugauccagcuaucgcggaagaccuucgacaccgaguaccagaagacgaagaacaacgacugggacuacguggucaccaccgauaucuccgagaugggcgccaacuucagggccgaccgugugauagacccgcgccggugccugaagccugugauucugaaggacggucccgagcgcguaauacucgccggcccaaugccugugaccguagccagcgcggcgcagcggcgcgggcggaucgggcggaaccacaacaaggagggcgaccaguacaucuacauggggcagccccugaacaacgacgaggaccaugcccacuggacggaggcgaagaugcugcucgauaacaucaacacgccggagggcauaauccccgcccucuucgagccggaacgcgaaaaguccgcugcgaucgauggggaguaccgccugcgcggcgaagcccggaaaaccuucgucgagcucaugcgccgcggggaccugcccgucuggcugagcuacaagguagccuccgaggguuuccaguacagugaccgccgguggugcuucgacggggagaggaacaaucaggugcucgaggagaacauggacguggagaucuggacuaaggaaggugagcggaagaaguugcgcccccgguggcuggacgcccggacauacagcgaucccuuggcccuucgggaguucaaggaguucgcggccggccgccguuccguaagcggcgaucugaucuuggagaucggcaagcugccgcagcaccugacccaacgcgcgcagaacgcccuagacaaucuggugaugcuccacaacuccgagcagggcgggcgggcguaccgccacgccauggaagaacuucccgacaccaucgagacccugauguuacuggcccuuaucgccgugcugacggguggggucacccucuucuuccugagcggccgggggcugggcaagacauccaucggccuccugugcgucauggccagcucggugcugcucuggauggcgagcgucgagccccauuggaucgccgccagcaucauucuggaguuuuuccugaugguucuccugaucccagagccggacaggcagcggaccccccaggauaaucagcuagccuacguggucaucgggcuccuauuuaugauauuaaccguugccgcgaacgagaugggccuccuagagacgaccaagaaggaccuggggaucgggcacguggccgucgagaaccaccaccaugcuacgaugcucgacguggaccugcaccccgccagcgccuggacccuguacgcgguggcaacgaccaucaucacgccgaugaugcgccauaccaucgagaacacgacugccaacaucuccuugacagccauugcgaaccaagcggccauacugaugggucuggacaagggauggccaaucagcaaaauggacauaggggugccccuccuggcccucgggugcuacagucagguaaaccccuugacguugacugccgcggugcugaugcucgucgcccacuacgccaucaucgggccggggcuucaggccaaagccacccgggaggcccagaagcgcaccgccgccggaaucaugaagaacccuaccguggacgggaucguagccaucgaccuggaccccgugguguacgacgcuaaguucgagaagcagcucggccagaucaugcugcugauccucuguaccagccagauccugcugaugcgcacaaccugggcgcucugcgaaucuaucacccucgccacugggccccugacgacccucugggaggguagcccaggcaaguuuuggaacaccacgaucgccgugagcauggccaauaucuuccgggggagcuaccuggccggcgcgggccuggccuucucccucaugaaguccuuggggggugggagacgugggaccggggcccagggcgagacccuaggcgagaaguggaagcgccagcucaaccagcuuagcaaguccgaguucaauaucuacaaacggagcgggauuauggagguugaccguuccgaggccaaggagggccugaagcgcggggagacaacgcgccacgccgucucacgcggcacggccaaacugcgcugguucguggaacggaaccuugucaagcccgaagguaaggucaucgaccugggcugcggacgcgggggcugguccuacuacugcgccggacuaaaaaaggugacugaggucaaaggcuacacuaaaggcgggcccggucaugaggagcccauccccauggccacuuacggguggaaccuugugaagcuacacuccggaaaggacguauucuucacgccgccagaacguugugacacccuucucugcgacaucggggaguccagccccaauccgaccauugaggaaggccgcacgcuccggguacugaagaugguagagcccuggcucagaggaaaccaguucugcaucaagauccugaacccguacaugccuuccguugucgagacccuggaacagaugcaacggaagcacggcggcauguuagugcgcaacccgcuuagccggaacuccacccacgagauguacugggugagcugcgggaccggaaacauugucagugccgugaauaugaccagcagaaugcugcuuaaccgcuucacgauggcgcaccggaagccgacguacgagcgugacguugaccucggggccggcacucgucacgucgccguugaacccgaggucgccaaccuggacaucauaggacagaggaucgaaaacauuaagcacgagcacaaguccacauggcacuacgacgaggacaaccccuacaagacgugggccuaccacgggagcuaugaagucaagccgucgggcagcgcgaguucaauggugaacggcguaguuaaguugcugacuaagccaugggacguaauccccauggucacgcagaucgccaugaccgauacuacccccuucggccaacagcggguguuuaaagaaaagguggacacccgcaccccgaaggcuaaacgggggacggcgcagaucauggaagucaccgcacgcugguuauggggcuucuugagucggaacaaaaagccccggauuugcacucgggaggaauucacccguaagguccggucgaacgcggccaucggcgccguuuucgucgaugagaaccaauggaacuccgccaaggaggcgguagaggacgaacgcuucugggaccuuguacaaaaggagcgggaauuacacaaacaggggaagugcgccacguguguuuacaacaugaugggcaagcgcgagaagaagcucggggaauuuggcaaggcuaaggggucgcgggccaucugguauauguggcugggcgcccgauuccuggaguucgaggcccucggcuucaugaaugaagaccacugguucucccgggagaauucccugucggggguugaaggcgaagggcugcacaaacucggcuacauccuacgcgacaucuccaagauucccggaggcaacauguaugccgaugacaccgcagguugggacacgcgaaucaccgaggacgaccugcagaacgaggccaagaucacggacaucauggagccggaacacgccuuacuggcgaccagcauuuucaaacuuaccuaccagaauaagguaguccgcguucaacgccccgccaagaacgggaccguaauggacgucauuucccggcgcgaccagcgcggcagcggacaggugggcacauaugggcugaacaccuucaccaacauggaggcccaacugauccgccaaauggaauccgagggcauuuuccugcccagcgagcucgagaccccuaaucucgccgagcggguucuggacuggcuagagaagcacggcgucgagcgccucaaaaggauggccaucaguggggacgacuguguggugaaaccgaucgacgaccguuucgcuaccgcccugaccgcccucaacgauauggguaaaguccggaaggacaucccccagugggaacccagcaagggauggaacgacuggcagcagguccccuucugcucccaccauuuccaccagcugaucaugaaggauggccgcgagaucgugguuccaugccggaaccaggacgaauuggugggucgcgcccggguaagccagggcgcaggguggucccuacgcgagacggcgugccuaggcaagagcuacgcccagauguggcagcugauguacuuccacaggcgcgaccuccggcuggccgccaacgccaucugcagcgccguucccguugacugggugcccacuucccgcaccacauggucuauccacgcccaccaucaauggaugaccacagaggauaugcuaucugucuggaacaagguguggaucgaggagaaccccuggauggaggacaagacgcacgugagcuccuggggagacguaccguaccucgguaagcgggaggaccagugguguggcuccuuaaucggucuaaccgcacgcgccaccugggcgagcaauauccagguggccaucaaccaagugcgccggcucaucgggaacgagaacuaccuugacuacaugacuuccaugaagcgauucaagaacgagggcgaccccgagggggcucugugguga

SEQ ID NO: 24474 - RNA, 9879 nt, Artificial Sequence
  derived and/or modified CDS sequence (opt11) from DENV-1__GU131766__SS-prME
ucugugaccaugcugcucauguuaaugcccaccgcccuggccuuccaccucaccacccggggcggggaaccccacaugauuguuacuaagcaggagcggggcaagagccuucuguucaagaccagcgccggagugaauaugugcacacucaucgccauggaccucggggaacugugugaggauacuaugaccuacaagugcccccguaucacggaggccgagcccgacgacgucgauugcugguguaaugccacugacaccugggugaccuacggcacuugcucgcagaccggcgagcaucggcgcgacaagcggagcguggcccucgcgccucacgugggccuggggcuggaaacccgcaccgagaccuggauguccagcgaaggcgccuggaagcagauccagagggucgagacgugggcccugcgucaccccggguucaccgucauagcccuauuccuggcgcaugccaucggcaccucuaucacccaaaaggggaucaucuucauccuccuaauguuggugacgcccagcauggccaugcggugugucggcaucggcucccgcgauuuuguggaggggcucagcggcgccacguggguggacguggugcuggaacauggguccugcgugaccacuauggccaaagacaagcccacgcuggacaucgaguugcugaagacagagguaacgaaccccgcggugcugcgcaaacucugcaucgaggccaagauaagcaacaccacgaccgacucccgcugucccacucagggugaggccacccugauggaggagcaagacgccaacuucguuugccgcagaacuuucguagaccguggcugggggaacggcuguggccuguucggcaagggaagccucaucacaugcgcgaaauucaagugcgugacgaagcuggaaggcaagaucguacaguaugaaaaucugaaguacuccgucaucgugacagugcacacuggagaucagcaccaggucgggaacgagagcaucgagcacggcaccacagcuaccauaacgccccaggcgcccacuucggagauacagcucaccgauuacggggcccugacccuggacugcagcccccgcaccggccucgacuucaacgagauggugcugcucacgaugaaagagaaauccuggcugguccauaagcagugguuccuggaccugccacuucccuggaccaguggagcaagcacuucccaagagaccuggaaucggcaagacuuacuggugacguucaagaccgcccacgcgaaaaagcaggaaguggucguguugggcucccaggagggcgccaugcacaccgcccugaccggugccacggagauucagaccuccggcaccacgacgaucuucgccgggcaccugaagugcaggcuuaagauggacaagcugacccuaaagggcaugagcuacgucaugugcaccggguccuucaagcucgagaaggaggucgccgagacccagcauggcacgguguuagugcagaucaaguacgagggcacagacgcccccuguaagauccccuucagcacccaggacgagaagggggucacgcagaacggcagacugaucacggccaauccgauuguaauagacaaggaaaagcccgugaacauagaggccgagccccccuucggcgaaucauacauugucauuggcgcgggcgagaaggccuugaagcucucuugguucaagaagggguccagcaucggcaaaauguucgaggccaccgcccguggggcacgaagaauggcaauccuaggcgacaccgccugggacuucgggagcaucggcggcgucuuuaccucuaucgggaagcuagugcaccagauauucgguacugccuacggggugcucuuuucaggcgugagcuggaccaugaagaucgggauaggggugcugcuaaccuggcucggacugaacucccguucgacuucgcugucaaugacguguauagccgucggucucgugacccuguaccugggcgugaugguucaggccgacuccgggugcgugaucaacuggaaaggcagggaacugaagugugggucuggaaucuuugucaccaacgaaguccacaccuggaccgagcaguacaaauuccaggcggacagcccgaagcgcuugucagccgccauugguaaagccugggaggaaggaguaugcggcauucggagcgccacccgccuggagaacauaauguggaagcaaauauccaaugagcucaaccacauccugcuggagaaugacaugaaguucaccguagucgugggagacguggucggaauccucgcucagggcaagaagaugauccggccgcagcccauggagcacaaguacagcuggaaguccugggggaaggcuaagaucaucggcgccgacgugcagaacaccacauucaucaucgacgggcccaacacaccugaaugccccgacgaccagagagccuggaacaucugggagguggaagacuacgguuucgggaucuucaccaccaacaucuggcugaaaaugcgggacagcuacacgcagguaugcgaucaucgccugaugucggcggccauuaaggacucuaaggccguucacgccgacaugggauacuggaucgaguccgagaaaaacgagaccuggaagcucgcccgggcgagcuucaucgaggugaaaaccugcaucuggcccaagucccauacgcuguggucgaacggcguccuggaguccgagaugauaaucccaaaaaucuaugggggccccauuagccaacacaauuaccgaccggguuacuucacgcagacggcuggcccuuggcaccucggaaagcuagagcuggacuuugaccucugugagggcaccacggugguggucgacgagcacugcggcaaccgggggcccagccugaggaccacuacgguuacaggcaagaucauacacgaguggugcugccguucaugcacccugccgccuuuacgcuucaagggcgaagauggcugcugguaugggauggagauacggcccgugaaggaaaaggaggagaaccuggucaaguccauggugucugccggcagcggcgagguugacuccuucagccuggggcuccucugcaucagcaucaugaucgaggagguuaugcggagccgguggucccgcaagaugcugaugacgggcacccucgccguguucuugcuucucaucaugggccaacugacguggaacgaccugauccgguugugcaucauggucggugccaacgcgucggauaggauggggaugggcaccaccuaccuggcgcugauggccaccuucaagaugcgcccgauguuugccgucggguugcuauuccgaagauugaccucccgggagguauugcugcugaccauaggucugagcuuaguggccagcgucgaguugcccaacucucucgaggagcugggcgacgggcucgcgauggguauaaugauccuaaaacugcuuaccgacuuccagucccaccagcucugcgccacgcuacuaagccucaccuucaucaagaccacgcucuccuugcacuacgccuggaagaccauggccauggugcucagcaucgucagccugaucccccuaugcuugagcacgacaucccagaagacuaccuggcuccccgugcugcucggaagccuggggugcaaaccgcuuacuauguuccucaucgcggaaaacaaaauauggggucgcaaguccuggccccugaacgaggggaucauggccgugggcgucgugagcauucuguuaagcucccuacugaagaacgacguaccccucgcggggccacugauugcaggcggaaugcugauagcuuguuaugugauaagcgguagcagcgcggaucucucccuggaaaaagccgcggaaguguccugggaggaggaggccgagcauuccggcgcaagccacaacauccugguggagguccaggacgacgggaccaugaagaucaaggacgaggagcgggacgacacgcucacgauccuacugaaggcgaccuuacuggccguguccggcguguacccgcugagcaucccggcgacccucuucguuugguacuucuggcagaaaaagaagcagagauccggugugcuaugggacacccccagcccgccggagguagagcgcgccguccuagacgacggcaucuaccgcauaaugcagcggggccugcuaggacgcucccaggugggcguugggguguuccaggagaacguauuccacacgauguggcacgugacucgaggugcuguccugauguaccaaggcaagcgccuugagcccagcugggccucgguaaaaaaggaccucaucucuuacggcggcggguggcgucugcagggcucuuggaacaccggggaggaagugcaggucaucgcuguagaacccggcaaaaacccgaaaaacgugcagacugcccccgggacguucaagaccccggagggcgaggucggagcgaucgcccucgacuucaaaccaggaacuagcggcucccccauaguuaaccgcgaggggaagaucgugggauuauauggcaacggggucgugacgacaaguggcaccuacgucagcgcgaucgcacaggccaaggccucccaggaggggccgcugccugagauugaggacgaaguauuucguaagcgcaaccugaccaucauggaucuucaccccggaagcgguaagacccggcgcuaccugccggcgaucgugcgggaggcaaucaagcgaaagcugcggacguuaauucuggcuccuacccgggugguggccuccgagauggccgaggcuuuaaagggcaugccaauccgcuaccagaccaccgccgucaagagcgagcauacgggcaaggaaaucguggaccucaugugccaugcgaccuucaccaugcggcugcugucccccguccgcgugccuaauuacaacaugauaaucauggacgaggcccacuucaccgacccgagcuccaucgcagcgcggggguacauaagcacccgcgugggcaugggggaagccgccgccaucuucaugaccgccaccccgcccggguccgucgaggcguucccgcagagcaacgccgugauccaggacgaggagcgggacauccccgagcgcuccuggaacagcggguacgaguggaucacugauuuccccggaaagacggugugguucguccccuccaucaaaagcggaaacgacaucgcaaauugccuccgcaagaacggaaagagggugauccaguuaucccggaagaccuucgacaccgaauaccagaagacaaagaacaaugacugggauuacguggucacgacggacaucagcgagaugggcgccaacuucagggcggaccgggugauagacccgcggcggugccugaagccggugauccugaaagacggacccgagcgcgugauccuggccggccccaugccggugaccguagcguccgccgcacagcggcgcgggcggaucgguaggaaccacaacaaggagggcgaccaguacaucuacauggggcaaccccugaacaaugacgaagaccaugcacacuggacugaagccaaaaugcuccuggacaacaucaacacgccugaaggcaucauccccgcgcuguucgagcccgaacgggaaaaguccgccgccauagacggggaguaccgccuacgcggcgaggcgcggaagacauuugucgaacugaugcgccgaggggaucugccaguuuggcucuccuacaaagucgccagcgagggcuuccaguacagcgaccgccgguggugcuucgacggcgagcgcaacaaccaggugcuggaggagaacauggacguggagauauggaccaaggagggggagcggaagaaguugcgcccccggugguuggacgccagaaccuauucggacccccuggcccugcgggaguuuaaggaguucgccgcgggucgccggucagugucaggcgaccucaucuuggagauaggcaagcugccgcagcaccucacgcagcgcgcccaaaacgcccuggacaaccuggugaugcugcauaacagcgagcaaggcgggcgggccuaccgccacgcuauggaggagcuuccggacaccaucgagacguuaaugcugcuggcccugauagccgugcucaccggcggggucacgcuguucuuucuguccggucgggggcuuggcaagaccagcauaggccuucugugcguaauggccucaucugugcuguuguggauggccuccguagaaccacacuggaucgcggccagcauaauccucgaguucuuucuaauggugcugcugauccccgagccggaccgccagcggacgccccaagacaaccaguuagcguacguagucaucggguuacuuuucaugauacucaccguugcggccaacgagauggguuuacuggagaccacgaagaaagaccucgguaucggucacgucgcgguugagaaccaccaccacgcuaccaugcuggacguggaucugcaccccgccuccgccuggacccucuaugccguggcgaccacuaucauaacaccgaugaugcgccacacaaucgagaauaccacggcaaauaucagccuaaccgccaucgcaaaccaggccgccauccugauggggcucgacaagggcuggccgaucuccaaaauggacauuggcgucccguugcuggcccucggaugcuacagccaggugaacccccugacccugaccgccgccgugcuaaugcuggucgcgcauuacgccaucaucgggccgggucugcaggccaaggccacgcgggaagcccagaagcgcaccgcggcggguaucaugaaaaaccccaccguggacgggauuguggccaucgaccucgaccccgucguuuacgacgccaaguucgagaagcagcugggccagauuaugcugcuaauccugugcaccucccagauucugcucaugaggacgaccugggcgcugugugagagcaucacccuggcgaccggcccccucacgacccugugggagggguccccgggcaaguucuggaacaccaccaucgccguuagcauggcaaacauuuuccggggguccuaccucgccggagccggccuggcguucagcuuaaugaagucccucggaggcgggcgccgugggacgggggcccagggcgaaacccugggugagaaguggaagcgccaacugaaccagcuguccaagucagaguuuaacauuuacaagagauccgggaucauggaggucgaccguucggaggccaaggaaggacugaagcgcggggagaccacgcgccacgccgucucgcggggcacggcgaagcugcgcugguuuguggagcggaaccuggucaagcccgagggcaagguuauugaucugggcugcggcagagggggauggagcuauuacugugccggucucaagaaggugaccgaggugaagggcuacaccaagggugggcccggccacgaggagccuaucccgauggccaccuacggguggaaucucguuaagcugcacuccggcaaggacguauucuucacuccgcccgaaaagugcgacacgcuccuuugcgacaucggggaauccucuccgaacccgaccaucgaagagggccgcacacuucgcguccucaagaugguagagccuuggcugcgggguaaccaguucuguaucaagauccugaacccuuacaugcccagcguagucgagacgcuagagcagaugcaacgcaagcacggcggcaugcugguacguaauccccuguccaggaacagcacacaugagauguacuggguuuccugugggaccggcaacaucgucagcgccgucaacaugaccucccguauguuacugaaccgcuuuaccauggcccaccgcaagcccacguacgagaaggauguggaccugggagcgggcacccggcacgucgccguggagcccgagguggccaaccuagacaucaucggccagcgaauugaaaacaucaagcacgaacacaagagcacuuggcacuacgacgaggacaacccauacaagacgugggcuuaccaugguaguuacgaggucaaaccgucuggauccgccagcucuauggugaacggagucguaaaacucuuaaccaagccaugggaugugauccccaugguaacccagauugcgaugaccgacacaacgcccuucggccaacagcgaguguuuaaggagaaaguggacacccgcacccccaaggccaagcggggcaccguccagaucauggaagugacggccagauggcuguggggauuucuguccaggaacaagaagccccgcauuugcacuagggaggaguucacucguaagguacgauccaacgccgcgaucggcgcgguuuucguggacgagaaccaauggaacuccgccaaggaggccguggaggacgagcguuucugggaccuggucaagaaggagcgggaacuccacaaacaggggaagugcgcgaccugcguguauaacaugaugggcaaacgcgagaagaagcugggggaguuuggcaaggccaaggggagcagggccaucugguacauguggcuaggcgcccgauuccucgaguucgaggcccuuggcuucaugaacgaggaccacugguucucccgggagaacucacuuuccggaguggaaggcgaggggcuccacaaguuaggcuauauccugcgcgacaucagcaagauacccgggggcaacauguacgccgacgauacggcgggcugggacacccggauuaccgaggacgaccuccaaaaugaggccaagauuaccgacaucauggagccggagcacgcccuguuggccacgucaaucuucaaauugaccuaccagaacaaggucgugcgcgugcagcggcccgcuaagaacgggaccgucauggacgugaucagccgccgggaccagagaggcuccggucaggugggcaccuacggccugaauacguucaccaauauggaggcacagcugauccgacagauggaguccgaagggaucuuccuccccuccgagcuggagacccccaaccucgccgagagggucuuggacugguuagagaaguacggcguggagcgccugaagcgcauggccaucagcggugacgacugcguugucaagccgaucgacgacagguuugccaccgcccucacggcguuaaacgacaugggcaaggugcggaaggacaucccccaaugggagcccucaaagggguggaacgacuggcagcaaguccccuucugcagccaccauuuccaccaguuaauaaugaaggacggcagggaaaucguugugccaugccggaaccaggacgaguuagugggccgcgcccgggucucccagggggccggcuggagccuaagagagaccgccugccugggcaagucuuacgcucagauguggcagcugauguacuuccaccggcgcgaccugcggcucgcggcgaacgcuaucugcuccgcuguacccgucgacugggugcccaccagccgcaccacguggaguauccacgcgcaccaccaguggaugaccaccgaggacaugcucagcguguggaaucggguguggaucgaagaaaaccccuggauggaggacaagacccacgugucuucauggggagacgugccguaccucgggaagcgugaggaccaguggugcggcucccugaucggacucacggcccgggcuaccugggcgagcaacauccagguggcgauaaaccaaguccguaggcugauuggaaacgagaacuaccuggacuacaugacauccaugaagcgauucaagaacgagggcgauccagagggagcgcucugguga

SEQ ID NO: 24475 - RNA, 9879 nt, Artificial Sequence
  derived and/or modified CDS sequence (opt11) from DENV-1__GU131767__SS-prME
agcgugaccaugcuucugaugcugaugcccacugcccuggccuuccaucucacaacgcggggcggggaaccccacaugaucguaagcaagcaggagcggggcaagagcuugcuguucaaaacgucugugggcgugaacaugugcacccucaucgccauggaucugggcgaguuuugugaggacaccaugacguacaagugcccacgcaucacggaagccgaacccgaugauguggacugcuggugcaaugccacugacacguggguaacauacgggaccuguagccagacuggcgagcaccggcgcgacaagcgguccguggcgcuggcgccucacguuggccucgggcuggaaacgcggaccgagaccuggaugucauccgagggcgccuggaagcagauccaacggguggagaccugggcacugcgccacccgggguucacugugauagcccucuuccuggcacacgcuaucggcacaucgaucacccagaaagggauaauuuucaucuuauugaugcuuguuaccccauccauggccaugaggugcguaggcaucggcagccgcgauuucguggaaggacuuucaggagccacgugggucgauguuguauuagaacacgggagcugcgugaccaccauggccaaggacaaacccacacuggauaucgagcugcucaaaacggaggugaccaacccagccguucuacgaaagcugugcauagaagcgaagauauccaacaccacgacggauucacgcugcccgacccagggcgaggccaccuuagucgaagagcaggacgccaacuucgugugucggagaacuuuuguggaccggggcugggggaacgggugcggccuguucgggaagggguccuuaauaacgugugccaaguucaagugcgucaccaagcuugagggaaaaaucgugcaauacgagaaucugaaguacagcgugauaguaaccgugcacacgggcgaccagcaccagguagggaacgaauccacggagcacggcaccacggccacaaucaccccccaagcgccuagcacggagauccagcugaccgacuacggggcccugacccuggacugcagccccagaacgggccuggauuucaacgagauggugcuccugacgaugaaggagaaguccuggcuggugcacaagcaaugguuccucgaucuuccacugcccuggacuucgggggccuccaccagccaggagaccuggaaccgucaggaccucuuagucacguucaagaccgcacaugccaaaaagcaggaggucgugguacugggcagucaggagggagcgaugcacacggcguugaccggggccacagagauccagaccagcggcaccacuacuaucuucgccgggcaccugaaaugccgccugaaaauggacaagcucaccuugaagggaaugagcuacgugaugugcaccgggagcuucaagcuggagaaggagguggccgaaacccagcaugggaccguucuagugcagauuaaguacgaagggaccgacgcgccuugcaagauccccuucucaacccaagacgaaaagggggugacccagaacggccgguuaaucacggccaacccgaucgucacagacaaggagaagccgguaaacaucgaggccgagccgcccuuuggggagagcuauaucgugaucggggccggugagaaggcgcugaagcuguccugguucaagaaggggagcucgauaggcaagauguucgaggccacugcccguggugcucggcgaauggcuauuuuaggugauacagcaugggacuuugggucuaucggcggcguauucaccuccguggggaaacuggugcaucagaucuuuggcaccgccuacgggguccuguucagcggcgugaguuggacaaugaagaucgggaucggcgugcuccugaccuggcugggauugaacagccgcagcacgagccuguccaugaccuguauagccgucggucuggugacccucuaucugggcgugaugguacgggccgacagcgguugcgugauaaacuggaagggccgcgagcuaaagugcggaucgggcaucuucguuaccaaugaggugcacacauggaccgaacaguacaaauuucaggccgacuccccgaagcgguugagcgcggccaucggcaaagcaugggaggagggggugugugguauccgcagcgccacccggcucgagaauaucauguggaagcagaucagcaacgagcugaaucacauccuccuggaaaaugacaugaagcuaacuguggucgucggggacguggccggcaucuuagcgcaggggaagaaaaugauccgcccccagcccauggaguacaaguacagcuggaaguccuggggcaaagccaagaucauaggcgccgacguucagaacaccaccuucaucauugacgggcccaacaccccggagugccccgacgaccagcgggccuggaacauuugggaagucgaggacuacggguucgggaucuucaccaccaacaucuggcugaagcuaagagacucguacacccagguaugugaccaccgcuugaugagcgcugccaucaaggacaguaaggcgguacaugccgauaugggcuacuggauugagagcgagaaaaacgagaccuggaagcuggcccgcgcuuccuucaucgaggugaaaaccugcaucuggccuaagagccacacccugugguccaauggcgugcucgagagcgagaugaucauucccaaaaucuacgggggcccuaucucacagcacaacuacagacccggguauuucacgcagaccgccggacccuggcaccuggggaagcuugaguuggacuucgaucugugcgaaggcaccacugucguuguggacgagcacugcggcaaccgagggccgagccugcgaacgaccaccgucaccggcaaaaucauucacgaguggugcugcagauccugcacucugccgccgcuccgguucaagggggaggauggcugcugguaugggauggagauccgccccgugaaggaaaaggaggagaaccucgucaagagcauggucucggccggcucgggcgaaguagacucguucucccucggguugcugugcaucagcauaaugaucgaggaggugaugagaucccgguggucaaggaagaugcuuaugaccggcaccuuagccgucuuuuuucugcucaucauggggcaacugacauggaacgaccugaucaggcucugcaucaugguaggcgccaacgcuuccgaccgcauggguaugggcacgacuuaccuggccuuaauggcaaccuucaagaugaggccgauguucgcugucggacuccuguuuaggaggcugaccagccgcgagguccuacugcugacaauagggcucucgcugguggccaguguggaacugcccaacucccucgaggagcugggcgacggguuggcgaugggaaucaugauucucaagcuccugaccgacuuccagagucaccagcucugggcaacacugcucucccucaccuuuauccggacgaccuuuagcuugcacuacgccuggaagacaauggcuauggugcuuagcaucguaagccucuucccccugugcuuauccacaacgagccagaagaccaccuggcuccccguccugcugggaucccucggaugcaaaccacugacgauguucuugaucgccgagaacaagaucuggggccgcaaauccuggccccuuaacgaagggaucauggccgugggcauagugagcauccuucuguccagcuuacugaaaaacgacguuccucuugccgguccgcucauagccggcgguaugcugaucgcuugcuaugucaucucaggcagcuccgccgaucugagccucgaaaaggcggccguggucuccugggaggaggaggccgaacacucaggcgccucccacaacauccuggucgaggugcaggaugacggaacgaugaagaucaaggacgaggagcgagacgacacccuaacuaucuuguugaaagcaacgcugcucgcuguaagcggcguguacccgcuguccauuccagccacccucuuuguuugguacuucuggcagaagaaaaagcagcgauccgggguccuaugggacacgcccagcccgcccgagguagagcgggccguccucgaugacgggaucuaccgcauaaugcagcggggacugcugggucgcucgcaggucgggguagggguuuuucaggagaacguuuuucacaccauguggcacguuacccggggcgccguguuaauguaccaggggaaacgccuggagcccuccugggcgagcguuaagaaggaucucauuuccuauggcggcggauggcgccuucaagggucuuggaauacuggggaggagguccaggugauagccgucgaaccgggcaagaaucccaagaaugugcagacggcccccgggacuuuuaaaacguccgaaggcgaggucggcgccaucgcgcuggacuucaagcccgguaccucugguagccccauuguaaaccgggagggcaaaauuguggggcuguauggcaacggcguagucacaacuuccgguaccuauguaucggcgaucgcccaggcaaaggccagccaggaggggccccucccggagaucgaggacgagguguuucgcaagcgcaaccugaccaucauggaucuacacccgggcucggggaagacucggcgcuaccuccccgcgaucguucgggaggccauaaagagaaagcugcgcacccugauauuagcaccaacccggguuguggccagcgagauggcagaggcgcugaaaggcaugcccauccgcuaccagaccacagccgucaagagcgagcacaccggcaaggagaucguggaccucaugugccaugccaccuucaccaugagauugcugagccccgugcgcgucccuaauuacaauaugaucauaauggaugaggcccacuucacggacccgaguuccaucgccgcgagaggcuauauaagcacccgcguuggaaugggggaggccgccgccaucuucaugacugccacgccccccggauccguagaggcguucccccagagcaacgccgucauccaggacgaggagcgggacaucccggagcgcagcuggaacagcggguaugaauggauuaccgacuuccccgggaagaccgugugguucgugcccagcaucaagagcggcaacgacauagccaacugucugcggaagaacgggaaacgugucauccagcuuuccaggaagaccuucgacaccgaguaccaaaagacaaagaacaacgacugggauuacguggugaccaccgacaucucggagaugggugccaacuuccgugccgaucgggucauagauccccgacgcuguuugaagccugugauccugaaggacggacccgagagagucauccuggcgggccccaugcccgucaccguggcauccgccgcccaacggcgcgggcggaucggccgcaaccacaacaaggagggugaccaguacaucuacauggggcagccgcuuaauaaugacgaggaccacgcucacuggacggaagccaagaugcugcucgacaauauaaacacacccgaagggaucauacccgcgcuguucgagcccgaacgggagaaguccgccgccaucgacggggaguaccgguugcguggagaggcgcggaaaaccuucgucgaacugaugagacgaggggacuugccgguguggcugucauacaagguggccucggagggcuuccaguacagcgaccgccgguggugcuucgacggcgagcgcaacaaccagguccuagaggaaaacauggacguugagaucuggaccaaggaaggggagcggaagaagcuccggccccgcuggcuggacgcucgcacguacagugacccccucgccuugcgggaguucaaggaguuugcagccggucgccggagcguauccggcgaucugauucucgaaaucggcaagcugccccaacaccugacccagcgcgcccagaacgcccucgacaauuugguaaugcugcacaacagcgagcagggcgggcgggccuacagacacgcgauggaagagcucccggacaccaucgagacccugaugcugcucgcguuaauagcugugcugacggguggcgugaccuuauuuuuccuguccggccgcgggcucggcaaaaccuccauuggccuccugugcgucauggccuccagcguuuuguuguggauggcguccguggagccccauuggauagcggccagcaucauccuggaguuuuuucugauggucuugcugauccccgagcccgaucgucagcggaccccgcaagacaaccagcuggccuacguggugaucgggcuucuguucaugauucugaccgucgcagccaacgagaugggccuccuggagacaaccaagaaggaccuggggaucggccacgucgcgguggagaaccaucaucaugccgccauguuagacgucgaccugcaccccgccuccgcguggacacuguacgcgguggccacaacuauuaucacacccaugaugaggcacacaauagagaacacaacggcuaauaucagccucacggcaauagccaaccaggcagccauacuaaugggacuggauaaagguuggcccauuucuaagauggauaucggcgugccgcuacuggcccucggguguuacagccaggucaacccccucaccuuaaccgccgcgguacugaugcugguagcccauuacgccauaaucggcccggggcugcaagcgaaggccacgcgcgaggcccagaagaggaccgccgcuggcaucaugaagaacccgaccguugacggcaucguggcaauugaccuggacccgguagucuaugacgccaaguuugagaaacagcucggccagaucauguugcucauccucugcaccagccagauccugcucaugcggaccaccugggcgcuuugcgagagcaucacacucgccaccggaccacugacgacccuaugggagggguccccgggcaaguucuggaauaccaccaucgccgugagcauggcaaacauauuccgggggagcuaccuagccggcgcaggccuugcguucucccucaugaaguccuuagggggagggcgcagaggcaccggggcccagggcgaaacccugggcgagaaguggaagcgccagcuaaaccaacuuuccaagagugaauucaacacuuacaagagguccgggaucauggagguugaccggagcgaagccaaagagggccugaaacgcggggagaccacgaaacacgcggucucccgcggcacggccaaacuccgcugguuuguggagagaaaccuagucaagccugagggcaaggugaucgaccuuggcugcggacgcggcggauggagcuauuauugugccggguuaaagaaagugaccgaagugaaggguuauaccaagggcggccccggccacgaggagccuauccccauggcaacguacggguggaaccucgucaagcugcacucuggcaaggacguguucuucauuccgcccgaaaaaugcgacacgcugcucugcgacauuggggaaucuucccccaaccccaccaucgaggagggacgcacucugcggguccugaagauggucgagccguggcuccgggggaaucaauuuugcaucaagauacugaaucccuacaugcccagcgugguggagacgcuggagcagaugcaacggaaacacggcgguauguuaguccgcaacccccuguccaggaacagcacucacgagauguauuggguaucuugugggacgggcaauauugugagcgcggucaacaugaccucgcgcaugcugcucaaccgcuuuaccauggcgcaccggaagcccacguacgaacgcgauguggaucugggggccggcacccggcacguggccgucgagcccgagguggccaaccuggacaucaucggccaacgcaucgaaaauaucaagcacgagcauaagagcaccuggcacuacgacgaggacaaccccuacaagaccugggccuaccacggguccuaugagguaaaacccuccgguagcgcgucaucuauggucaacgggguggucaaauuacuaacuaaaccgugggacgucauaccuaugguuacccagaucgcgaugacagacacgacacccuucggccagcagcggguguucaaagaaaaagucgacacccggacccccaaagcgaaacgcgggaccgcccaaaucauggagguuaccgccaaguggcuguggggcuuccuaucccgcaacaagaagccucggaucugcacccgugaggaauucacgcggaagguccgcagcaaugcagcuauuggcgcaguguucguggacgagaaccaauggaacuccgccaaggaagcgguagaagacgagcgguucugggaucuagugcaucgagagcgagagcuccauaagcaggguaaaugcgcuaccugcguguauaacaugaugggcaagcgcgagaagaagcuaggcgaauucggcaaggccaaggggagccgagccauuugguacaugugguugggcgccagauuccuagaguucgaggcucucggguuuaugaacgaggaccacugguucucgcgggaaaacagccucuccggcgucgagggugaagggcugcacaagcuuggcuacauccuucgcgauaucuccaagauccccggcggcaacauguacgcagacgacacugccgguugggauacccggaucaccgaggacgaucugcagaacgaagccaagauuaccgacaucauggagcccgagcacgcccuccuagcgaaguccaucuucaagcuaacguaccaaaacaagguggugagaguucagcgcccggccaagaacgggaccguuauggacgucauaagccggcgcgaucagcggggcucugggcaggucggcaccuacggccucaacaccuuuacgaacauggaggcccagcugauacgacagauggagagcgaagggauauucuccccaagcgagcuugaaacccccaaccucgccggacgggugcuggacuggcuggagaagcacgggguggaacgccuaaagagaauggccauauccggcgaugacugcguggugaaacccaucgacgaccgguucgcgaccgcauuaaccgcccugaacgauauggggaagguacggaaggacauaccgcagugggaaccgagcaagggcuggaacgacuggcagcagguccccuucugcucucaccauuuucaucagcuaaucaugaaggauggccgagagauuguggugcccugccggaaucaggacgagcuggucggccgcgcccgggucagucagggcgccggguggagucuacgcgaaacggcaugccugggcaaguccuaugcccagauguggcagcugauguauuuccauaggcgcgaccuucgccucgccgccaacgcgauauguucugccgugccggucgacugggugccuacuucccgcaccacguggagcauacaugcccaucaccaguggaugaccaccgaggacaugcugucgguguggaaccgggucuggaucgaggagaaucccuggauggaggacaagacccacaucucuucauggggcgacgugccuuaccuggggaagcgugaagaucagugguguggcucccucaucgggcuuaccgcccgcgcaacaugggcgaccaacauacagguggcuaucaaucaaguccggaggcugcugggcaacgagaacuacuuagacuauaugacuuccaugaagcgauucaagaacgaaagcgacccggagggcgcccugugguga

SEQ ID NO: 24476 - RNA, 9879 nt, Artificial Sequence
  derived and/or modified CDS sequence (opt11) from DENV-1__HM181967__SS-prME
agugugaccaugcuacuaauguuaaugcccaccgcccuggcguuccaccuuaccacccggggcggugagccacacaugaucgugagcaagcaggagcggggcaagagccugcuguucaagaccucggccggagugaacaugugcacccucaucgccauggaucugggcgaguuaugcgaggacaccaugaccuacaaguguccccgcauuaccgagaccgagcccgacgacguggacugcugguguaacgccacggacaccuggguuacuuacgguaccugcagucagacgggcgagcaccggcgcgauaagagaaguguagcgcucgcgccccacgugggucuggggcuggagacccggaccgagacuuggaugagcuccgagggcgcguggaagcagauccagcgcgucgagacuugggcccuccggcaccccggguucaccgugauugcccuguuucuggcacaugcgaucggcaccucgaucacccagaaggguaucaucuucauuuuacugaugcuggugacgccauccauggccaugcggugcgucggcauaggcucacgcgauuucguagaggggcucuccggggccaccuggguggacgucguauuggagcacgggagcugcguaacgaccauggccaaagacaaacccaccuuggacaucgagcuacugaagaccgaggucaccaaucccgccguccugcggaagcucuguaucgaggcgaagauuuccaacaccaccacggacagccgcugcccgacacagggcgaggccacccuaguggaagagcaggacgccaacuucguuuguaggcgcacuuucguggaccgcggcugggggaacgguugcgggcuguucggcaaagggagccucaucacgugcgccaaguucaaaugugugaccaaacuagagggaaagaucguccaguaugagaaccugaaguacagcgugaucguaaccguccacacgggcgaccaacaccagguggggaacgagucaaccgaacacggcaccacggccaccaucacgccccaagcccccaccaccgagauucagcucacugacuacggcgcucugacgcuggauugcucgccgcgcacaggccucgacuucaacgagauggucuuauuaaccaugaaagagaaaagcuggcucgugcacaagcagugguuccuggaccuaccguugcccuggaccaguggggcuagcacgucccaggaaaccuggaaucgccaggaccuucugguuacguucaagacugcccacgccaagaaacaggaggucguagugcucggcagccaagagggagcuaugcacacggcccugaccggugccaccgagauccagaccagcggcacgaccaccauuuucgccggucaccuuaagugccggcucaaaauggauaagcugacccuuaagggcaugagcuacgucauguguacggggucguucaaguuggagaaggaaguggcugagacccagcacggcaccgugcuuguccagauaaaguacgagggaaccgacgcgcccugcaagauaccauucaguacgcaagacgagaaggggguaacgcagaacggccggcugauaaccgcuaacccuaucgugaccgacaaggagaagcccgugaauauagaggccgagccacccuucggggagagcuacaucgugaucggcgccggggagaaggcccugaaguugagcugguucaaaaaggggucgucuaucggcaagauguucgaggcgaccgcccgcggggcccgucggauggccauccugggcgauaccgcgugggacuucggguccauaggcggcguuuucaccagcgugggcaaacugguccaccagaucuucgguaccgcuuacgggguacuguucuccggcgucucuuggacgaugaagaucgggaucggcgugcugcugaccugguuggggcuaaauucccgcagcaccucccugagcaugaccugcaucgccguggggcucgugacgcuguaccuaggcgugaugguacaggcggauuccggcugcguaaucaacuggaaaggccgggagcucaagugugggagcggcaucuucguaacgaacgaggugcauaccuggaccgagcaguacaaguuccaagcagacucgccgaagcgccuauccgccgcuaucggaaaggccugggaggagggugucugcggcauccggagcgccacccgccuggagaacaucauguggaagcagauuuccaacgagcucaaccacauccuuuuagaaaaugacaugaaguucacgguggucgucggggacguggccggcauccucgcccaagggaagaagaugauccggccccagcccauggaguauaaauacagcuggaaguccugggggaaggcgaagaucaucggcgccgacguccaaaacaccaccuuuaucaucgacgggcccaacaccccggagugucccgacgaccagcgcgccuggaacaucugggaggucgaagacuauggauucgggauauucacgaccaacaucuggcugaagcugcgugacagcuacacccaagugugcgaccaccgccuaaugucagcggcaauaaaggacaguaaggccguacacgcugacaugggcuacuggaucgagagcgagaagaacgagaccuggaaacuggcucgggcgagcuuuaucgaaguuaagacgugcaucuggcccaagucccacacccuguggucaaacggcgugcucgaguccgagaugaucaucccgaagauauacggagggccgaucagucagcacaacuaccguccgggcuacuucacccaggcggccgggccauggcaccugggaaaacuggaacuggacuucgaccugugcgagggcaccacgguugucguggacgagcacugcggcaaccgggggccguccuugcgcaccaccaccgugacgggcaagaucauucacgaguggugcugccggagcuguacccugccgcccuugcgcuuccgcggggaggauggcugcugguauggcauggagauucgccccgucaaggagaaggaggagaaccugguaaaguccaugguuagcgcgggcagcggcgagguagacuccuucucacucggguuacuguguaucuccaucaugauagaggaagugaugcggagccgcuggucccggcgcaugcucaugaccggaacauuagccguguuuuuccuguugaucaugggucaacugacguggaacgaccucauccgccucuguaucauggucggcgcgaacgccagcgaccggauggggaugggcacgaccuaccuggcucugauggcuaccuucaaaaugcgcccgauguuugccgugggccuccuuuuucggcgccucacgucccgggaggugcuacugcugacuauugggcucagccugguugcguccguggagcugcccaacucucucgaagagcugggcgacgggcuugccaugggcaucaugauccucaaguugcugaccgacuuccagucccaccagcucugggccacccuucugagccucacguucaucaagaccaccuucucccuccacuaugcguggaagaccauggcgaugguccugucaauuguguccuuguucccgcucugccugagcaccaccucacagaagacaacuuggcucccagugcugcugggcagccucggcugcaagccgcugacgauguucuugaucgcugaaaacaagaucuggggccgccgguccuggccucucaacgaggggauaauggccgucgggaucgugagcauccuguugagcucucuccugaagaaugaugugccucuggccggcccccuaaucgccggcggcaugcugaucgcuugcuacgucauaagcggcucgagcgccgacuugucucucgaaaaggccgccgaggugagcugggaggaggaggccgaacacuccggcgcuagccacaacauccugguugagguccaggacgacgggaccaugaagaucaaggacgaagagcgagacgacacccuaacgauucuccugaaggccacccugcucgcuguguccgguguguauccucuuagcauucccgccacgcuuuucgucugguauuuuuggcagaagaaaaagcagagauccggggugcucugggacacccccagcccgcccgagguggagagggccguccuggaugacggcaucuacaggaucaugcagcgcggucuguuagggcggucacaagugggcgugggggucuuccaggagaacguguuucacaccauguggcacgucacccgcggcgcgguuuuaauguaccaggggaaacgacuagagcccucgugggccuccgugaagaaggaccugauuagcuacgguggcggguggcgcuuacagggcagcuggaauacgggagaggaggugcaggucaucgccguggagcccgggaagaacccgaagaacgugcagaccgccccagguaccuucaagacccccgaaggcgaggugggcgccaucgcgcuggacuucaaacccgggacgaguggcucacccaucgugaaccgggaggggaagaucgugggccuguacggcaacggugucguuaccaccagcggcacuuacgugucugccauagcccaggcaaaggcgucccaggaagggccguuacccgagauugaggacgaggucuuccgcaagcggaaccugacgaucauggaccugcaccccggaagcggcaagacccggcgguaucuaccggccaucguccgagaggccauaaagcgcaagcugcggaccuugauacucgcccccacccgcgucguagcuuccgagauggcugaggcccugaaaggcaugcccauccguuaccaaacgacugcggucaagagcgaacacaccggcaaggagaucguugacuuaaugugccacgcaacauucacgaugcgccugcugucgcccguccgggugcccaacuacaacaugaucaucauggaugaagcgcacuucaccgaccccagcuccaucgccgcgcguggguauaucucuacccgggugggcaugggggaggcggcagcgaucuuuaugaccgcgacgccgcccggcuccgucgaggcuuucccccagagcaaugcugugauccaggacgaagagcgcgauaucccugagagauccuggaacagcggguacgaauggauaaccgauuucccggggaagacggugugguucgucccaaguaucaagucaggcaacgacauagccaacugccugcgcaagaacgggaagcgagugauccaacucucccgcaaaaccuuugacacggaguaccagaaaaccaagaacaacgauugggacuacguagucaccacugacaucagcgagaugggcgcgaacuuccgggcggacagggucaucgacccacggcgcugccugaagccuguaauccugaaggacgggcccgaacgggucauucucgccgguccuaugccggucacggucgcuuccgcugcgcagcgcaggggacgcaucggaaggaaccacaacaaggaaggagaccaauacaucuacaugggccagccccugaauaaugacgaggaccacgcacacuggaccgaagccaaaaugcuucucgacaacaucaacacccccgaggguaucauucccgcccuguuugagccggagcgggagaagucggccgcgaucgauggcgaguaucgcuugcggggcgaggcccgcaagaccuucguggagcucaugaggcgcggggaccugcccguguggcugucauacaaggucgcgucugaggguuuccaguacagcgaccggagaugguguuucgacggggagcggaacaaucagguguuagaggagaacauggacguggagaucuggacgaaggagggggagcgcaagaagcuacggcccagguggcuggacgcccggacuuacuccgaccccuuagcacuccgcgaguuuaaggaguuugccgccggccgucgcagcgucuccggagaccuuauccucgagaucggaaaauugccgcagcaccuuacccagagggcccagaacgcccucgacaaucuggucaugcugcacaacagcgagcagggcgggcgggcguaccggcaugccauggaggaguugccggacaccaucgagacgcugauguugcucgcccuuaucgccguccugaccggcggggucacccuguucuucuugaguggccgcggguuggguaagaccuccaucggccuccugugcgugauggccuccagcguguuacucuggauggcgaguguagagccccauuggaucgcagcgucuaucaucuuagaauucuuccugauggugcuccucauacccgaaccggaccggcagcguacgccccaggauaaccaguuagcguacguaguaauuggccuacuguucaugauccugaccguggccgcgaacgagauggguuuacuggagaccaccaagaaggaccuggggaucggccacauggccguugaaaaccaccaccacgccgcuaugcucgacguggacuuacaucccgccuccgcguggacccucuacgccguggcaacgaccaucaucaccccgaugaugcgccauaccaucgagaacaccaccgccaacauuucccuuacagccaucgcgaaccaggccgccauccuuauggggcuggacaaaggcuggcccaucuccaaaauggauaucggcgugccccuccuggcccuggguugcuacagccaggucaacccccugacccugacagcggccguccugaugcucguagcccacuacgcaaucaucggcccggggcugcaggccaaggccacccgggaggcucagaagcggacagccgccggcaucaugaagaaccccacagucgacgggaucguagccauugaccuggaucccguugucuacgacgcgaaguucgagaagcagcucggccaaaucaugcuacugauacucuguacgagucagauacuauuaaugcggaccaccugggcccucugcgagagcauaacccuagccacgggcccccugaccacccucugggaagguuccccggguaaauucuggaacaccacaaucgccgugagcauggcgaacaucuuccguggguccuacuuggcuggggccggcuuggccuucucgcucaugaagucccucgggggcggucggcgagguaccggggcccagggcgaaacccuaggggaaaaguggaagaggcagcuaaaccagcuguccaagagcgaguucaacaccuacaagcgcucagggauuauggagguggaccggucugaagcgaaggagggccugaagcggggggaaacgacgaaacaugcggucucccggggcaccgcaaagcuacggugguucguggaaaggaaccuagugaagccagaggggaaggucaucgaccugggcugcggccgaggaggcuggucauacuauugcgccgggcuaaaaaaggugaccgaggucaagggcuacaccaaggguggcccuggccacgaagagcccaucccuauggccaccuacggguggaaccucgucaagcugcacuccggcaaggacguguucuucauuccgccugagaagugcgacacccugcuaugcgacauuggagagagcucccccaauccaaccauugaggagggccggacgcuccgaguacugaagauggucgagccuuggcuccgggggaaccaguucugcaucaagauacuuaaccccuacaugcccagcgugguggagacccuggaacagaugcagcgcaaacacggcggaauguugguccggaacccgcugucuagaaacagcacccacgagauguacugggugucuugcgggaccggcaacaucgugagcgcggucaacaugaccuccagaaugcugcucaaccgauuuacgauggcucaccguaagccuaccuacgaacgggauguggaccucggugccgguacucgccacguggccgucgagccggagguggccaaccuagauaucaucggccaaaggauagagaacaucaagcacgaacacaaaucaaccuggcauuacgacgaggacaacccauacaagacuugggcguaccacgggaguuacgagguaaaaccgagcggcuccgcgagcaguauggucaaugggguugucaagcuccugaccaagcccugggacgucaucccaauggugacccagaucgccaugaccgacacgaccccguucggacagcagagagucuucaaggagaagguggacaccagaaccccgaaggcgaaaagagggacggcccagaucauggaggugaccgcuaaguggcuguggggcuuccuauccaggaacaaaaagccuaggaucugcacccgugaagaguuuacccgcaaggugcguagcaacgccgccaucggggccguguucguggacgagaaucaauggaacuccgccaaagaggccgucgaggacgagcgguuuugggaccuggugcaccgggagcgcgagcuucauaagcaggggaagugcgccacgugcguguacaacaugauggguaagcgggagaagaagcuuggugaguucggcaaggcaaaagggagccgcgccaucugguauaugugguugggggcgcgguuccuagaguucgaggcucucggcuucaugaaugaggaccacugguucucccgcgagaacagccugagcggaguagagggggaggggcugcacaagcucggauacauccugcgggacaucagcaagauccccggcggcaacauguacgcugaugauacugccgguugggauacccgcaucaccgaggacgaccugcagaacgaggcccguaucacggacaucauggagccggagcacgcgcucuuagccaaguccauuuucaagcugaccuaccagaacaagguggugcggguccaacgccccgccaaaaacgggacugugauggacgugauuagccggcgcgaccagcggggcucugggcaggucggcaccuacgggcucaacacguucaccaacauggaggcccagcugauccgacaaauggagagcgaggggaucuucagucccagcgagcuggagacccccaaucucgcagagagggugcuggacuggcuggagaaauauggcguggagcgacuuaagcggauggcuaucuccggggacgacugcgucgugaagccuauagacgaucgcuucgccaccgcccugacugcccugaacgauaugggcaaggugcggaaggacaucccucaaugggagcccaguaagggguggaacgacuggcagcaggucccguucugcucgcaccacuuucaucagcucauuaugaaagauggccgugagaucguggugccgugucggaaccaggacgagcuggucggccgagcacgcgugucacaaggagcgggcuggagccugcgugaaaccgccugccucgggaagagcuacgcucagauguggcagcugauguacuuccaccggcgcgaccugcggcucgccgcuaacgccaucugcagcgccgugccaguugacuggauccccacuucccgaaccaccuggagcauccacgcccaucaccaguggaugaccaccgaggauaugcuguccgucuggaaccgcguguggaucgaggaaaaccccuggauggaggacaagacccacaucagcuccuggggcgacguuccguaucuggggaagcgagaggaccaguggugcgggucacucaucggccuuacggcacgcgcgaccugggccaccaauauccaaguggccaucaaccaggugcggcgacugaucgggaacgagaacuaccucgacuacaugacauccaugaagcgguucaagaacgagagcgaccccgagggcgcccugugguga

SEQ ID NO: 24477 - RNA, 9879 nt, Artificial Sequence
  derived and/or modified CDS sequence (opt11) from DENV-1__GU131768__SS-prME
agcguaacgaugcuccucaugcugaugccaaccgcacucgcguuccacuugaccacuagggguggggaaccccauaugauugugacaaaacaagaacgagggaaaucgcuccuguuuaaaacguccgcaggagucaacaugugcacccuaauagcaauggaccugggggaacugugcgaagacacgaugacguacaagugcccaaggauuaccgaagcggagccggaugacguggacugcuggugcaaugcgacggauacaugggucacguacggaaccugcagccaaaccggcgaacauaggcgagacaagcgcagcgucgcccuagcaccccauguggggcuaggcuuagaaacgcggacugagaccuggaugagcucggaaggcgccuggaaacaaauccaaaggguggagaccugggcgcugcgccacccaggcuuuacagugauagcccuguuccucgcccaugccaucggcaccagcauuacccaaaagggaaucaucuuuauccuccucaugcuaguuacgccaucuauggccaugcgauguguugggaucggcucaagagacuucguggaggggcuuagcggggcgaccuggguagacgucguccuugagcacggcucaugcguaacaaccauggccaaggauaagccaacgcuggacauagaacuccucaaaacugaagucacuaaccccgcaguucuacggaagcucugcaucgaagcaaaaauaagcaacacgacaacugacucacggugccccacccaaggagaagccacguuaauggaggagcaagacgcgaacuucguaugcagacgcacguucguagacagaggcugggggaacgguugcggacucuuugggaaaggcucacuaauaacgugcgcuaaauucaaauguguaaccaaacuggaaggcaagaucgugcaauacgagaaucuuaaguauuccgugaucgugacaguccacacgggagaccaacaucaagugggaaaugaaucgacggaacacggcacaaccgcaacaauaacgccacaagcccccaccagcgagauucaauuaaccgacuacggagcguuaacucuugacugcagcccuaggacaggccuagauuuuaacgaaauggucuuguugacgaugaaagagaaauccuggcucguacacaaacaaugguuccuagaccuaccgcugccguggaccagcggagccagcaccucucaagagacguggaaccgccaagaucuccucguaaccuuuaaaacagcacacgccaagaagcaagaagucguaguacuaggaucacaagagggcgcgaugcacacggcgcugacaggggcuacugagauacaaacaagcgguacaacgaccauauuugcuggccaccugaaauguagacuuaagauggauaaacucacacucaaggggaugucguauguaaugugcacagguucauucaagcuagaaaaggaagucgcagagacgcaacacgguacaguacugguacaaaucaaguaugaagggacagaugcucccuguaagaucccauuuucaacacaagacgaaaaaggggugacacaaaauggcagacugaucaccgccaaccccaucguaaccgacaaagaaaaaccugugaacaucgaagccgaacccccguuuggggaaagcuauaucgugauaggcgcaggggaaaaagcccucaagcuaucgugguucaagaaaggcucauccaucggcaagauguucgaggcaacugcacggggagccaggcgaauggccauacucggggacacugccugggacuucgggucuguaggaggcguuuucacuucaguggggaagcuaguccaccagaucuucgggaccgcguacggcgucuuauuuucuggagugaguuggacgaugaagauuggaaucggugugcuccugacauggcugggcuuaaacucgcgcagcacuuccuugagcaugaccuguauagcggucggauuagucacgcuauaccugggggucaugguacaagccgacaguggcugcgucauuaauuggaaaggaagggaacuaaaguguggcucgggcauuuucgugacuaaugaagugcacacauggacagaacaauacaaguuccaggccgacagcccgaaaaggcucucagccgccaucggaaaggccugggaggagggggucugcggaauacgaagcgcuacaaggcuagaaaacaucauguggaaacagauauccaaugagcuaaaccauauauuguuagaaaaugacaugaaauucacugucguagucggagacgucguuggaauacucgcccagggcaagaagaugauaagaccacagcccauggaacacaaauauagcuggaaaucauggggaaaggcuaaaaucauaggagccgacguccagaacacaacauucauaauagacgggccaaacaccccggaaugcccugaugaccaacgcgcguggaacaucugggaagucgaagacuacggauucgguauuuuuacaaccaauauuuggcuuaaguuacgagacaguuacacgcaaguuugugaccaccgccucaugagcgccgcgauaaaagacagcaaggcaguacaugcggacaugggcuacuggaucgaaagcgagaaaaacgaaacguggaaacuagcccgcgccagcuucaucgagguuaaaacaugcaacuggccgaaaagccacacccuguggaguaacggcguacucgagucggaaaugaucauaccaaaaaucuauggaggcccgaucucacagcacaacuacaggccgggauacuuuacacagacagcgggccccuggcaccucggaaaacuggaacuagauuucgaccucugugaaggcaccacagucgucguggacgagcacugcggaaaucgagggcccucacuaaggacaacaacaguuaccgggaaaauaauucacgaauggugcugcagguccugcacacuaccaccacuacgcuucaaaggcgaagacggaugcugguacggcauggaaauaagacccguaaaggagaaggaagagaaucugguaaagucgauggugagcgcaggaagcggagaaguagacagcuucucguuaggguuauuauguaucagcauaaugaucgaagaagucaugagaagccgguggagccgaaaaaugcuaaugacgggcacccuagcaguauuccuauuacuaauuaugggccagcucaccuggaaugaccuaauccgacuaugcauaaugguaggagcuaacgcaucugacaggaugggaauggggaccacauaccuagcgcuaauggcuacauuuaagaugcgaccaauguucgccgucgggcuccuguuccgcaggcuuacgucccgagaaguauuacuacuuacuaucggccuuagccucgucgccucagucgaacugccaaauucucuggaagaacuuggcgauggucuagcaauggguauuaugauucugaaacuccuaacugauuuccagucucaccaacucugggccacgcugcugucgcuuacauuuauaaaaacgacacuaagccugcacuaugccuggaaaaccauggccauggugcucuccauuguaucccuauuuccacugugucuuuccacaaccucccagaaaacaaccuggcuaccaguguugcuggggucgcugggcugcaagccccucaccauguuccucaucacagaaaacaaaaucuggggacggaaaucauggccccuuaaugaagguauuauggccgugggcguagugucgauccucuuaagcagccuacugaaaaacgauguucccuuagcgggaccacugaucgccggcggcaugcugaucgcguguuaugucauaucggguagcagugcugaccucucauuggaaaaagccgcagaaguaagcugggaggaagaggcagagcacaguggggccucgcauaacauccugguagaggugcaagacgacggaacgaugaagaucaaagacgaggaacgagacgauacgcuaacaauacuccucaaagcgacccuauuggccguaucgggcguguacccacuaucgauaccugcaacacucuucguaugguacuucuggcagaaaaagaaacagagaucaggcguccuaugggacaccccauccccuccagaggucgaacgggcgguccuagacgacgggaucuaccguauuaugcaacguggccuccugggacggagucaggugggugucgguguguuccaagagaacguguuccacacaauguggcauguaacaagaggggcaguccucauguaccaaggaaaacgccuugagccguccugggccagcgugaagaaagaucuaauuagcuacggcgggggauggcgacugcaaggaagcuggaacaccggagaagaaguucaagucaucgcgguugaaccagggaagaacccgaaaaacguucaaacagcccccggcacauucaaaacuccggagggcgagguaggcgccaucgcgcucgauuucaaacccggaacgagcggaucgccgaucgugaaccgcgaaggcaaaauaguggggcuguacggcaauggaguuguaacuacguccggaacuuauguauccgcgauagcccaggcuaaagccagucaggaaggaccacuucccgaaauagaagacgaggucuucagaaaacgaaaucucacaauaauggaucuccacccaggcagcggaaaaacacgucgguaucuaccggccauaguucgggaggccaucaaacgcaaacucaggaccuuaauccuggcuccaacccgugucguggccagcgaaauggccgaggcccuaaagggaaugccgauacgcuaccaaacgaccgcgguaaaaucagaacacaccggaaaagaaauaguagacuuaaugugucacgccacauucacaaugagacugcucagccccguacgggugccuaacuauaauaugaucaucauggacgaagcacacuucacagacccaagcucaauagcugcaagggguuauaucagcacgcgagucgggaugggcgaggcugcagcaaucuucaugacagcgacaccacccgggagugucgaagcguucccccaaaguaaugcuguuauucaggacgaagaacgagacauccccgaacgaagcuggaacagcggcuaugaauggauaacagacuucccaggaaagacaguuugguucgugccgaguauuaagucgggcaaugauauagcgaacuguuugcguaaaaacgguaaaagaguaauccaauuaagucguaaaacguucgauacggaauaccagaaaaccaaaaauaacgauugggacuauguuguaacaacugacauaucagagaugggagccaauuuucgagcagaccgaguaaucgacccacgaagaugucugaagccaguaauccugaaggacggccccgagaggguuaucuuagcagguccaaugccaguuacgguggccagcgcagcccagcgacggggacguauaggccgaaaccacaacaaggaaggagaccaauauauauacaugggucaaccgcuaaacaacgacgaggaccaugcgcauuggaccgaagcgaagaugcucuuagacaacauaaacaccccagaaggaauaauacccgcccuguucgaaccagaaagagagaaaucagccgcuaucgacggggaguaucgacuccggggcgaagcccggaaaacauucgucgagcuaaugaggagaggggaccuaccaguauggcuaaguuacaagguagcgucggagggcuuucaguacuccgacagaagaugguguuucgacggcgaacgcaacaaccagguacucgaggagaauauggacguagagauuuggaccaaagaaggcgagcgcaagaaacugcggcccagguggcuagacgcacggaccuacagcgauccgcuagcccucagggaguucaaagaauuugccgcgggacgaaggagcguaucgggcgaccucauccuagagauugguaaacucccacaacaucuaacccaacgggcgcagaacgcacuggacaaccugguaaugcuacacaacagcgagcaagggggccgggcuuauagacacgccauggaagaacuaccggacaccaucgagacucuuaugcuauuagcgcugaucgcaguccuaaccgguggggucacacuauucuuccuaucaggccgcggacucgggaagacgagcauaggccucuuaugcgucauggcgaguagcgugcuccuguggauggcaaguguggaaccccauuggaucgcugcaucaauaauauuggaguucuuccucauggucuuacucauaccagaaccugacagacagagaaccccgcaagacaaucaacucgcauauguaguaaucggguuauuguuuaugauacucaccgucgccgccaacgagauggggcuccuugagaccacaaagaaagaccuagggauagggcacgucgcgguggagaaucaccaccacgcaacgaugcuugacguggacuuacacccagccuccgcuuggacacuauaugcaguagcgacaacgauaauaacgccaaugaugcggcacacaauagaaaacacaaccgcgaauauaucacucacugccauugccaaccaggcggcaauacucaugggucuugacaaaggcuggcccauaucgaaaauggacauaggcguuccgcugcucgcgcuaggcugcuauucacaaguaaacccacucacacugacagcggccguacuaaugcuaguggcccauuacgcaaucauaggcccagggcuccaggcaaaggcaacccgagaggcucagaaaaggacggcugcgggcaucaugaagaacccaaccguagacgggaucgucgcgauagaucucgacccgguaguguacgaugcaaaauucgagaaacaacucggucaaaucaugcugcucauacuaugcacgucgcaaauacugcucaugcgaacgaccugggcauugugcgaaucgauaacccuagcaacgggcccgcuaacgacacuaugggaaggaucucccggcaaguucuggaacacgaccauagccgugaguauggcgaacaucuuccgugggucauaccuagcaggggcugggcucgcguuuucccucaugaaaucccuaggaggagggcggagagggacaggggcacaaggcgaaacgcuaggggagaaauggaagcgacaacugaaccagcucucuaagagcgaguuuaacaucuacaaaaggagcggaaucauggaaguugacaggagcgaagcaaaagaggggcugaaaaggggagaaaccacccggcacgcggucucgcguggaacagccaaauugcgcugguucguggaacgcaaucuggugaagcccgaaggaaaagucauagaccuuggauguggacgaggaggcuggagcuacuauugcgcuggacuaaagaaaguaaccgaaguaaagggcuauacgaaaggcggaccaggucaugaggagccaauccccauggcgacauacgguuggaaccuggucaagcuccacucaggcaaagacguauuuuucacgccacccgagaaaugcgauacccuacuaugcgauauaggagaaucguccccaaacccaacaauagaagaaggaagaacccuaagaguucuaaaaaugguggaaccauggcugcggggaaaccaguucugcauaaaaauacucaaccccuacaugcccagcguagucgaaacacuggaacaaaugcagaggaaacauggagguaugcuaguucgcaacccgcugucgagaaauucgacccaugagauguacuggguaaguugugggaccgggaacauaguaucggcaguuaauaugacaucaaggauguuacucaauagauucacgauggcacaucgcaaaccgacguacgaaagagacguggaccugggagcaggaacaagacaugucgccguugagccagaggucgcaaaccuggacaucaucggccagaggauagagaauauuaaacaugaacacaaaucaacauggcacuacgaugaggauaacccauacaagaccugggcguaucauggcuccuacgaggucaaaccguccggcagcgcauccuccauggucaauggcguugucaaacuacuaaccaagccgugggaugucauaccaaugguuacccaaaucgcgaugacagacacgacgccauucggacaacaaagggucuucaaagagaaaguagauaccaggaccccgaaagcaaagcgaggaacagcacagaucauggaggucaccgcgcgauggcuguggggauuuuugucgcgaaacaagaaaccgaggauaugcacgcgcgaggaguucacccgcaaaguacgcagcaacgccgcaauuggcgccguuuucguggacgaaaaccaguggaacagcgcaaaagaagcagucgaagacgaaagauucugggaccucguuaagaaagagcgagaguuacacaagcagggcaaaugcgcaacaugcguguacaacaugauggggaaacgagagaagaaacucggagaguucggcaaggccaagggaagccgagcgauuugguacauguggcugggugcucgcuucuuggaguucgaagcacugggcuucaugaacgaggaccauugguuuucccgcgaaaauucacucagugguguugaaggcgaaggacuacauaaguugggguacauccuaagagacauaagcaagauaccaggagguaacauguacgcagacgacacugcugggugggacacccgcaucaccgcggacgaccuucaaaacgaagcgaagaucacggauauuauggaacccgagcacgcacuacuugcaacuucuaucuucaagcucaccuaccagaacaagguaguccgaguucaacguccugccaagaacgguaccguaauggacgugauuucacgaagagaccaacgagggaguggacaagucggaacauauggacucaacacguucacuaacauggaggcccaacuaaucagacagauggaguccgaaggcauauuccuaccaucugaacuggagacacccaaccuggcggaacgagucuuagauugguuagaaaaauacgggguugagagacugaaacgcauggcuauaucaggagacgauuguguggucaagccaauagacgaucgguuugcgacggcacuaacggcucucaacgacaugggaaaaguccguaaggacauuccgcaaugggaaccaagcaaaggauggaacgauuggcaacagguacccuucuguagucaccacuuccaccaacuuauuaugaaagaugguagggaaauaguaguacccugccgaaaccaagacgagcucgugggacgcgccagagucagccaaggcgcgggguggucacuaagggagacugccugccuagggaaaagcuacgcacagauguggcaacucauguacuuucaccgacgagaucuccgacuagcagcaaacgcaaucuguagcgcggucccaguggacuggguaccgacuucucgaacuaccuggagcauacacgcacaucaccaauggaugaccacagaagacauguuaagcguauggaaccguguuuggaucgaggagaauccuuggauggaagacaagacccacguaagcucguggggagacgucccauaccuggguaaaagggaagaccagugguguggcagucuaauuggccucaccgcgagagccaccugggccagcaacauccaaguagcgauaaaccagguacgucggcucauagguaaugaaaacuaccucgacuauaugacauccaugaaacgguucaaaaacgaaggagacccggaaggggcucugugguag

SEQ ID NO: 24478 - RNA, 9879 nt, Artificial Sequence
  derived and/or modified CDS sequence (opt11) from DENV-1__GU131770__SS-prME
ucggugaccaugcugcucaugcugaugccuacggcccuggccuuccacuuaaccacccggggaggagaaccccacaugauugugagcaagcaggaacggggcaagagccugcuuuucaaaacgagcgccggggucaacaugugcacccucaucgcuauggaucucggcgagcugugcgaggacacuaugaccuacaaaugcccccggauaaccgagaccgagccagacgacguagacugcuggugcaacgccacggacaccugggugaccuacgggacguguagccagacuggcgagcaccguagagacaagcgguccguggcccucgcgccucacguuggccuggggcuggagacccggaccgagaccuggaugagcuccgagggcgccuggaagcagauccaaagagucgagacgugggcacuccgccaucccggguuuaccgucaucgcccuguuccuggcacacgcgaucggcaccucaaucacccagaaggggaucaucuucauacuacugaugcuggugacaccgucuauggccaugagaugugugggcaucggcagccgagacuucguggaagggcucucgggcgccaccuggguggacgucguacuggagcacgggagcugcgugaccacuauggccaaggacaagccaacgcuggacauugagcuucuaaaaaccgaggucaccaaccccgcugugcugcggaaacucugcaucgaagcgaagaucucgaacacgacgaccgacagccgcugcccgacccagggcgaggcgacccugguggaggagcaggacgccaacuuugucugccgccggaccuuuguggaucggggcugggggaacgguugcgggcuguucgggaaggggucccucaucacgugcgccaaguucaagugcguuaccaaacuggagggcaagaucguccaguacgagaaccugaaguauagcgugaucguaaccguccacacuggcgaccagcaccagguagggaacgaguccaccgagcacggcacaacagcuacgaucacgccacaagcgcccaccacugagauccagcucaccgacuacggggcccugacgcuugacugcagcccgaggaccggccuggacuucaaugagaugguccugcugacuaugaaggagaagucuuggcucgugcacaagcagugguuccuggaccuacccuuaccauggaccagcggggccaguacgucccaggagaccuggaaucggcaggacuuauuaguuacauucaagacagcccacgccaaaaagcaggaggugguggugcuugggucgcaagaaggcgcuaugcacacggcacugaccggggccaccgaaauccagaccuccgguaccaccaccaucuucgccgggcaccugaagugucgccucaaaauggacaagcugacccugcggggcaugagcuacgucaugugcacggguuccuucaaauuggagaaggagguugccgagacccagcacggcaccgugcugguccagaucaaguacgagggcaccgacgcgccauguaagauccccuucucaacgcaggaugaaaagggggugacccagaacggccgucugaucacugccaacccgaucgugacggacaaggagaagcccgugaacaucgaagcagaaccgcccuucggggagucuuauauagugaucggugccggagagaaggcgcugaagcuaaguugguucaagaaagggucaucgaucggcaagauguucgaggccacggcccgcggggcccgacgcauggccauccucggcgacaccgccugggacuucggauccaucggcggcguguucacuagcgucgguaagcuagugcaucagaucuucggcacggccuacggggugcuauucucaggcgucagcuggacgaugaagaucgguaucggcgugcuacuaaccuggcucggccugaacuccagaucuaccucccuuagcaugaccugcaucgccgugggccucgucacgcuguaucugggcgugaugguucaggcggauucugggugcgucauaaacuggaagggccgcgaguuaaaaugugguaguggcaucuucgugacaaacgaaguacauaccuggacugaacaauacaaguuucaggccgacagcccgaagcgguuguccgcugccauaggcaaggcuugggaggagggggucugcggaauccgcagcgcuacccggcucgagaauauuauguggaagcagauuucuaacgagcucaaucacaucuugcuggaaaacgauaugaaguucaccgugguggugggggacguggccggcauccucgcccaagggaagaagaugauccgcccacagcccauggaguacaaguacaguuggaaguccuggggcaaggccaagaucaucggcgccgacgugcaaaacacaacguuuaucauugacggaccaaacaccccggaaugcccagacgaccagcgggccuggaacaucugggaggucgaagacuacggguucggaaucuuuacgaccaacaucuggcuuaagcugcgcgacagcuacacccaggugugcgaccaccgcuugauguccgcggccaucaaggauucgaaggcagugcacgcggacaugggcuacuggaucgagucagagaagaacgagacuuggaaacuggcccgcgcgaguuucaucgaggucaaaacgugcaucuggcccaagucucacacccuguggagcaacggcgugcucgaguccgagaugaucaucccaaagauuuacggcggcccgaucagccaacauaacuacagacccggguacuucacccagacugccggcccauggcaccuggguaagcuggagcucgacuucgauuuaugcgaggggaccacaguggucguggacgaacauugcggaaaccgcgggccgucccuucggaccacgacggugacuggaaagauaauccaugaguggugcugccgcagcugcacucugccaccccuccgguuucgcggggaggacggcugcugguacgguauggaaauacggccugucaaggagaaggaagagaaccuggugaaguccauggugagcgcgggcagcggggagguugacuccuucagccucgggcugcugugcaucuccauaaugaucgaagaggugaugaggagccgguggucccguaagaugcucaugaccgggacgcuggccguguucuuccugcucaucauggggcagcugaccuggaacgacuugaucagauuaugcaucauggucggcgcaaaugcgagcgaccggauggggaugggaacuaccuaccuggcacugauggcuacguucaagauccgcccgauguucgccgucggcuuacuguuccgacgccugaccucccgggaggugcuccugcuuaccauaggucucagccucguggccuccguggagcugccgaacagccucgaggaacugggcgacgggcuggcgaugggcauuaugaucuugaagcuccucaccgacuuccagucccaccagcucugggccacgcugcuaucacuuacauuuauaaagacaaccuucucccugcacugcgccuggaagacuauggcaaugguccucagcauugugagccucuucccgcuaugccuuagcacuaccucccagaagacaacguggcuccccguccuacugggcucuuuggguugcaagccgcugaccauguuccugaucgcugagaacaagaucugggguagacgaucuuggccgcucaaugagggaaucauggccgucgggaucgugagcauccuucugagcucccuccugaagaaugaugugccccuggccggcccccuuaucgccggcggaaugcugaucgcgugcuacgucaucagcggguccucggcugacuuguccuuagagaaggccgcggaagugagcugggaggaagaggcggagcacucgggcgccagucacaacauccugguggagguccaggaugacgggaccaugaaaauaaaggacgaggagcgcgacgacacccugacaauccuccucaaggcuacguuacucgcagugucgggcgucuacccacugaguauccccgccacucuguucgucugguacuucuggcagaagaagaagcaacgguccggaguguuaugggacacccccagcccgccagagguugagcgagccguacuggacgacgggaucuacaggaucaugcagcgcggccugcuugggcggucccaggucggcguagggguguuccaagagaacguguuccacaccauguggcaugucacgcgcggcgcugucuuaauguaccaggggaagcggcuugagcccagcugggcguccgucaagaaagaccugaucagcuacggcggcggauggcgccuccaggguuccuggaacaccggggaggagguccaggucaucgccguggagcccgggaaaaaucccaagaacgugcagaccgcgcccggaaccuucaagacgccggagggcgaggucggcgccaucgcccuggacuucaagcccgggaccagcggcagucccauagugaaccgggaagggaagauugugggccuguacgggaacggggucgugaccaccagcggcacguacgugagcgcgaucgcgcaggccaaggcuucccaggaggggccgcuccccgaaaucgaggaugaggucuuucgcaagcggaaccucaccaucauggauuugcaccccggcagcgggaagacccgcagauaccugccggcgaucgugcgcgaggccaucaagcguaaguugcgcacacugauacucgcccccacgcgcguggucgccuccgaaauggcggaggcgcugaaggggaugccgauacgauaccaaacgaccgcgguaaagagcgagcacaccggcaaggagaucguggaccugaugugccacgccacguucaccaugcgucuccucuccccaguccgggugccaaacuacaacaugauaaucauggacgaggcccacuucaccgaccccucuucgaucgccgcgcgcggguauaucaguacccgggugggcaugggagaggcggccgccaucuucaugacggccacgccgcccggcuccgucgaggcauucccgcaaagcaacgccgugauucaggacgaggagcgugacaucccagagagaucguggaacucaggauacgaguggaucaccgacuuccccggcaagaccgugugguucguccccuccauaaagucagggaacgacaucgccaacugccugcggaagaacgggaagcggguuauccagcucucacgcaagacguucgacaccgaguaccagaagaccaagaacaaugauugggacuacguaguaacaacggacaucagcgagaugggagccaacuuccgggcggaccgcgugauagacccacgacgcugccugaagcccgucauccugaaggacgggccggagcgggucauccucgccggccccaugccagugaccgucgcauccgccgcacagcgccgggggagaaucgggcgcaaccacaauaaagagggugaccaguacaucuacauggggcagccccugaacaacgacgaagaccacgcgcauuggacugaagccaagaugcugcucgacaacauaaacacccccgagggcauaauacccgcccuguuugagccggagcgggagaaguccgccgccauagacggggaguaccgccugcgaggcgaggcgcguaagacguucguagaauuaaugcggcgcggggaccugcccguguggcuguccuacaaagucgccagugagggcuuccaauauuccgaccggcgcuggugcuucgauggcgagcggaauaaccagguguuagaagagaauauggauguggagaucuggaccaaggagggagagcggaagaaacugcggccccgguggcuggacgcccggacguacuccgacccccucgccuugcgcgaguucaaagaguucgccgccggucgccgcuccgucuccggggaccugauccuggagaucggcaagcugccgcagcaccugacccagcgggcccagaacgcccucgacaaccuggugauguuacacaacagcgagcagggcgggcgcgccuaucggcacgcuauggaggagcuccccgacacgaucgagaccuuaaugcugcucgcgcuuaucgccguccugacgggcggggucacccucuucuuccuauccggccgcgggcuaggaaagaccagcauugguuuacugugcgugauggccucuagcgugcugcucuggauggccuccguagagccccacuggaucgccgcgagcaucauccuggaguucuuccuaaugguucuccugauccccgagccggacaagcagcggacaccccaggacaaucaacuggccuacguuguaaucgggcuccuguucaugaucuugacgguggccgccaacgagauggggcuccuggagaccaccaagaaggacuuaggcauaggccacguugcuguggagaaccaccaccacgccgccaugcucgauguggaccugcaccccgccuccgcauggacgcucuacgcggucgccaccaccaucauaaccccuaugaugcgccacacgaucgagaacaccaccgcgaacaucuccuugacagcgaucgccaaccaggcagccauacugauggggcuagacaaaggcuggcccaucuccaagauggacauuggcgucccccucuuggcucuggggugcuacagccaggugaauccccucacacuaaccgccgcagugcugaugcucguugcccacuacgcaaucaucggacccgggcugcaggccaaggcgacccgcgaagcgcagaagcggaccgccgccgggaucaugaagaaccccacgguggacgggaucguagccaucgaccuggaccccgucguguacgacgcuaaguuugagaagcaacucggccagaucaugcugcuuauccucugcaccucgcagauccugcucaugcguacaaccugggcucucugcgagaguaucacacuggccaccggcccccugaccaccuuaugggagggguccccgggcaaguucuggaacacgacuauugcggugaguauggcgaacaucuuccggggguccuaccuggccggagccgggcuggccuucagccucaugaagucccucgggggcggucggcgggggacuggggcccaaggggagaccuuaggcgagaaguggaagcggcaacuaaaccagcuguccaagagcgaguuuaauacuuauaagcgguccgggaucauggaggucgaccgguccgaggccaaggagggccugaagagaggggaaaccaccaagcacgcggugucacgcggcaccgcgaagcuccggugguucguggaacgcaaucuggucaagcccgaggggaaggugaucgaccuggggugcggucgcggaggauggaguuacuacugcgccggguuaaagaaagugacggaggucaagggguacacuaaaggagggcccggucaugaggaacccaucccgauggcgaccuacggguggaaccucgugaagcugcauuccgggaaggacguguucuucaucccgcccgagaaaugugacacccugcucugcgauauuggggagagcucccccaacccgacgaucgaggagggcagaacccugcgggugcugaagaugguggagccuuggcuccgcgggaaccaguucugcaucaagauucugaaccccuacaugccuucgguggucgagacgcuggagcagaugcagcggaagcauggcggcaugcucgugaggaacccgcugucgcggaauagcacgcacgagauguauuggguguccugcgggaccgggaauaucgucagcgccgugaacaugacaagucguauguugcucaacagguucaccauggcgcaccggaagccuaccuaugagcgcgacguggaccucggggccgguacccgacacgucgccguggaacccgagguggccaaccucgauaucaucggccagcgcaucgagaacaucaagcacgagcacaagucuacguggcacuacgacgaggacaaccccuacaaaaccugggcauaccacggguccuaugagguaaagccgucugguagugcuagcaguauggugaacggggucgugaaauugcugaccaagcccugggauguaauccccauggucacccaaaucgcgaugaccgacaccaccccuuuuggccagcagcgaguguuuaaggaaaaggucgacaccaggacgccaaaagccaagcgggggaccgcccagaucauggaggucaccgccaaguggcuguggggcuuccuuucccgcaacaagaagccccggaucugcacccgcgaggaguucacgcggaagguucgcagcaacgcggccaucggcgccguguucguugaugagaaucaguggaacuccgccaaggaggcgguggaggacgagcgguuuugggaccuggugcacagggaacgagagcuccacaaacagggcaagugcgcgaccugcguuuacaacaugaugggcaagcgcgagaagaaauugggugaguucggaaaggccaaaggcagccgggccaucugguauauguggcugggcgcccguuuucuggaguucgaggcgcucggcuucaugaacgaggaccacugguuuucccgugagaacagccugucgggaguagagggcgaggggcugcacaaacucggcuacauccugcgcgacauaagcaagaucccugggggcaacauguacgcugacgacaccgcagguugggauacccggaucacugaggaugaucuucagaacgaggcccgcaucaccgacaucauggagccggagcacgcccugcuggcuaaguccaucuucaagcugaccuaucagaacaaggugguccgggugcaacggcccgccaagaacgggacugugauggacgugaucagcagacgggaccagcgcgguuccggccagguuggcacguauggccucaacacauucacuaauauggaggcccagcuaauucggcaaauggagagcgagggcaucuucuccccgagugagcuggaaacuccgaaccuggccgaacgcguccuggacugguuagagaaguacggcgucgagcggcuaaagaggauggccauauccggggacgacugcgugguuaagccgaucgacgaccgguucgcgacggcccuuaccgcccugaaugacaugggcaagguccgcaaggacauaccacaaugggagcccucaaagggguggaacgacuggcaacaaguccccuucugcucccaccacuuccaccaacucauaaugaaggacggccgugagaucguggucccgugcagaaaccaggacgagcuggugggacgggcccgagugagccagggggccggcuggucacuccgggagaccgcgugccuggggaaaagcuacgcucagauguggcagcugauguauuuccaccgccgggaucugcgucucgccgccaaugcgaucugcagcgcggucccaguggacuggaucccaaccucccggacaaccuggagcauccacgcccaccaccaguggaugacgaccgaagacaugcuguccguguggaaccgcgucuggauagaggaaaaccccuggauggaggacaagacgcauaucagcucuuggggcgacgugccguaccugggaaaacgcgaagaucaguggugcggcaguuugaucggauuaacugcccgggccaccugggcgaccaacauccagguggccaucaaccagguccgccggcuuaucgggaacgagaacuaccuagacuacaugaccuccaugaaacgcuucaagaacgaaagcgauccagagggggccuugugguag

SEQ ID NO: 24479 - RNA, 9879 nt, Artificial Sequence
  derived and/or modified CDS sequence (opt11) from DENV-1__GU131773__SS-prME
agcgugaccaugcuguugaugcugaugcccacagcccuggcuuuccaccucacgacccgggguggcgagccccauaugauugugagcaagcaggagaggggcaaaagccugcuguucaagacuuccgccgggguaaacaugugcacccucaucgcgauggaccuaggcgagcucugcgaggacaccaugaccuacaagugcccccgaaucaccgaggccgagcccgacgacguggacugcuggugcaacgccaccgacacgugggugaccuacgggacaugcagccagaccggcgagcauagaagggagaaaaggucuguggcucucgcuccucacgugggccuggggcuggagacgcggacggagacuuggaugucauccgaaggcgccuggaaacagauccagcgcguggagaccugggcacuccgucaccccggguucacggugaucgcccuguuucuggcucacgccaucggaaccucuaucacccagaaggggaucaucuucauccuccugaugcugguaacucccagcauggccaugcggugcgucggcaucggcagucgggacuucguggaggggcuauccggcgccacguggguugacgucgugcuggagcacgggagcugcguaaccaccauggcuaaggacaagcccacccuggacaucgagcuccugaagacagaggucaccaaccccgcagugcugcguaagcucugcaucgaggccaagaucuccaacaccaccacggauagcaggugcccgacacagggcgaggccacccugguggaggagcaggacgccaauuucgucugucggcgcaccuucguggaccggggcuggggcaacggcugcgggcuguucggcaaggguucucuccugacgugcgccaaguucaaauguaugaccaagcuggagggaaagaucgugcaguacgagaaucucaaguauagcgucaucgugacagugcacaccggcgaccagcaccaggucgguaacgaauccaccgaacacggcaccaccgcgacgauuacuccucaggcccccaccacggaaauccagcugaccgacuauggggcccugaccuuagacugcagccccaggaccggucuggacuucaaugagaugguguugcucaccaugaaggagaaguccuggcugguucacaagcagugguuccuggaucuaccccugcccuggaccagcggggccagcaccucccaggagaccuggaaccggcaggaccugcucgugaccuucaagaccgcccacgcgaagaaacaggagguggucgugcugggaagccaggagggcgccaugcacacggcacugacgggggcuaccgagauccagaccucggguaccacaacaauuuucgccggucaccugaagugccgucugaagauggacaagcugacccuuaagggcaugagcuacguuaugugcacaggguccuuuaagcuagagaaagaggucgcggagacgcagcacgguaccgugcuggugcagaucaaguacgagggcacugacgcgcccugcaagauccccuucagcacucaggacgaaaaggggguaacgcagaauggccggcugaucaccgccaacccgaucgugacagacaaggaaaagcccgugaacaucgaggccgagccgcccuucggggagucuuacaucgucaucggggcuggggagaaggcccucaagcugagcugguucaagaaggggagcucaaucggcaagauguucgaggccaccgcccgcggggcgcggcgcauggcgauccucggcgacacggccugggacuucggguccaucggcggcguguucaccagcgucgggaagcucguucaccagaucuucggcaccgcuuacgggguccuauucaguggcgugagcuggacaaugaaaaucgggaucgggguccugcucacgugguugggccugaauucccgcucaacguccuuaucgaugaccugcauugccguggggcucgugacccuguacuuaggcgucauggugcaagcggacuccgggugcguuauuaacuggaagggcagggagcugaagugcgggagcggcaucuucgucacgaaugagguacacaccuggacggaacaguacaaguuccaagccgacagcccgaagcgacuauccgcggccauaggcaaggccugggaggaggggguguguggcauccggagcgccacccgccucgagaacaucauguggaagcagauauccaacgagcugaaccacauccugcuugagaacgauaugaaguucaccgucguggugggggacgucgcgggcauccuggugcagggaaagaagaugauccgaccccagccgauggaguacaaguacaguuggaaguccuggggcaaggccaagaucaucggcgcugacguucagaacagcacguucaucaucgacgggccgaacaccccggagugucccgacgaccagcgcgccuggaacaucugggaggucgaggacuacggcuucgggaucuucaccaccaacaucuggcugaagcuccgggacuccuacacccaggugugcgaccaccgccucaugagcgcggcuaucaaggacuccaaggccgugcacgccgacaugggcuacuggaucgagagcgaaaagaacgagacauggaagcuggcccgggcgucuuucaucgaggucaagacgugcaucuggccuaaaagccauacccucugguccaacggagugcuggagucggaaaugaucauucccaagauccauggcggcccgaucucccagcacaacuaccgccccggguacuucacgcagacagcgggcccauggcaccuggguaaacucgagcuggacuucgaccugugcgagggcaccaccguggucguggacgagcacugcggcaaccgggggccgagccucagaaccaccaccgucaccggaaagaucauccacgagugguguugucgguccugcacuuugccgccccugagguuucgcggggaggacggcugcugguacgggauggagauucgccccgugaaggagaaggaggagaaccuggucaagagcauggugagcgccggaagcggcgagguggacagcuuccuguuggggcuccuuugcaucucgaucaugaucgaggaaguuaugagaagccgauggucccggaaaaugcugaugaccggcacccucgccguguuuuuucugcugaucaugggacagcucaccuggaaugaccugauccgccugugcaucauggucggcgcaaaugcgagcgaccgcaugggaaugggcacgaccuaccucgcccugauggccaccuucaagaugcggccgauguucgccgugggccugcuguuucgccggcugacuucccgugaggucuuacuccugacgaucgggcugagccucgucgcaagcguggagcugcccaauagccuggaggagcuaggagauggucuggcuaugggcaucaugaucuugaagcuucuuaccgacuuccaguccuaccagcugugggcgacccuccugucacugaccuucaucaagacgacguucucucuccacuacgccuggaaaacaauggccaugguccugagcaucgugucgcuguucccucucugccugagcaccacaucccaaaagaccacguggcugccggugcuccugggcucuuuagggugcaaaccgcucaccauguuccugauugcggagaauaagaucuggggccggaaguccuggccccuuaacgaggggaucauggccguugggaucgugagcauuuuacugagcucccuguuaaagaacgacgugccccuggccgggccucugaucgccggcggcaugcucaucgccugcuacgucaucagcgguuccagcgcggacuuaucacuggaaaaggcugccgaggucagcugggaggaagaggccgaacacuccggagccagccacaacauccucguggaaguccaggacgacgggacaaugaaaauaaaggacgaggagagggacgacacccugaccaucuuacucaaggccaccuuauuggccguguccggcguauacccgcucagcaucccagccacccucuucgucuggcacuuuuggcagaagaagaagcagcggagugggguguuaugggacacgccuagcccgcccgagguggagcgcgccguccuggacgauggcaucuaccggaucaugcagcgcggccuccugggccggagucaaguggggguaggggucuuccaggagaacguauuccacaccauguggcacgugacucgcggcgccguccugauguaccaggggaagcgccucgaacccuccugggcgagugugaagaaggaccugaucagcuacggcggcggguggcgcuuccaggguuccuggaacaccggcgaagaggugcaggucaucgcgguggagcccggcaagaacccaaagaacgugcagacggcccccggcaccuuuaagacccccgagggcgaggugggugccaucgcgcuagacuucaagccagguacgagcggaucucccauaguuaaccgggaggggaagauugugggccucuacgggaacggcgucgugaccacaaguggcaccuacgugucagcgaucgcacaagcgaaggccucccaggaggggccgcugcccgagaucgaggacgaggucuuccgcaagcggaaccugacgaucauggaccuccaccccggcagcgggaagacgcgccgguaccugccugcgaucguacgcgaagcaauuaaacggaagcugcgcacguugauccuggcacccacccgaguggucgccuccgagauggccgaagcgcugaagggcaugccgauccgguaccagaccaccgccgucaagagcgagcacaccgguaaggaaaucguugaucucaugugccaugcaaccuucaccaugaggcuacugucccccguccgggugccgaacuacaacaugaucaucauggacgaggcccacuucacggaucccagcuccaucgccgcgcgcgguuacaucagcacccgggugggcaugggugaggccgcugccaucuucaugaccgccaccccgccagguuccauggaggcguucccgcagagcaacgccgucauacaagacgaggagcgcgacauccccgagcggucguggaacagcggauacgaguggaucacggacuuccccggcaagaccgugugguucgugccuuccaucaaggccgggaacgacaucgcaaacugccuccgcaagaacgggaagcgggucauccagcuaagccgaaagaccuucgacaccgaguaccagaagacgaagaacaacgacugggacuacguggugaccaccgacaucagcgagaugggggcgaacuuccgggccgaccgcgucaucgacccgcggcgcugccugaagcccgugauucucaaggacgggcccgagcgggugauauuagcgggccccaugccuguuaccguggccagcgccgcgcagcguagggggcgcauaggccguaaccacaacaaggagggcgaccaguacaucuauauggggcaaccccugaacaacgacgaagaccacgcccacuggacggaggccaaaaugcuguuggacaacaucaauacccccgagggcaucaucccagcgcuguucgaaccggagcgcgagaaguccgccgcgaucgacggggaguaccgccuccggggcgaggcucgcaagaccuuugucgaacugaugcggcgcggggaccuacccguauggcucagcuacaagguggccucagagggcuuccaguacagcgaccggcgcuggugcuucgacggggagcggaauaaccagguccuggaggagaacauggacgucgagaucuggaccaaagagggggagcgcaagaagcugcggcccagaugguuggaugcccggacguacagugacccccuggcccugcgcgaguucaaggaguucgcggcgggccggcgcucugugagcggggacuuaaucuuagagaucgguaagcugccgcagcaccucacccagcgggcccagaacgcccuggacaaccucgucaugcuccacaacuccgaacagggcgggcgcgcguaccggcacgccauggaagagcugcccgauaccaucgagacccugauguugcuugcacugaucgccgugcucacgggcgggguuacccuauucuuccugucggggaaaggacucggcaagaccuccaucggccugcucugcgucauggccagcuccgugcuguuguggauggcaagcgucgagccccacuggaucgccgccuccaucaucuuagaguucuuccucauggucuugcucauaccagagccggaccgccagaggacgccgcaggacaaccagcucgcguacguggucaucgggcugcuauucaugauuuugaccgucgcagccaacgagaugggccugcuggaaacgaccaagaaggaccucgggauaggccacguggcaguggagaaccaccaccacgccgccaugcuugacgucgaccugcauccugccuccgcauggacccucuacgccguggccaccacgauaauuaccccgaugaugcgccauaccaucgagaauaccacggcuaacaucagcuuaaccgccaucgcaaaccaggccgccauccuaaugggacuggauaagggcuggcccaucagcaagauggacaucggggugccccugcuggcccucgggugcuacagccagguuaacccccugacccugaccgcggccgugcucaugcuuguggcccacuaugccaucauuggcccggggcugcaagccaaggcaacccgggaggcccagaagcgcaccgccgccggcauuaugaagaaccccaccaucgacgggaucgucgccaucgaucucgaccccgucguguacgacgcgaaguucgagaagcagcugggccagaucaugcugcucauccuguguaccagccagauccugcucaugcgcacgacaugggcccugugcgaauccauuacccuggcgaccggccccuugacaacgcuaugggaggggagcccgggaaaguucuggaacaccaccaucgcggucuccauggccaacaucuuccggggaaguuaccuagccggagcgggccucgcguucuccuugaugaagucccucgggggcggccgccgggggacaggggcccaaggcgagacacucggagagaaguggaagcgccaguuaaaccagcugucuaagucugaguucaacaccuacaagcggagcggaaucauggagguggaccgcuccgaggccaaggagggcuuaaagcguggggagaccacaaagcacgccgugucccgcggcaccgccaaacugcguugguuugucgagcgcaaccuggugaagcccgaggggaaggugaucgaccuuggcugcggccgcgguggcugguccuacuauugugcagggcucaaaaaggucacagaggugaagggcuauaccaaaggcgggcccgggcacgaggaacccaucccgauggccacguacggguggaaccuggugaaacuacacagcggcaaggacgucuucuucaucccacccgagaagugcgacacacuccugugcgauaucggggaguccagcccaaacccaacaaucgaggaaggccguaccuuacgggugcucaagaugguggagccauggcugagagggaaucaguuuugcaucaaaauucugaaccccuacaugcccuccgucguggagacccucgaacagaugcagcgcaagcauggcggcaugcugguacggaacccccucagccggaauuccacgcacgagauguacugggucagcugcgggaccggaaauaucguuuccgccgucaacaugaccagccgcaugcuccugaaccgguucaccauggcgcaccgcaaacccacguacgagcgcgacguggaccugggugccggcacccgucacguggccguggaacccgaggucgcaaaccucgauaucauaggccagcgcaucgaaaacaucaagcacgagcacaagucgaccuggcacuacgaugaggacaaccccuauaagacuugggcauaccacgggucguacgaagugaagccguccggaagcgccuccagcauggugaauggggucguuaagcugcugacgaagcccugggacgugauccccauggugacccagauagccaugaccgacaccacgcccuucggccagcaacggguguucaaggagaagguggacacccgcacuccgaaggccaaacgggggacggcucaaauuauggaggugacggcgcgguggcucuggggguuccugagccgaaacaagaagccccgcaucuguacccgggaggaguucacccgcaaggugcguaguaacgcugcgaucggcgccgucuucguggaugagaaccaguggaacucugcgaaggaagccguagaggacgauagauuuugggaccugguucauagagagcgcgaacuccacaaacaggggaagugugcgaccugcguguacaauaugaugggcaagcgggagaagaagcugggggaauucggcaaagccaaggggucccgggccauaugguauauguggcugggggcacgguuccucgaguucgaagcgcugggcuucaugaacgaggaccauugguucagccgugagaauuccuuaagcgggguggagggugagggguuacacaagcugggcuacauccugcgcgacaucagcaagauuccuggaggcaacauguacgcggacgacacagccggcugggauacgagaauaaccgaggaugaccuccagaacgaggccaagaucaccgacauuauggaaccggagcacgcgcugcucgcaaaaagcaucuucaagcucacguaccagaacaaggucgugcgggugcagcgccccgccaagaacggcacugucauggacgugaucucccgccgggaccaacgcggcagcgggcagguggguaccuacgggcugaacaccuucaccaacauggaggcccagcugauccgccaaauggagucggaggggaucuucuuacccaaugagcuggagacccccaaccuggccggccgcguccucgacuggcuggagaaguacggugucgagagauuaaagcgcauggcgaucucaggggacgacugcguggucaaacccaucgacgaccgguucgccaccgcccucaccgccuugaacgauauggggaaggugcgcaaggacaucccccagugggaacccucaaaggguuggaacgauuggcaacagguccccuucugcucgcaccacuuccaccaacugaucaugaaggacggccgugagaucguagugccaugucgcaaccaggacgaacucguggggcgcgcccgcgugagccagggugcgggguggagccugagagagacggccugccugggcaagagcuacgcucagauguggcaguuaauguacuuccaccgccgggaccuacgucuggccgcaaaugccaucugcucugcagugcccguggacuggguccccaccagccgaaccaccugguccauccacgcccaccaccaguggaugacgacugaggauaugcucagcguguggaaccgcguguggaucgaggagaaccccuggauggaggacaagacccgaaucuccagcugggaggaugucccguaucuggggaagcgcgaggaccagugguguggaucccugaucggccuuacggcccgcgcgacgugggcaacgaacauccaggucgccaucaaccaggugagacgccugaucgggaacgagaacuauagcgacuacaugaccuccaugaagcgguuuaagaacgaaagcgagcccgagggcgcccugugguga

SEQ ID NO: 24480 - RNA, 9879 nt, Artificial Sequence
  derived and/or modified CDS sequence (opt11) from DENV-1__GU131775__SS-prME
ucagucaccaugcugcugaugcucaugccgacagcacuggccuuccacuugaccacucgcggaggggaaccgcacaugauuguuaccaaacaagaacgcggaaaaagccuccuguuuaagacgagcgcaggcgugaacauguguacuuuaauagcgauggaccuuggagaacucugcgaagacaccaugacauacaaaugccccaggaucaccgaagccgaaccugacgauguggacugcuggugcaacgccacggauaccuggguaacuuacggcacaugcagucagacgggagagcauagaagagacaaacgcagcguugcacuagccccacacgucggacucggccuagaaacucggacugagacguggaugucauccgagggcgcauggaaacaaauacagcgcguagagacgugggcacuaagacacccaggauucacagucauagcccucuuucucgcucacgccauuggaaccucgauaacacagaaggggaucaucuuuauccuucucaugcucguaacucccaguauggcgaugaggugcgucggaaucggcagccgggacuucguagaagggcuaucaggagcgaccuggguggacgucguacucgaacacggaucgugcgucacuaccauggcaaaagauaaaccuacccuugacaucgaacucuuaaaaacagaagucacgaauccagcaguacuccggaaauugugcaucgaggccaagaucagcaacacuacaacggauucuagaugcccaacccagggagaagccacgcugauggaggagcaagacgcaaacuuugucugucgucggacguucguggaccgcggcugggggaacgggugcggccucuucgggaaaggcucacucaucacaugcgccaaguucaaguguguuacaaaacuagaaggcaaaaucguccaguacgagaaccuuaaguacagcguggucgugaccguacacaccggggaucaacaucaggucggaaacgagagcacagaacacggcacgacugcaacaauaaccccacaagcacccacaucggaaauacaacuaacggacuauggcgcccucacgcuugauugcagccccagaaccggccuagacuucaacgagaugguacuacuaacgaugaaggagaaguccuggcuaguacacaaacagugguuccuagaucugccuuuaccguggacaagcggagcaaguacgucacaagaaacauggaacaggcaggaccucuuagucacguuuaaaacggcacaugccaagaaacaagagguugugguccuagguagccaagaaggggccaugcacacggcccugacaggggcgacagagauacagacaucaggcaccacaacaauuuuugccgggcaccugaagugccgguuaaaaauggauaagcuaacacucaagggaaugagcuacgucaugugcaccggcagcuucaaacucgaaaaagaaguugcagagacccaacacggaacaguccuaguacaaauuaaguaugaagggacggacgcacccugcaaaaucccauucaguacacaagacgagaagggcgugacucaaaacgggcgccuuauaacugcuaacccaaucgucacggacaaagaaaaacccguuaauaucgaggcggagcccccguucggcgaaaguuauaucgucaucggagcaggcgggaaggcccucaaacuuucaugguucaagaaaggaagcagcauuggcaaaauguucgaagcaacugcucggggcgcgcggcgaauggcuauccucggcgacacggcaugggacuuugggagugucgguggaguauucacgagcgucgguaaacugguacaucaaaucuuuggcacggcguaugguguccucuuuucaggagucucauggacaaugaaaauugggauaggaguccuacucacgugguuaggucuuaauucgcgcagcacuucccucuccaugaccugcauugccgugggcuuggugacccuuuaccuggggguaauggugcaagcagacucgggaugcgucauuaacuggaagggacgagaacugaagugcgggucuggcauuuucguuaccaacgagguccauacauggacagaacaauacaaauuucaggcggauucgcccaaacgacuaucagcugcgaucggcaaagccugggaagagggggucuguggaauaagguccgcgaccaggcucgaaaacaucauguggaagcaaauaagcaacgaacuuaaccacauacuccuagaaaacgauaugaaauucacagucguagugggcgacgucguuggaauauuggcacaaggaaagaaaaugauaaggccgcaacccauggaacacaaauauucauggaaauccugggggaaagcaaagauaaucggagcagaugugcagaacacgaccuucauuauagauggcccgaacaccccagaauguccagacgaucaaagggcguggaacaucugggaaguagaagacuacggauucggcauauucaccacgaacaucuggcucaagcuccgcgacucauacacccaagucugugaucauaggcugaugagugccgcgauaaaggauucaaaagcaguucacgcggacaugggcuacuggauagaaagcgaaaagaaugaaacuuggaagcuagcacgcgccagcuucauagaaguaaagacgugcauauggcccaagucgcauacucucugguccaacggcgugcuggaaagcgagaugaucauaccaaaaaucuacggcggacccauuagucaacacaacuacagaccagguuacuucacccagacagcuggucccuggcaccuggguaagcucgaacuagacuucgaccugugugaggguacuacagucgugguggacgaacauugcggaaaccggggcccgucacuccgaacgacaacaguaaccgggaaaauaauccaugaguggugcuguaggagcugcacacugcccccacuucguuucaaaggggaagacgguuguugguacggcauggaaauccgacccguaaaagaaaaagaggagaaucuggucaaauccaugguaucugcaggcaguggggaaguggacagcuucagccuagggcucuuguguaucucaauaaugauugaagaaguaaugcggucaagauggucaagaaaaaugcucaugaccggaacauuagccguauuucuacugcuaauaaugggccaauuaacauggaacgaccugauccgacugugcauaauggugggcgcgaacgcuucggaccgaaugggaaugggcacgacguaucuagcccuaauggccacauucaagaugcggccaauguucgcagugggccuucucuuccgacgucugacaucccgggaagugcugcuacuaaccaucggacuaucccuaguagcuagcgucgaacucccgaacucccuagaagaacuuggcgacggcuuagcuauggggaucaugauacuaaaacuccugacagacuuccagucacaucaacucugggccacucucuuaucacuaacguucaucaaaaccacauugucccuacacuacgcguggaaaacuauggcgaugguacuaucuauagugucacuauuuccacugugccugagcacgacuucccagaaaacaacuugguuaccuguacuccucgggucccucggaugcaaaccgcuaacaauguuucucaucacagaaaacaagaucuggggacgaaagagcuggccgcuuaacgaaggaauaauggcagugggcgucguaucuauacugcucaguucccugcuaaagaaugacgugccccucgcaggaccgcucauugccggcggcaugcucauagcaugcuacguaauuuccggauccagcgcugacuuaucccuagaaaaagccgcggaaguguccugggaagaggaggcagaacauucaggagcgucacacaacauccucgucgaaguacaagacgaugguacaaugaagauaaaagacgaggagcgcgacgacacccuaaccauccuucugaaagcgacccuauuagcggugaguggcgucuacccccugucaauacccgcgacauuguucgucugguacuucuggcagaagaagaaacaaaggagcggaguccucugggacacgcccagcccaccagaaguagagagagccguccuagaugacgggaucuaccgcauuaugcaaagagggcugcuggggagaagccaaguaggaguugguguauuccaagaaaaugucuuccacacaauguggcacguaacacguggagcgguccucauguaucaggggaaacguuuggaaccauccugggcgucgguaaagaaagaccucaucagcuacgggggaggguggcgccugcagggguccuggaacacaggggaagaaguacaggucauagcuguggaaccgggcaaaaacccgaagaacguccagacggcgccagggacguucaaaacaccggagggagaagucggugccauagcauuggacuucaagccaggaacgagcgggagcccaaucgugaacagagaggggaagauagugggacuauauggaaacggugugguaaccacuagcgggaccuacgucucugcaauagcccaagcaaaagcgucacaggaagggccccugccggaaauagaagaugagguguuccguaagagaaaccuuacgauaauggaccuccacccaggcaguggaaagacucgacgauaccugccagcgauaguacgggaggcgaucaaacgcaagcucaggacucucauccuagccccaacgagaguagucgcaagugaaauggcggaagcgcuaaagggaaugccaauccgcuaccaaacaacagcagugaaaagcgagcacacaggaaaagaaaucguggaccucaugugccaugcgacauucacgaugagacugcucucaccggugcgcguuccgaacuacaacaugauuauaauggacgaagcccauuuuacagauccgucauccauugccgcgagagguuauauuuccacccgaguaggaaugggcgaagcugccgcaauuuucaugacagcaacaccgccuggaaguguagaagcguucccgcaguccaacgcggugauucaggacgaggaaagagacauacccgaaagauccuggaauaguggauaugaauggauuacugacuucccgggcaaaacgguuugguucgucccauccauuaagagcggcaacgacaucgcaaacugucuucggaagaacggaaaacgggucauacaacucagcagaaaaaccuuugacacagaguaccagaaaacuaaaaacaacgacugggauuacguaguaacgacggacauaagcgagaugggcgcaaacuucagggccgauagagucaucgauccaaggcgaugccuaaaaccugucauacucaaagauggacccgaaagagucauacucgcgggccccaugccagugacgguugcaagcgcggcacagcggagaggucggauagguaggaaccacaacaaagaaggagaucaauauaucuacaugggacaaccccucaacaaugacgaagaucaugcccacuggacugaggccaaaauguuauuggacaacaucaacacccccgaaggcaucauuccggcccuguucgaaccggaaagggaaaaaucggcugcaauagacggagaguaccgucuccguggagaggcgaggaagacguucguagaauugaugaggcgaggcgaucuuccaguuuggcuaucauauaaaguagccagcgaaggauuccaguacucagaucgccgcuggugcuucgacggggaaagaaauaaucagguacuagaagaaaauauggacguagaaaucuggacgaaagaaggcgaacguaagaagcuaaggccgcguuggcuggacgccagaacauacagugauccucucgcccuaagagaauuuaaagaguuugcggcaggacgccgaucaguaucgggagaccuaauacuagaaauagggaaacuaccccaacaccuaacacagcgagcacaaaacgcauuggacaauuuggucaugcuccauaacagugaacaaggcggacgagcauaccgacacgcgauggaagaacuuccggacacgauagaaacauugaugcuacucgcacuaauagcaguauuaaccggugggguuacccucuucuuucugucugggagaggucucggaaagacaucaauuggucuguugugcgugauggcuucuaguguccuacuguggauggcgucaguagaaccccacuggauagcggcaucaauaauacuagaguucuuccuaaugguacuauugauaccggagcccgacagacaacgcacaccacaagacaaucaacuagccuacgucgucauagggcuacucuucaugauccuaacaguggccgcgaaugaaaugggccugcuugagaccaccaagaaagacuuggguauaggacacguugccguagagaaccaccaccacgcaacaaugcuagacguagacuuacacccagcaagcgccuggacauuauaugcaguagcuacuaccauaauaacuccgaugaugcgccauaccauagaaaacaccacggcaaacaucucccuuacagcaaucgcaaaucaagcagcaauccugaugggacuggacaagggauggcccauaagcaaaauggacauaggcguaccgcuucucgcucucgggugcuacucgcaagugaacccuuuaacacuuaccgcagcaguacucaugcuggucgcucacuaugcgauaauugguccgggccuccaagcaaaggcaacacgggaagcgcagaaaagaaccgccgcagggauaaugaaaaacccgacagucgaugguaucgucgcuaucgaucucgacccgguaguguacgacgcgaaauucgaaaaacaacucggacaaauuaugcugcuaauccuaugcacaucacaaauacuacuaaugcgaacaacuugggcucugugcgaaaguaucacacuagcaacuggaccacuuaccacgcuaugggagggaagcccgggcaaauuuuggaacaccacgaucgccgugaguauggccaacauauuuaggggaucauaucuagcaggggccggacuugcguuuuccuugaugaagucacuaggcgggggaagacggggcacuggcgcacagggggaaacccucggggaaaaauggaagagacaacuuaaccaacucagcaagucggaguucaauaucuacaaacguagcgguauaauggaggucgaccgcagcgaagccaaagagggucuaaaaagaggggagacuacgcgucaugcggucagucgcggaacagcaaaauuacgaugguucguagagcggaaccucgucaagccagaaggcaaagugauugaucuuggaugcggucgcggcgguugguccuacuacugugccggccugaagaaggugacagaggugaaaggauacacgaaaggcgggccaggacaugaggagccaauacccauggcgacauauggcuggaaccuagucaagcuacacucagguaaagacgucuuuuucacaccacccgaaaagugcgacacacugcuaugugacauuggggaaaguucgccgaacccaacgaucgaggaaggcagaacccuacgcguguuaaaaauggucgagcccuggcugagggggaaccaguucuguauuaaaauccucaauccauacaugccgagugucgucgaaacccuggagcaaaugcaacgaaaacacggugguaugcuugucagaaacccgcugagccgaaacaguacccacgaaauguacuggguuaguugcggcacggguaacauaguaagugcgguaaauaugacauccaggauguuacugaaccgguucacgauggcccaccgcaagccuacguacgaacgagacguagaccuuggcgcaggcacucgacauguagcaguagaaccugaaguagcgaaucuugacaucauagggcagcgcaucgagaacaucaaacacgaacacaaaucaacguggcacuaugaugaagacaacccuuauaagacaugggcauaccacggcaguuaugaggugaagccgagcggauccgcaucgucaaugguaaaugguguuguaaaacuucuuaccaaaccaugggacguaauaccuauggucacccaaauagcgaugacugacaccacaccauucggccagcaacgcgucuucaaagaaaagguggacacaaggacccccaaggcaaaacgaggaacagcacagauaauggaggucacggcgcgguggcuauggggcuuucugucccggaacaagaaaccgcgaaucugcacacgcgaagaguucacacgaaagguaagaagcaaugcggccauuggugccguauuugucgacgagaaccaauggaacuccgccaaggaggccguagaagaugagcgauucugggaccucguacagaaagaacgagagcuacauaagcagggaaaaugugccacuugcgucuacaacaugaugggcaaaagagaaaagaaacuuggcgaguucgguaaggccaagggcucgcgcgccauaugguacauguggcucggcgcgcguuuucuugaguucgaggcguugggguucaugaacgaagaccauugguuuucgcgggagaacucccuaagcggagucgaaggagaaggacuacauaaacuuggguacauacuacgcgacaucuccaaaaucccaggaggcaauauguacgcugacgacaccgcgggcugggauacuagaauuacagaagacgaucuacaaaacgaggcuaagauaacagacauaauggaaccugagcacgcccuccuagcaacaucaaucuucaagcuaacauaccagaacaaagugguccggguccagaggccggcuaaaaauggcacagucauggacgugaucucccggcgcgaucaaagggggucugggcagguaggaacguacggccugaauacuuucacgaacauggaagcccaacuaaucagacagauggaaagcgaagguaucuuccuaccaucggaacuggaaacucccaaccuggcugaaagaguacucgacuggcuagaaaaguacgguguagaaagauuaaaacgaauggccauauccggugaugacugcgugguaaaaccgauagaugauagguucgcaacugcacucacagcuuugaacgacauggggaagguccguaaagauauaccucaaugggaacccagcaagggcuggaacgacuggcaacaagugccguuuugcucucaccacuuucaccaacuuauuaugaaggacggcagagagauaguugucccauguaggaaccaagacgagcuuguaggcagagcaaggguaagccaaggggccggauggucccugcgagaaacagccugccucgggaaaaguuaugcacaaauguggcaacuuauguauuuucaccgaagagaccuacgguuggcggcgaacgcaauuugcagcgcaguaccaguggacugggugccaaccagucggaccacauggagcauccacgcucaccaccaguggaugacaaccgaagacauguuaagcgucuggaacaggguguggauugaagagaacccauggauggaagacaaaacacaugugaguagcuggggcgacgugccauaccugggcaaaagggaagaucaauggugcgggagccuaaucggguuaaccgcacgcgcaacaugggcaagcaacauacagguggccauaaaccagguccgcagauuaauuggaaacgagaacuaucucgauuauaugaccagcaugaaaagauuuaaaaacgaaggugacccagaaggagcccuuugguaa

SEQ ID NO: 24481 - RNA, 9879 nt, Artificial Sequence
  derived and/or modified CDS sequence (opt11) from DENV-1__GU131777__SS-prME
agcgucaccaugcugcucaugcugaugcccaccgcccuggcguuucaccugaccacccguggcggggagccccacaugaucgugagcaagcaggagcgggggaagagccuguuauucaaaacaagcgccggggugaacauguguacccucaucgcgauggaccuuggcgaacugugugaggacaccaugaccuacaagugucccaggauuacagagaccgagcccgacgacguggauuguuggugcaacgcuaccgauacaugggugaccuaugggaccugcagccagacgggagagcaccggagggauaaacgguccguggcccuagcgccacacgugggccugggucuggagacacgcaccgagaccuggaugagcagugaaggagcguggaaacagauccaacgggucgagacgugggcuuugagacaucccggguucacuguuaucgcguuguuccuggcccacgcaaucggcaccagcauuacccaaaaagggaucauuuucauacuccugaugcuggugacgcccuccauggccaugcguugcgucggcaucggcagcagagacuuuguggaagggcucuccggcgccaccuggguggacgucguuuuagaacaugggagcugugugaccaccauggcuaaggacaagcccacgcuagauaucgagcuccugaagaccgaggucaccaaccccgccaucuuacgaaagcucugcauagaggcaaagauuuccaauacuacgaccgacucgaggugcccgacacagggagaagcgacauugguugaggagcaggaugccaacuuugugugucggcgcacguucguagaccggggcugggggaacggaugugggcucuuuggcaaagggagucucauuacgugcgccaaguucaaaugugugaccaagcuagagggcaagaucgugcaauacgagaaccugaaauacuccgucaucgugaccgugcacacgggagaucaacaccaagucggaaacgaguccaccgagcacggcacuaccgccaccaucacgccgcaggcgcccacaaccgagauccagcugacugacuacggggcccugacacuggacugcagcccccgcaccggccucgacuucaaugagauggugcugcugaccaugaaggaaaaauccuggcucguccauaagcaaugguuccuggacuuacccuugccguggaccagcggagcuaguacuucccaggagaccuggaaccggcaggaccugcuggugaccuucaaaaccgcccacgcuaagaagcaagagguaguugugcucggcucacaggaaggcgcgaugcacacggcgcugaccggggccaccgaaauccagaccuccggcacgaccaccaucuucgccgggcaucuuaagugccgucucaagauggacaagcucacccuuaagggaaugagcuacgugauguguacggggagcuucaagcucgagaaggaagucgcggagacccagcacggcaccgugcuggugcagaucaaguacgagggcaccgaugcacccuguaagauccccuuuagcacucaggacgaaaagggggugacacagaauggccggcugauuaccgccaacccgaucgugaccgacaaggagaaacccgugaacauugaagcugagccgcccuucggggaguccuacaucgucaucggcgccggcgagaaggcgcuuaaguugucaugguucaagaagggcuccucaaucgggaagauguucgaggccacagcccgaggggcucggcgcauggcaauccugggcgacaccgcaugggauuucggguccauaggcggcguauucaccagcguggggaagcuaguccaccagaucuucgggaccgccuacgggguccucuuuuccggagugaguuggacgaugaagaucgggaucggcgugcuuuugacauggcucgggcugaacucgcggagcaccucccugagcaugaccugcauagccguugggcucgucacgcuguaccuaggcgucauggugcaggccgauucggggugcgugaucaacuggaagggccgggagcucaaaugcgggucaggcaucuucguaaccaacgaggugcauaccuggaccgagcaguauaaguuccaggccgacagcccgaagcgcuuauccgcugccauuggcaaggcgugggaggaagggguguguggcauacggagcgccacccgcuuggagaacaucauguggaagcagaucucgaacgagcucaaucacauauugcuggagaacgacaugaaguucacggucguggucggggacguggccgguauccucgcccaggggaagaaaaugauccgaccccagcccauggaguacaaguauagcuggaaauccuggggcaaggccaagauuaucggcgccgacgugcagaacacaaccuucaucaucgacgggcccaacaccccggagugucccgacgaucagagggccuggaacauaugggagguagaggauuacggcuucgggauauuuacgaccaacauuuggcuaaagcuccgggacucguacacccaagugugcgaccaccgccucauguccgcggccaucaaagauagcaaggccgugcaugccgacaugggcuacuggauugaaucagagaagaacgagacuuggaaacuggcgcgggcuucuuucauagaggugaaaacuugcaucuggccaaagucccacacucuguggagcaacggcguccucgaauccgagaugaucauaccuaagaucuacggggguccuauaagccaacacaacuauaggcccggcuauuucacgcagaccgccggcccauggcaccugggaaagcucgagcucgacuucgaccugugcgagggcacgaccgugguaguagaugagcacuguggcaacagggggccgagcuuacgcaccaccacagugacuggcaagauaauccaugagugguguugccggagcugcacacugccgccccuccguuuccgcggggaggacgggugcugguacggcauggagauccgccccgucaaggagaaggaggagaaccuggugaaauccauggugagugccggcucgggagaaguggacucuuucagccucggccugcuuugcaucucuaucaugaucgaggagguaaugcgaagccggugguccagaaagaugcuuaugacaggcacucuggcuguguuucugcuccugauuaugggucagcugaccuggaacgauuugauccgccuuuguauaaugguuggcgccaacgcgagcgacagaauggggaugggcacaaccuaccuggccuuaauggcaacguucaagaugcggccgauguucgccgucgggcugcuguuccgccggcucacuucccgcgaggugcuacugcucacgaucgggcugagcuugguggcuuccguugaacucccuaacagcuuagaagagcuuggggacggccucgcaaugggcaucaugauccuaaagcugcucaccgacuuccagucccaccagcuaugggccacgcuguugagucuaaccuucaucaagacaaccuucucccugcacuacgccuggaagacuauggccauggugcucaguauagucucccuguucccccucugccucagcaccacgucccagaagaccacuugguuacccgugcugcugggaucguuaggguguaaaccguugacuauguucuugaucgcugagaacaaaaucuggggccggcgcucauggccccugaaugaggggaucauggcugugggcaucgucucuauauugcucagcuccuugcugaagaacgacgugccgcuagcugggccgcugaucgcagguggcaugcucaucgccugcuacgucaucagcggguccagcgcggaccucucccuggagaaggccgccgaggucucuugggaggaagaggcggagcacagcggcgcuagccacaauauccugguggagguccaggacgaugguaccaugaagaucaaagaugaggagcgggaugauaccuuaaccauccugcucaaagcgacgcuccuggcgauuaguggcgucuacccgcugagcauccccgcaacccuuuuuguaugguauuucuggcaaaagaagaaacagcgcucggggguacugugggacacccccagcccuccagagguggaacgggccguguuagacgacggcauauacaggaucaugcagaggggcuuacucggucgcucccaagugggcgucggcguguuucaggagaauguguuucacacaauguggcacgucacgcggggugcugugcucauguaccaggguaagcgccuggagcccagcugggcuucggucaagaaggaccucauaagcuacggcgggggguggcggcuacagggcuccuggaacaccggcgaagaaguccaggugaucgcgguggagcccgggaagaacccuaagaacguucagaccaccccaggaacuuuuaaaaccccggagggcgaagugggggcgauagcccuggacuucaagcccggcaccagcggcucccccaucgugaaccgugaggggaagaucgucggccucuacggcaacgguguggugaccacgucgggcaccuacguaagcgccauugcccaggccaaagcuagccaggaggggccgcugccugagaucgaggacgagguguucaggaaacgcaaucugaccaucauggauuuacaccccggcagcgggaagacccggcgcuaccuuccagccauugugcgggaagcgauuaaacgaaaacuccguacgcuuauccuggcucccacgcgggucguggccuccgaaauggccgaggcccugaagggcaugccaauccgcuaccagaccaccgcaguaaagagcgagcauacggguaaggaaauagucgaccucaugugucacgccacauucacaaugcggcugcuaagccccgugagaguaccaaauuacaacaugauuaucauggaugaggcccacuuuaccgaucccagcaguauugccgcccgaggguacaucagcacucgcguaggcaugggggaagccgccgccauuuucaugacugcgacaccgccuggcuccguagaagcauucccgcagagcaacgcagucauacaggacgaggagcgggauauccccgaacgcagcuggaacucgggguacgaauggaucaccgacuucccgggcaagacggucugguucgugcccuccaucaaaucagguaacgauauagccaacugucuucggaagaaugggaagcgcgugauccagcugucccggaagacguuugacacugaauaccagaagaccaagaacaaugacugggacuacguggugacgaccgacaucagcgagaugggcgccaacuuccgcgccgaccgggugauugacccgcgccggugccugaagcccgugauccuuaaggacgggcccgagcgcgugauacuggcgggccccaugcccguaacugucgccuccgccgcccagcgacgcgggcggaucgggcgcaaccauaacaaggagggcgaccaguacaucuacaugggccagccccugaacaacgacgaagaccacgcccacuggaccgaagcgaagaugcuccuggacaacauuaacacgcccgagggcauaauaccagcucuguucgagccggagcgcgagaaauccgccgcgaucgacggggaguaccgacuccgcggcgaggcccggaagacguuuguagagcugaugcgccgcggggaccugccuguuuggcucuccuacaagguagcgagcgaggguuuccaguacagcgauagaagauggugcuucgacggcgagcgcaauaaccaggugcuggaggagaauauggaugucgagauuuggaccaaggaaggggaacgaaagaagcugcgcccccgguggcuggacgcccgcaccuacucggacccacuggcgcuucgggaguucaaggaguucgccgcgggccggcgguccguguccggggaccucauccuggagaucggcaaacugccccagcacuugacgcagcgcgcgcaaaacgccuuggacaacuugguaaugcuccacaacagcgagcaaggcgggcgggcauacaggcacgccauggaggaguugcccgacaccauugagacccugaugcugcuggcgcucauagccguccugaccgggggggugacccuuuucuuccuguccggccgcgggcucggcaaaacuagcaucggccuguugugugugauggccuccagcgucuuacuguggauggccagcgucgagccgcauuggaucgccgcgagcaucauacuggaguucuuccugauggugcugcuuauacccgagccagaccgccagcggaccccccaggacaaucaauuggccuacgucguaauugggcugcuguuuaugauacugaccguggccgccaacgagaugggccugcuugagaccacgaagaaagaccucgggaucgggcacgucgccgucgggaaucaucaccacgcggcuaugcuggacguggauuugcaccccgcaucggcguggacucucuacgcgguugcgaccaccaucaucaccccgaugaugcgccauacgaucgagaacacgaccgccaacaucagcuuaacagcuaucgcuaaucaggccgcgauccugaugggccuagauaaaggauggccaaucucuaagauggacaucggggugccacugcuugcccucggcugcuacagccaagugaacccgcucacucucaccgcagccgucuuaaugcugguugcucacuacgccaucaucggacccggccugcaagccaaggccacccgcgaggcccagaaacggaccgcggccgggauaaugaagaaucccacagucgauggcaucgucgcgaucgaccucgacccggugguguacgacgccaaguucgagaagcagcuuggucagaucaugcugcuaauccuguguaccucccagauccugcucaugcggacgacgugggcccugugcgagagcaucacccuggcgaccggcccccucacaacacugugggaggguuccccggggaaguucuggaacaccaccauagccgucagcauggccaacaucuuucggggcucauaccuggccggagcagggcucgcauucagccugaugaagucacugggggggggccgccgcgguaccggcgcccagggcgagacccuuggcgagaaguggaagcgccaacugaaccagcugagcaagagcgaguucaacacuuauaaaagauccggcaucauggagguugaucgcucagaggccaaagagggguugaagcggggcgaaaccacaaagcacgccgugucccgcgggacggcgaagcugagaugguucgucgagcgcaaccuuguuaagcccgagggcaaggugaucgaccuggggugcggccggggaggcuggagcuauuacugcgccggucucaaaaagguaaccgagguaaaagguuacaccaagggcggucccgggcacgaggagcccaucccgauggcgacguacggcuggaaccuggugaagcugcacagugggaaggauguuuucuucaucccccccgagaagugugacacgcuccugugcgacaucggcgagaguucacccaacccgaccauagaggagggccgcacccugcgggugcucaagaugguugagcccuggcugagagguaaccaguucuguauuaaaaucuuaaaccccuacaugcccagcgucguggaaacccucgagcagaugcagcggaagcauggcggcaugcuggugcgcaacccacugucccggaauagcacccacgagauguacugggucuccugcggcacagggaauauaguuagcgcggugaacaugaccucccgcaugcuacugaacagauucaccauggcccaucggaagccuaccuacgagcgcgacgucgaccugggagcgggaacgcgucaugucgccgucgaacccgaaguugccaaccuugacaucaucgggcaacgcaucgagaacaucaagcacgagcacaaaagcacguggcauuacgaugaggacaaccccuacaagacgugggcauaucacggcuccuacgaggugaagccgagcgggagugccagcagcauggugaacggcguagugaagcugcugaccaagccaugggacguaauccccauggugacgcaaauagcgaugacagacaccacccccuucgggcagcagcggguguucaaggaaaaggucgacacccggaccccaaaggcaaagcguggcacugcccaaaucauggaggugacggcaaaguggcucuggggcuuccuaucccgcaacaaaaagccucggaucugcacccgcgaggaguucacccggaaggugagaucgaacgcugccauaggggcuguuuucguugacgaaaaccaguggaacagugcuaaggaggcgguagaagacgagcgguucugggaccugguccaccgcgagcgggaguugcacaagcaggguaaaugugcgacuuguguguauaacaugauggggaagcgggagaagaagcucggcgaauuuggaaaggccaaagggucacgggccauaugguacauguggcugggcgccagauuucuugaauucgaggccuugggguucaugaaugaggaccacugguucuccagggagaacagcuuaucgggcguagagggggaaggcuugcacaagcugggguacauccugcgcgacaucucaaagauccccggcggcaacauguaugcggacgauaccgcugggugggacacgcggaucaccgaggaugaccuccagaacgaggcacgcaucaccgacauuauggagccggagcacgcccugcuagccaaguccauuuucaagcugaccuaccagaacaaggucgugcgggugcagcggcccgccaagaacggcacggucauggacgugauaagccgccgcgaucagcgcggcucgggacaggugggcacuuacgggcugaacacauucaccaacauggaggcccagcugauacggcagauggaaagcgagggcaucuuuucccccagcgaacucgaaacgccaaaccuggcggaacguguccuagacugguuagaaaaguacggggucgagcggcugaagcgcauggccaucuccggcgacgacuguguggucaagccuauagacgaccgguuugccaccgcgcugacagcucucaacgacauggggaagguaagaaaggacaucccccagugggagcccagcaagggcuggaacgacuggcaacaagucccguucugcucccaccacuuccaccagcuuaucaugaaggacggccgggagaucgucgugccuugccgcaaccaggacgaguugguagguagggcccgugucagucagggagccggcuggucgcuccgggagaccgccugucucggaaaguccuacgcgcagauguggcagcugauguacuuccaccgccgggauuuaaggcuggccgccaacgccauuuguagcgcagugcccguugauuggauccccacgucaagaaccaccuggagcauccacgcccaucaccaguggaugaccacggaagacaugcuguccgucuggaaccgugucuggauugaggaaaaucccuggauggaggauaagacucacaucaguucauggggcgacgugccguaccugggcaagagagaggaucagugguguggcucacugauugggcuuaccgcgcgggcaaccugggcuaccaauauccaagucgcaauuaaccaaguacgucggcuaaucggcaacgaaaacuaccuugacuauaugacguccaugaagcgcuucaagaacgagucagacccggagggggcacugugguaa

SEQ ID NO: 24482 - RNA, 9879 nt, Artificial Sequence
  derived and/or modified CDS sequence (opt11) from DENV-1__GU131778__SS-prME
agcgugaccaugcuccucaugcugaugccaaccgccuuggccuuccaccucacaacccgggggggggaaccccauaugaucgucagcaagcaagaacggggcaagagccugcuguucaagaccucugccggggugaauaugugcacccugauagcuauggaccugggagaguucugugaggacacaaugacguacaaguguccgcgcaucacugaggccgaaccugaugacguggacugcuggugcaaugccacagauacaugggugaccuacgggaccugcagccagaccggcgagcaccggcgagacaagcggucuguugcccuggccccccacguggggcuagggcuggagacgcgcacggagacuuggaugagcuccgagggcgccuggaaacagauccagcggguggagaccugggcccugagacaccccgguuucacggugaucgcccucuucuuggcgcacgcaaucggcaccagcaucacccagaaagggaucaucuucaucuuacucaugcuagugacccccucuauggcaaugcguugcgucggcaucggcagcagagacuucguggaggggcuguccggagcgacauggguggacgucguccuugaacacgggagcugcgugaccaccauggcuaaagacaagcccacgcuggacaucgagcugcucaagacugaggugacaaaccccgcuguauuacggaagcugugcaucgaggcgaaaaucuccaauaccaccacggacagccgcugcccgacacagggugaggcgaccuuaguagaggagcaagaugcaaacuucgugugccggcgcaccuucguggaccggggcuggggcaacgguugcgggcuguuuggcaaggggucccugauuacgugcgccaaauucaaaugcgugaccaagcucgagggcaagaccguacaguaugagaaccugaaauacucggugaucgugaccguccacacgggagaccagcaccagguggggaacgaguccacugaacacggcaccaccgcgacaaucacaccccaagccccaucuaccgagauacagcucaccgacuacggagcacugacacuggauugcagcccccgaacagggcuggacuucaacgagaugguccuccugaccaugaaggagaaguccugguuaguucacaagcagugguuccucgaucucccgcugcccuggaccuccggggccuccaccucgcaggagacguggaaccggaaagaucuucuggugaccuuuaagaccgcgcaugcgaagaaacaagaggucguagugcuggggucucaggagggcgccaugcacaccgcccucacgggggcgaccgagauccagaccucuggcaccacuaccauauucgccggacaucugaagugccgccugaaaauggacaagcugaccuuaaagggcaugaguuacgucaugugcacagggagcuucaaguuggagaaggagguagcggagacgcaacauggcaccgugcucguccagauaaaguacgaagggaccgaugcucccugcaagauccccuucuccacccaggacgagaagggaguaacccaaaacggucggcugaucacggccaacccgaucgugacggacaaggagaagcccgucaacaucgaggccgagccccccuucggggagagcuacaucguuaucggcgcgggcgagaaagcccugaagcucuccugguucaagaaagggucauccaucggcaagauguucgaggccaccgcccggggggcccggcgaauggcgauccucggcgacacugccugggacuucgguagcaucggcggcguguucaccuccgucggaaaguuaguccaccagaucuucggcaccgcuuacggcguacuguucucaggcgucuccuggaccaugaagaucgggaucggcgugcuacugacguggcugggccuaaacucacgcuccacgucacuuuccaugaccugcaucgcaguggggcucgucacccuuuaccugggcgugaugguccaggcggacagcgggugcgucaucaacuggaaaggccgggagcuuaagugcgguuccggcaucuucgugacgaaugaggugcacacuuggaccgaacaguauaaauuccaagcggacuccccgaagcgcuuaagcgccgccaucggaaaggccugggaggagggggucugcggcauacguuccgccacccgccuugagaacaucauguggaagcaaaucagcaacgagcugaaccauauucuccuugagaacgacaugaaauuuaccguaguggucggggacguggcaggcauccuggcccaaggcaagaagaugauccggccccagccuauggaguauaaguauuccuggaaguccuggggcaaggccaagauuaucggcgcugaugugcagaacacgacauucaucauagacggucccaacacgccugagugccccgaugaccagcgcgccuggaacaucugggaggucgaggacuacgguuucgggaucuucaccacgaauaucuggcucaagcugcgcgacuccuacacccaagugugcgaccaccgccugaugagcgccgccaucaaggacuccaaggccguccacgcagacaugggcuacuggauugaaagcgagaagaacgagaccuggaagcucgcacgugccaguuucaucgaggucaagaccugcaucuggcccaggagccacacacuaugguccaaugggguccuagagagcgagaugauuauacccaagaucuacgggggcccaauaucccagcacaacuaccggcccggguacuucacccagaccgccgggcccuggcaccuugggaagcucgaacuggacuucgacuuaugcgaggggaccacggugguaguggacgagcauugcggcaaccgagggccgucgcuuagaaccaccacugugacgggaaagaucauucacgaauggugcugccgcucaugcacccugccgccgcugcgguucaagggcgaggacggcugcugguacgguauggagauccgccccgucaaggagaaagaagagaaccuagucaagagcauggugucugccggcuccggcgaggucgauagcuuuuccuuaggguuacuaugcauaaguaucaugaucgaggaggugaugcggucccgcuggucucggaagaugcucaugacagguacccucgcuguguucuuccugcugaucauggggcaacuaacguggaacgaccucauccgccugugcaucauggucggcgcgaacgcauccgaccgcauggggaugggcacuaccuaccucgcccucauggccaccuucaagaugcggccgauguucgccgugggacuccuguuccgccggcugaccucgcgggaaguccugcuccuaaccaucgggcugagucuagucgcuagcguggaacugcccaacagucucgaggaguuaggcgacggacuggcgaugggcaucaugauccugaagcuccucaccgacuuccagagccaccagcugugggccacccuccucucucugacauuuauaaagaccacguucagcuugcacuacgccuggaaaaccauggcgaugguccuguccauugugagccuguuuccccucugcuuauccacgaccagccagaaaaccacuuggcugcccgugcuccugggcucgcugggguguaagccacucacgauguuccucaucgccgagaacaagauuuggggccgcaagucguggccccugaacgaggggaucauggccgucggcaucgucagcaucuuacuauccagccuccucaagaacgacgugccccuggccgggccauuaaucgccggcggcaugcuuaucgcgugcuacgucauauccgggaguuccgccgaccugagccuggagaaggccgccgagguguccugggaggaggaggccgagcacuccggcgcgucucauaacauccuaguggagguccaggacgacgggaccaugaagauuaaggacgaggagcgggaugacacccugacaauccugcucaaagccacccugcuggcugugagcggcguuuacccgcuguccauacccgccacgcuguucguaugguacuucuggcaaaagaagaagcagcggagcggggugcuuugggauaucccaagcccgcccgagguggagcgcgccgucuuagacgacggcaucuaucggaucaugcagcgaggccuguuggggagaagccaggugggugugggggucuuccaggagaacguguuccacacuauguggcacgugacccgcggcgcgguccucauguaccaagggaagcggcuugagcccuccugggccagcgugaagaaggaccugaucuccuacggcgggggguggagacugcagggcucuuggaacaccggagaggaagugcaggucaucgccguggaacccggcaaaaacccuaagaacguccagacugccccggggaccuuuaagacgucugaaggcgaggucggugccauagcgcucgauuucaagcccgggaccagcggcagccccaucgugaaccgggaagguaagauagugggccuguacggcaacggggucguuacgaccuccggaaccuacgugagcgccaucgcacaggcuaaggcgucccaggaggggccccuaccggagaucgaggacgaggucuuccgcaagcggaacuuaaccaucauggaccugcacccaggcagcggcaagacgagacgguauuugccggccaucgugagggaagccaucaagcgaaagcuccgcacccucauacucgcaccgacccgcguggucgccucagaaauggcggaggcccucaaaggaaugccuauccgguaccaaaccacggccgucaaaagcgagcacaccggcaaagagauugucgaccucaugugccacgccaccuucaccaugcgccuucucucgccaguccgggugcccaacuacaauaugaucaucauggacgaggcccacuucacggauccuuccuccaucgccgcccgcggguauauuagcacccggguaggcaugggggaagccgcggcuaucuucaugaccgcgacccccccggguuccguggaggccuucccccagagcaacgccguuauccaggacgaagagcgcgacauuccggagcggaguuggaacagcggguacgaauggaucacagauuuccccggaaagaccgugugguucguccccuccaucaagagcgggaaugacaucgcuaacugccuacgcaagaacgggaagagaguaauccagcugucccgcaagacauucgacacugaguaccagaagacgaaaaacaaugacugggacuauguggucaccaccgacaucagcgagaugggcgcuaacuuccgugcagaucgcguuauugauccccggcgcugcuuaaaaccggugauucugaaagaugggcccgaacgugucauccuggccggccccaugcccguuaccgucgccagcgccgcgcagcgccgggggcgcaucgggagaaaccacaacaaggaaggcgaccaguacaucuauaugggacagccgcuuaacaacgaugaagaccacgcgcacuggacagaagccaagaugcugcuggacaacauaaacacccccgagggcaucauaccugcucucuuugagccagagcgcgagaaauccgccgcaaucgacggggaguaccggcugcggggcgaggcccgcaagaccuucguggaacugaugagacgcggggacuugccgguguggcugagcuacaagguagccuccgaagguuuccaguauagcgaccggcgcuggugcuucgacggcgagcgaaacaaccaggucuuagaggagaacauggacgucgaaaucuggaccaaggagggagagcgcaagaagcuccggccccgcuggcuggacgcccggacguacagcgauccccuggccuuacgagaguucaaggaguucgcggccggccggcgcucgguauccggagaucuuauccuggaaaucggcaagcucccccagcaccugacccagcgcgcccagaaugccuuagacaaccucgugaugcugcacaacagcgagcagggcggacgcgcguaccgucacgccauggaggaacucccggacaccaucgagacccucaugcuucuggcccucaucgcagugcugacgggcgggguaacucuguucuuccucuccggccguggguuaggcaaaaccucuaucggccugcucugcguuauggccuccagugugcugcuauggauggcuuccgucgagccccacuggaucgccgccagcauaauccuggaguuuuuccugauggugcuguuaauucccgagcccgaccgucagcguaccccgcaggacaaucagcuggcauacgugguaauaggcuugcucuucaugauucugacgguggcagccaacgagaugggcuuacucgagacgaccaagaaagaucuggggaucggccaugucgccgucgagaaccaccaccacgccgccaugcuggacguggaccuccaccccgccuccgcguggacgcuguacgcgguggcgaccacgaucaucacgcccaugaugcgacacaccaucgagaacaccacggcuaacaucucccugaccgccaucgccaaucaggccgccauucucaugggucuagacaaagguuggcccaucuccaagauggacaucggggugccccuuuuggcccuggggugcuacucccaggugaacccgcugacacucaccgcggccgugcugaugcuggucgcccacuacgcgaucaucgggcccgggcugcaggccaaggcgacacgcgaggcgcagaaacgcaccgccgcuggcaucaugaaaaacccuacggucgaugguaucguggccauugaccucgaccccgugguguacgacgcgaaguucgagaagcaauugggccagaucaugcuccugauccugugcacuucucagauccuccugaugcggacgaccugggcgcuuugcgagagcaucacccuugccacagguccccugacuacccugugggaagggucgcccggcaaguucuggaacacaaccauugcggugagcauggcgaacaucuuccgcgggagcuauuuagcgggagcgggacuugccuuuagucugaugaagucacucgggggcggucggcgcggcacgggggcgcagggcgagacccugggugaaaaguggaaacggcaguugaaucagcucuccaaaagcgaguucaacaccuacaagcgaucagggauuauggaggucgaccgguccgaggcgaaggagggccucaagaggggggagaccacgaagcacgcgguaagucggggcaccgcaaaguuaaggugguucgucgagcgcaaucucgucaagccggaggguaaggugaucgaucuggguugcggucgcgggggcuggaguuacuauugugccgggcugaaaaaggugaccgaggucaagggcuauaccaagggggggcccggucaugaggaaccuauucccauggccacguacggguggaaccuugugaaguuacacagcggcaaggacguguucuucaucccgcccgagaagugugauacccuucuaugcgacaucggugagagcagucccaaccccacaaucgaggagggccggacccuccggguucugaagaugguggagccguggcugcgcgggaaccaguucuguaucaagaucuugaauccuuacaugcccagcguggucgagacgcuggagcagaugcagcgcaagcacggaggcaugcucguccggaacccacucucucgcaacagcacgcacgagauguauuggguguccugcgggaccggcaauaucgucagugcggugaauaugaccagucggauguuacugaaccgcuucacgauggcccaccgcaagccgaccuacgaaagagauguggaccucggggcagguacccgacauguggccguggagcccgagguggccaaccuugacaucaucggucagcggaucgagaauaucaagcacgaacacaagagcaccuggcauuacgaugaggauaaccccuacaagaccugggcguaccacggguccuacgaggucaagcccagugguucagcuuccucuauggugaacggaguugucaagcugcuuacuaaaccgugggacgugaucccgauggucacccagaucgcaaugaccgacaccacgcccuucggccagcagcgcguguucaaagagaagguggacacccggacaccuaaggccaagcgcgggaccgcacagaucauggaagugacagcaaagugguuguggggauuccugucccgcaacaagaagccgcgaaucugcacccgggaggaguucacccgcaaggugcgcucgaaugcugccaucggcgccguguucgucgaugagaaccaauggaacuccgcgaaagaggccguagaggacgagcgguucugggaccucguccaccgagagcgcgagcugcacaagcagggaaagugcgcgaccugcgucuacaacaugaugggcaagcgggagaagaagcuuggcgaguucggcaaagccaaggggagccgcgccauuugguacauguggcucggugcgcgguuccuggaguucgaggcccugggcuuuaugaacgaagaucacugguucucccgcgagaauagccucuccgggguagaaggugagggguugcacaagcugggcuacauccucagagacauaucacgcauccccgggggcaacauguacgccgaugacaccgccggcugggacacccggauaacagaggacgaccugcagaacgaagccaagauaaccgacaucauggagccggaacacgcgcuacucgccaaauccaucuuuaagcugaccuaccagaacaaggugguccgcgugcagcgcccggcuaagaacgggaccgugauggacgugaucagccggcgggaccagcggggaucgggacaggugggcaccuacggccugaacaccuucacgaacauggaggcccaacucauacgccagauggaguccgaaggcauuuucuccccgagcgaacuagagacccccaaucuggccggccgggugcucgacuggcuugagaagcauggcguagaacgccuaaagcggauggcgaucuccggcgaugacugcguggugaagcccaucgacgaccgcuucgccaccgcgcucaccgcccugaacgacauggggaagguccggaaggacaucccgcagugggagcccagcaagggcuggaacgacuggcagcagguccccuucugcucacaccacuuccaccagcuuaucaugaaggacggccgggagaucguaguccccugccggaaucaggacgagcuuguggggcgcgcucgugugucccagggcgcggguuggagcuugcgcgaaacggcgugccugggcaaauccuacgcccagauguggcagcucauguacuuccaccgacgcgaccugcggcuggcagcuaaugccaucugcucagccgucccuguagacugggugcccacuucccgcacgaccuggagcauccacgcccaccaccaguggaugaccaccgaggacaugcuguccgucuggaacagaguauggaucgaggagaaccccuggauggaggacaagacccacaucagcuccuggggagacgugcccuauuugggcaagcgcgaggaccaguggugcggcucgcuuauuggguuaacggccagagcgacgugggccaccaacauccaaguugccauaaaccagguucggcgacuaaucggcaacgagaacuacuuggauuacaugaccucgaugaaacgguucaaaaacgaguccgacccggaaggggcccucugguga

SEQ ID NO: 24483 - RNA, 9879 nt, Artificial Sequence
  derived and/or modified CDS sequence (opt11) from DENV-1__GU131779__SS-prME
agcgugaccaugcugcucaugcugaugcccaccgcccuggccuuccaccucaccaccaggggcggggaaccccauaugaucguuucgaagcaggagcggggaaagagccugcuguucaaaaccagcgccggggugaauaugugcacccucaucgccauggaccugggcgagcuuugcgaagacaccaugaccuacaagugcccccggaucaccgaaaccgagcccgaugacguggacugcuggugcaacgcgacagacaccugggugacuuacgggaccugcagccagacgggagagcaccgacgugacaagcgcuccguggcccucgcaccccaugugggccuggggcuggagacccgcaccgagaccuggaugucuuccgagggugccuggaagcagauccagcggguggagacgugggcccuccgccaccccggguucaccguaaucgcccucuuccuggcccacgcgaucgggaccagcaucacccagaaggggauaaucuuuauccuccugaugcuggugacacccuccauggccaugcggugcgugggcaucggcagccgugacuucguggaggggcucuccggcgccaccuggguggacgucgugcuggagcacgggagcugugugacuacaauggccaaagacaagcccacgcuugacaucgaguuguuaaagaccgaggucaccaaccccgcuauccugaggaaauugugcauagaggcgaagaucucaaauaccacgaccgacagccgcugcccgacccaaggcgaggccacccugguggaggagcaggacgccaacuuugugugccggcgcacguucgucgaccggggcugggggaacggcugcggguuguucggcaaagggucccucaucacgugcgccaaguuuaaaugcgugaccaaguuagagggcaagaucgugcaguacgagaaccucaaguacagcguaaucgugaccgugcacacgggcgaccagcaucaggucgggaacgaguccaccgagcacggcaccaccgcuaccaucacgccccaggcaccgaccaccgagauccagcuuacagacuauggcgcccugacucuggacugcagcccccgcacgggacucgacuucaacgagaugguccugcugaccaugaaggagaaguccuggcugguccacaagcagugguuccuggacuugccccuccccuggaccagcggggccucuacgucacaggagaccuggaaccggcaggaccugcuggugaccuucaagaccgcccacgcuaagaagcaggagguggucguccuuggcagccaggaaggcgcgaugcacacggcccugaccggcgccaccgagauccaaaccuccgguacaacuaccaucuucgcggggcaccugaagugcaggcucaagauggacaagcugacccugaagggcaugagcuacguuaugugcacgggguccuucaaguuagagaaggaagucgccgagacacagcacggaacagugcuggugcagaucaaguaugagggcaccgacgcgcccugcaagauccccuuuagcacgcaggacgagaagggggucacccagaacggccggcugaucaccgcuaaucccaucgugaccgacaaagagaagcccguaaacaucgaggccgagccgcccuucggggaguccuacaucgucauuggugccggcgagaaggcgcugaaacucagcugguucaagaaaggcuccagcauuggcaagauguucgaggccacggcccgcggggcccgucgcauggccauucugggcgacaccgcgugggacuucggguccaucggcgggguguucaccagcguggguaagcugguccaccagaucuucggcacagccuacgggguccucuucuccggcgugagcuggacgaugaagaucgggauaggcguucugcugaccuggcuggggcugaacucccgcagcaccucccugagcaugaccugcaucgccguggggcucgugacucuguauuuaggcgucauggugcaagcggacuccgggugcgugaucaacuggaagggacgggagcucaagugcgggagcggcauauucgucaccaacgagguccacaccuggacagagcaguacaaguuccaggccgacagcccgaagcgccuguccgccgccaucggcaaggccugggaggaaggggugugcggcauccggagcgccacccgacuggagaacaucauguggaagcagaucagcaacgagcucaaucacaucuuacuagagaacgacaugaaguucacgguggugguaggggacgucgccggcauacucgcgcaggggaagaagaugaucaggccccagcccauggaguacaaguacagcuggaaguccuggggcaaggccaagaucaucggcgccgacgugcaaaacaccaccuucaucaucgaugguccgaacacccccgagugccccgacgaccagcgggccuggaacaucugggagguggaggacuacggcuucgggaucuucacgaccaacaucuggcugaagcugcgggacagcuauacccaggucugcgaccacagacucauguccgcggccaucaaggauagcaaggccgugcacgcugacaugggcuacuggaucgaguccgagaagaacgagaccuggaagcuggcucgggcgagcuucaucgaggugaagacgugcaucuggcccaagucccacacccuguggagcaauggcguccucgaguccgagaugauaaucccgaagaucuacgggggcccgaucucucagcauaacuaccgccccggauacuucacccaaaccgccggacccuggcaccuggggaagcuggagcucgacuucgaccugugugaggggacgacugugguagucgacgagcacugcgggaaccgggggccgagcuugcgaacuacuacggugacgggcaagaucauccacgagugguguugccggagcugcacgcugccgccccucagauuccgcggggaggacggcugcugguacgggauggagauacgucccgugaaggagaaggaggagaaccuggucaagucgauggugagcgcggggagcggcgagguagacuccuucagccuagggcugcuuuguaucuccaucaugaucgaggaggucaugcggucgcguugguccaggaagaugcucaugaccgguacgcuagcaguguuccugcuccuaaucauggggcagcugaccuggaacgacuuaauccgccugugcauaauggugggagccaaugcuagcgaccguaugggaaugggcaccaccuaccucgcccucauggccacuuucaagaugcggccgauguucgccgucggacugcuguuccgcagacuuaccucgcgcgaggugcugcugcucaccaucggguuaagccugguggucuccguggagcugcccaauagccuggaggaguugggggacgggcucgccaugggcauaaugauccugaagcugcuuaccgacuuucagucccaucagcugugggcuacguuauugagccugaccuucaucaagaccacuuucucccugcacuacgccuggaagacgauggcgaugguccucagcaucgugucccuguucccccugugccucuccaccaccucccagaagaccaccuggcuucccgugcuccucggaagccuggggugcaagccgcugaccauguuccucaucgcagagaacaagauauggggcagaagguccuggcccuugaacgaggggaucauggcggucggcaucgugagcauucugcuaagcucccugcugaagaacgaugucccacuagccgggccccugaucgccgguggcaugcugaucgccugcuacgucaucagcggguccagcgccgaccucucccuggagaaggcggccgagguaagcugggaggaagaggccgaacacuccggcgcgagccacaacauccuggucgagguccaggacgacgggaccaugaagaucaaggacgaggagcgggacgacacccucaccauccugcugaaggccacucucuuggcagucuccggcguauacccgcuaagcaucccggccacccucuucgucugguacuucuggcagaagaagaagcagcgcuccggggugcugugggacacccccaguccacccgagguggagcgggccguccuggacgacggcaucuaccgcaucaugcagcggggacugcucgggcgcucccaagugggcgugggcgucuuccaggagaacguguuccauacuauguggcacgugacacggggcgccguacugauguaccaggggaagcgccuggagcccagcugggccuccgugaagaaggaccucaucagcuacggcggcggguggcggcugcagggcuccuggaauaccggggaggagguucaggucaucgccguggagcccggaaagaaccccaagaacgugcagaccacccccggaacguucaagaccccagagggugaggucggcgccaucgcucuggacuucaaacccgggaccagcggcucccccaucgugaacagggaggggaagaucgucggccucuauggcaacggggucguuaccacuagcgggacuuaugugagcgccaucgcccaggcgaaggccucccaggaggggccgcugcccgagaucgaggacgagguauuccggaaacgaaaccugaccauuauggaccuccaccccggcagcgggaagacccggcgcuaccugccggccaucgugcgggaggccaucaagcgcaaacugcgcacccucauccuggcgccgacgcggguggucgcauccgaaauggccgaggcccugaagggcaugcccaucagauaccagaccaccgcggucaaaagcgagcacacggggaaagagaucguggacuuaaugugccacgcgaccuucaccaugcggcugcugucccccguccgcgugccgaacuacaacaugaucaucauggaugaggcacauuucaccgacccuucauccauagccgcccggggguacauuucgacccgcguggguaugggggaggccgcggccaucuuuaugaccgcuacgccacccggcuccgucgaggccuucccgcagagcaacgccgugauccaagaugaggaacgggacaucccagagcgcuccuggaauagcggguacgaguggaucaccgacuuccccggcaagacggugugguucguccccuccaucaagagcggcaacgacaucgcgaacugucuccggaagaacgggaaacgcgugauccagcuguccaggaagacuuucgacacugaguaccagaagaccaagaauaacgacugggacuauguggucacgacagacaucagcgagaugggcgcaaacuuccgggcagaccgagugaucgacccgcgccggugccugaagcccgugaucuugaaggacggucccgagcgcgucauccuggccggcccgaugccggugaccgucgcguccgccgcccagcggcgcgggcguaucggccguaaccacaacaaggagggagaucaguacaucuacauggggcagccccuuaacaacgacgaggaccacgcucacuggaccgaggccaagaugcuccuugacaacaucaacacgcccgaaggcauaauccccgcgcuguucgagccggagcgcgagaaguccgccgccaucgacggggaguaccggcuccgcggcgaagcgcggaagaccuucgucgagcucaugcgccgcggggaccugccagugugguugucguacaaggucgccagcgagggcuuccaguacucugaccgccgguggugcuucgacggagagagaaacaaccaggugcuggaggagaacauggacguggagaucuggacgaaggagggggagcggaagaagcugcgcccucgguggcucgacgcgcgcaccuacuccgacccgcuggcccugcgggaguucaaggaauuugccgccggccgccggucgguauccggggaccucauccuggagaucgguaaacugccgcagcaccucacgcagcgcgcccagaacgccuuggacaaccuggugaugcuccacaacagcgagcagggagggcgggcauaccgccacgccauggaggagcugccugauaccaucgaaacccugauguuacuggcccugaucgcggugcucaccggcggggucacccuauucuuccuguccggccgggggcucggcaagacgagcaucggccugcugugcgugauggccuccagcguccuccuguggauggccuccgucgagccccacuggaucgccgcgucaaucauccuggaguucuuucucaugguacugcugauacccgaaccugaccgccagcggacgccccaggacaaucagcucgcguacgugguaaucggguuacuguucaugauccucaccguggcagccaacgagaugggccuccuggagaccacgaagaaggaucucgggaucggccacguggccgucgggaaccaucaccaugccgcgaugcuggacguagaccugcaccccgccucugccuggacccucuacgccguagccaccacuaucaucacgccuaugaugcgccacaccaucgagaacacgaccgcgaacaucagccuaacggcaauagccaaccaggcggccauccugaugggccucgacaagggcuggcccauuuccaagauggacaucggggucccccuccuggcguuaggcugcuacagucaggugaacccccugacccugacugccgccgugcucauguugguagcacacuacgcgaucaucgggccgggcuuacaggccaaagccacccgugaggcccagaagcggacugcugcggggaucaugaaaaaccccaccguggacggcaucguggccaucgaccucgaccccgucguguacgacgccaaguucgagaagcagcugggacaaauaaugcugcucauccugugcaccagucagauccugcucaugcgcaccacgugggccuugugcgagagcaucacccuggccacuggcccccucaccacucugugggagggcuccccggggaaguucuggaacacgaccaucgcggugucuauggccaacaucuuccggggcuccuaccuggccggcgccggacucgcauucagccugaugaaguccuuaggcggaggccgccgggggaccggcgcgcagggcgagacgcucggggagaaguggaagcggcagcuaaaccaacuguccaagucugaguucaacacauacaagcgguccggcaucauggaggucgaccgcagcgaagccaaggaggggcucaagcggggcgaaaccaccaaacacgccguaucccgcggcacggccaagcugcgcugguucguagagcgcaaccuggugaaacccgagggcaaggugaucgaucucggcugcgggcgcggcggguggagcuacuacugcgcgggccucaagaagguaaccgaggucaaaggguauaccaagggcggccccggccacgaggagcccaucccgauggcgaccuacggcuggaaccuggugaaacugcauuccgggaaggacguguucuuuaucccgcccgagaagugcgacacguuauugugcgacaucggggagagcucccccaaccccaccaucgaagaaggucgcacccugcggguccucaagaugguggagcccuggcugcgcggcaaccaguucugcaucaagauccugaacccauacaugccgagcguaguggagacccucgagcagaugcagaggaagcacggcgggaugcuagugcgcaauccucugucccgaaacucgacccaugagauguacuggguguccugcggcacggggaacaucgucagcgcagugaacaugaccucccgcaugcuccugaaccgcuucaccauggcccacagaaagcccaccuacgagcgcgacguggaccugggugcuggcacgcggcacgucgcgguggagcccgagguggccaaccucgacaucaucgggcagcgcauagagaacaucaagcacgagcacaaguccaccuggcacuacgacgaggacaaccccuacaagaccugggccuaccacggcuccuaugaggucaagccgagcgggucggcuagcagcauggucaacggcguggugaagcugcugaccaagcccugggacguuauccccauggucacgcaaauagcuaugaccgacaccacgcccuucgggcagcaacggguguucaaggaaaagguggacacgagaaccccgaaggcgaagcggggcaccgcccagauuauggaggucaccgccaaguggcuauggggauuccugucccgcaacaagaaaccccggaucuguacucgcgaggaguuuacccgcaaggugcgcagcaacgcagccaucggggcgguguucguagacgagaaccaguggaacuccgccaaggaggccguggaggacgaacgguucugggaccuggugcaccgcgagcgggaacuccacaagcaaggcaagugcgcuaccugcguauauaacaugaugggcaagcgggagaagaaguugggcgaguucgggaaagcgaagggcagccgggccaucugguacauguggcugggcgcccgcuuccuggaguucgaagcccugggguucaugaacgaggaccacugguucucacgggagaauagccuguccggcguggagggggaaggacuccacaagcugggcuacauccugcgagacauaagcaagauccccggcggcaacauguacgccgacgacaccgcgggcugggacacgcggauuaccgaggacgaucuacagaacgaggcccggaucaccgacaucauggagccggagcacgcccugcuggccaaguccaucuucaaacucaccuaccaaaacaaggugguccgcgugcagcggcccgcgaagaacggcacggugauggacgucaucagccgccgggaccagcgcgggaguggccaagugggcaccuacgggcugaacacuuucaccaacauggaggcgcagcugauccggcagauggagagcgagggcauuuucucucccagcgagcucgagacgcccaaccuggcagagcgcgugcuggacuggcucgagaaauauggggucgagcggcugaagagaauggcuaucucgggugacgacugcguggucaaaccaaucgacgaccgguucgccacggcccugaccgcgcugaacgacauggggaagguccgcaaggacaucccccagugggagcccagcaagggcuggaacgacuggcagcagguccccuucugcucccaccacuuccaccagcucaucaugaaggacggccgggagaucguagucccgugccgcaaccaggaugaacugguggggcgggcccgagugagccagggcgccggguggagccuccgggagaccgccugccugggcaaguccuacgcccagauguggcagcugauguacuuucaccgccgugaccuccgccuggcggcgaacgcgaucugcagcgccguccccguagacuggauucccacgucccgaaccaccuggagcauccacgcgcaccaccaguggaugaccacggaggacaugcuguccguguggaacaggguauggaucgaggagaaucccuggauggaagacaagacccacauuagcuccuggggcgacgugccguaccucgggaaacgcgaagaccaauggugcggcagucugaucgggcugaccgcccgggccacgugggccaccaauauccagguggccauaaaccagguccgccggcucaucggcaacgaaaacuacuuggacuacaugacguccaugaagcguuucaagaacgagagcgaccccgagggugcgcugugguga

SEQ ID NO: 24484 - RNA, 9879 nt, Artificial Sequence
  derived and/or modified CDS sequence (opt11) from DENV-1__GU131780__SS-prME
agcguaaccaugcuacucaugcucaugcccacugcccuggccuuucaccucacgaccagagggggggagccgcacaugaucguaagcaaacaggagcgugguaagagccugcuguucaaaaccuccgccggggugaacaugugcacacucaucgccauggaccugggagaguuuugcgaggacaccaugacguacaagugcccccguauaacugaagcugagccagacgacguggacugcuggugcaacgcgaccgacacgugggugacguacgggacgugcagucaaacuggcgagcauagacgggacaagcgguccguggcccuggcgccccacgucggacucgggcucgaaacgaggaccgagaccuggaugucauccgagggagccuggaagcaaauccaacgggucgagaccugggcuuuaagacaucccggguucaccguuaucgcccuuuuccuugcgcacgccaucggcaccagcaucacccagaaggguauaaucuucaucuugcucaugcuagugacuccuuccauggccaugcggugcgucgguauuggcagccgggacuuuguagagggguuaucaggugccaccuggguggaugucguauuagagcacgggagcugcgugacgacaauggcaaaagacaagccgacccuggacaucgagcuacugaagacggagguuacgaaccccgcggugcugcgcaagcuauguaucgaggccaagauauccaacaccacuacagauagccgcugcccgacccagggagaggccacauugguggaggagcaggaugccaacuucgucugccggcgcaccuucguggaccggggcugggggaacggcuguggucuguucggcaagggcucauuaauaacgugcgcaaaguucaagugcgugaccaagcucgaaggaaagacgguccaauacgaaaaucuuaaguauagcgugauaguuacaguccauacaggggaccagcaccaaguggggaaugaaucaacugagcacggcaccacugccacgaucacgccccaggccccuagcaccgagauucagcugaccgacuacggggcguuaacccuugacuguagcccccguaccggcuuagacuucaacgaaaugguccuccugacgaugaaggaaaaguccuggcucguccacaaacagugguuccuugacuuaccgcugcccuggacuagcggggcuuccaccagccaggaaaccuggaaccguaaggaccuccuggugaccuuuaagaccgcccacgccaagaagcaggaagucgugguguugggcagccaggagggugccaugcacaccgcccucacgggugcaaccgagauccagaccucgggcaccacgacgauauucuccgggcaccugaagugcagacugaagauggacaagcucacgcugaaggggauguccuacgucaugugcacaggguccuuuaagcuugagaaagagguggccgagacgcagcacgggaccgugcucguccagaucaaguacgagggcacagaugcgcccuguaagauccccuucuccacccaagacgagaaggguguaacgcagaacggccggcugaucacugcaaacccuaucgugaccgacaaggagaagccugugaacaucgaggccgaaccgcccuucggggaauccuacaucgugauaggagccggcgagaaggcucuaaagcuaagcugguucaaaaaaggguccagcaucgguaagauguucgaggccaccgccaggggggcccggagaauggccauccuaggagacacggcgugggacuucggcucuauaggcggcguuuuuaccagcgucgggaagcugguacaccagauauuuggcaccgcuuacgguguguuguucuccgggguguccuggaccaugaagaucggaaucggcgugcucuugacguggcugggucucaauucccggucgaccucccuuagcaugaccugcaucgcugugggguuagucacccucuaccuaggcgugauggugcaagccgauucaggcugcgucaucaacuggaagggccgcgagcuuaagugugggucgggcaucuucgugacuaaugaggugcacaccuggaccgaacaauacaaguuucaggccgacagcccgaagcgguuguccgcugccaucgguaaggccugggaagagggggucuguggcauccggagcgcgacucgccucgagaauaucauguggaagcagaucuccaacgagcugaaccacauacugcuggagaacgauaugaaguuuaccgugguggucggggacguggcaggcaucuuagcccaggguaagaagaugauacggccccagcccauggaguacaaauacagcuggaagucuuggggcaaagccaagaucaucggcgcagacguccagaacacgacauuuaucaucgacggaccgaacacaccggaaugccccgacgaccaacgcgccuggaacauuugggaagucgaggacuacggcuuuggcauuuucaccacuaacaucuggcuuaaauugcgggacagcuauacccagguaugcgaucaucgccugaugagugcggccaucaaggacagcaaagccgugcacgccgacaugggcuacuggaucgagagcgagaagaacgagaccuggaaacucgcaagagcaagcuucauugaagucaagaccugcauauggcccaagucucacacguuauggagcaacggcguacuggaguccgagaugaucauccccaagauuuacgggggcccgaucucucaacacaacuaccgccccgguuauuucacacagacagcuggccccuggcaccucgguaagcuggaguuggacuucgaccucugcgaaggaaccacggugguaguggacgagcacugcggcaaccgcgggccgucacugcgcaccacgaccgugacgggcaagaucauccacgaguggugcugccggucaugcacacugccgccacugcgcuucaagggggaggacggcugcugguacggaauggaaauccggccugucaaggagaaggaggagaaccuggucaagagcauggugucagcuggguccggugaggucgacuccuucagccugggguuacuguguaucucaaucaugaucgaagagguuaugcgcagccgguggucccgcaagauguugaugacuggcacuuuagcaguguucuuccuguuaaucaugggucagcucacuuggaacgacuugauacggcugugcauuauggugggcgcaaacgcuagcgaccgcauggggaugggcaccaccuaucucgcgcugauggccacuuuuaagaugcgcccgauguucgccgugggacucuuauuccgacgccucacgucgcgggagguacugcuccugacaauuggucugucgcuaguggcaucuguggaguuaccgaacagucuggaggaacucggggaugggcuggcgaugggcaucaugauccuuaagcuccugacagacuuucagucccaucagcugugggcaacccuacugucccuaaccuucaucaagacgacguucucgcugcacuaugccuggaagaccauggccaugguauuaagcauagugucucuguuuccuuuaugccugagcacuacaucccagaagaccacguggcugcccgugcuccuggguucucugggaugcaagccguugacgauguuccugaucgcggagaauaagaucuggggccggaaaagcuggccacuaaacgaagguaucauggccgucggcauagucuccauccucuuaagcagccugcucaagaacgacgugccgcuggccgggccccuuaucgccgggggcaugcucaucgccuguuacgucauuagcggaaguucugcggaccuguccuuggagaaggcggccgaggucagcugggaggaggaggcggaacacaguggcgccagccacaacauccucguggaggugcaagaugacgggaccaugaagaucaaggacgaagaacgggacgauacccugaccaucuugcucaaggcaacccugcugacggugucgggcguguauccucucagcauccccgcgacccuguucgugugguacuucuggcaaaagaagaaacaacgcuccgguguccugugggacacacccagcccgcccaagguggagcgggccguccucgacgacggaauuuaucgcaucaugcagcguggccugcuggggagaucgcagguaggcguuggugucuuccaggagaacguauuccacacaauguggcauguaacgcguggcgccguucuaauguaccaaggaaagcgccucgaaccaagcugggccucugucaagaaggaucugaucagcuauggcggcggguggcgguugcagggcuccuggaacaccggugaagaggugcagguaaucgcgguagagcccgguaaaaacccgaagaaugugcagaccgcccccgggacauuuaagacuucagaaggcgaggucggcgccauagccuuggacuucaagcccggcaccagcggcuccccgauugugaaccgcgagggaaagaucguggggcuguacggcaacggggucgugacaaccagcggcacguauguauccgccaucgcgcaggccaaagccagccaggaggggccauugcccgaaaucgaggacgaggucuuucggaagcguaaccugacuauaauggaccugcaccccggaagcgggaagacccggagauaucugccggccaucgugagagaggcgaucaagcgcaagcuccguacccugaucuuggccccuacgagaguggucgccucagagauggccgaagcauuaaaggggaugcccauacgcuaccagaccacagcgguuaaauccgagcacaccggcaaggaaauuguggaucugaugugccaugcaacguucaccaugcgguugcucuccccuguccgcgugccgaacuacaacaugauuaucauggaugaagcccacuucaccgacccuagcaguauugccgcccguggauauaucagcacccgggucggcaugggggaggcggccgcaaucuucaugaccgccacgccgcccggcucagucgaggcuuucccucaguccaacgcggugauucaagacgaggagcgcgauaucccggagcgcagcuggaacuccggguaugaguggauuaccgacuuccccggcaagacagugugguucgucccuagcauaaagaguggaaaugauauagcgaacugcuuacggaagaacggcaaaagggugauccagcugagccggaagacguuugacaccgaguaccagaaaacuaagaacaaugauugggacuaugugguaaccacggauauuucggaaaugggcgccaauuuuagggccgacagggugaucgauccccggcggugccugaagccggugauccugaaggacgggccagagcgcgucaucuuagcagggccgaugcccguuacugucgccagcgccgcccagagacgcggucggauaggcagaaaucacaauaaggagggcgaccaguauauuuauauggggcagccacucaacaacgacgaagaucaugcccacuggacggaggcgaaaauguuacuggauaacauuaacaccccugagggaaucauccccgccuuguucgagccugagcgugaaaaguccgcggccaucgacggcgaguaccggcuucggggcgaggcacgaaagacuuuuguggaacuaaugaggaggggggaucucccgguguggcugucauacaaggucgcgucggaggguuuucaauacucggaucgccgguggugcuuugacggagagcggaacaaccaggugcuagaggaaaacauggacguggagaucuggaccaaggagggugagcggaagaaguuacgcccacggugguuggacgcccggacauacagcgaucccuuagcacuccgugaguucaaagaguucgcugcuggccgccgauccgucuccggggaccugauccuggagaucgguaaguugccccagcaccugacacagcgcgcucagaaugcacuggacaaccugguuaugcugcacaauuccgagcagggcgggagagcguaccgccacgccauggaggagcuaccggacacuauugagacaaugaugcucuuggcgcucauagccguacucacuggcggagucacccuguucuuccucagcggacgagggcucggcaaaaccuccauagggcugcugugcguuauggcuaguuccguccuucuguggauggccagcguggagccccacuggaucgccgcauccauaauccuggaguucuuucucaugguuuugcugauacccgagcccgaccgucagcggacaccacaggacaaccaguuagccuacguggucaucggccugcuguucaugauccuuacgguagcggccaaugagaugggccugcuggagaccaccaagaaggaccuggggaucggccacguugcugucgaaaaucaccaccaugcggccaugcuggacgucgaccugcaccccgccucagcauggacguuguacgcuguugcuaccaccaucaucacccccaugaugcgccauaccaucgagaacaccacugcgaacaucucccugaccgccaucgcgaaccaggccgcaaucuugaugggguuggacaagggcuggccgauuagcaagauggacaucggugucccccuguuggcccucgggugcuacagucaggugaacccucugacgcugaccgccgccgugcucaugcugguugcgcacuacgccaucaucggcccuggguuacaggccaaggcuacccgcgaggcacaaaaacguacggcggcaggcaucaugaaaaacccuaccguggacgggauaguggccaucgaccucgaccccgucguuuaugacgcuaaauucgagaaacagcugggccagauuaugcuguugauccugugcaccagccagauacuacucaugagaaccaccugggcccucugcgagaguaucacgcuggcgaccggaccucuaacuacccugugggaggggucccccggcaaauucuggaacacgaccauagcgguaagcauggcuaacaucuuccggggaucguaccuagccggugccgggcuggcguucucgcugaugaagucccucgggggcgggcgaagggguacgggggcucaaggcgagacccucggcgagaaguggaagcgccagcucaaucagcucuccaaguccgaauucaacacguauaagcggucagggaucauggaagucgaccgaagugaagcgaaggagggcuugaaacgaggugagaccaccaagcaugccgugagccgcggcaccgcuaagcugaggugguucguggaacgcaauuuagucaagccggaagguaaggugaucgaccucggcugcggccgcggcgggugguccuacuacugugcaggccugaaaaaggugacggaaguaaagggguacaccaaaggcggucccgggcacgaggagcccauacccauggcuacguacgguuggaacuuggugaagcugcacuccggcaaggauguguucuucaucccgcccgagaaaugcgauacauugcucugcgacaucggggaguccucacccaaccccaccaucgaagaaggccgaacccugcguguacuaaagaugguggagcccuggcuacgagggaaccaguucugcauaaagauccuuaaccccuacaugcccagcguggucgagacccucgagcagaugcaacggaagcacgguggcaugcuggugcgcaacccccugucgcggaacucuacccacgagauguacuggguguccugcgggacaggcaacaucgucuccgcagucaacaugacguccagaaugcuucugaaccgcuucaccauggcccaccgcaagccgaccuacgagagggacguugaccugggagcgggcacccggcacguugccguggagcccgagguugccaaccucgacaucaucggccagaggaucgagaacauaaagcacgaacacaagucuaccuggcacuacgacgaagacaacccauacaagaccugggcuuaccacggguccuacgaggucaagcccagcggguccgcuagcaguaugguuaacggcgucgugaagcugcucacuaagccgugggacgugauccccauggucacacagauugcuaugaccgacaccaccccguucggccagcagcggguguuuaaagagaagguggacacccggacgcccaaggccaagcggggcaccgcccagauaauggaggucaccgcuaaauggcucuggggcuuccuuagccgcaacaagaagccacgcauuuguaccagggaagaguucacgcggaaggugcgcucaaacgccgcgauaggcgcuguguucgucgaugagaaucaguggaacucagccaaggaggccguggaggacgagagguucugggaccuaguucaccgcgaacgggagcuccauaagcagggcaagugcgcuaccugcguguacaacaugaugggcaaaagggaaaaaaagcugggugaguuuggcaaagccaaggggucaagggccauaugguacauguggcugggagcccgcuuccuagaguucgaggcccucggguuuaugaacgaggaccacugguucagccgggaaaacucgcucucugggguggagggagagggacuccacaagcucggcuauaucuugcgcgacaucuccaagauccccggcggcaacauguacgcagaugacaccgccgguugggacacacggaucacggaagacgaccuacagaacgaggccaaaauuaccgauaucauggagccagagcacgcacugcuggccaagagcaucuucaaacucaccuaccaaaacaaagugguacgugugcagcgaccggccaagaacggaaccgugauggacguuauuucacguagggaccagcggggcuccggccaggugggcacguacggcuugaacacauucaccaacauggaggcccagcugauccgccagauggaguccgaagggauauucagucccuccgagcucgagacaccaaaccuggccaggcgcgugcuggacuggcucgagaagcauggcgucgagcggcugaaacgcauggccaucagcggcgacgacugugucguuaagccaauagacgaccgguucgcuaccgccuugaccgccuugaaugacaugggcaaagugcggaaggacaucccucagugggagccgagcaaaggcuggaaugacuggcagcaaguccccuucugcucgcaccacuuucaccagcugaucaugaaggacgguagagagauugugguccccuguaggaaccaggaugagcucgucggccgugcgcgcgugagccagggcgccggcuggucccuccgggagaccgcgugccugggaaaaagcuaugcgcagauguggcaacuaauguacuuccaucgccgggaucuccgacuugcagccaacgccaucugcuccgcgguaccaguggacuggguaccgaccuccaggacuacgugguccauacacgcccaucaccaguggaugaccaccgaagacaugcuaucagucuggaauagaguguggaucgaggagaaucccuggauggaagacaagacgcacaucucuucauggggugacgucccuuaccuggggaagcgggaggaccaguggugcggcucccugaucggccuaacagcgcgcgcaaccugggccaccaauauccaggucgcuaucaaccaggugcgaagacucaucgggaacgaaaauuaucuggauuacaugacaucaaugaagcgcuuuaagaacgaguccgacccagaaggggcccugugguga

SEQ ID NO: 24485 - RNA, 9879 nt, Artificial Sequence
  derived and/or modified CDS sequence (opt11) from DENV-1__GU131781__SS-prME
uccgucaccaugcugcuaauguuaaugccuaccgccuuggccuuccaccucacgacccggggcggggagccucacaugaucgugucuaagcaggaacguggcaagagcuuacuguuuaaaaccagcgccgggguaaacaugugcacccucaucgcgauggaccugggcgaauucugugaggacacuaugacauacaagugcccacgaaucacugaggccgagcccgacgacguggacugcugguguaacgccaccgacacgugggugacuuacgggaccugcagccagaccggcgagcaccggcgggacaagcgguccguggcacuggcgccacaugugggccuaggucuggagacgcgcacggagaccuggaugagcagugagggcgccuggaagcagauccagcgugucgagaccugggcuuugcgacaccccggguuuacgguaauagcccucuuccuggcccacgccaucggcacaucuauuacucaaaaggguaucaucuucauccuucugaugcuggugacacccucaauggccaugcggugcgucggcaucgggagccgggacuucgucgaggggcuguccggcgccacguggguggacgucguccuugagcacggcagcugcgugaccaccauggcaaaagacaagcccacucuggacauugagcugcucaagaccgaggucacuaaccccgcgguccugcggaagcucugcauagaagccaagaucuccaacaccaccacggacagccggugccccacccagggagaagcaaccuuaguagaagagcaggacgcuaacuucgucugccggcguaccuuuguugaccggggcugggggaacgggugcgggcuuuucgguaagggguccuugaucacaugugccaaguuuaagugcguuaccaagcucgaaggcaaaauaguacaguacgagaaccugaaguacagcguaaucgugacgguccacaccggggaucagcaucaaguggggaacgagucgacagaacacggcaccaccgcgaccaucacgccccaagcccccucaacggagauccagcugacugacuacggggcauuaacucuggacugcagucccagaacuggccuggacuucaaugaaaugguccuccucacgaugaaggaaaaguccuggcugguacacaagcaaugguuccucgaucugccccuacccuggacgucuggcgccuccacaagucaagagacguggaaccggcaagaccuccucgucacguucaagaccgcccacgcgaaaaaacaggaggucgucgucuugggaucccaggagggcgcaaugcacaccgcccuaaccggggcgacggagauccagaccuccggcaccaccacuauauucgcugggcaccugaagugucgccugaagauggauaagcucacccuuaagggcauguccuaugucaugugcacuggguccuucaagcuggagaaggagguugccgagacacagcacgguacggugcucguccagauuaaauacgaaggcaccgacgcccccugcaagaucccguucuccacccaggacgagaaggggguuacccagaauggccggcugaucacggcuaacccuaucgugaccgacaaggacaagcccgucaacaucgaggcugagccgccuuucggggaaagcuauaucgugaucggcgcgggggagaaggcccugaagcuguccugguucaaaaaggguuccaguaucggcaagauguucgaggccaccgcgcgcggugcccggcggauggccaucuugggcgauaccgccugggacuucgggagcaucggcggcguuuuuacuuccgucgggaagcugguucaccaaaucuucgggaccgcauacggcguccuguucagcggcgucuccuggaccaugaagaucgggauuggcguguuacuaaccuggcugggccucaacucacgcuccacaucuuuauccaugaccugcauagccguagggcuggucacuuuguaccugggcgugauggugcaggccgacagcggcugugucgugaacuggaagggcagagaacugaagugcgggagcggcauauucgugaccaaugagguccacacguggacugagcaguacaaauuccaggcggacuccccgaaacgccuaagcgcagccaucggcaaggccugggaggagggggucuguggcauccggucggccacccggcuggagaauaucauguggaagcagaucagcaacgagcugaaccauauccugcuagagaacgacaugaaauucaccguggugguuggggacgucgcaggcauccuggcccaagggaaaaaaaugauccggccccagcccauggaguauaaguauuccuggaaauccuggggcaaggccaagauuaucggcgcagauguccagaacacaacguucauaaucgacgggccaaacacgcccgagugcccugacgaccagcgcgcguggaacaucugggagguagaggacuacggauucgggaucuucaccaccaauauauggcucaaacugcgggauuccuacacgcaagugugcgaccaccggcugaugagcgcagccaucaaagacuccaaagcaguccacgccgacaugggcuacuggaucgagagcgagaagaacgagaccuggaaacucgcgcgugccuccuucaucgaggugaagacguguauuuggcccaagagccacacccugugguccaacggugugcuggaaagcgagaugauaauuccaaagauuuacgggggcccgaucucacaacauaacuaccgacccggguacuucacccagacugccggcccauggcaccucgguaaacuagaacuggacuuugaccucugcgagggcacaaccgucgugguggacgagcauugcggcaaccggggcccaagccugcgcaccacgaccgucaccggaaagauuauacacgagugguguugcaggucgugcacuuugccgccucugcgguucaagggggaggacggcuguugguacgggauggaaauucgcccggugaaggagaaggaggagaaccuggucaagucaaugguaagcgccggcucuggcgagguugacagcuucucuuuaggguugcugugcauaaguauaaugauugaggaggugaugaggucccgauggagccgcaagauguugaugaccggcacccucgccguuuucuuccugcugaucauggggcagcucaccuggaacgaccugauaaggcugugcaucauggugggcgcgaacgccuccgaccgcauggggaugggcaccaccuauuuagcccugauggccacguucaagaugcgcccgauguuugcggugggccugcuguuccggcgcuugacaagccgggaggucuuacuccugaccauaggccugucccucguggcaagcgucgagcugccgaauucccuggaggaguugggcgacgggcuggcuaugggcaucaugauccugaagcuccuaaccgauuuccagucccaccagcugugggccacccuccugucccugaccuucaucaagacgaccuucucacuccacuacgcguggaagaccauggcuauggucuuauccaucgugucucuguucccccuguguauguccaccacaucgcaaaagaccaccugguuaccuguccugcucggcucccuggggugcaagccgcugaccauguuccucaucgccgagaacaagaucuggggccgcaagucuuggccccuaaacgaggggaucauggcagugggcauuguuagcauccuccucuccagccugcugaagaacgacguuccccuugccgggccccugaucgccgguggcaugcuaaucgcgugcuacgugaucuccgguagcuccgccgaccugucgcuugagaaggccgccgaggugucgugggaagaagaggcggagcacucaggcgcaucucacaacauccuggucgaggugcaggacgacggcaccaugaagaucaaggaugaggagcgugacgacacccucaccauccugcugaaggccacccuacucgccguuagcggagucuauccacuauccaucccugcuacccucuucguuugguacuucuggcagaagaagaaacagcgcagcggcgugcugugggacacaccgagcccacccgaagucgagagagccguacuggacgacggcaucuaccgcaucaugcagcgaggcuuacugggacgcagccaggugggagucggggucuuucaggagaacguguuccacacuauguggcacgugacaagaggcgcggugcugauguaccagggcaagcgccucgagccuuccugggccucugugaagaaagaucucaucuccuauggcggcggguggcgacugcagggcagcuggaacacgggggaggagguccaggugauugccguugagcccggcaagaaccccaagaauguccagacugcgcccgggaccuucaaaaccucggagggcgaggugggugcuaucgcgcuggacuucaagcccgguacuagcgguagccccauagugaaccgcgaaggcaagaucgucggccuuuacggcaaugggguggugacaacuuccggcaccuacgucagcgccaucgcccaggccaaggccucccaagaggggccccugccggagaucgaggaugaggucuuucggaagcgcaaucugaccaucauggaucuccaucccggcagcgguaagacgcggcgcuauuugcccgccaucgugcgugaggccaucaagcgcaaacuccgcacccuuauccuggccccuacaagagucgucgccuccgagauggcggaggcccugaaaggcaugccaauccguuaccagaccacggccgucaagucugagcacaccgguaaagagaucguagaccucaugugccaugcgaccuucaccaugagacugcuuucucccgugcgcguacccaacuacaacaugauuaucauggacgaggcccauuucacggacccgagcuccaucgcggcccgcggguacaucucaacccgcgucggcaugggggaggccgccgccaucuucaugacggccacgccgcccggcuccguggaggccuucccucagagcaaugccgugauucaagaugaggagcgggacauaccggaacgcucauggaauagcgguuacgaguggaucaccgacuuccccggcaagaccgucugguucgugccuuccauaaaaagcggaaacgacaucgccaacugccuccguaagaaugguaagcgcgugauccaacugucccggaagaccuucgacaccgaguaccagaagacgaagaacaacgacugggacuaugucgugaccaccgacaucucagaaaugggcgccaacuuccgcgcugaccgggugaucgacccgcgccggugcuugaagcccgucauccucaaggacgggcccgagcgcgugauccucgcuggccccaugcccgucaccguggccucugccgcgcagcggcgcggccggaucggacgcaaccacaacaaggaaggcgaccaguacguguacaugggucagccacugaacaacgacgaagaccacgcgcacuggacggaggcgaagaugcuucucgacaacauaaacacccccgagggcaucauccccgcccuguuugagcccgagcgggagaaguccgccgcgauugacggggaguaccgccuccgaggcgaggcccggaagaccuucgucgaacugaugcgcaggggggaccugccgguguggcuaucguauaagguggccagcgaggguuuccaguacagcgaccguagauggugcuucgacggcgagcgcaacaaccaggugcuugaggagaauauggaugucgagauauggaccaaggaaggggagcggaagaaguuacguccgcguuggcuugacgccaggacguacuccgauccacuggcacugcgagaguucaaggaguucgcggccggucgccggagcguguccggagaucucauucuggagaucggcaaacucccucaacaccucacccagcgcgcccaaaacgcccuggacaaccuggucaugcuacauaauagcgagcagggugggcgggcauaccgccaugccauggaggagcugccggacaccaucgagacccugauguugcuggcccuaaucgccgugcuuacgggcggggugacccuguucuuucuguccggacgagggcucgguaagacuagcaucggccuucugugcgugauggccagcagcgugcuucuguggauggcgucgguggagccccacuggaucgccgcaagcaucauccuggaguucuuucucaugguccuguuaaucccagaacccgaccgccagcggaccccgcaggacaaucagcucgccuacguugugauuggucugcuguucaugauccucaccgucgccgcgaacgaaaugggccugcuggaaacgaccaagaaagaucucgggaucggccacguggccguggaaaaccaccaucacgcagccaugcucgacgucgaccugcaccccgccuccgcguggacccuguacgccguggcaaccacaauuauuaccccuaugaugcgccauacgauugagaacaccacggcgaacaucagccucacugccauugcgaaccaggcagccauacugauggggcuggauaaaggguggcccauauccaagauggauaucggcgugcccuuacuggcacucggguguuacucacagguaaaccccuuaacccugacagcggcaguacucaugcugguugcgcacuacgccaucauugggcccgggcugcaagcgaaggcaacgcgagaggcccaaaagcggacugcugccggcauaaugaagaacccgaccgucgacgggauaguggccaucgaucucgacccaguggucuacgaugcgaaguucgagaaacaguugggccaaaucaugcugcucauccugugcaccucccaaauccugcucaugcgcacaaccugggcccugugcgagagcaucacgcuggcgaccggcccccuaacuacccugugggagggaucccccggcaaguucuggaacaccacgaucgccgugagcauggccaacaucuuccgggggagcuaccuggcgggcgccggucucgcuuucucccugaugaagucccucgggggcggccggcgggggacgggggcccagggcgagacccucggcgagaaguggaaacgccagcugaaccagcuguccaagagcgaguucaacacuuacaagcgguccgguaucauggagguggaccgcagcgaagcgaaggaaggccucaagcgaggggagaccacgaagcacgccgucucacggggcaccgccaagcugcggugguucguagagcgcaaccuugugaagccggaagggaaggucauugaucugggcugcggccgcggcggguggagcuauuauugcgccgggcuuaagaaagugacagaggugaagggauacaccaagggcgggccgggccacgaagagcccaucccaauggcaacguacgguuggaacuuggucaagcuccauagcggaaaggacguguuuuucauuccacccgaaaagugcgauacccuccugugugauaucggagaguccuccccaaaccccaccaucgaggagggccgcacccugcgggugcucaagauggucgagccauggcugcgagggaaccaguucugcauaaagauccuaaacccauacaugccuagcgugguggagacgcucgagcagaugcagcggaagcaugggggcaugcugguccguaacccccuaucccggaacagcacucacgagauguauuggguuuccugcggaaccgguaacaucgugagcgcggucaacaugaccuccaggaugcuccugaaccgcuucaccauggcccaccguaaaccgacguacgagagggacguugauuugggggcaggcacccggcacguggcggucgagcccgaagucgccaaucuagacaucaucgggcagcgcauagagaacaucaagcacgagcauaaaagcaccuggcauuacgacgaggacaaccccuacaagaccugggcguaccacggguccuaugaggucaagccaagcggcucagccuccagcauggugaacgggguggucaagcugcucacgaagccgugggacgucaucccgauggugacccagauugccaugaccgacaccacgcccuucggccagcaaagagucuucaaagagaagguagacacccgcacucccaaagccaagcgugguaccgcccagaucauggaagugacggcgaaguggcucuggggcuuccugucccgcaacaagaaaccgcggaucugcacccgcgaggaauucacccgcaagguccgcagcaacgccgccaucggggcuguuuucguggacgagaaccaguggaacuccgcgaaggaggccgucgaggacgagcgguucugggaucuagugcaucgcgagcgcgaacugcauaaacaggggaagugcgcgaccugcguguacaacaugauggguaagcgggagaagaaacugggggaguuugguaaggccaaagggucgcgggcaaucugguauauguggcugggcgcgagauuucuggaauucgaggcauugggcuucaugaacgaagaccacugguucucccgggagaacagccuguccggggucgagggagaggggcuccacaagcugggcuauauccugcgcgacaucagcaagauccccgggggcaacauguaugccgacgacacggcaggcugggacacccguauuaccgaggacgaccuccaaaaugaggcuaagaucaccgacaucauggagcccgagcacgcgcugcuggccagaaguaucuucaagcugaccuaccagaacaagguggugcggguccagcggccagccaagaacgguaccguaauggacgugauuagcagacgggaccaacgcggcuccggacaggucggcacauacggccugaacaccuucacgaacauggaggcacagcugauucggcagauggagagcgaaggcauauuuucccccucagagcucgagaccccuaauuuagccggccgagugcuggacuggcuggagaaacacgguguggagcgccugaagcgcauggcaaucuccggcgacgacugcgucgugaagccuauagacgaccgguucgccaccgcccugacagccuugaacgauauggggaaggugcgcaaggacaucccacaaugggagccgagcaagggcuggaacgauuggcaacaaguccccuucugcagccaucacuuccaccaacugaucaugaaggacggccgggaaaucguugugcccugccgcaaccaggacgaacugguugggcgggcccgggucucccagggcgcgggguggagccuucgggagacagccugucucggcaaguccuaugcccagauguggcaacugauguauuuccaccgccgggaccuccgcuuggccgcgaacgccaucugcagcgccgugccggucgauugggugccuaccucgcggaccacauggagcauccacgcccaccaucaauggaugacaaccgaggacaugcuaucgguguggaaccgcgucuggaucgaggagaaccccuggauggaggacaaaacccauaucagcucauggggagacgugcccuaccugggcaagcgggaggaccaauggugcggcucucugaucggguuaaccgcccgcgcgacgugggccacaaacauccaggucgccaucaaccaggucaggcgcuuaaucggcaaugagaacuaucuggacuacaugaccucgaugaagagguucaaaaacgagucugacccagaaggugcccugugguga

SEQ ID NO: 24486 - RNA, 9879 nt, Artificial Sequence
  derived and/or modified CDS sequence (opt11) from DENV-1__GU131782__SS-prME
uccgugaccaugcugcugaugcugaugcccacagcccuagcauuccaccucaccacccgggggggggaaccccacaugaucguaacuaagcaagagcggggcaagagccuucuguuuaagaccucugcgggggugaacaugugcacccucaucgccauggaccugggcgagcugugcgaggacaccaugaccuauaagugcccgcgcaucaccgaggccgaaccugacgacguagacuguuggugcaaugccacugacacaugggugacuuacgggaccuguucacagaccggcgagcacagaagggauaagcgcagcguggcucuggcgccccacguggggcugggacuagagaccaggacugaaacauggaugaguucugaaggggccuggaaacaaauucagcgugucgagacuugggcccucaggcacccgggguucacagugaucgcccucuuccuggcccacgccauuggcaccuccaucacccagaaggggaucauauucauucuccugaugcuaguaacgcccagcauggcaaugcggugcguagggaucggcagucgcgacuucgucgagggucucagcggcgccacauggguugaugucgugcuggagcaugggagcugcgugaccaccauggcgaaggacaagcccaccuuagauaucgaacuccugaagacagaagucaccaauccggcagugcugcggaagcuauguaucgaggcgaagaucucgaacaccacuaccgauucacgcugcccgacccagggcgaggcaacgcugauggaagagcaagacgccaacuucguaugccggcgcacguuuguggauagaggcuggggaaacggcugcgggcucuucggaaagggaucacuuauaacaugugcgaaauuuaaguguguuaccaagcuggaaggcaaaaucgugcaguaugagaacuuaaaauacuccgucaucguaaccgugcacacgggcgaccagcaccaggucgggaacgagucuaccgaacacggcacuaccgcgacgaucacgccccaggcccccacaagugagauccagcuuaccgauuacggggcguugacgcuggacuguuccccgcgcacgggcuuagacuuuaaugagauggugcuucugacgaugaaggagaaguccuggcucguccauaagcaaugguucuuagaccuuccucucccuuggaccagcggggcaagcaccucucaggagacguggaaccggcaggaccugcuggugaccuuuaagaccgcgcacgcgaagaagcaagagguagucguucucgggucacaggagggugcaaugcacacagcgcuaacgggggccaccgagauacagaccagcggcaccacgaccauuuuugcuggucaccuuaagugucgccugaagauggacaagcugacucugaaggguaugagcuacguuaugugcaccgguuccuucaagcucgagaaggagguagcagagacgcagcauggcaccguacucgugcagauuaaguacgaaggcacagaugcaccguguaaaauccccuucagcacccaggacgagaaggggguaacacaaaacggccguuuaauuacugcgaacccgaucgugaccgacaaggagaagcccgugaauaucgaagccgagccgcccuucggggaguccuacauugucauuggcgcgggcgagaaggcccucaagcucagcugguucaagaaggguagcaguaucggcaagauguucgaagcgacggcaagaggcgcccggcgcauggcaaucuugggagacacggcgugggacuuugggucgaucggcggcguguucacaucaguagguaagcugguucaccaaaucuucggcaccgccuacggugugcuguucuccggcguuucauggaccaugaagauuggaauuggcgugcuucugacuugguugggcuugaacucccgcucuaccucccugagcaugaccugcaucgccgucggguuagucacccuguaccugggcgucaugguccaagccgacucagggugugugaucaacuggaaggggcgggagcuaaaaugcggaagcggcaucuucguuaccaacgaggugcacaccuggaccgaacaauacaaguuucaggcggacucaccgaagcguuugucggccgcgaucgggaaggccugggaggagggaguuugcgggauuagaucggcaaccagacuggagaacaucauguggaagcagaucucaaacgaguugaaccacauccugcuggagaaugacaugaaguucaccgucgucgucggggacgucgugggcauucucgcacaggggaagaagaugauccggccgcagccuauggagcacaaguacagcuggaaguccuggggaaaagccaagaucauuggugccgacgugcagaacacuacguucaucaucgacgggcccaauacaccggagugccccgacgaccagcgcgccuggaauauaugggagguggaggauuacggauuugggaucuucaccacgaacaucuggcugaaguuacgcgacagcuacacgcaaguaugcgaccaccgguugauguccgcggcgauaaaggacagcaaggcugugcacgcugacauggguuacuggaucgagagcgagaagaacgagacauggaagcuggccagggcgagcuucauugaggucaagaccuguauuuggccaaagucccacaccuugugguccaacgggguacucgagagugaaaugaucauccccaagaucuacggaggaccgauaagccagcauaauuaccgccccgguuauuucacucagacugcagguccuuggcaucuggggaagcuggaacucgacuuugacuuaugcgaaggcaccacgguggucguggacgaacacugcgggaaccgggggccgucccugcggacgacaaccguaacgggcaagauuauccacgaguggugcugcaggagcuguacccugccgccccuccgcuucaagggcgaggacggcugcugguacggcauggagaucaggccugucaaggagaaggaggagaaccuugucaaauccauggugagcgccggccuaggggagguggacuccuucucacuuggacuccucugcaucagcauaaugauugaagagguaaugcgcucccgcuggucucgcaagauguugauggccggcacccuggccguguuccugcuguuaaucauggggcagcugaccuggaaugaucugauacgguuaugcaucaugguuggggcaaaugccuccgaccgcauggguaugggaaccacuuaccuugcucugauggccacauucaagaugcgcccgauguucgcggugggccuccuguuccggcgacugacuagccgggaaguguugcugcugacgaucgggcugucccuugucgccagcguggagcugcccaacucccuggaggagcucggcgacggacucgcgaugggaaucaugauccucaagcuacuuacugauuuccagccacaccagcugugggccacccuacuuucguuaacguucaucaaaacgacacucucccugcacuacgccuggaagaccauggcgaugguucuauccaucgugagucucuuuccucucugucugucaaccacuucgcagaaaaccacauggcucccaguucuguugggaucccucgguugcaagccacugaccauguuccuuaucgcugaaaacaagaucuggggccgcaaaucuuggccccucaacgaggggaucauggcagucggggugguaucaauccuguuauccucacuccucaagaaugacgucccccuggcugggccacugaucgcgggcggcaugcugaucgcgugcuacguaaucagcggcucaagcgccgaucugucgcucgaaaaggcugcggaggugagcugggaagaagaggccgagcacucuggcgcuucccauaacauccuggucgaggugcaggaugacgggacgaugaagauaaaggaugaggagcgggaugacacccuaacgauccuccuuaaggccacuuugcucgcuauuuccggaguguaccccuugucuauuccagcaacucuguucgucugguacuuuuggcagaagaagaagcagcgcaguggggugcugugggacacccccagcccgccagaaguagagcgggcgguccuugacgacggcaucuacagaaucaugcaacggggccugcuggguagaucccaggugggcgugggagucuuccaggagaauguguuccacacaauguggcacgugacacggggcgccguuuugauguaccaggggaaaagacuggaacccucaugggccuccgugaaaaaggaucucauuagcuacggggguggguggcgguugcagggguccuggaacaccggggaagaggugcaagucauugccguggagccgggcaaaaacccgaagaaugugcaaacggcccccggcacuuuuaagacccccgagggcgaggucggcgccaucgcgcuggacuucaagccggggaccaguggcuccccgaucgugaaccgcgaggggaaaaucguggguuuauacggcaacggggugguuacgacaagcggaaccuacguauccgcuauagcccaggcgaaggcgucucaggaggggccccugcccgagaucgaggacgaggucuucaggaaacgcaaccucacaauaauggacuuacacccaggcagcgggaagacucgucgcuaccucccugccauugugagagaagcgaucaagcggaaacuucguacccuuauccuagccccaacgcggguggucgccagugaaauggcggaggcccuuaaggguaugcccauccgauaucagacaacggcugucaagagcgaacauaccggcaaggagaucguagaccucaugugucacgccaccuucaccaugaggcuccuaucuccgguccgcgugccuaacuacaauaugaucauuauggacgaagcgcacuuuacugaccccaguuccaucgcugcccgcggcuacaucuccacacgcguuggcaugggggaggcugccgccaucuucaugacagcgaccccacccgguuccguggaggccuucccacagagcaacgcggugauccaggacgaggaacgugacaucccagagcgcucguggaauucgggguacgaauggaucacggacuuccccggcaagaccgucugguuuguccccaguaucaagaguggcaacgacaucgccaacugcuugcggaaaaacgggaagcgcguaauccagcucucccggaaaacuuucgacacggaguaccagaagaccaagaacaacgacugggacuacgugguuacuaccgauaucagcgagaugggcgcgaacuuccgcgccgaccgugugaucgaccccagacggugccugaagcccgugauccucaaagauggccccgaacgcgucaucuuagcuggcccgaugcccgugaccgucgcuuccgcagcgcaacggcgcggaagaaucggccgcaaucacaacaaggagggagaccaguacauuuacauggggcaaccccugaacaaugaugaagaccacgcacacuggacggaggccaagaugcuauuagacaauauuaacacccccgaaggcaucauucccgcccuguucgagcccgaacgggaaaagucagccgcgauugauggggaguaccgauugcgcggggaagcccguaagaccuuuguugaguugaugcgccgcggagaccuacccguauggcugaguuacaagguagccucggagggauuccaguauuccgaccgcaggugguguuuugacggugagcggaacaaucaagugcucgaggagaacauggaugucgagaucuggaccaaggaaggugagcggaaaaagcugcgcccucgguggcuggaugccagaacguacagcgauccucuugcccugcgggaguucaaggaguucgcggccgggcgccggucaguaucgggggaccuaauauuggagaucgguaaacucccccagcaucuuacccagcgcgcccaaaaugcccucgacaaucuggugaugcuucacaacagugaacaaggaggccgggcguaccgccacgcaauggaggagcuacccgacaccauugaaacucucauguugcucgcccugauagccgugcuaacgggcggggucacccucuucuuucugucugggagaggucugggaaagacaagcaucggccuucugugcguaauggcuucuucggugcuuuuauggauggcgucagucgagccucauuggaucgccgccucaaucauucuggaguucuuccuuaugguucuccuaaucccugagcccgaucgccagcggacuccgcaagacaaccagcuggcauauguggucauagggcuucuguucaugauauuaaccguugccgcaaaugagaugggacucuuagagaccaccaagaaggaccuggggauuggccacguggcagucgagaaccaccaccacgcuacaauguuagacgucgauuugcacccugccuccgcauggacgcuauacgcgguggcaacgacuaucaucacgcccaugaugcggcauaccaucgagaauacgaccgcgaacauuagccucacagcuauagccaaccaggcagcaauucuuauggggcuggacaaagguuggcccaucucuaaaauggacaucggcgucccccuccuggcguugggcugcuacagccaggugaauccgcucacccugacggccgcagugcuuaugcucgucgcccacuacgccaucaucggaccugggcuccaagcgaaggccacucgggaggcgcagaagcgcaccgccgccgggauuaugaagaaccccaccguagacggcauuguugccauagaccucgaccccguaguguacgacgcuaaguucgagaagcagcucggccagauuaugcuccugauuuuauguacgucccagauccuucugaugcggaccaccugggcucuaugcgagucgaucacccuggcaacgggcccauuaacaaccuuaugggaggggucuccuggcaaguuuuggaacaccacgauagcagugagcauggcuaacauauuucgagggaguuacuuagccggcgcgggcuuagcguuuagccuaaugaagucccucgggggcgggaggcgggggaccggagcucagggcgaaacccugggcgagaaauggaagcgccagcucaaccagcucagcaaaagcgaguucaacaucuacaagcgguccggaaucauggaggucgaccggucagaggcuaaggagggucuuaaacgcggugagaccacgcgccacgcggugucucgaggcacugcuaagcugcgaugguuugucgagcggaaucuagucaaacccgaggguaaagucaucgacuuagguugcggccgcggcggcuggagcuacuacugcgcuggucucaaaaaaguuaccgaagucaagggauacacaaaggguggacccggacacgaagagccuaucccgauggccacauacggguggaaucuggugaaacugcacuccggcaaagauguguuuuucacgccuccggaacgaugcgacacucugcucugugacaucggugagaguuccccuaacccgacgaucgaggagggccgcacccuucgggugcugaaaaugguugagccguggcuccgagguaaccaguuuugcauuaagauauugaacccuuacaugccaagcguggucgaaacucuggaacagaugcagcggaagcacggcggaaugcucgugcgaaaucccuuaucccgaaauagcacccacgagauguacugggucucgugcgggacagggaacaucguaagcgccguaaauaugaccuccagaaugcugcuaaaccgcuuuacgauggcgcaccguaagcccaccuacgaacgcgauguggaccugggagccgggacucggcacguggcaguggagccggaggucgcgaaccuggauaucaucggccaacguaucgaaaauauuaagcacgagcacaagaguaccuggcacuacgacgaggacaacccguacaagacuugggcguaccacgggucauacgaaguuaaaccaagcggcuccgcaagcaguaugguuaacggggugguaaagcuccuuaccaagcccugggacgucaucccaauggucacccagaucgccaugacggacacgacgccuuucggccagcaacggguguuuaaagagaaaguggacacccggaccccuaaagccaagcgggguacggcgcaaaucauggaggugaccgccagauggcuguggggcuuccucagccggaacaagaagccucguaucugcacgcgggaggaauucacccgcaaagugcgcucuaaugcggccaucggcgccgucuucguagacgagaaccaguggaacagcgccaaggaggcgguugaggaugagcgcuucugggaccugguacagaaggagcgggagcuccauaagcaaggaaagugcgccacgugugucuacaacaugaugggcaagcgcgaaaaaaaacuuggagaguuugguaaggcgaaggguucccgggccaucugguauauguggcuuggagcccgcuuccuggaguucgaggcgcucggguuuaugaacgaggaucacugguuuucacgggagaauagccugagcggggucgagggcgaggggcugcauaagcugggcuacaucuuacgcgauaucagcaagauccccgggggcaauauguacgccgaugacacugccgggugggacacccggauaacagaagacgaccugcagaacgaagccaagauaaccgauaucauggagcccgaacaugcacucuuggcgaccagcauuuuuaagcugaccuaccaaaacaaggugguacgcguucagcgcccugccaaaaacgggacuguuauggacguuauuucccggcgcgaccagcggggguccggccaggugggcacguacggccucaacaccuucacuaacauggaggcucagcugauucgccagauggagagcgaggggaucuuccuucccucagagcucgaaacaccgaacuuagcugagcggguacuggauugguuggagaagcacggcguugagcgauuaaagaggauggccauuagcggagacgacugcguggucaagccuaucgacgaccgcuuugcgaccgccuugacugcccucaacgauauggggaaaguccguaaggauaucccccaaugggaacccaguaagggguggaaugacuggcagcaagucccguuuugcucgcaccacuuccaucagcugauaaugaaggauggucgcgagaucguggugccgugucggaaccaggacgaauuggugggacgcgccagagugucccagggugccggcuggagccuccgagagaccgcuugccuagggaaauccuacgcccagauguggcagcucauguacuuucaccggcgggaccuucgucuggccgcaaaugcgauuugcucggccguccccguagauuggguaccuaccucgcgcacaaccuggucuauccaugcccaucaccaguggaugaccaccgaggauaugcugagugucuggaauagaguguggaucgaggaaaaccccuggauggaagacaaaacgcacgugucuuccuggggggacguacccuaccuugguaagcgcgaggaccaauggugcggcucucugaucggccuaaccgccagagccaccugggcgaguaauauccaaguggcaaucaaccaggugcggaggcugaucgggaacgagaacuaucuggacuacaugacuuccaugaagcgguuuaaaaacgagggcgacccagagggagcccugugguaa

SEQ ID NO: 24487 - RNA, 9879 nt, Artificial Sequence
  derived and/or modified CDS sequence (opt11) from DENV-1__GU131784__SS-prME
ucaguuaccaugcuacuuaugcugaugccaacggcgcuagcguuccaccuaacgacaagagguggggaaccgcacaugaucguaagcaaacaggaacgcgggaaaagccuuuuauucaaaacaucggcugggguaaacaugugcacgcuaaucgccauggaccugggagaauuuugugaagacaccaugacguacaaaugcccacggaucacugaagcggaacccgaugauguggauugcugguguaacgccacggacacauggguaaccuacggaaccugcucucaaacgggggagcacaggagagacaaacggucuguagcgcuggcaccccacgucgggcugggacuagagacaaggacggaaaccuggaugaguuccgaaggcgcguggaaacaaauccaaagagucgaaacaugggcccuuagacacccuggauucaccgugaucgcgcuguuccuggcccaugcaauaggaacaucaaucacgcaaaaggggauaaucuucauacuccuuaugcucgugacuccgucaauggcaaugagaugcguggggauagguuccagagacuucguagaaggucucagcggugcgacguggguggacguagucuuagagcacggcagcuguguaacaacaauggcaaaggacaagcccacccuagacauugaguuacugaaaacagaaguaacgaacccugccguacuccgaaaacuaugcaucgaggcaaaaauaaguaacacaacgacggacucccguugcccgacacagggggaagcgacacucguagaagaacaagaugcgaacuucgucugccgacgaacguucguagacagaggcugggggaacgggugcggacuguuuggcaaagggucacugaucacaugcgcgaaauuuaaguguguaacuaaacucgagggcaaaacaguacaauacgaaaaucucaaauacagcguaaucguaaccguacacacaggcgaccaacaccaggucgggaaugaaucgacggagcauggaacuaccgcaacaaucacgccgcaagcaccaucgacagagauccaacucacggauuacggggcccuuacccuagacugcucacccaggacaggccuggacuucaaugaaaugguuuugcucaccaugaaagagaaaaguuggcuaguacacaaacagugguuccucgaccuaccacuaccguggaccucuggagcuagcacaagucaagaaacauggaauaggaaagaccuacucgucacauuuaagaccgcccacgcuaagaagcaggagguugucgugcuagggucacaggaaggggcaaugcacacagcccucaccggugccacggagauccagaccaguggcaccaccacaaucuucgccggccaccugaaauguagacuuaaaauggauaagcucacucugaaagggaugagcuaugugauguguacgggaucuuucaaacuagaaaaggaggucgccgaaacacaacacggcacaguccugguccagaucaaauacgagggcacggacgccccgugcaaaaucccuuucaguacccaggacgaaaaaggagugacccaaaacggccgacuaaucaccgccaacccgauagugacagacaaggagaaaccaguuaauauagaggcggaaccacccuucggugaaagcuacaucguaauaggagcgggggaaaaagcucugaagcuaagcugguuuaagaaaggcuccaguaucggcaaaauguucgaagcaacugcccgaggcgcgcgcagaauggcaauacucggcgacacggccugggacuucgguuccaucggaggggucuuuacgucgguagguaagcuaguacaucagauauucggcaccgcuuacggcgugcuauucagcggcgucucguggacgaugaaaauaggaaucggaguucugcugaccuggcuaggacuuaacagccgcagcacgagcuuaagcaugacuuguauagcagucggccuggugacuuuguaccucgguguaauggugcaggcggauagcggcugcgugauaaacuggaaaggcagagaacucaagugugggagcgggaucuucgucacgaacgaaguccacacauggacggaacaguauaaauuccaagcggacucaccaaagagguuauccgcugcaauaggaaaggcuugggaggagggagucugcggcaucagaagugcaacacgccuggagaacauaauguggaagcaaauaaguaacgaacuaaaccacauccuacuggaaaacgacaugaaguucacagucgucguuggggacguugcugggauauuagcucaaggcaagaaaaugauccguccucaaccgauggaguacaaauacuccuggaaauccuggggcaaggccaagauaauaggcgcggaugugcaaaacaccacauucaucauagacggaccaaacacuccggaaugcccggaugaccaacgcgccuggaauaucugggaggucgaagacuauggauucggcauauuuaccaccaacauuuggcuaaaacucagagacucuuacacccaagugugcgaccaccggcugauguccgcugcaauuaaagacagcaaggcaguacacgcggacaugggauauuggauugagucggagaaaaacgaaaccuggaaacuggcgagggcuucguucauugaggucaagacaugcaucuggcccaagagccacacauuguggagcaaugggguccucgagagcgaaaugauaauaccaaaaauauacggcggaccaaucagccagcacaacuaccgcccagguuacuucacucaaacggcagggccguggcaccuaggcaaacuggaacuugacuucgauuugugugaaggcacaacgguaguaguagacgaacauugcggcaacagggggccgagucuccgaacaacgacugucacagggaagauuauucacgaaugguguugccgaagcugcacacugccgccgcugcgcuucaaaggagaagacggaugcugguacggcauggaaauacgcccggugaaggagaaagaagaaaaucucgucaaaucaaugguuucggcaggaagcggggaagucgacuccuuuucauugggccugcucugcauaagcaucaugaucgaggagguaaugaggaguagauggagucggaagaugcuuaugaccggcacacucgcaguauucuucuuauugauaaugggacaacugaccuggaacgacuugauccguuugugcaucaugguuggagccaaugcaucugaccgcauggggaugggaacgacauaccuugcccugauggcgacauuuaagaugcgacccauguucgccgucggccuguuauuucgacgacucacguccagagagguucugcuacuaacaauaggcuuaucccugguggccagcguugaauugcccaauucgcucgaagaauugggugauggacuagcaauggggauaaugaucuugaagcuccuaacggacuuccaaucccaccagcuaugggcaaccuuacucucucugacauucaucaaaacaacguucucgcuacaccacgcuuggaaaaccauggcaaugguacuaaguaucgucucccuauucccgcuaugccugucuacaaccucgcagaaaacuacauggcuuccgguacuacuagggucacucgggugcaagccccugacgauguuccucauagcagagaacaaaaucuggggcagaaagucauggccuuugaacgaggguauaauggcagucgggaucgugagcauucuccuaagcucacuguuaaagaacgacgucccucuagcaggcccgcuaauagccggcggaaugcuaauagcgugcuacguaauaucaggcucgagcgcggacuugucgcucgagaaagcagccgaagucucaugggaggaagaagccgaacacucaggugccagucauaacauauuagucgaagugcaagacgacgggaccaugaaaauaaaggacgaggagcgugacgacacccuaacaauauuacuaaaagccacccuacuugcggucuccggaguauacccacuaucaauaccggcgacccucuucguaugguacuucuggcagaagaagaagcaacgauccggcguccugugggacacgccaagcccacccgaagucgaacgagccguccuggacgacggaaucuauagaaucaugcaaagagggcucuugggcaggagccaggucggagugggaguauuccaagaaaacguguuccacaccauguggcacgucacgcggggagcaguccucauguaccaggggaaaaggcuagaaccauccugggcaagugucaagaaagaucugaucagcuauggcggaggguggcgacugcaaggaucauggaauacgggagaggaagugcagguaauagcggucgaaccgggcaaaaaucccaaaaacgugcaaaccgcccccggaacuuucaagaccucugaaggcgagguuggagccauugcacuagauuucaaacccggcaccuccggcagccccaucguuaaccgugaaggaaagauagugggcuuauacggcaauggagucgucacaacaagcggaaccuauguaagcgcaauugcacaggcgaaagcaucccaagaaggaccccucccagagauagaggacgaaguuuuccgaaagcgaaaccuaaccauuauggaccuacacccggguaguggcaagacacgccgcuaccugcccgcuaucgucagggaggcaaucaaaagaaagcuaagaacacucauccuugcgccaacccgagucguagcaagcgaaauggcugaagcccuaaaaggaaugccaauccgcuaucaaaccacggccgucaaaagcgaacacacaggaaaagagaucguagaccuaaugugccaugcuaccuucacaaugagacugcucucccccgugcgcguaccaaacuacaacaugaucaucauggacgaggcccacuucacagacccuaguucgaucgcagccagaggguacaucagcacccgaguggggaugggggaagcagcggccaucuucaugacagcgacgccgcccggaucuguugaggcauucccacagagcaacgcuguuauucaggacgaggaacgagacaucccggaacgaucauggaacucgggauacgaauggaucacggacuuccccggaaaaacaguaugguucgugccgucaaucaaguccggcaaugacaucgccaacugcuugaggaaaaacgggaagagagugauacagcuaucgcguaagacguucgacaccgaguaccagaaaacuaagaacaacgacugggauuacgucguaaccacagacauaucagaaaugggagcaaacuuuagagcagauagggugauagacccaagacggugucucaaaccagucauccuuaaggacggaccugaaagagucauuuuggcagggccaaugcccguaacaguagccucagccgcccagaggagggggcgcauagggcgcaaccacaacaaggagggcgaccaauacauauacaugggccaaccccugaacaaugacgaagaucaugcgcacuggacugaagcgaagaugcugcuugauaacaucaacacaccggaggggaucauacccgcguuguucgaacccgaaagagagaaaagugcagcuaucgacggcgaauacagacuuagaggugaagcccggaagaccuucgucgaacugaugaggagaggcgaucuacccgucuggcucucguacaaggucgccagugagggauuucaauauagcgauagacgaugguguuucgauggggagcggaacaaucaagugcuagaggaaaauauggacgucgaaaucuggacaaaggaaggagagagaaagaaacugcgcccuagauggcucgacgcccggacguacagcgacccacuagcccuccgcgaauuuaaagaguuugcagcuggacgccggagcgugucaggcgaucugauacuagaaaucggcaaacuaccacagcaccucacccaacgggcccaaaaugcgcucgacaaccuaguaaugcuacacaacagcgagcagggaggccgcgcauaucgccacgcuauggaggagcuacccgacacgauagaaacccuuaugcugcuggcacuaauugcaguacuuacaggaggggugacccuauucuuucugagcggccggggcuuagggaaaacgagcauaggguuauugugcguaauggcauccagcguccuacuguggauggcgaguguagagccgcacuggauagcggccagcaucauacucgaguucuuccuaaugguacuauugauuccagaaccugaccgucaacggacaccacaagacaaccaacuagcguauguugugaucggucuacuauuuaugauacucacagucgccgcgaaugaaaugggccuucucgaaacgaccaaaaaggaccuaggaauaggacaugcggcgguggagaaccaccaccacgcggccaugcuagacguggaccuccaccccgcuucagcauggacguuguacgcaguagccacaacaaucauaacaccgaugaugcggcauacaauagaaaauacaacggcaaacaucucgcuaacggccauagcgaaccaagcggcgauucuuaugggacuagacaaaggauggccgaucagcaagauggauauaggaguuccgcuccuggcauuaggcuguuacagccaagucaauccacucacauuaaccgcggcugugcuaaugcucguugcacauuacgcgauaauaggcccgggacugcaggccaaagcaacaagagaagcgcagaagaggacugccgcagguaucaugaaaaaccccacagucgacggaauagucgcaaucgauuuggaccccgugguguacgaugccaaauucgaaaaacaacuugggcaaauaaugcuccuaauauugugcaccucacagauacuccugaugaggacgacuugggcccucugcgaaagcauaacuuuagccacaggaccgcugacaacuuuaugggaagggucaccggggaaguuuuggaacacgacaaucgcaguaucaauggcgaacaucuuucgcgggucauaccucgccggcgcaggucucgcauuuucguugaugaagagucuagggggugggagaaggggaacaggggcacaaggagagacacuaggggaaaaauggaagcgacaguugaaccaacuaucgaaaagcgaauuuaacacauauaaacgauccggcauaauggaggucgaccgguccgaagcaaaagaaggccuaaagcgaggagaaacgaccaagcacgcggucagcagagggacagccaagcuaagaugguucguggaacgcaauuuggugaagccugaaggaaaaguaauagaccuuggcugugggcgcgggggcuggucauacuacugcgcggggcucaagaaaguaacggagguaaagggcuacacuaagggaggacccggacacgaagaacccaucccaauggcaaccuauggcuggaaucucgugaaacuucacucaggaaaagacguauucuuuaucccucccgaaaagugcgacacccugcucugcgacauuggcgaguccaguccaaaucccacuauugaggaaggcagaacccuacgcguacuaaagaugguagaaccauggcugcgcggaaaccaguucugcauaaagauucuaaacccguauaugcccuccguggucgagacacuagagcaaaugcagaggaaacacggaggaauguuaguaagaaacccacuaucaagaaauagcacacacgagauguauuggguaucaugcggaacaggcaacauaguaagugcggugaacaugacgucccguauguuauuaaaccgguuuacuauggcacacaggaaaccaacguaugaaagggacguagaccucggcgcgggaacccgacacguggccguagaacccgaaguugcgaaccucgauauaaucgggcaaagaauagagaauauaaaacacgagcacaagagcacauggcacuacgacgaagauaacccauacaaaacaugggccuaccacggcucuuacgagguaaaaccgagcggcagcgcgaguucgauggugaauggggucguaaaacuccucacgaagccaugggacguuauaccgauggugacgcagaucgcuaugacugauacaacaccauucggacaacaacggguguucaaggaaaagguagacacccgaacuccuaaagcgaaaagaggaacggcacagaucauggaggucacagccaaguggcucuggggcuuccucucaaggaacaaaaagccccgaauaugcacgagggaggaguucaccaggaagguccgguccaacgcggccauaggcgcaguauuugucgacgaaaaccaauggaacucagccaaagaagccguugaagacgaacgcuucugggacuugguacaccgggaacgagaacuacacaagcaagggaagugcgcaaccugcguauacaauaugaugggaaagcgagagaaaaagcugggggaguucgggaaggccaaaggaagucgugcaaucugguacauguggcucggagcacguuuccuagaguucgaggcucucggauucaugaacgaagaccauugguucucuagagaaaacucauugaguggaguagaaggggaagggcugcacaagcucggguacauauugcgagauauaucaaagaucccaggcggcaauauguaugcagacgacacagcaggcugggacacccggauaacugaggacgaccugcagaaugaggcaaaaaucacugauaucauggagccggaacacgcacuauuggcuaaaucgaucuuuaaacugacauaccagaauaaaguagucagaguacaacgucccgccaagaauggcacggucauggacgucaucucccgacgagaccagaggggguccggccaaguaggcaccuacggccugaacaccuucacaaacauggaggcucaacuaauccggcaaauggaguccgaaggaaucuuuuccccgagcgaacuagaaacaccgaacuuagcacguagaguccuagacuggcuagagaagcacggaguagaacgccuuaaaagaauggccauuucgggagacgacugcguagugaagccgauagacgaccgguuugcaacugcacuuaccgcgcugaaugacaugggaaaaguacgaaaagacauaccccagugggaacccuccaaaggguggaaugacuggcaacaggucccauuuugcagccaucauuuccaccagcucaucaugaaagacggucgcgagauagugguacccugcagaaaccaggacgaacugguggggagagcacgcguuucgcagggggccggcuggagcuugagagaaacagccugucuagguaaaagcuaugcgcagauguggcagcuaauguacuuccaccggcgggauuugcgacuagcggccaacgccauauguucggccguucccgucgauugggugccgacgucccgcacuaccuggucaauucacgcgcaccaucaauggaugacaaccgaggacaugcucucggucuggaaucggguauggauagaggaaaauccauggauggaagauaaaacgcacauaucgaguuggggagacgugcccuaccugggcaagcgugaggaucaguggugcgguucacucauaggccuaaccgcaagagcaaccugggcaacaaacauacaagucgccaucaaccaggugaggagacuuaucgggaacgagaauuauuuggauuacaugacaaguaugaagcgguucaaaaacgaaucggacccggaaggagcacucugguga

SEQ ID NO: 24488 - RNA, 9879 nt, Artificial Sequence
  derived and/or modified CDS sequence (opt11) from DENV-1__JF937612__SS-prME
agcgugaccauguugcucauguuaaugccuacugcucuggccuuccaccucaccacccgcggcggggagccacauaugaucguaucaaagcaagagcggggcaagagcuugcuguucaagaccagcgccggggugaacaugugcacccucaucgccauggaccugggugagcugugugaggacacuaugaccuauaaguguccccggaucacugagacggagccugacgacguggauugcuggugcaacgcaacggacaccugggucaccuacgggacuugcucacagacuggcgagcaccggcgugacaagcgcuccguugccuuagccccucacgugggccugggucuggaaacccggaccgaaacauggaugagcucagagggugcuuggaagcaaauccagcgggucgagacgugggcccucagacaucccggauuuacagugauagcucuguuccuggcucaugcuaucggaaccagcauuacacagaaagggaucauuuucauccuccuaaugcuugugacgccguccauggccaugaggugcgucggaauugggucgcgcgacuucguggaggggcuauccggggccaccugggucgacguagugcuugaacacggaagcugugugaccaccauggccaaggauaagcccacucuggacaucgagcucuuaaaaaccgaggugaccaacccggccgugcugcggaagcuuugcaucgaagcgaagaucuccaacacgacaaccgacucacgcugcccaacccaaggugaggccacucuuguggaggagcaggacgccaacuucguaugccggcgcacauucguagacagggguugggggaauggcugugggcuauucgggaaggggucccucaucaccugcgccaaguucaagugcguaaccaaguuagaaggcaaaaucguacaguacgagaaccugaaauacucaguuaucgugacugugcacacgggcgaccaacaccagguagggaacgaguccaccgaacauggaaccaccgccacuauaaccccacaggcgccgaccacugagauucaauuaaccgacuacggggcccuaacucuggacugcagcccacgcacggggcuggacuucaacgaaaugguucuacugacgaugaaggagaaauccugguuagugcauaaacaaugguuccuagaccucccccuccccuggaccucaggggccucgacgucucaagagacguggaaccgccaggaccuucucguaaccuuuaagaccgcucaugccaagaaacaggaaguagucgugcuggguagucaagaaggggcuaugcacaccgcacuuaccggggccacagagauccagaccuccggaacgacaaccauauucgccggccaucuaaagugucgccuaaagauggacaaacuaacccugaagggaaugucguacguaauguguacgggcuccuucaaauuagagaaagagguagccgagacccaacacggcaccgugcugguacagauuaaguacgagggaaccgacgcaccaugcaaaauccccuucagcacacaggacgagaagggcgugacccagaacggccgucugaucaccgcuaacccgaucgugaccgacaaggaaaagcccgugaacauagaagccgaaccucccuucggcgaaucauacaucgugaucggggcaggggagaaagccuugaagcugagcugguucaagaaaggcaguagcaucgggaagauguucgaggcgacggcccgcggggcucggcgaauggcgauacugggagacacggcaugggacuucgguaguauaggcggcguguucacuucugucgggaaauuagugcaccaaaucuuuggcaccgcuuauggcguucucuucucgggcgucucuuggacgaugaagauugguaucggggugcuacugaccuggcucggccugaacucccgcuccaccucccugucgaugaccuguauugccgucggucucgucacgcuguaccugggcgugaugguucaagcggacucagguugcgucauuaauuggaaaggccgugaauugaagugcgguagugguaucuucgugaccaacgaggugcacacauggacagaacaguacaaguuccaggccgauucucccaagcgccuauccgcugccaucggcaaggccugggaggaaggggugugcgggaucaggagcgccacacgccuggaaaacaucauguggaagcagauauccaacgagcucaaucacauucuccuggagaacgacaugaaguucacgguaguugucggggacguggcaggcauuuuagcgcagggaaaaaagaugauacgaccucagccgauggaguacaaguacagcuggaaguccuggggcaaagccaaaaucauaggcgccgacgugcagaaugccacguucauaaucgacgggcccaacaccccggaaugccccgacgaccagcgugcuuggaacaucugggaggucgaggacuacgguuuugggaucuuuaccacaaauaucuggcugaagcugcgggacaguuauacucaagugugugaccaccgccucauguccgcagccauccgggauagcaaggccgugcacgccgacaugggguacuggauugagagcgagaagaacgagaccuggaaacuggcacgggcgagcuuuaucgaggugaagaccuguauauggcccaaaucccacacgcuguggagcaaugggguauuggaguccgaaaugauuauucccaagaucuacggcggaccuaucagccagcacaauuaucggcccggauauuuuacucaggccgccggccccuggcaccuggggaaauuagaauuggauuucgauuuaugcgaggguacgaccgucgucguggacgagcacugcgggaaucgggguccaucccuccggacuacgaccgugaccggcaaaaucauccacgaguggugcugucguagcugcacgcuaccgccgcuccgcuuucgcggagaagacgggugcugguacgggauggaaauccggcccguuaaagaaaaagaagagaaccucgugaaauccauggugagcgccggcaguggggagguagacuccuucagccucgggcuguuaugcaucuccauaaugaucgaggaggugaugaggucacgguggagccgccguauguuaaugaccggcacacuagcuguguucuuccugcuuaucauggggcagcugacauggaacgaccuaauaagacucugcaucauggugggagccaacgccagcgaccgcauggggaugggcacgaccuaccuggccuugauggcuaccuucaagaugcguccuauguuugcgguggguuugcuguuuagacgucugacaagccgcgagguuuugcugcugacaaucggucuuagucuugucgccuccguggaacucccgaauucuuuagaggagcuaggggaugggcuggcgaugggcauaaugauccuaaaacuacugaccgauuuucaaagucaccagcucugggcuacccugcuuucucucaccuucauaaaaacgaccuucagucugcauuacgcguggaagacgauggcaauggucuugucaaucgugucccucuuccccuuaugcuuaagcaccacuucccagaaaacgacuuggcucccgguccuguuaggaucacuugguugcaagccgcugacuauguuccucaucgcggagaacaagaucugggggcgucgguccuggccucuaaacgaagggauaauggccgucgguaucgucagcauacuccuguccucccuccugaagaacgacgugccccuggccggaccacuaauugcggguggcaugcugauugccugcuauguaauuagcggguccucagccgacuuguccuuagagaaggcagccgaggugagcugggaggaggaggcggaacacuccggagcgagccacaacauacucguggagguccaggacgacgggacgaugaagauuaaagaugaggagcgggaugauacacucacuauccuccuuaaggccacccugcucgcugugaguggcguguacccccuuaguauccccgccaccuuauucguuugguacuucuggcagaaaaaaaagcagcgauccggugugcucugggacacgcccagcccgccggaaguggagcgugcgguccuggacgacggaaucuaccgcauaaugcaacggggccuguuagggcgcagucagguagggguugggguauuucaggagaacguuuuccauacaauguggcacguuaccaggggcgcuguccucauguaccaagggaagcgucuggagcccaguugggcguccgugaagaaagaccugaucucauacggcggaggcuggcggcuccaagguuccuggaauacaggugaggaagugcaggucauagccguagagccuggcaagaacccgaagaaugugcagacggcccccgggacuuuuaagaccccggaaggugagguaggcgcgaucgcccuggacuuuaagccagggaccaguggcucacccauagugaaccgcgaaggcaagaucgugggucuguacggcaacggagugguuaccaccucggguacguaugucuccgcgaucgcccaagcaaaggcaucacaggaggggccucucccagagaucgaggaugagguuuucagaaagaggaauuugacaaucauggaccugcaccccggcagugggaagacgcggcgcuacuuaccggccauugugcgcgaggcaauaaaaaggaaguugaggacccuuauccuagccccuacccggguugucgccucagagauggccgaggcacugaaggggaugccgauccgcuaccagacuaccgccguaaagucagagcacacugggaaggagauaguggaccuaaugugccacgccaccuucaccaugcggcuccugucccccguccgagucccgaacuacaacaugaucaucauggacgaggcacacuucacggaccccaguuccauagcugcccguggguacaucucaacccgcgugggaaugggggaggcggccgcuaucuucaugacagcaaccccgcccggcuccgucgaggccuucccgcaguccaaugcggugauccaggacgaggagcgggacauacccgagcgcuccuggaacagcggguacgaguggaucacagauuuccccgguaagaccguuugguucgucccgagcaucaagagcggcaaugacaucgcgaauugccugcggaaaaacgggaagaggguaauucaguugucccggaaaacauucgacaccgaguaccaaaagaccaagaauaacgacugggacuauguaguuacaacugacauuagugagaugggcgccaacuuucgggcggaccggguuaucgacccacgccggugccugaagccagugauccugaaagacggacccgagcgcgugauccucgccggucccaugccggucaccgucgccucugcggcccagcgccgggggcggauaggacggaaucacaauaaggaaggcgaucaguacaucuacauggggcagccacugaacaaugacgaggaccacgcccacuggaccgaggccaaaauguugcuugauaauaucaauacccccgaaggaaucauccccgcccuguucgagccugagcgggagaagagugcggccaucgacggcgaauaccggcuccgcggcgaggccagaaagaccuucguagaacuaaugcgacgaggcgaucuccccguuuggcugucuuacaaaguagcuucugagggguuucaauacucugaucgccgguggugcuuugauggcgagagaaacaaccaggugcucgaagaaaacauggacguggaaauauggaccaaggagggggagcggaagaaguuacgcccacgguggcucgacgcgcgcaccuauuccgaccccuuagcccugcgggaauuuaaagaauuugcggcaggacgaagaagcgucucuggugacuuaauacuugagauugggaaacuaccccagcaccucacgcagcgcgcgcagaacgcacucgacaaucuggugaugcugcauaacucggagcagggugguagggcuuauaggcacgcuauggaggagcucccagacacaaucgagaccuugauguugcucgcucuaaucgccgugcugaccgggggcguaacccucuuuuuccugucaggccggggguuaggcaagaccagcauuggacuucuaugugugauggccuccucgguucugcucuggauggccuccguugagccgcauuggaucgccgccucgaucauccuggaguucuuccugaugguccuccucaucccugagccugaccgccagcgcacgccccaggacaaccaacuugcauaugucguaauugggcuccucuucaugauucugaccguugcggcuaacgagaugggacuacuggagacgacaaagaaggaucuggggaucggucacguugcggucgagaaccaccaccaugccgccaugcuugacguagacuuacacccagcguccgccuggacuuuauaugccguugccacuacuauaauuacuccuaugaugcggcacaccauugagaacaccacggcaaacaucucgcucacggccauagccaaccaggcugcgaucuugaugggguuagacaaggguuggcccaucuccaaaauggauaucggcgugccccuccuggcuuuaggcugcuauucacaggugaacccccucacccuaacagcagcuguucugauguuggucgcccacuacgcaaucauaggcccgggucugcaggcgaaggcgacccgggaagcccagaagcggacggcugccggcauuaugaagaacccaaccgucgacgggaucguggcgaucgaccucgauccugucguauaugacgccaaguucgaaaagcaacucggccagaucaugcuguugauccucugcaccucccagaucuuacugaugcguacgacgugggcguugugcgagaguauuacccuagccacgggcccgcuaacgacgcuuugggagggauccccuggaaaguucuggaacaccaccauagccguuagcauggccaacauuuuccgcggcuccuaucuagcgggcgccggccuugccuucucgcuaaugaagucccucgggggcggacgucgggggacgggggcgcagggcgagacccuaggcgagaaguggaaaaggcagcuaaaccagcuuaguaagagcgaguucaacacguacaagcgcuccgggaucauggaggucgaccgcucggaggccaaagaggggcugaagcgcggcgagaccacuaaacacgccgucucacguggcaccgcaaagcuccggugguuugucgagcgcaaccucgucaagccggaggggaagguaaucgaucugggcugcggccgaggcggguggagcuauuacugcgccggccuuaagaagguaaccgaggucaaaggcuacacgaagggcggccccggccacgaggagcccaucccgauggcuacauacggguggaaccucgugaagcuacacuccgggaaagacguauucuuuauuccccccgagaagugcgacacccuccuaugcgacaucggcgagagcucgccgaaucccacuauugaggaaggccggacacugcgcguccugaagaugguggagcccugguuacgagggaaccaguucugcaucaaaauccuuaacccguacaugccgagcguggucgagacguuagaacagaugcagcggaaacacggcggcaugcucguucgcaacccguugagucgcaacucgacccacgagauguacuggguuucgugugggaccgggaauauugugagcgccgucaauaugaccaguagaauguuguugaaccgcuuuacgauggcccaccggaaaccaacguacgaacgcgacguggaucugggggccgggacccggcacguggcuguggaacccgagguggccaaccuggacauuauaggccagcgcaucgagaacaucaagcaugagcacaagagcacauggcauuacgaugaagauaacccuuacaagaccugggcguaucacggaucuuacgaggucaagccgucagggucagccagcuccauggugaacggggucgugaagcuccucacuaagccuugggaugugauccccauggugacccaaauagccaugaccgauaccacgcccuucgggcaacaacggguuuucaaggagaagguagacacccgaacgccgaaggcaaagcgaggcacugcucagauaauggagguaacugccaaauggcuauggggcuuccucuccagaaauaaaaaaccgagaauuugcaccagggaggaguucacacgcaaggugcgcagcaacgccgcgaucggcgcuguguucguagacgaaaaucaguggaacagcgccaaggaggccguugaggacgaacgguucugggaucugguacaucgcgaaagagaguuacacaagcaagggaaaugcgcuaccugcgucuauaacaugaugggcaaacgagaaaaaaagcugggcgaguuuggcaaggccaaagggucccgagcuaucugguacauguggcugggcgcccgcuuccuggaauucgaggcacucggguucaugaacgaagaccacugguuuucgcgcgagaauagcuuaucuggcgucgagggugaggggcugcacaagcuuggcuacauacuaagagauauuucaaaaauccccggcggcaacauguacgccgaugauacggccggcugggauacccgcaucaccgaagacgacuugcagaacgaagcgcggaucaccgacaucauggagcccgagcacgcccuacuggccaaaaguaucuucaagcucacguaccagaacaagguagugcguguccagcggccggcuaaaaaugggacggugauggacgucauaagcagacgggaccagcgcggauccggccaggugggcacauauggccuaaauaccuuuacgaacauggaggcccagcucauccggcaaauggaaucggaaggaauauucagucccagcgagcuggagaccccgaaccuugcggaacgcgugcuagacuggcuagagaaguacggcguggagcggcucaagcggauggccaucaguggggaugacuguguaguaaaaccuauugacgaccgguuugcaacugcccuuaccgcacugaacgacaugggcaagguccgcaaagauaucccccagugggagcccuccaagggauggaaugacuggcagcagguucccuucuguagucaccacuuccaccagcucaucaugaaggacggaagggagauuguuguuccgugccgcaaucaggaugagcuagugggcagggcgcgcgugucacagggagccggcuggagucuccgggaaacugcuugucuugggaaaucguaugcucagauguggcagcucauguacuuccacagaagggacuuaagacucgcggccaacgcaaucuguucagcggucccgguggauuggauccccacgucccgaaccacguggucgauacaugcccaccaccaauggaugacgaccgaggauaugcuauccguguggaaccggguuuggaucgaagaaaacccuuggauggaggacaagacgcacaucagcagcuggggcgacguuccguaccuaggcaagcgggaagaccaguggugcggcagucucaucggccuuacagcgcgcgcaaccugggccacaaacauccagguggcgauuaaccagguccgccgccuuaucgggaaugagaacuaccuggacuacaugaccuccaugaagcgcuucaaaaacgagagcgaccccgagggcgcccuuugguaa

SEQ ID NO: 24489 - RNA, 9879 nt, Artificial Sequence
  derived and/or modified CDS sequence (opt11) from DENV-1__GU131786__SS-prME
agcgugaccaugcugcucaugcugaugccuaccgcccuggccuuccaucuuaccacuaggggcggggaaccgcacaugauagugucaaagcaggaacggggcaagagccugcuguucaagacgucugcggggguuaacaugugcacccuaaucgccauggaucuaggcgaguucugcgaagauaccaugaccuacaagugcccccgcaucaccgaggccgagcccgacgacgucgacugcuggugcaacgccaccgacaccugggugaccuacgggaccugcucccagaccggcgagcaccggcgggacaaacgguccguggccuuagcgccccacgugggccucggucuggagacgcgcaccgagaccuggaugagcuccgagggggccuggaagcagauucagcggguggagaccugggcccugcggcacccuggguuuacggugauagcccucuuccuggcacacgccauuggcaccuccaucacucagaagggaaucaucuucauccuacucaugcuggugacccccuccauggcgaugcgaugcgucggcaucggaagccgcgacuucguggagggucuguccggcgccacguggguggacgucguucucgagcacgggagcugugugaccaccauggccaaggacaagcccaccuuagacaucgaacugcugaagacggaggucacuaaccccgccgugcuucggaagcugugcaucgaggccaagauuuccaauaccaccacggacagccgcuguccaacccagggggaggcaacccucguagaggaacaggacgccaacuucgucugccggaggacauucguggaucgggguugggggaacggaugcggacucuucggcaagggguccuugaucacgugcgccaaguucaagugcgugaccaagcucgagggcaaaaucguccaauacgaaaaccugaaguacagugugaucgugacgguccauaccggcgaccagcaccagguugguaacgaguccacggagcacggcaccaccgcgaccaucacaccccaggcccccagcacggagauccaguuaacagacuacggggcucuuacccuggacugcaguccucggaccggccuggacuucaacgagaugguccuccugacuaugaaggagaaguccuggcuggugcacaagcagugguuccucgaccugccccugcccuggaccagcggggccagcacuucacaggaaaccuggaaucggcaagaccuccugguaacauuuaagaccgcccaugcgaaaaagcaggaggucguggugcugggcucccaggagggcgcaaugcacacugcccucacuggggcgacggagauccagaccaguggcaccaccacgaucuucgcagggcaccugaaaugccgccugaagauggacaagcucacgcugaagggcauguccuacguaaugugcaccgggagcuucaaguuagagaaggaaguggcggagacacagcacggcacggugcucguccaaaucaaauacgagggcaccgacgcccccugcaagauucccuucuccacccaggaugagaagggggugacccagaacggccggcugaucacggccaacccgauagugaccgacaaggagaaacccgucaacaucgaggccgagccgcccuucggggaaagcuacaucgugaucggcgcgggcgagaaggcccuuaaacugaguugguucaagaaggggagcucuauaggcaagauguucgaggccccggcccgcggggcccggcgcauggcgauccucggcgcuaccgccugggacuucggguccauaggcggaguuuuccccucugucgggaaguuagugcaccagaucuucggcacggcguacgggguguuauucucgggcgucuccuggacgaugaagaucgggauuggcguccuccugacguggcugggccucaauucacgcuccacaagccugucaaugaccugcaucgccgugggacuugucacgcucuaccugggcgugauggugcgggcugacagcgggugcgucaucaacuggaagggccgcgagcugaaguguggguccggcaucuucgugaccaacgaagugcacaccuggaccgagcaguacaaguuccaggcugacuccccgaagcggcucagcgccgccaucggcaaggccugggaggaggggguuugcgguauucgcuccgcgacuagacuggaaaauauuauguggaagcaaaucagcaaugaacugaaccauauucuccuggagaaugacaugaaguuaaccgugguggucggggacguggccggcauccucgcccaggggaagaagaugauccgcccccagccgauggaguacaaguauuccuggaaauccuggggcaaggccaagauaaucggcgcggacgugcagaacacaaccuucaucaucgacgggcccaacacccccgagugccccgacgaucagcgggccuggaacaucugggaggucgaggauuacggcuucgggaucuuuacuacuaacaucuggcugaagcuacgcgacagcuacacccaggugugugaccacagacucaugagcgccgcgauuaaggacucuaaggcaguacaugcggacaugggcuauuggaucgaguccgagaagaacgagaccuggaagcuggcccgcgccagcuucaucgaggucaagacguguaucuggccgaagucacacacccugugguccaacggcguguuagagagcgagaugaucauccccaagaucuacgggggaccaaucagucagcacaacuaccggccgggguacuucacccagaccgcgggccccuggcaccuggggaagcuggagcucgacuucgacuugugcgagggcacgaccgucguaguugacgagcauugcggcaaccgcgggccgagcuuacggaccaccacggugaccggcaagauaauucacgaauggugcugccguaguuguacccugccaccccuccgguuuaagggggaggauggcugcugguacgggauggaaauccgccccgucaaggagaaggaggagaaucuuguaaagagcaugguaagcgccggcuccggcgaggucgacagcuucuccuuggggcuucuguguaucagcaucaugauugaggaagugaugcggucccgcuggagccggaagauguugaugacaggcacgcuggcgguguucuuccugcugaucauggggcagcugaccuggaacgaucugauccgccucugcaucauggucggggccaacgcauccgaccgcauggggaugggaaccaccuaccuggcccugauggccaccuucaagaugcggcccauguucgcggugggucugcuguuccgacgccugaccagcagggaggugcuccuacugaccauaggucucucccuggucgccagcguggagcugccaaauucccuagaggagcugggcgacgggcuggccaugggcauuaugauccucaagcugcugacagacuuucagagccaccaacucugggccacacugcugagcuuaaccuucaucagaaccaccuucucucuccacuacgccuggaagacgauggccaugguccuguccaucgugagccuguucccgcugugucucuccaccaccagccagaagaccacauggcuccccguucugcuaggcuccuuagggugcaagccgcucaccauguuccugauagcggagaacaagauauggggucgcaagagcuggccauuaaaugaggggaucauggccgucggcaucguaagcauccugcuguccucgcuccugaagaacgacgugccccuggccgggccacucaucgcuggcggcaugcugauagccugcuacguaaucucugggucuuccgccgaccugucucucgagaaggccgccguggugagcugggaggaagaggcggagcacagcggcgcgucccauaacauccucgucgaggugcaagacgacgggaccaugaagaucaaggaugaagaacgggaugacacccugaccauccuccugaaggcuaccuuacuggcagugagcggcgucuacccccuguccauccccgccacccuguucguuugguacuucuggcagaagaagaagcagcggucuggagugcucugggacaccccauccccaccggaggucgagcgggcgguacuggacgacggcauuuaccgcauaaugcagcggggccuacuuggcaggagccaggugggcguagggguauuccaagagaauguguuccacacuauguggcaugucacgcgcggcgcagugcucauguaccagggcaagcgccuagagcccuccugggccucagugaagaaggaccucaucuccuacggcggcgguuggcgacuccaggguucguggaacaccggggaggagguccaggugauugcuguggagccaggcaagaacccaaagaacguccagacggcccccgggaccuucaagacguccgagggagaggugggugcgaucgcccuggacuucaagcccggaaccagcggcagcccgauagugaaccgcgaggggaagauaguuggccuguacggcaacgggguggugaccaccuccggcacguacgucagcgccaucgcccaggcgaaggccucccaggaagggccccuccccgaaaucgaggacgagguuuuccgaaagcggaaucugaccauaauggaccugcacccgggcagcgggaagaccagacgcuaccuccccgccaucgugagggaagccaucaagcgcaagcugcgcacccugauauuggcccccacucgagucguagcguccgagauggccgaagcccugaagggcaugcccauccgcuaccagaccaccgccgucaaauccgagcacacgggcaaagagauagucgaccugaugugucaugcgacguuuaccaugcggcucuuguccccgguccgcgugcccaacuacaacaugaucauaauggacgaggcgcacuucacagaccccagcuccaucgcugcccggggguacauuucaacccgcgucggcaugggugaggccgccgcgaucuuuaugacagccacgccaccgggauccguggaggcuuucccccagucgaacgccgugauccaagaugaggagcgggacauaccugagcgcaguuggaacagcggauacgaguggaucaccgauuucccugguaagaccgucugguucgugccgucuaucaagucuggcaacgacaucgcgaacugcuugcggaagaacgggaagcgcgugauccagcucucccggaagacguucgacacagaguaccagaagacaaagaacaacgacugggacuacgucgugaccacggacaucagcgagaugggcgccaacuuccgcgccgaccgggugaucgauccuagacggugccugaagcccgucauccugaaagacggucccgagcgcguuauauuggccggcccgaugcccgucaccguggccagugcggcccagcggcgcgggcgcauaggccgcaaccacaauaaagagggggaccaguacaucuauaugggccaacccuugaauaacgacgaggaccacgcccacuggaccgaggccaagaugcuacucgacaacaucaauacucccgagggcauaaucccugcccuguucgagcccgaaagggaaaagagcgcagccauagacggggaguauagacugcgcggcgaggcccggaagacguuuguggagcucaugcgucgcggggaccugcccgucuggcugaguuauaagguggcuucagagggcuuccaguacagcgaccgccgguggugcuucgacggcgaaaggaacaaccaggucuuagaagagaacauggacguugaaaucuggaccaaggagggugaacggaagaagcugcgcccacggugguuagaugcccgcaccuacuccgacccacucgcgcugcgcgaguucaaagaguucgccgccggccgccggagcguguccggagacuuaauccucgagaucggcaagcugccacagcaccugacccagcgcgcacaaaacgcgcucgacaaccuggugauguugcauaacuccgagcagggcggccgggcauaccggcacgccauggaggagcucccagacacgaucgagacccugaugcuccucgcacugauugccguccugaccggcggggugacccucuucuucuuauccggccggggucugggcaagacgucaauuggccuacugugugugauggcguccagcguccuguuguggauggccuccguggaaccccacuggaucgccgccagcaucauccuggaguucuucuuaauggugcugcugauuccagagcccgaccgucagagaacgccccaggacaaccagcuagcuuacgucgucaucgggcuccuguucaugauccuaaccgucgcggccaaugaaaugggcuugcuggagacaaccaagaaggaccuggggaucggccacgucgccguggagaaccaccaccaugccgcgaugcucgacguagaccugcauccggcgagugccuggacgcuauaugcgguagccaccaccaucaucacccccaugaugcgccacacgaucgagaacacuaccgccaacaucagccucaccgcgauagccaaccaggcugccauccugauggggcuggacaagggcuggcccaucuccaagauggacaucggcgugccccuccuggcgcugggauguuauagccaggugaacccguuaacgcuuaccgcagcuguccugaugcucguagcccacuaugcgaucaucggccccggguuacaggcgaaggccacccgcgaggcccagaagagaaccgcugccggcaucaugaagaaccccacgguagacgggaucguugcgauagaucuggacccaguaguguacgaugccaaguucgagaagcagcucggccaaaucauguuacugauccucugcacgucccagauccugcucaugaggaccaccugggcccucugcgagagcauaacuuuggccacgggcccgcuaaccacccucugggagggguccccaggcaaguuuuggaauacaaccaucgccgucagcauggcgaacaucuuccgggggagcuaccuggcaggcgccgggcuggccuucucccucaugaagucccucgggggcgggcgacgggggaccggugcgcagggcgaaacccucggcgagaaauggaagcgccagcucaaucaguuauccaagagcgaguucaacacguacaagcgguccgggaucauggagguggaccgcagcgaggccaaggagggccuuaagcgcggggagaccaccaagcacgccguaagucgaggcaccgccaagcucaggugguucgucgagcgcaaucugguuaagcccgaggguaaggugaucgaccuaggaugcggcagaggcggguggagcuacuacugcgccgguuugaagaaggucacugaggugaaggguuacaccaagggcgggccuggccacgaggagccgaucccaauggcgaccuacggcuggaaccucgugaagcugcacuccggcaaggacgucuucuuuaucccucccgagaagugcgacacccugcuaugcgacaucggggaguccuccccgaaccccacgauagaggagggucgcacccugcgagugcugaaaaugguggagcccuggcuccgcgguaaucaguucugcauaaagauccuaaacccguacaugccgagcgucguggagacucuggagcagaugcagcguaagcacgggggaauguuagugcgaaacccccuguccaggaacagcacccaugagauguacugggucuccugcgggacgggcaacaucgugagcgcagugaacaugacuucccgcaugcugcucaaccgcuucaccauggcacaccgaaagcccaccuacgagcgcgacguggaccugggggccggcacccggcacguggccgucgagccagaggucgcgaaccuugacaucauugggcagcgcauugagaacaucaagcacgagcacaagagcacguggcacuacgaugaagacaaccccuacaagaccugggcauaccacggguccuacgagguuaagcccagcggaagcgccuccagcauggucaacgggguggugaagcuccugaccaaaccgugggacgucauacccauggugacccagaucgccaugacggauacgaccccguucggccagcaaaggguguuuaaggagaaggucgacacacgcacgcccaaggccaagcgggggaccgcgcaaauaauggaggugaccgcaaaguggcuguggggcuuccucucccggaacaagaagcccaggaucugcacccgcgaggaguucacgaggaaggugcgaagcaacgccgccaucggcgcgguuuucguggacgagaaccaguggaacuccgcuaaggaggccguagaggacgagcgcuucugggaccucguccaccgcgagcgggagcugcacaagcagggcaagugcgcuaccugcguuuauaacaugaugggcaagcgugagaagaagcucggggaguucggcaaggccaaggggucgcgggcgauuugguacauguggcugggcgcccgcuuccuggaguucgaggcccucggcuucaugaacgaagaucauugguucucacgggagaacagccuguccggcguagagggcgagggguuacacaaacucggcuacauccugcgcgacauuagcaagauucccgggggcaacauguacgccgaugacaccgcgggcugggauacaagaaucacggaggaugacuuacagaacgaggcgaagaucaccgauaucauggagcccgagcacgcccuccuggcuaaguccauuuucaagcugaccuaccagaacaaggucguucgcgugcagcgcccggccaagaacgguaccgucauggaugucauaagccgccgcgaccagcggggcuccggacagguaggcacauacggccucaacaccuuuacaaacauggaggcccagcugauccggcaaauggagagcgaggggauauucucccccagcgaguuggagacccccaaccucgcgggccggguguuagacugguuagagaagcacggaguggagcgccucaagcggauggcuaucuccggcgacgacugcgugguaaaacccaucgacgaccgcuucgccacggcccugaccgcccugaacgacauggggaaggugcggaaggauaucccccagugggaaccgagcaagggauggaacgacuggcagcaggucccguucugcagccaucacuuccaccagcuaauuaugaaggauggccgcgagaucgucgugcccugccggaaccaggacgagcuggucggccgcgcgcgggucagccagggggccggauggagccugcgcgagaccgccugccucggcaaguccuaugcccagauguggcagcugauguacuuccaccggcgugaccugcggcuggcggcgaacgccauuugcagcgccguacccguggacuggguacccaccucccguacgacauggagcauucacgcccaccaccaguggaugaccaccgaggauaugcugucgguauggaaccgcguguggauagaagagaacccguggauggaggauaagacgcauaucagcucuuggggcgauguucccuaccugggcaagcgcgaagaccaauggugcggcagccucaucgggcugaccgcgcgcgccacgugggcuaccaacauccagguggccaucaaccaggugcggcgccuucuuggcaacgagaacuaccuggacuacaugacguccaugaagcgguuuaagaacgaaagcgaccccgaaggggcccugugguag

SEQ ID NO: 24490 - RNA, 9879 nt, Artificial Sequence
  derived and/or modified CDS sequence (opt11) from DENV-1__GU131787__SS-prME
uccguaaccaugcugcucaugcugaugcccaccgccuuagccuuucaccucaccacccggggcggggagccccacaugaucgugagcaagcaggagcgggggaagucauuguuauucaaaacaagcgcuggggugaacaugugcacccucaucgccauggauuuaggcgagcuuugcgaagacaccaugaccuacaagugcccgcguaucaccgaaaccgaacccgacgauguggauugcuggugcaacgccaccgauaccuggguaaccuaugggaccugcagccaaacgggcgagcaccggcgcgacaagcgaucaguggcccuggccccucacguggggcuuggacuggaaacgcgcaccgaaaccuggaugagcuccgagggcgccuggaagcaaauccagaggguggagacgugggcacuccgccacccgggguuuaccgucaucgcccuguuccuggcucacgcuaucggaaccagcaucacgcagaaggggaucauauucauccuccugaugcuugugacacccagcauggccaugcguugcgucggcaucggcagccgugacuucguggaggggcucucaggcgccaccugggucgacgucguauuagagcacgggagcugcgugaccaccauggccaaggacaagccgacgcuggacaucgagcucuuaaaaaccgaggucaccaaccccgccguucugcggaagcucugcaucgaggcgaagaucuccaacaccacgacggacucccggugucccacucagggagaggccaccuuaguggaggagcaggacgccaauuuugucugccggcgcacguucguggaccgaggcugggggaauggcugcggucuguucggcaaagguagccucauaaccugcgcgaaguucaaaugcguaaccaaacuugaaggcaagaucgugcaguaugaaaaccugaaguacagcgugauagugaccguccacacgggcgaccagcaccagguggggaacgaguccaccgagcacggcaccaccgccaccauaacgccccaagcgccaaccaccgagauccaguugaccgacuacggggcccugacguuagacugcagcccccgcacgggccucgacuucaacgagaugguccugcugaccaugaaagaaaaauccuggcucgugcacaagcagugguuccuggaccugccucucccuuggaccucaggggccucuaccucccaggagacauggaaccggcaagacuuacuggugaccuucaagaccgcccacgcuaagaagcaagaagucguggugcuagggucacaggaaggcgcgaugcacacggcgcugacaggggccacagagauccagacgucgggcacgacaacaaucuuugccgggcaccugaaaugcagacuaaagauggauaagcugacccugaaggguaugucguacgucaugugcacgggguccuuuaagcucgagaaggagguggcagagacccagcacggcacagugcugguccaaaucaaguacgagggcaccgacgcgccauguaagauacccuucuccacgcaggacgagaagggagugacccagaacggccggcugaucaccgcgaacccgaucgugaccgacaaggagaagcccgucaacauugaggccgagccgcccuuuggggaguccuacaucgugaucggcgcgggcgagaaagcgcugaaacucagcugguucaagaagggcucgagcaucggcaagauguucgaggccacggcccgcggggccagacguauggccauccugggcgauaccgccugggacuucggcucuaucggcggcguuuucaccuccgucgggaaauuaguacaucagauuuucggcacagccuacgggguccucuucaguggcgucucuuggacgaugaagaucgggaucggcgugcugcugacguggcuaggucuaaauucgcgcagcacaucccuguccaugaccugcaucgccgugggguuagucacguuauaccugggcguaauggugcaggcugacuccgggugcgucaucaacuggaagggccgggagcucaagugcgggaguggcaucuucgugaccaacgaggugcacaccuggacagagcaguauaaguuccaggccgacuccccgaagcgucugagugcggcuaucggcaaggccugggaggaaggggucugcggcauccggagcgccacccgccucgagaacauaauguggaaacagaucucaaacgagcucaaccacauccuccuggagaacgggaugaaguucacgguuguggugggcgauguggccggcauccuagcacaggggaagaagaugauacggccccagcccauggaguacaaauacagcuggaagucauggggaaaggccaagauaaucggggcagacgugcagaauaccaccuucauuaucgacgguccuaauacccccgagugccccgaugaccagcgcgccuggaacauuugggagguugaagacuacggguucggcaucuucacgacgaacaucuggcugaaacugcgggacagcuacacccaagucugugaccaccgccucauguccgcggccauuaaggacuccaaggccguucacgccgacaugggauauuggaucgagagugagaagaacgagaccuggaaacuggcccgggcgagcuucaucgaggugaagacgugcaucuggcccaagucccacacccuguggucgaacggugugcucgaguccgagaugauaauccccaagaucuacggcgggccgaucagccagcacaacuaccgcccuggcuauuucacacagaccgccgggcccuggcaccugggcaaauuagagcucgacuucgaccugugcgagggcacgaccgucgucgucgacgagcacugcggcaaccggggcccgucccuuaggaccaccacagucacggggaagaucauccaugaguggugcugccggagcuguaccuugccgccccuccgcuuucggggcgaggauggguguugguauggcauggagaucaggcccguaaaggagaaggaagagaaucuggugaaguccauggugagcgccggcagcggugagguggauucguucagccucgggcuacugugcauaucaaucaugaucgaggaggugaugcggagccgcuggucgcggaagaugcucaugaccgggacccuggcaguguucuuccugcucaucaugggucagcugaccuggaacgaucugauccgccucugcaucauggucggggccaaugccuccgacaggaugggcaugggcaccaccuaccuugcccugauggccacguucaaaaugcgcccuauguucgcaguggggcuacuguuccgccggcugacuucccgcgaagugcuccugcucaccaucggacucagccuugucgcuuccguggagcugccgaacagcuuggaggagcugggugacggccuggcgaugggaaucaugauccucaagcugcugaccgacuuccagagucaccagcucugggcgacgcugcugucuuuaaccuucaucaagaccaccuucagccuucauuacgccuggaagacgauggccaugguccugagcaucgugucccucuuuccccugugcuuaagcaccaccagccagaagaccacguggcucccuguacugcuggggucuuugggcuguaagccgcugaccauguuccucauugccgagaacaagaucugggggcggcgcuccuggccgcuuaaugagggcauaauggcugucgggaucguguccaucuuacugagcucccuccucaaaaacgacgugcccuuggcuggcccucuuaucgccggcgggaugcugaucgccugcuacgucauuagcggauccagcgccgaccugucccucgagaaggccgcggaggugagcugggaagaggaggccgagcauuccggugcaagccacaacauccugguggagguucaggaugacggcaccaugaagauuaaggacgaggagcgagaugauacccucaccauucuacugaaggcgacguugcucgccguguccgggguguauccucuuucaauucccgcgacccuguuugucugguacuuuuggcagaagaaaaagcagcgcucgggcgugcugugggacacccccaguccacccgaagucgaacgugcgguccuggacgacggcaucuaccgcaucaugcagcggggguugcuuggccgaucccaggugggggugggggucuuccaggagaacguguuccauacgauguggcacgucaccagaggggccguacucauguaccaaggcaaacgccuggagcccagcugggcgucagugaagaaggaucugauuaguuacggagggggauggcgccuccaggggaguuggaacaccggagaggagguucaggucaucgcgguggagcccgggaagaaucccaaaaacguccagaccgccccuggcaccuucaagacucccgagggugaggucggggccaucgcccuggacuucaagcccgggacuagcgguucccccaucgugaaucgcgagggaaaaauugugggccuguacgguaacggcgucgugacgacaucagggacguacgugucagcgauugcccaggccaaggccucccaggagggcccgcugcccgagaucgaggacgaggucuuccggaagcgcaaccugaccaucauggaccugcaccccgggagcgguaagacccggcgcuaccucccugcgaucgugcgcgaggccaucaaacgcaagcugcgaacccugauucuugccccaacucggguagucgccuccgaaauggcagaggcgcugaagggcaugccgauucgcuaccagaccacggccgucaagagcgagcacaccgggaaggagaucgucgacuuaaugugccacgcaacauucacaaugagacuccucucccccguccgcgugccuaacuauaauaugaucauaauggacgaggcgcacuuuaccgaccccagcuccaucgccgcgcggggauacaucagcacccgcgucgguaugggcgaggccgccgccaucuucaugacugccacgccgcccggguccgucgaggcauucccccagagcaacgccgugauucaggaugaggagcgggacauucccgagcgcuccuggaacucaggcuacgaguggaucacagauuucccgggcaagacggucugguucguccccuccaucaagagcgggaacgacauagcaaacugccugcggaaaaacggcaagagagugauacagcucucccggaagacguucgauaccgaguaccagaagaccaagaacaacgauugggacuacguugucaccacugacauaucagaaaugggggccaacuuucgagcggaccgggugauagacccgagacggugccugaaacccgucauucugaaagacggccccgagcgcgucauccucgccggucccaugccaguuaccgucgccucggccgcccagcggcgcggccggauaggacggaaccacaacaaggagggggaccaguauaucuacaugggccaaccacugaacaacgacgaggaccacgcgcacuggaccgaggccaagaugcugcucgauaacaucaauacuccagaggggaucaucccggccuuguucgagccggagcgcgaaaagucagccgccauugacggcgaguaucggcugcguggugaggcacggaagacguucguggagcugaugcgccggggcgaccugccaguguggcugaguuacaagguagccagcgaaggcuuccaguauagcgaccgccgguggugcuucgacggggagcgcaacaaccaggugcucgaggagaauauggacguggagaucuggaccaaggagggcgaacggaagaagcugcgcccccgguggcucgaugcgcgcacauauucggacccccucgcauuacgggaguucaaggaguucgcggcggggcgccggucagucagcggcgaccuaauccucgaaaucggcaaguuaccgcagcacuugacccagcgcgcucagaacgcgcucgauaaucuggugauguugcauaacuccgagcagggaggacgugcuuaucgccacgcuauggaggagcucccggacacgaucgagacgcugaugcuacucgcccuaaucgcuguucugacagggggcgucacacuguucuuucugucgggccggggccuggguaagaccagcaucggccuccugugcgugauggcauccagcgugcugcucuggauggccaguguugaaccccacuggaucgcagccuccaucauccuugaguucuuccugaugguacuccugaucccugagccggaccgccagcguacgccgcaagauaaccagcuggccuacguagucaucggccuccuguucaugauccuaaccguugccgccaacgagauggggcuccuggagaccaccaaaaaggaucuuggaaucgggcacguagcggucgagaaccaccaccaugccgccauguuggacguggacuugcaccccgcguccgccuggacgcuguacgcgguggccacuaccauuaucaccccgaugaugcgccacacgaucgagaacaccacugcgaacaucagccucaccgccaucgccaaccaagcugccauacugaugggccucgauaagggcuggcccaucuccaagauggacaucggagucccguuacuggcccugggcugcuacagccagguuaauccgcuuacacugaccgccgcagugcugaugcucguggcccacuacgccaucauagggccgggccugcaggccaaggccacgcgcgaggcgcagaagcgaaccgccgccgggaucaugaagaaccccacuguugacggaaucguggccaucgaucuggacccugucguauacgacgccaaguucgaaaaacagcucggacagaucauguuacugauucugugcaccucccaaauacuguugaugcgcaccaccugggcgcucugcgaaucuaucacacuggccaccgggccccugaccacccucugggagggcuccccggggaaguucuggaacacaacaauugccgugaguauggccaacauauuccggggcuccuaccuggcaggcgccggacuggccuuuucacucaugaagucgcugggcgggggcagacgagggaccggggcccagggcgagacccugggggaaaaguggaagagacagcucaaccagcuguccaaguccgaguuuaacacguauaagcguuccggaaucauggaagucgaccggagcgaggccaaggaagggcugaagcggggcgagaccaccaagcacgcgguaucacgcggaaccgccaaacuucggugguucguggagcgcaaccuggucaagcccgagggcaaagugauugaccugggaugugggcggggugguuggagcuacuacugcgcuggguuaaagaaggugacggaggucaagggguacaccaagggcggcccugggcaugaggagcccaucccgauggcaaccuacgguuggaaccucgugaaacugcacuccgguaaagacguguucuucaucccgcccgagaagugcgacacacuguuaugcgacaucggugaaucauccccuaacccaacuaucgaagaggggaggacccugcguguacugaagauggucgagcccuggcuaagggggaaucaauucugcaucaaaauccugaaccccuacaugccaucugugguagagacacuggagcagaugcagcggaagcauggcgggauguuggugcgcaacccgcugagucggaacagcacccacgagauguacuggguguccugcggcacagggaacaucgucucggccguuaacaugacaucacgaaugcugcucaaucgcuucaccauggcucaccggaagccgaccuacgagcgcgacguggaccugggcgcuggcacccggcacgucgcgguggagccggaaguggccaaucuggauauuauagggcagcgcaucgagaacaucaagcacgagcacaagagcaccuggcacuacgacgaagacaaccccuacaagaccugggccuaccauggcuccuaugaggucaagccgaguggcuccgcgucuagcauggugaacggaguuguuaagcugcugaccaagcccugggacgugauccccauggugacucaaauugccaugacggauaccacgccauucgggcagcagcggguguuuaaggagaaaguggacacccgcacgcccaaggccaagcggggcaccgcacagaucauggagguaaccgccaaguggcuuuggggcuuccucucccggaacaagaagccccgaaucugcacccgcgaggaguucacgaggaagguacgcagcaacgcggccaucggugcaguguucgucgaugagaaccaauggaacuccgccaaggaagcuguggaggacgagcgguucugggaccuggugcaccgcgagcgggagcugcacaagcaggggaagugcgcgacaugcgucuauaacaugaugggaaagcgggagaaaaagcuaggagaguucgggaaggccaagggcagccgagccaucugguacauguggcucggagcgagguuccuggaguucgaggcccucgguuucaugaacgaagaccacugguuuucccgggagaacagccugucugguguggagggggagggccugcacaaguugggguauauucugcgcgacaucuccaagauccccgggggcaacauguacgccgacgacacggccggaugggacacccggaucacggaagacgaccugcaaaacgaggcgcgcauuaccgauaucauggagccggagcaugcgcuucuggcgcggaguaucuucaaacuuaccuaccagaacaagguuguccggguccagcgcccagccaagaauggcaccguuauggacguaaucagccggcgcgaccagcggggguccggacagguggggacguacgggcucaacacguucaccaacauggaggcgcagcugauccgccagauggagagugaggguaucuuuucacccagcgaacuggagacgcccaaccucgcagagcggguguuagacuggcuggagaaguaugggguggagcgccuuaaacggauggccaucucuggcgacgacugcgugguaaagccgauagacgaccgcuucgcgacggcccuuacagccuuaaacgacauggggaaaguccgaaaggacauaccccagugggagcccagcaaggguuggaacgauuggcagcagguccccuucuguucccaccacuuccaccaacucaucaugaaggacggucgcgaaaucgucgucccuugccggaaucaagaugagcugguggggagggcacgggugucacagggcgccggcuggagccugcgagagaccgcgugcuugggcaagucuuacgcccagauguggcagcugauguacuuccaccggcgagaccugcgucucgccgccaacgcgauuugcucagcuguccccgucgauuggauccccacuucccgcacgacauggagcauccacgcccaccaccaauggaugaccacugaggacaugcuguccguguggaaccgcgucuggauugaggagaaccccuggauggaggauaagacgcacaucaguucauggggcgacgugccguaccugggcaaacgggaagaccaguggugugguagccucaucgggcugacagcccgcgccaccugggcgaccaacauccagguggccaucaaccagguccguaggcuaauuggcaaugaaaacuaccucgauuacaugaccuccaugaaacgguucaagaacgagagcgaccccgagggggcgcugugguga

SEQ ID NO: 24491 - RNA, 9879 nt, Artificial Sequence
  derived and/or modified CDS sequence (opt11) from DENV-1__HM181968__SS-prME
agcgugaccaugcuacucaugcugaugccuaccgcccuggccuuccaccucaccacccggggaggcgagccccacaugaucgugaccaagcaagagcggggcaaaagccugcuguucaaaacuagcgcgggggugaauaugugcacccucaucgccauggaucuaggggagcuaugcgaggacaccaugacguacaagugcccccggaucaccgaggcagagcccgaugacguggacugcugguguaaugcuacugacaccugggugaccuacggaaccugcucgcagacaggggagcaccggcgcgacaagcggagcguggcccucgcgccccacgugggccuggggcuggaaacacgaaccgagacauggauguccagcgaaggugccuggaagcagauccagcggguggaaacgugggccuuacgccaccccggguucacggugaucgcccuguuccuggcacaugccauaggcacuuccaucacccagaaaggcaucaucuucauacuccucaugcuugugacgcccagcauggccaugcggugcguaggcauugggucccgcgauuucguggaggggcucagcggcgcuaccuggguagacguaguguuagagcacgggucgugcgugaccaccauggccaaggacaagcccacucuggacaucgagcugcugaagaccgaggucacgaaucccgcuguacugcggaagcucugcaucgaggccaaaaucagcaacaccacgacggacucccgaugucccacccagggcgaggccacuuugauggaggagcaggacgccaacuucguuugccgucgaacguucgucgaccgggguugggggaauggcugcgguuuauuuggcaaggggucacugaucacaugugccaaguucaagugcgugaccaagcuggagggcaagaucgugcaguacgagaaucugaaguacagcgucaucguaacggugcacacgggcgaccaacaccaggucgggaacgagucuacggagcacggaaccaccgccaccauuacgccacaggcgcccacauccgagauccagcucaccgacuacggugcccuaacacuugacugcagcccucgcacaggcuuggacuucaacgaaaugguucuccugaccaugaaggagaaguccuggcucguccacaagcagugguuccuggaucugccgcucccguggacuucaggggcaucuaccucccaggagacuuggaaccggcaggaccugcuuguaaccuucaagaccgcccacgcgaagaagcaggaaguggucguucucggcagccaggagggugccaugcacaccgccuuaaccggggcuaccgagauccagacguccggcaccacuacuaucuucgccggccaucugaagugccggcucaagauggacaagcugaccuuaaagggcaugagcuacgugaugugcaccggguccuucaagcucgagaaggaggucgcggagacgcagcacggcacggugcuggugcagauaaaguacgagggcaccgaugcgccaugcaagauucccuucagcacucaggacgagaagggggcaacccagaacggccggcugaucaccgccaacccgaucgucacggacaaggagaagcccguuaacaucgaggcggagccgcccuucggagagucauacauugucaucggggccggcgagaaagcccugaaacucagcugguuuaagaagggcuccucuaucggcaagauguucgaggccacugcccgaggggcgcggcgaauggccauccugggcgacacggcuugggacuucggguccgucggcgguguguucaccucgguugggaagcucguucaucaaaucuucgguaccgccuauggggucuuguucaguggcguaagcuggaccaugaagauaggaaucggggucuuacugacuuggcucggccugaacucccgcagcaccucccugagcaugaccuguaucgccguggggcucguaacccuguaucuggguguuaugguacaggcggacuccgggugcgugaucaacuggaaaggcagagaacucaagugugguucgggcaucuucguaacgaacgagguucacacauggaccgagcaauacaaguuccaagccgacucuccgaagcgccuguccgccgccaucggcaaggcgugggaagagggggugugcggcauccgaagcgcgacccgccuggaaaacaucauguggaagcagaucuccaacgagcucaaucauauccugcuggagaacgacaugaaguucaccgucguagugggggacguuguggguauucucgcccagggcaagaaaaugauacggccccagccuauggagcacaaauacaguuggaaaucguggggcaaagccaagaucaucggcgcggacguccagaacacgacauucaucauugaugggcccaacacccccgagugucccgacgaccagagggcguggaacaucugggaggucgaggauuacggcuucgggauauucgccacaaauaucuggcugaaguuacgggacaguuauacccaagugugcgaccaccggcucauguccgccgccaucaaggacagcaaggccguccacgcggacaugggcuacuggaucgagucagaaaagaacgagaccuggaagcuggcucgggccucguucauagaggucaagaccugcaucuggccuaagucccacacccucuggagcaauggagugcuagaaucugagaugaucaucccgaaaaucuacgggggcccgauaagccaacacaacuaccgccccggauacuuuacgcagaccgccggaccauggcacuuggggaagcuggagcucgauuucgaccugugcgaaggaaccacuguggucguagacgagcacuguggcaaccgggggcccucacugcgcacgaccacgguaaccggcaaaauuauccacgagugguguugccggagcugcacgcugccgccccucagguucaagggugaagauggcugcugguacgggauggaaauccggccuguuaaagagaaagaagagaacuuagugaaguccaugguuagcgcaggcagcggcgaggucgauaguuucagccucggucucuugugcaucaguaucaugauugaagagguuaugcguagccgguggucacgcaagaugcucaugaccgggacccuggcgguguuccugcuucugaucauggggcagcuuaccuggaacgaccucauccggcuguguaucauggucggugcuaacgcgucagacagaauggggaugggcacuaccuaucuggcccucauggccaccuuuaagaugcgccccauguuugcggugggccuguugcuccgccgccugaccucccgggaggugcuguuacugacgaucgggcugagccucgucgcguccguggaacugccgaacagccuggaggaauugggugaugggcuugccaugggaaucaugaucuugaaacuccucacggacuuccagucccaccagcugugggccacccuucugagccuaaccuucauuaagacuacccucucacugcacuaugcguggaagaccauggccaugguccugagcaucgugucacucuuuccccugugccuaagcacgacgucccagaagaccaccugguugccggugcugcugggaagcuucgggugcaagccgcucaccauguuccugaucacggagaacaagaucuggggccgcaaguccuggccacugaacgaaggaauaauggcagugggugucgugagcauccuuuuaagcagccugcucaagaaugaugucccccuggccgggccccugaucgccggcggcaugcucaucgcgugcuacgugaucagcgggucaagcgccgaccugucccuggagaaggccgccgaggugucaugggaagaggaggcugagcacuccggcgcgagccacaacauccuugucgagguacaggacgacgggacuaugaaaaucaaggacgaggagcgggacgauacacugaccauacuucucaaggcaacccuucuggccguguccggugucuacccgcucagcauaccggcaacgcuguucgugugguacuuuuggcagaagaagaagcaacgcucaggggugcugugggacacccccucgcccccugaggucgagcgggccguguuagacgacggcaucuaccgcaucaugcagcggggccuccuagggcgcagucaagugggcgucgggguauuccaagagaacguguuccacaccauguggcacgucacccggggugcugugcugauguaccaggggaagcgucucgagcccucgugggccuccgucaagaaggaccuuaucagcuacggcggcggguggcggcugcagggcuccuggaacacgggggaggagguccaggugaucgcgguugagccggguaagaaccccaagaacguccagaccgcacccgggaccuucaagaccccagagggcgaggucggcgccaucgcgcuggacuucaagcccgggaccagcggcucccccauugugaaccgcgaaggaaaaaucgucggacuguacggcaacggggugguuacgaccagcggcaccuaugucuccgcaaucgcccaggcaaaggcgucccaggaggguccgcugcccgaaauugaagacgagguauuucggaagcgcaaccucacgaucauggaucugcaucccggcagcgggaagacccgacgcuaccuucccgccaucgugcgggaggccaucaagcgcaagcuccggacccugauccuggcgcccacccgcgucguggccucggagauggcggaggcccucaagggcaugccaauccgcuaccagacgaccgccguaaagucugagcacaccggcaaggagaucguugaccugaugugccacgccacguucacgaugcggcugcugucgccggugcgugugccgaauuacaacaugaucauuauggacgaggcccacuucaccgaccccagcucaauagcggcccggggcuauauaucaacucgcgucggcaugggugaggccgccgccauuuuuaugacggcgacaccucccggcuccgucgaggccuucccgcagagcaacgcggugauccaagacgaggagcgggacauacccgagcguuccuggaacagcggguacgaauggaucacugacuuccccggcaagaccgucugguucgugccuuccaucaagucgggcaacgacaucgccaacugccugcggaaaaacgguaagcgcguuauucagcuaucccggaagaccuucgauacggaauaucaaaagacaaaaaacaacgacugggacuacgucgugaccaccgacaucagcgagaugggcgcgaacuuucgcgcagacaggguuaucgacccucgccggugccuaaagcccgucauccugaaggacgggcccgagcgcguuauccuggcuggucccaugccugugacaguggccucggcagcccaacggcguggccggauagggcgcaaccacaacaaagagggcgaccaauacaucuacauggggcaaccccucaacaacgacgaggaccaugcacacuggaccgaagccaagaugcugcuggacaacauuaacaccccggagggcaucauccccgcccucuucgagccggagcgggagaaguccgccgcaaucgacggggaguacagacugcgcggcgaggcgcgcaagaccuucgucgagcugaugcgccgcggggaccuccccguuuggcugaguuauaaaguggcuagcgaaggcuuccaguacagcgaccgccgauggugcuucgauggcgaacgcaauaaucaggugcuugaggagaacauggacgucgagaucuggacgaaggagggggagcggaagaagcuccgcccccgguggcuagacgcccgcacuuacuccgauccacuggcccuucgggaguucaaggaguucgcggccggccgacggagcgugucaggggaucugauccuggagaucggcaagcucccgcaacaccucacucagcgcgcccaaaacgccuuagacaaucucguaaugcugcauaacucggagcagggcgggcgggcguaccgccacgccauggaggagcugcccgauaccaucgagacucucaugcugcucgccuugaucgccguccugacuggcggggugacgcuguucuuccucuccggucggggacugggcaagaccagcaucggccugcucugugugauggccaguuccguccugcuguggauggcguccguggagccgcacuggauugccgccagcaucaucuuagaguucuuucugaugguccugcucauaccagagccggaccgccaacggacaccccaggacaaccaguuagccuacgucgugauagggcuccuuuucaugauacugacaguggccgcaaaugagaugggccugcucgagaccaccaagaaggacuuagggauaggucacgucgcuguggagaaccaccaccacgccacaaugcuugacguggaccuacaccccgccuccgcuuggacacuguacgcggucgccacuacuaucaucacuccgaugaugcgccacacgaucgagaacaccacggccaacaucucacucaccgcaauugccaaccaagcggccauccugauggggcuggacaagggcuggcccaucuccaagauggacaucgggguuccacugcuugcccugggcuguuacucccaggugaacccccugacgcuuaccgccgcgguccucaugcugguagcccacuacgccauuaucggcccggggcuccaggccaaagccaccagggaggcgcagaagcgaacagcggcuggcaucaugaagaaccccacgguggacgguauuguagccaucgaccuggaucccgugguguacgacgccaaauucgagaagcagcugggccagaucaugcuccuaauacugugcacuucccagauucuccugaugcgaaccaccugggcgcugugcgaguccaucacccucgccaccggcccccugaccacccugugggagggcuccccgggcaaguucuggaacaccaccaucgccgucaguauggccaacaucuuccguggcuccuaccucgccggcgcaggccuggccuucagccugaugaagucccuagguggcgggcgccggggcaccggggcucagggcgagacgcugggggaaaaguggaagcggcagcugaaccagcucuccaaaagcgaguuuaacaucuauaagcggucuggcaucauggaagucgaccgcagcgaagcgaaagagggccugaagcgcggggagacgacgcgccacgcaguaucuagaggaaccgccaagcuccgcugguuuguagagcggaaccuugugaagccggaagggaagguuaucgaccucggaugcggccgcgggggaugguccuauuacugcgccgggcugaagaaagugaccgaggugaaaggcuacacgaaagguggucccggccacgaggagcccaucccgauggccacauacggguggaaccugguuaagcuucacagcggcaaggacgucuucuuuacgccgccggagaagugugacacacugcugugugacauaggggagagcagucccaacccgacgauagaagagggccggacacuccgcguguuaaagaugguggagcccuggcugcgggggaaccaguucugcaucaagauccuaaaccccuacaugccuagcguaguggaaacccuggagcagaugcagcgcaagcauggcggcaugcuugugcgaaacccgcucagcagaaacagcacccacgagauguacugggucuccugcgggaccggcaacauugugagcgccgugaacaugacgucccggaugcugcugaaccgcuucaccauggcgcaccgcaaacccacuuacgagcgcgacgucgacuugggagcgggcacccgccacguugccguggagcccgagguugccaaccuggauauuaucggccagcggaucgaaaacaucaagcacgaacauaagaguacguggcacuacgacgaggacaacccguacaaaaccugggccuaucacggcuccuaugaggugaagcccuccggcucugcgagcagcauggucaacgggguagugaagcugcucaccaaacccugggaugugaucccuauggugacccagaucgccaugacggacaccaccccuuucggccagcagcgcguguucaaggagaaaguugauacccgcacgccgaaggccaagagggggacagcccagaucauggaagugaccgccagguggcucuggggcuuccuuucaaggaacaagaagccccgaaucugcacccgagaggaauucacacggaaagugcgcagcaacgcugccaucggcgccguauucguggacgagaaccaguggaacuccgccaaggaggcaguggaggacgagcgguucugggaccuuguccagaaggagcgcgaacugcacaagcaagggaagugcgcgacuugcguuuauaacaugaugggaaagcgggagaagaagcugggggaauuuggcaaggccaagggguccagggccauaugguacauguggcucggcgcccgguuucuagaauucgaagcgcugggcuucaugaaugaggaccacugguucucucgcgagaacagccucuccgguguggagggcgaggggcuucacaagcuaggcuacauccucagagacaucagcaagauucccgggggaaacauguacgccgacgacacggccggcugggacacccgcauuacggaggaugaccuucaaaacgaggccaagaucaccgacaucauggagccggaacacgcccugcucgcgaccuccauauucaagcugacauaccagaacaaggugguacgugugcagcgcccggccaagaacgggacugucauggacgugaucagccgccgggaccagcgcggcuccggucaagugggcaccuacggcuuaaacacauuuaccaacauggaagcccagcucaucagacagauggagagcgaggggaucuuccugcccuccgagcuggagacgccaaaccuugccgagagagucuuagacuggcuggagaaauacggcguggagcgucucaagcgcauggccaucucuggggaugacugcguggucaagccgaucgacgacagauucgcgaccgcgcuuaccgcgcugaacgauaugggcaaggugcgcaaggacauaccucagugggagccuucaaaaggguggaaugacuggcagcagguccccuuuugcagccaccauuuccaccagcucaucaugaaagauggucgggagaucguuguccccugccgcaaccaggacgaacucguugggcgggcccgcgucagucagggggccggcuggagcuuacgggaaaccgccugccugggcaaaagcuacgcccagauguggcagcugauguacuuccacagacgagaccugcgcuuagcagccaacgcgaucugcucagccguccccaucgacugggugcccacuagccggacaaccugguccauccacgcacaccaucaguggaugaccaccgaggacaugcuguccguguggaaccgcguauggaucgaggagaacccuuggauggaggacaaaacccacguguccaguuggggcgacgucccguaucuggguaagcgggaggaccagugguguggcucccucauaggccugaccgcucgcgccaccugggcgagcaacauccagguggcaaucaaccaggugcgccggcugaucggaaacgagaauuauuuggacuacaugaccuccaugaagcgcuucaagaacgagggagaccccgagggggcccuaugguaa

SEQ ID NO: 24492 - RNA, 9879 nt, Artificial Sequence
  derived and/or modified CDS sequence (opt11) from DENV-1__GU131789__SS-prME
agcgugacgaugcuccuaaugcucaugccuaccgcccuggccuuccacuugaccacgcgugggggggagccccacaugauuguaagcaagcaggagcggggcaagagccuucuguuuaagaccagcgccgggguuaacaugugcacccucaucgccauggaccucggcgagcugugcgaggacaccaugaccuacaagugcccucggaucacggaaaccgagcccgaugacguggacugcuggugcaacgccaccgacaccugggugacguacgggaccuguagccaaacuggagagcaccggcgcgacaagcggucuguggcucucgcgccccacgugggcuuaggucuggaaacccgcaccgagaccuggaugagcucugagggugcuuggaagcagauccaacguguagagacuugggcccuccgccaccccggguucaccgugauagccuuauuccuggcccacgcuaucggcacaagcaucacacaaaagggcaucauauuuauucuccugaugcuggugacgcccaguauggcuaugcggugcgugggcaucggcagccgcgacuucguggaggggcucucgggugccacuuggguagaugugguguuggagcacgggaguugcgugacaaccauggcaaaggacaagcccacacucgauaucgagcuccuaaagacugaagucacgaauccugccauccugcggaagcucugcaucgaggcgaaaaucagcaacacgacgacggacagccgcugcccuacccagggcgaggcaacgcugguggaggaacaggacgccaauuuugugugccggcgcacguucgucgaccggggcugggggaauggcugcggucuguucgggaagggaucccucaucacgugcgccaaguucaaaugcgugaccaaguuagagggcaagauagugcaguaugaaaaucugaaguauuccguaaucgugaccgugcauacgggcgaccaacaccagguggggaacgaauccaccgaacauggcaccaccgccaccaucacgccucaagcgcccaccacugagauucagcucaccgauuacggugcccugacgcuugacugcaguccacgcacgggccuagacuucaacgagauggugcuuuugaccaugaaagaaaagagcuggcucguccauaagcagugguuucuggaccugcccuuaccauggaccagcggggcaagcacgucccaggagaccuggaaccggcaggaccuauuagugaccuucaagaccgcccaugccaagaaacaggagguggucguguugggcagccaagagggcgcgaugcacacggcucucaccggggcaacagagauacagaccucuggcacgacaacaaucuucgccgggcaccugaagugccgccucaagauggacaagcugacccugaagggaaugagcuaugugauguguacaggcuccuuuaagcuagagaaggaaguagccgagacccagcacggcacgguucuggugcaaauaaaauaugagggcacagacgcgcccugcaaaaucccauucagcacgcaggaugagaagggggucacucagaacggccggcugaucacagccaacccuaucguuaccgacaaggagaagcccgugaauaucgaggccgagccgcccuucggggaauccuacauaguuaucggcgcuggcgagaaggcgcugaagcuuagcugguuuaagaagggguccagcaucgggaagauguucgaggccacggcccgcggcgcucggcggauggcaauccugggcgacaccgcuugggacuucgggaguauaggcggcguguucaccagcgucgggaagcucguccaccaaaucuucgggaccgccuacggaguccucuucuccggcgugagcuggacgaugaagauaggaauuggcguauugcugaccuggcucggccugaacagccgcagcacaucccugaguaugaccuguaucgccgugggucucgugacucucuaccugggagucaugguacaggccgacuccgggugugugaucaauuggaagggccgggagcucaaaugcgggagcggcauuuucguuaccaaugagguacacaccuggaccgagcaguacaaauuccaagccgauagccccaagcgccuguccgcggccauagguaaggcuugggaggagggggugugugggauccggagcgccacucgccuggagaacaucauguggaagcagaucaguaacgagcucaaccacauacugcuggaaaacgacaugaaguuuacggucguggugggagauguagcuggaauacucgcgcaggggaagaaaaugauccggccccagccuauggaguauaaguacagcuggaagucauggggcaaggccaagaucaucggcgcggacgugcagaacaccaccuuuaucauugacggaccuaacaccccugagugcccugacgaccagcgcgccuggaacaucugggagguggaggauuacggcuucgggauauucacaaccaacaucuggcuuaaguuacgagauagcuacacccaggucugcgaccaucgccuaaugagugcggcuaucaaggacagcaaggccgugcacgccgacaugggcuacuggaucgaauccgaaaagaaugaaaccuggaagcucgcaagagcuagcuucaucgaggugaagaccuguaucuggcccaagucccauacguuguggagcaacggcgucuuagaguccgagaugaucauccccaagaucuacggcggcccgaucagccagcacaacuaccgccccgguuacuucacccaaaccgccggcccauggcauuuagggaaguuggagcucgauuucgaccugugcgaaggcacaaccgucguugucgaugagcauugcggcaaccgggggccgucccugcgcacgaccacggugacuggcaaaaucauccacgagugguguugccggucaugcacccugccgccucuccgcuuccgcggugaggauggcugcugguacgggauggagauacgccccgugaaggagaaagaggagaaccugguaaaauccauggugagcgccggcucuggcgaaguagacucauucagccucggacugcugugcaucuccaucaugaucgaggaaguuaugcggagccgcuggaguagaaagaugcucaugaccggcacgcuggccguuuucuugcuacugaucauggggcaguugaccuggaacgaucucaucagacuguguaucauggugggcgccaacgcgagcgauaggauggggauggggacgacauaucuggcccucauggcgacauuuaagaugcggccgauguucgcuguaggucugcuguuccgccggcucaccucccgcgaggugcugcugcucacuaucggguugucgcugguggccuccgucgagcucccgaauagccuggaggagcugggcgauggacucgcgaugggcauaaugauccugaagcuucuuacggacuuccagucucaucagcugugggccacgcugcucucacugaccuucaucaaaaccaccuucucgcugcacuacgccuggaagacgauggccauggugcucagcaucgucucccuguucccucugugccucaguaccaccucccagaagaccacguggcugcccgugcugcucggcagccugggguguaagccgcuaaccauguuccucaucgcggaaaauaaaauuuggggaagacgcucuuggccacugaaugaggggaucauggcugucggcaucgucucgauccugcucagcucccuacucaagaacgacgugccacuggcugggccacugaucgccggcggcaugcuaaucgcgugcuacguaaucagcggguccuccgcggaccuaucacuggaaaaagcggcggaggucaguugggaggaggaagccgaacacuccggcgcuagccacaacauucucguggagguucaagacgacgggacuaugaaaaucaaggacgaagaacgggacgacacucucaccauccuguugaaggcgacccuccuggcagucuccggcguuuacccccuaagcauccccgcaacacucuucgugugguauuuuuggcagaagaagaagcagcgcuccgggguucugugggauacacccucgccgcccgagguugagcgggccguuuuagacgauggcaucuaccgcaucaugcagcggggccugcuagggcgcucccaggucggcguggggguuuuccaggaaaacgucuuccauacgauguggcacguuacccggggcgcaguacugauguaccaggggaagcgccuggaacccagcugggcguccguaaaaaaggaccucauaagcuacggcggcggguggcgucuacagggcuccuggaacaccggggaggaaguccaggugauagccgucgagccuggcaagaauccgaagaaugugcaaaccacccccgggaccuucaagacccccgagggcgaggugggcgcuaucgcccuggacuucaagccagguaccucuggcucacccauagucaaccgcgaggguaagaucgucggcuuguacggcaacggaguugugacuacgagcggcaccuacgucagcgccaucgcgcaggccaaagccagccaggaggggccccugcccgagaucgaggacgaaguguuccggaaaagaaaucugaccaucauggaucugcaccccggaagcgggaaaacccggcgcuaucuaccggcgaucguccgugaggcuaucaagcgcaagcuccgcacguuaauccucgcccccacccgaguuguagccagugaaauggccgaggcacuuaagggcaugccaauccguuaccagaccaccgcuguaaagagcgagcacacggggaaggagauuguggaccuaaugugccacgcuaccuuuacgaugcgacugcuaagccccgugcgcguacccaacuacaauaugaucauuauggaugaggcucacuuuaccgaccccagcagcaucgcggcuaggggguacaucagcacccgggugggaaugggggaggccgccgccaucuucaugacagccacgccgcccggcuccguggaggcuuucccucaaagcaaugcggucauccaggacgaagagcgggauauccccgaaagguccuggaacagcggguacgaguggaucacugauuuccccggcaaaacggugugguucgugccguccaucaaaagcggcaaugacaucgcgaacugccuccggaagaauggaaagcgcgucauccagcuaucgcggaagaccuuugacaccgaauaccagaagaccaagaacaacgacugggacuacguggugacgacugacauuagcgagaugggcgccaacuuucgggcagaccgcguuaucgacccgcgacguugccugaagcccguaauacuuaaggacgggccagagcgcgugauccucgccgguccaaugccggucacaguugccucagcugcccagcggcgcgggcggaucggccgcaaccauaauaaagagggggaccaguauaucuauaugggacagccccugaacaaugacgaagaccacgcccacuggacggaggcgaagauguugcuggacaauaucaacacaccggaagguaucauccccgcacuguuugagccggagcgagagaagagugcagccaucgacggggaguaccggcucagaggcgaggcccggaagacauuuguagagcugaugaggcgcggggaucuccccguauggcucucguauaagguugcaagcgagggcuuccaauacuccgaucgccgaugguguuucgauggagagcgcaauaaucaaguccuggaagaaaacauggacguggagauauggaccaaagaaggggagcggaagaaacugcgaccccgcuggcucgacgcgaggaccuacucugauccccuggcgcucagagaauuuaaggaauucgcggcuggccgccguagcguguccggggaccucauccuggagaucggcaaacugccgcagcaccucacacagcgcgcacagaacgccuuggacaaucugguaauguuacacaauagcgagcagggggggcgggccuaccgccacgccauggaggaacugcccgacacuaucgagacauuaaugcuccuggcgcugaucgccgugcucacagggggggucacccuguuuuuucugucaggccgggggcucggcaagacgagcaucggccugcucugcgucauggccucaaguguguuacuauggauggcguccguggagccccauuggaucgcugcuagcaucauccuggaguucuuucucaugguacuccugaucccggagccggauaggcagcggacuccccaggacaaccagcucgcauacguggugauugggcugcuguucaugaucuugaccguggccgcaaacgagaugggccugcuggagaccacgaagaaggaucucgggauuggccacguggccguggggaaccaccaccacgccgccauguuggaugucgaccugcaccccgccuccgcauggacccucuacgcuguggccacuacgaucauuacgccgaugaugcgccacaccauugagaacaccaccgccaauaucagucugacggccaucgccaaccaggccgcgauucugaugggccucgacaaaggcuggcccaucucuaagauggacaucggggugccucuauuggcgcucgguugcuacucacaagucaacccccugacccugaccgccgccgugcucaugcucguggcgcacuacgcuaucaucgggccgggccugcaggccaaggccacccgcgaggcgcagaagcggacggcggccgggaucaugaagaacccaaccguagacggaaucguggccaucgaccucgaccccgugguuuacgacgccaaauucgagaagcagcugggccagauaaugcuucugauucuuugcaccucccagauacugcucaugcgcacuaccugggcccugugcgagagcaucacucuggcgaccgggccccucacgacgcuaugggagggcucuccggggaaguucuggaacacuaccaucgcuguaagcauggcgaacauauucagggguaguuaucuggccggggccggauuggcauucucccugaugaagucacucggggggggucgccgggggacgggcgcccagggcgagacgcucggugagaaguggaagcgccagcugaaccagcugucuaagagcgaguucaacaccuacaagcgguccggcauaauggaaguugaccgcagcgaggcaaaggaggggcucaagcggggcgaaaccacaaagcacgccgucucccgcggaaccgcaaagcugcggugguucguagaacgcaaccucgugaaaccagaaggaaaggucaucgaucugggcugcgggcggggcggguggagcuacuauugcgccggccucaaaaaagugacggaggugaagggguacaccaagggcggccccgggcacgaagagccgaucccgauggcuacguauggcuggaaccuggucaaguugcacuccgggaaggacguuuucuucauuccgcccgaaaaaugugauacgcuucugugcgacauaggggaaaguucgcccaaccccacuauagaggaagguaggacucuccguguucucaagaugguugagcccuggcugcgcggcaaccaguucuguaucaagauccugaaccccuacaugcccucagugguggagacccucgagcaaaugcagcggaagcacggcgggaugcugguccgcaacccguugucccggaacagcacccacgaaauguacuggguguccugcgggacggggaacauugugagcgccguaaacaugaccuccagaaugcuacugaaccgcuucaccauggcucaccggaaacccaccuacgagcgcgacguggauuugggagcggguacgcggcauguggccgucgagcccgaaguggccaaccuugauauaaucgggcagcgcaucgaaaacaucaagcaugagcacaaaaguaccuggcacuacgacgaagacaacccguacaagacuugggccuaccauggauccuacgaggugaaaccuagcgggucugcgagcaguauggucaacgguguggucaagcugcugaccaagccaugggacgugaucccgauggugacgcagaucgccaugaccgauacuacccccuucggccagcagcggguguuuaaggagaaaguggacacgcggaccccgaaggccaagcgggguaccgcccagaucauggaggucacagcgaaguggcuauggggcuuucugucucgcaacaagaagccccggauauguacgcgcgaggaguucacucggaagguccgcucaaacgccgcgauuggggcuguauuuguagacgaaaaccaguggaacucagcaaaggaggccgucgaggacgagcgguuuugggaccuggugcaccgcgagcgcgagcuccacaaacaaggcaaaugcgcgaccugcguguacaacaugauggggaagagggagaagaaacugggcgaguucgguaaagccaagggcucacgcgccauuugguacauguggcugggcgcacgcuucuuagaguucgaagcccugggguuuaugaacgaggaccauugguucucccgcgagaacagccucucaggggucgagggggaggggcuccacaagcuggguuacauccugcgcgacaucagcaagauucccggcgguaacauguacgcggacgauacggcggggugggacacgcguaucaccgaggacgaccuccagaaugaagcgcgcauuacggacaucauggaaccggagcacgcccuauuggcuaagucuauauucaagcucacuuaucagaauaagguugugaggguccagcggcccgcaaagaauggcacgguuauggaugugaucagccgccgagaccagcgagguuccggccaggucgguaccuacgggcuaaacaccuucacuaacauggaggcgcagcuaauucggcaaauggagagugagggaauauuuucccccagcgagcucgaaacccccaucuuagccgagcgcgugcuggacuggcucgaaaaguacgggguggaacgccuuaaacgcauggccaucuccggcgacgacugcgucgugaagccgaucgacgaccguuucgcaaccgccuuaacagcgcugaacgacauggggaaggugcggaaggacauuccacagugggagccuaguaagggauggaaugacuggcagcagguccccuuuugcagucaucauuuccaucagcucaucaugaaggauggcagggagaucgugguaccgugucgaaaccaggacgagcuggugggacgugcccgcgugagccagggcgccggguggagucuccgggagacggccuguuuaggcaaguccuacgcgcagauguggcaacugauguacuuccaccgccgcgaccuccgccuggccgccaaugccaucuguagcgcgguucccgucgacuggauacccacauccaggacgaccuggaguauccacgcccaucaucaguggaugacgacggaggacaugcuguccguguggaauagagucuggauugaggagaaccccuggauggaagacaagacccacaucagcuccuggggagacgugccguaccucggcaagcgcgaggaccaguggugcgguucgcugaucgggcuaaccgcccgcgcuaccugggcgaccaacauccagguggcgauaaaccaggugcgucgccucauaggcaaugaaaacuacuuggauuacaugaccuccaugaaacgcuucaagaacgagagcgacccagagggggcuuugugguga

SEQ ID NO: 24493 - RNA, 9879 nt, Artificial Sequence
  derived and/or modified CDS sequence (opt11) from DENV-1__GU131790__SS-prME
ucggugaccaugcugcugaugcuggugccaaccgcccuggccuuccaucucaccacucggggcggugaaccacacaugaucguuagcaagcaggaacggggcaagagucugcuguucaagaccagcgccgguguuaauaugugcacccucaucgccauggaccugggcgagcugugcgaggacaccaugaccuacaaaugcccccggaucaccgaaaccgagccagacgacguggacuguugguguaaugccaccgacacuugggugacguaugggacgugcagccaaacgggcgagcaucggcgggacaaacggucuguggcccucgcgccucacguuggccuggggcuggagacccgcacagagaccuggaugagcuccgagggcgccuggaaacaaauacagcggguggagacuugggcacuccggcaccccggguucaccgugaucgccuuguuccuggcccacgcgaucggcaccagcaucacccagaagggaaucaucuucauccuccuuauguuagucacucccuccauggcaaugaggugcgugggcaucggcagccgcgacuucguggagggccucuccggcgccaccugggucgacguggugcuggagcacgggucuugcgucaccaccauggccaaggacaagccgacgcuggacaucgagcuccugaaaaccgaggugaccaaucccgccgugcugcggaagcuuugcaucgaggcuaaaaucuccaacaccacgaccgacucccgcugcccgacucagggcgaggccacacuggucgaggaacaggacgccaacuucgugugccggcgcacguucguggacagaggcugggggaacgggugcggucuguucggcaagggcucccucauaacgugcgccaaguucaagugcgucacuaagcuggagggcaagaucguucaauacgagaaccugaaguauagugugaucgucaccguucacacgggcgaccaacaccaggucgggaacgaguccaccgagcacgggaccaccgccaccaucaccccccaggcgcccaccaccgagauucagcucaccgacuacggggcccugacucucgacugcagcccccgcaccggccucgacuucaacgagaugguuuugcugacaaugaaagaaaagucguggcucgugcacaagcagugguuccuggaccugcccuuacccuggaccagcggggccagcacgucccaggaaaccuggaaccggcaggaccuucuggugaccuucaaaaccgcccaugcgaagaagcaggaggucgugguccuuggcagucaggagggcgcgaugcacacagcacugaccggggccaccgaaauccagacguccggaacgaccaccaucuucgccgggcaccugaaaugccgccucaaaauggacaagcugacccugaaggggaugagcuacgugaugugcacgggcuccuucaaacucgagaaagagguggccgaaacccaacacgggaccguccuaguacagaucaaguacgaggguaccgaugcgcccugcaagauccccuucagcacgcaggacgagaagggagugacccagaacggccggcugaucaccgccaacccgaucgucaccgauaaggagaagccagugaacaucgaggccgagccccccuuuggggagucguauaucgugaucggcgcaggcgagaaggcgcugaagcucagcugguucaaaaagggguccagcaucggcaagauguucgaggccacagcccgcggggcccguaggauggccaucuuaggcgacaccgcgugggacuucggguccaucggcggcguauucaccagcguggggaagcuggugcaucagaucuuuggcaccgccuacggugucuuauucucaggcgucagcuggacgaugaagaucgggauaggcgugcugcugacauggcucggacugaacucccgcagcaccagccuuagcaugaccugcaucgcaguagggcucgugacgcuguaccuuggcgugaugguccaggccgacuccgggugcguaaucaacuggaagggccgggaacucaaaugugggaguggcauuuucgugaccaacgaaguccacacguggacagagcaauacaaguuccaagcagacagcccgaagcgccuguccgcggccaucggcaaggccugggaggagggcgugugcggcauccggagcgccacccgccuggagaacaucauguggaagcagaucagcaacgaguuaaaccacauccugcucgaaaacgacaugaaguucacggugguagugggcgacguggccggcauccucgcccaggggaagaagaugauccguccccagccgauggaguacaaauacucauggaaguccuggggcaaggcaaaacugaucggcgccgacguccagaacaccacuuuuaucaucgacggacccaacacccccgaaugccccgaugaccagcgagccuggaacaucugggagguugaggacuacggguucgggaucuucaccaccaacaucuggcugaaacuccgggacagcuacacucaggugugcgaccaccgccugauguccgcggccaucaaggacagcaaagccguccacgcugacaugggcuacuggaucgagagcgagaagaacgagaccuggaagcuggcgagggcgaguuucaucgaggugaagacgugcaucuggcccaaaucccacacccucuggucaaacggagugcuggaguccgagaugauuauccccaagaucuaugggggcccuaucagccagcacaacuaccgccccggguacuucacccagaccgccggaccauggcaccuggggaagcuagaacuggacuucgacuuaugcgagggcacgaccgucguaguggacgagcauugcggcaaucgggggccgucccuccgcaccaccacggucaccggaaaaauuauccacgaguggugcugccggagcuguacccugccucccuugcgcuucagaggcgaggacggaugcugguacgggauggagauccgccccgugaaggagaaagaagaaaaucucgugaaguccauggucucagccggcucaggagaggucgacuccuuuagcuuagggcugcucugcaucuccauaaugauugaggaggugaugcggagucgcuggucacggaagaugcugaugaccgggacgcuugccgucuuuuuccucuuaaucauggggcagcugaccuggaacgaccucauacgccugugcauaauggugggcgccaacgcaagcgaccgcauggggaugggcaccaccuaccuggcccucauggccacguucaaaaugcggccgauguucgccgugggccuacuguuccgccggcucaccagccgcgaaguccuacugcucaccaucgggcugagccugguggccuccgucgagcugcccaacagccuggaagaacugggcgacggguuggcgauggggaucaugauucuuaagcugcucaccgacuuccagucgcaccagcugugggccacucugcucagccucaccuucaucaaaaccaccuuuucccugcacuacgccuggaagacgauggccaugguacuuagcauugugucccuguucccccugugccucagcaccacgagucagaagaccacguggcugcccguccugcucggcucgcugggaugcaagccgcugaccauguuccucaucgcggaaaacaaaaucuggggucggcguuccuggccccugaacgaggggauaauggccgugggcaucguuagcauccugcuuagcucucugcugaagaacgacgucccccucgccggacccuugaucgccggcggcaugcugaucgccugcuacgucaucagcggauccucggcggaccucucccuggaaaaggccgccgaggugagcugggaggaggaggccgagcacuccggcgccagccauaacauccugguugaggugcaggacgacgggaccaugaagaucaaggacgaggagcgggacgacacccucaccaucuugcugaaagcgacgcuccuggccguauccggugucuacccgcugagcauuccggcgacccucuucguuugguacuucuggcagaagaagaagcagcgguccggggugcugugggauacccccagcccgcccgaggucgagcgagccgugcuggaugacgguauuuaccgaauuaugcagcguggcuugcuggggcgcucccaagugggcgucgggguguuucaggagaacgucuuccacacgauguggcacgucacgcggggcgccgugcuuauguaccaggggaagcgccuggagcccagcugggcguccguaaagaaggaucucaucagcuacggaggcggguggcggcugcaggguuccuggaacacuggggaagagguccaggugauugcuguggagcccggcaagaaccccaagaacguccaaaccgcaccaggcaccuucaagacgcccgagggugaggugggagcuauugccuuagauuucaaacccgggaccagcgguucccccaucgugaaccgagagggcaagaucgucggcuuguacggcaacgggguggugacuaccagcggcacauacgucuccgccauagcccaggcgaaggccagccaggaggggccguuacccgaaaucgaggacgagguguuccggaaacgcaaucugaccaucauggaccuccaccccgguagcgggaagacccggcgcuaucugccggcgaucgugcgggaggcuaucaaacguaagcugcgcaccuuaauccuugcccccacgaggguugucgcguccgagauggcugaggcgcucaagggaaugccaaucagauaccagaccacugccgucaagagcgagcacacgggcaaggagaucgucgaccugaugugccacgcaacguucaccaugcggcugcugagccccguuagggugccgaacuacaauaugaucaucauggacgaggcccacuucaccgaccccagcuccaucgccgcgcgggguuacaucagcacccgcgucggcaugggagaggccgccgccaucuuuaugaccgccacgccgcccggcuccgucgaggcguucccucaaagcaacgccgugauccaggacgaggagcgggacauccccgagcgcuccuggaacagcggguaugaguggaucaccgacuuccccggcaagaccgucugguuugugcccuccaucaagucuggaaacgacaucgcaaacugccuccggaagaacgggaaacgcguaauccagcuguccaggaagacuuucgacacggaguaccagaagaccaagaacaacgacugggauuaugucgugacuacagacaucucagagaugggcgcuaacuuccgcgcggaccgagugaucgacccucgcagaugccugaagcccgucauucucaaggacgggcccgagcgcguaaucuuagccgggcccaugccggucaccguggccuccgcagcccagcgucgcgguagaaucggccgcaaccauaacaaggagggcgaccaguacaucuacauggggcagccccugaacaaugacgaggaccacgcgcacuggacagaggccaagaugcuccuggacaacaucaacaccccugagggcauaauacccgcguuauucgagccggagcgcgagaaauccgccgccaucgacggggaguacagacuccggggcgaggcucggaagacguucguggagcugaugcgcagaggggaccugcccgucuggcucuccuacaagguggcuagcgagggcuuccaguauucagaccgccgguggugcuucgacggcgagcgcaacaaccaggugcuggaagagaacauggacgucgagaucuggaccaaggaaggugaacggaagaagcugcggccccgguggcucgacgcccguaccuacuccgacccgcuugcccugcgggaguucaaggaguucgcugcgggucgccggagcgugagcggcgaccucauucuggagaucggcaagcugccgcagcaucucacacagcgcgcccagaacgcguuggacaaucuggugaugcugcacaacagcgagcagggcggacgggccuaccgccacgcgauggaggagcugccagacacgaucgaaacccugaugcuccuggcccugaucgccguccucaccggcggggugacccuguucuuccuguccggccgcgggcucggcaagaccucaaucggccugcugugcgugauggccuccagcguccuccuguggauggcaucgguggaaccccacuggauugcggccaguauaauacuggaguuuuuccucaugguccugcugauccccgagccggaucgccagcggacgccacaggacaaccagcuagccuacguugugauagggcuacuguucaugauccucaccguggccgccaacgaaauggggcuccuagagaccacaaagaaggaccucgggaucggccacguggcgguggagaaccaucaccacgccgccaugcuggacguggaccuucacccugccuccgccuggacgcucuacgcggucgcuacuacaaucaucacuccgaugaugcgccacacgaucgagaauaccaccgcgaacauuagccugaccgccauagcgaaccaggcggccauccugauggggcucgauaagggcuggccgaucuccaagauggacaucggcgugcccuuauuggcccucgggugcuacagccaggugaacccccugacccugaccgcggcgguccucauguugguggcccacuaugccaucauuggaccggggcugcaagccaaggccacccgcgaggcacagaaacggaccgccgccggcauuaugaagaacccaacgguggacgggaucgucgccaucgaccucgaccccgugguguacgacgcgaaguucgaaaagcaacugggccagaucaugcugcucauccugugcacaagccagauccugcucaugcggaccaccugggcguugugcgaaagcauaacgcuugccaccggcccccucaccacauuaugggagggguccccgggcaaauucuggaacacgaccaucgccgucagcauggccaacaucuuccgggggagcuaccuagccggcgcgggccucgccuucagccugaugaaguccuuagggggcgggcgccgggggaccggggcgcagggcgaaacccucggcgagaaguggaagagacagcugaaucagcugucuaagagcgaguucaauacguacaagcgguccgggaucauggaaguggaccgcagcgaggccaaagagggccucaagcgcggggagacaaccaaacacgcugugucccguggcaccgcaaaacuucggugguucgucgagcgcaaccuggugaagcccgagggcaaggugaucgaccuuggcugcggccgcgggggcuggagcuacuacugcgccggucucaaaaaggucacggaggugaagggauacaccaaggggggcccgggccaugaggagcccaucccgauggcgaccuacggguggaaucuggugaagcugcauaguggcaaggacguguucuucaucccgcccgagaagugcgacacccuccugugcgacaucggggagaguucccccaacccgacaaucgaggagggccgcacgcugcgggugcuaaaaaugguggagcccuggcugcgcgggaaccaguuuugcaucaagauccugaaucccuacaugcccagcgucguggagacccucgagcagaugcagagaaagcacggcggcaugcuggugcgcaacccguuaagccggaacagcacccacgagauguauuggguauccugcggcaccggcaacaucgugagcgccgugaacaugacaucucgcaugcugcugaaccgcuucacuauggcgcaccggaagcccaccuacgagcgcgacgucgaccugggggccggcacccggcauguggcgguggagcccgagguggccaaccucgacaucaucggucagcgcaucgagaacaucaagcacgagcauaaaagcacguggcacuaugacgaagacaaccccuacaagaccugggcauaccacgggucguaugaggugaaaccgucuggcuccgccucaucaauggugaacgggguggugaagcuucugaccaagcccugggacgucauccccauggugacccagaucgcuaugacggauaccacccccuuuggccagcagcggguguuuaaggaaaagguugauacccgcacgccuaaggcaaagcgggggacagcacaaauaauggaggugaccgccaagugguuguggggcuuccugucccgcaacaagaagccucggaucugcacccgcgaggaguuuacgcggaaggugcgcagcaaugcggcgaucggcgccgucuucguggacgaaaaccaguggaacuccgccaaggaggcggucgaggacgagcgguucugggaccugguccaccgcgagcgggagcuccacaagcagggaaagugcgcgacuugcguguacaacaugaugggcaagcgcgagaagaagcugggagaauucggcaaggcaaaagggagccgcgccaucugguacauguggcugggcgcccgcuuccuggaguuugaagcgcugggguucaugaacgaggaccacugguucucccgggagaacagccuguccgguguggagggcgaggggcuucacaaacucggcuacauccugcgcgacaucucuaagauccccgggggcaacauguaugccgacgacaccgccggcugggacaccagaaucacggaggacgaucuccagaacgaggcccgcaucaccgauaucauggagccggaacacgccuuacuggcgaagucaaucuucaaacucaccuaccagaacaaagucgugagagugcaacggcccgccaagaacgggaccgucauggacgugaucagccgcagagaccaacgcggauccggccagguggggacguacggccugaacaccuucaccaacauggaagcccagcugauccgucagauggaaagcgaggggaucuuuucccccagcgagcuggagaccccgaaccuggccgagcgcguccuggacuggcucgagaaauacggcgugaaacggcucaagcgcauggccaucuccggggacgacugcguggucaagcccaucgaugaccgguucgcgacggcucugacagcccucaacgauaugggcaagguccgcaaggacaucccgcagugggaacccagcaaaggguggaacgauuggcagcagguccccuucuguucccaccacuuucaccagcugaucaugaaggacggccgggagaucgucgucccgugccggaaccaggacgagcuggugggccgggcccgcgucagccagggcgccgguuggagccuccgggagacagcuugcuuggggaagucauacgcgcaaauguggcagcuuauguacuuccaucgccgggaccuccgccuggccgccaacgcgaucugcagcgccgugccgguggacuggauccccaccucccggaccaccuggucaauucacgcucaccaucaguggaugacuaccgaagauaugcuguccguuuggaaccgcguguggaucgaggagaacccguggauggaggacaagacgcacauuagcucguggggcgacgugccguaucucggcaaacgcgaagaccaguggugcgggucacugaucggccuuacagcccgggccaccugggcgaccaacauccaggucgccaucaaccaagugagacggcucaucgguaacgagaacuaccuagauuacaugaccaguaugaagcgcuucaagaacgagagcgacccugaaggugccuugugguga

SEQ ID NO: 24494 - RNA, 9879 nt, Artificial Sequence
  derived and/or modified CDS sequence (opt11) from DENV-1__GU131791__SS-prME
agcguaaccaugcugcucaugcugaugcccaccgcccuggccuuccaccucaccaccaggggcggggagccacacaugaucguaagcaagcaggagcggggcaaaagccugcuguucaagaccucugcaggcgugaauauguguacccucaucgccauggaccugggggaacugugcgaggacaccaugacguauaaaugcccccgcaucaccgagaccgagccagaugacguggacugcuggugcaaugcuacugacaccugggugaccuacgggaccugcagccagacgggcgagcaucggcgcgacaagcggagcguagcgcucgcgccccacgugggccuugggcuugagacccgcaccgaaaccuggaugagcucagagggagcuuggaagcagauccagcgggucgagacgugggcgcuccgccaucccggcuucacugugaucgcccuguuccuggcccacgcgaucggcaccaguaucacccaaaaggggaucaucuucaucuuacugaugcuggugacgcccuccauggcgaugcguugcgucggcaucggcagccgcgauuuuguugaggggcucuccggcgccaccuggguggacgucguacuggaacacgguuccugcgugaccaccauggcaaaggacaagcccacgcuugacaucgagcuccugaagaccgaggucaccaaccccgccgugcugagaaagcuaugcaucgaggcgaagaucuccaacaccacgacggacucacgcugcccgacccagggggaggccacacucguagaggagcaggacgccaacuucgucugccggcgaacguucguggaccggggcuggggaaacggaugcggguuauuugguaaggggucacucaucaccugcgccaaguucaagugcgugaccaaacuggaaggcaagaucguccaguacgagaacuugaaguacagcgugaucgugacgguccacacgggcgaccagcaccagguagggaacgaguccaccgagcacggcaccacggccaccaucaccccccaggcacccacaacggagauccagcugacagauuacggggccuuaacgcuagauuguuccccccgcacaggccucgacuucaacgagaugguccugcugaccaugaaagaaaaguccuggcucgugcacaaacagugguuccuagaccugccgcuccccuggaccuccggggccucaacuucccaggagacuuggaaccggcaggaccugcuggugaccuucaagaccgcccacgccaagaagcaggaggucgugguucucggcucccaggagggugcgaugcacacggcccuaaccggggccaccgagauacagacguccggcacgaccacaaucuucgccggacaccugaagugcagguugaagauggacaagcugacccugaagggcaugagcuaugucaugugcacgggguccuucaagcucgagaaggagguggccgagacccagcacgguaccgugcugguccagaucaaguaugaggguaccgacgcgcccuguaagauucccuuuagcacacaggaugagaagggggugacucagaacggccgacugaucacggcuaacccgaucgugaccgauaaagagaagcccguaaacauagaggccgagccgccuuucggggaguccuacauuguaaucggcgccggcgagaaagcgcugaagcucagcugguucaagaagggguccagcaucggcaagauguucgaggccacggcccgcggggcccggcgaauggccauccugggagacaccgcgugggacuucggauccaucggcgggguauucaccagcguugggaaacuggugcaccaaaucuuuggcaccgccuauggugugcuguucuccggcguaagcuggacgaugaagauugggaucggcguauuacucaccuggcucggccugaacucccgcagcaccucuuuauccaugaccugcaucgccguggggcucgucacccuguaccugggcgugauggugcaggccgacuccgggugcgucaucaacuggaagggccgggaacucaagugcggguccggcauuuucguaaccaacgaggugcauaccuggacggagcaguauaaguuccaggccgacagcccgaagcgccuauccgcggccaucggcaaggccugggaggagggggucugcggcauccggagcgcaacccgauuggagaauaucauguggaagcagaucagcaacgagcucaaccacauccugcuggagaacgacaugaaauucacggugguggucggggacguggccggcauccuagcgcaggggaagaagaugauccggccccagccaauggaauacaaguacagcuggaaguccugggguaaggccaagaucaucggcgcagacgugcagaacacaaccuucauuaucgacggucccaacaccccggagugccccgacgaccagcgcgccuggaacaucugggaggucgaggauuacggcuucgggaucuuuacgaccaauaucuggcugaagcugcgggacucuuacacccaggucugcgaccaccgucucauguccgcggccauuaaggauaguaaggccgugcacgccgacaugggcuacuggaucgaauccgagaagaaugagaccuggaaacuggcccgugcgucguucaucgagguaaagacguguaucuggccgaagagccacacccuguggagcaauggcgugcucgaguccgagaugaucauucccaagaucuacgggggcccaaucucccagcacaacuaucgcccgggguacuucacccaggccgccgguccuuggcaccuggggaagcuagagcucgacuucgaccugugcgaagguacuacgguggucguggacgaacacuguggcaaccgggggccgucccugcgcacuaccaccgugacgggcaaaaucauccacgaguggugcugccggagcugcacccuuccgccacuccgcuuccgcggggaggauggcugcugguacgggauggagauccgccccgucaaggagaaggaggagaaccuagugaaguccauggucagcgccggcagcggcgagguagacuccuucagcuuaggccuguuauguauauccaucaugaucgaggaggugaugaggagccgcugguccaggcgcaugcucaugaccggcacccuugccgucuucuuucugcucaucaugggacagcuuacguggaacgaccucauccgccucugcauaauggucggcgcgaaugccagcgaucggauggggaugggcaccaccuaucuagcccugauggccacauucaagaugcgcccgauguucgccgugggccuucuauuccggcgcuugacgucccgggaggugcuccugcugaccaucgggcugagccugguggcgucuguggagcugcccaacagcuuggaggaacugggcgacgggcuggcuaugggcaucaugauccuuaagcugcugacggacuuucagucccaccagcucugggccacccugcugagccucacuuucaucaagaccaccuucaguuugcacuacgccuggaagaccauggcgauggucuugagcaucgugucccuuuucccccugugccugagcacgaccucccagaagacuaccuggcucccggugcugcugggcagccuaggaugcaagccgcugacgauguuccuuaucgccgagaacaagaucuggggccgccgcuccuggccccugaaugagggcaucauggccgucggcaucgugaguaucuugcugagcuccuuacugaagaacgacgugccccuggccggaccccucaucgccggcggcaugcugaucgcgugcuacguaaucaguggguccagcgcugaccuguccuuggagaaggccgccgagguuagcugggaggaggaggccgagcacuccggagcaagccacaauauccugguggagguccaggacgacgggccaaugaagaucaaggacgaggagcgcgacgacacccugaccauacuccugaaggccacucugcucgcugucuccgguguguacccccugagcauccccgcuacccuguucgucugguacuucuggcagaagaagaagcaacgguccggggugcucugggacacgcccaguccacccgagguugagcgcgccguccuagaugacggcaucuaccggaucaugcagcgcggucugcuggggaggucgcaggugggcgugggggucuuccaggagaacguguuccacaccauguggcacguaaccagaggcgcaguccucauguaccaaggaaagaggcuggagcccagcugggcaucagugaagaaagaccugaucuccuacggcggcggguggcgucuccaaggcuccuggaacaccggggaagaggugcagguuaucgccguggagcccggcaagaacccaaagaacgugcagacugcccccgggaccuucaagacccccgagggagaagugggagccaucgcgcuagacuucaagccggggacuagcggcuccccgaucgugaacagagaggggaaaaucgugggccuguacggcaacggggucgugacgaccucaggcacguacgugagcgcgauagcccaggcuaaagcgucccaggaagggccguugcccgagaucgaggacgaggucuuccgcaagaggaaccugacaaucauggaucugcacccggggagcgggaagacgcgccgguaccugcccgccaucguucgcgaggccaucaagcgcaaacuacggacccugauccucgcccccacucgcguuguagccuccgagauggcagaggcccuuaaggggaugcccauccgguaucagaccacagccgucaaauccgagcacaccggcaaggagaucguagaccucaugugccaugccacuuuuaccaugcgccuccugucccccgugcgggugccaaauuauaacaugaucaucauggacgaggcccacuucaccgaccccaguucuaucgcggcacgcggguauauaucaacccgggugggcaugggggaggccgccgccaucuucaugacugcgacgccccccggcuccguugaggccuucccccagagcaacgcugugauacaagacgaggagcgcgacauucccgagcgguccuggaacagcggguacgaguggaucacggacuuccccggaaaaaccgugugguuuguccccuccauaaagagcggcaacgauaucgcuaacugccuucgcaagaacgggaagcgggugauucagcucucucgcaagacguucgacaccgaguaccagaagacgaaaaacaacgauugggacuacguggucaccacagauaucagcgaaaugggagcgaacuucagagccgaccgcgugaucgacccccgucgcugccugaaacccgugauucugaaagacgggcccgagcgggucauccucgccggcccgaugcccgugaccgucgccuccgccgcgcagcgccgggggcggauuggccgcaaccacaacaaagagggggaccaguauaucuacauggggcagccucugaacaacgacgaggaucacgcccacuggacggaggccaagaugcuguuggacaacaucaacacuccggagggcauaaucccggcccuguuugagcccgagcgugagaagucagccgcgaucgacggggaguaucgccugcggggcgaggccaggaagaccuucgucgaguugaugagacgcggggaucuuccuguguggcuuagcuacaaggucgccagcgagggcuuccaguacagcgaccggcgcuggugcuucgacggcgagcguaacaaucaggugcucgaggagaacauggacguggagaucuggacgaaggagggagagcgcaagaagcugcggccccgcuggcuggacgcccggacguacuccgacccgcucgccuuacgcgaguucaaagaguucgcggccgggcggagaagcgucuccggagaccugauccucgagaucggcaagcucccccaacaccugacacagcgggcccagaacgcccucgauaaccugguaauccugcacaacucggagcagggcgggcgugcguaccggcaugccauggaggagcugcccgacaccaucgagacccugaugcuguuagcccuaaucgccgugcucacgggcggggucacccuauuuuuccucucgggccgcgggcuggguaagaccagcaucgggcucuugugcgugauggccucgagugugcugcucuggauggcgagcguggagccccacuggaucgccgccagcaucauccuggaauucuucuugaugguguuacucaucccugagcccgacaggcagcgaacgccccaggacaaccagcuggccuauguggucaucgggcuccuguucaugauccugaccgucgccgccaaugagaugggccuccuggaaacgaccaagaaagaccuugggaucggucacguggccgucgagaaccaccaccacgcggccaugcucgacguggaccugcaccccgccuccgccuggacacuguacgcuguugccacgacaaucaucacccccaugaugcgccauaccaucgagaacaccacggcuaacaucagcuugaccgccaucgcgaaccaagccgccauccugauggggcuggauaagggcuggcccaucuccaaaauggacauuggcgucccccuccuggcccuggggugcuacagccaggucaacccgcucacccuaacagcggcuguguugaugcucgucgcccacuacgccauaaucggaccaggguuacaggccaaggcgacccgugaggcucagaagcggaccgccgcuggcauaaugaaaaaccccaccguggacgguaucguugcuaucgaucuggaccccgucguguacgaugcgaaguucgagaaacagcucggccagaucaugcuacugauucuuugcaccucccagauucugcuaaugcggacgaccugggcccuaugcgagagcaucacccuggccaccggcccgcugacgacccucugggaggggucccccggcaaguucuggaacaccaccauagcggugagcauggccaacauauuccgcggcuccuaccucgcgggcgccgggcuggccuucagcuugaugaaauccuuagggggcgggcggcgagguacuggggcccagggcgagacacugggggagaaguggaagcggcagcucaaccagcuguccaaaagcgaguucaacaccuacaaacgaagcgggaucauggagguggacaggagcgaggcuaaagaaggccugaagcgcggggaaaccacgaagcacgccgugucccggggcaccgccaagcuccgcugguucgucgagcggaaccuggucaagccugaaggcaaggugaucgacuuaggcugcggccgcgggggcuggagcuacuacugcgcagggcugaagaaggugaccgaggucaagggcuacaccaagggcggccccggccaugaggagccgaucccaauggccacguacggcuggaaccucgugaagcuucacuccggcaaagacguguucuucaucccccccgagaagugcgacacucugcucugcgauaucggggagagcucccccaaccccacuauugaggagggccggacucugcgcguccuaaagaugguggagcccuggcuuagggggaaccaguucugcaucaagauccugaaccccuauaugccgagcguagucgaaacgcucgagcagaugcaacggaagcacggcggcaugcucgugcggaacccccugucccgcaacagcacccacgagauguauuggguguccugcgggaccggcaauaucguaagcgcggugaauaugaccucccgcaugcugcucaaccgcuucacuauggcccaccgcaagcccacguacgagcgggacguggaccugggggccggcacccgccacguagccguggagcccgagguggccaaccuggacaucaucggccagcggaucgagaacaucaaacacgaacacaaaucuacuuggcacuacgacgaggauaaccccuacaagaccugggcguaccacggguccuaugagguaaagcccagcggcucggccagcuccauggugaacggagucgugaaguuguugacgaagcccugggacgugaucccuauggucacccagaucgcgaugacggacaccacgccguucggccagcagcgcguguucaaggaaaagguggacacccggacuccaaaggccaagcgcgggaccgcccagaucauggaggucacggcgaaguggcuuuggggcuuccucucccggaacaagaagccacgcauuugcacacgggaggaguucacccguaaggugcggagcaacgccgccaucggugccguguucgucgacgagaaccaguggaauuccgcuaaagaggccguggaggacgagcgcuucugggaucuggugcaccgggagcgcgagcugcacaagcaggggaagugugcgacuugcgucuauaacaugaugggcaagcgggaaaagaagcucggagaguucggcaaggccaaggggucaagagcaaucugguacauguggcugggcgcgcgguuccuggaauucgaggcccuagguuucaugaacgaagaccacugguucuccagggagaacagccuguccgggguagagggggagggucugcacaagcucgguuauauccugcgggauaucagcaaaauccccgggggcaacauguaugccgacgauacggccggcugggauacacgcaucaccgaagacgaccugcagaacgaggcccgcaucacugacaucauggagccagaacacgcgcuccuggccaaguccaucuucaagcugacguaccagaacaaagugguccgcguacagcgccccgccaagaaugggaccgugauggacgucauuagccggcgcgaccagcgaggauccggccagguugggacuuacggccugaacaccuucacgaacauggaggcccagcugauccgccagauggaaucggaggggaucuucucccccagcgagcuggagaccccaaacuuggccgagagagugcuggacuggcuggagaaguacggcgucgagcgccucaaacgcauggcgaucuccggcgaugacugcgugguaaagcccauagaugaccgcuuugccaccgcacugaccgcccugaacgacaugggcaaggugagaaaggauaucccccagugggagcccagcaagggguggaaugacuggcagcagguaccguucuguucccaccacuuucaccagcucaucaugaaggacggccgcgagauagugguccccuguaggaaccaggacgagcuggugggucgcgcccgggugucacaaggggcgggcuggucacugcgcgagacggccugccucgggaaguccuacgcgcagauguggcagcugauguacuuccauagacgcgaccuucgguuagccgcgaacgccaucugcagcgccgucccaguggacuggauccccacuuccaggaccacuugguccauacacgcccaccaucaguggaugacgacagaggacaugcuguccguguggaaccgcguguggaucgaggagaauccguggauggaggacaagacccacauauccucuuggggcgacguacccuacuuaggcaaaagagaggaccaauggugcggcagccuuauuggacugacugcccgcgcgacgugggccacaaacauccaaguggccauaaaccagguacggcggcugaucgggaacgagaacuauuuggacuacaugaccagcaugaagagauucaagaacgagagcgaccccgaaggcgcacugugguga

SEQ ID NO: 24495 - RNA, 9879 nt, Artificial Sequence
  derived and/or modified CDS sequence (opt11) from DENV-1__GU131792__SS-prME
ucaguaacuaugcuccucaugcugaugcccacggcccucgccuuccaucucaccacuagagguggagaaccgcacaugaucguaacuaagcaagaacgcggaaagucguugcucuuuaagaccagcgcaggaguuaacaugugcacccuaaucgcaauggaccuaggcgaacugugcgaagacacaaugacauacaaaugcccgcgcaucacagaagccgaacccgacgacguugacugcuggugcaacgccaccgacacgugggugaccuacggcacaugcucacaaacaggagaacaucgaagagacaagaggaguguggcucuggcuccacacguuggauuaggacucgaaacucgaacagaaacauggaugucuuccgaaggcgccuggaaacaaauccaacgcguagaacccugggcccugcgacaucccggguucacagucauagcuuuauucuuagcacacgcaauuggcacaagcauuacacagaaagggaucauauucauuuuauugaugcuugucaccccaucgauggccaugagaugcguuggaaucggcuccagagcuuucgucgaaggauuaagcggcgccaccuggguagauguagugcuagaacaugguuccuguguuacgaccauggcgaaagacaagcccacacuggauauagaacuccucaagaccgaagucaccaaccccgcuguccuaagaaaacuguguaucgaagccaaaaucuccaacacaacgacggacucacgcugccccacgcagggggaagcuacgcuaauggaagaacaggacgcgacuuucguaugccgcaggacguucguagauagaggcugggggaaugguugcggccuguucggcaagggcagccuaauaacgugcgcaaaauucaaaugcguaacaaaacucgagggcaagaucguccaauacgagaacuugaaauacagugucauugugacagugcacaccggagaucaacaccaagucgggaacgaaucaacagagcacgggaccacagcgaccauaaccccacaggcacccacuagcgaaauacaacuaccugacuacggcgcgcuaacucuggacugcagcccuagaacaggguuagacuuuaacgaaaugguucugcucacgaugaaagaaaagucaugguugguccauaagcaaugguuccuugauuuaccgcuaccauggaccaguggagcaucuacaagccaagaaaccuggaaccgucaggaccugcuuguuaccuucaaaacagcgcaugcgaagaagcaggaaguggugguacuaggaucccaagaaggagcaaugcacaccggacuaacuggugccaccgagauacagaccagcggaacgacaacaauuuucgcaggccacuuaaaaugccgccuaaagauggacaaacuuacccuaaaagggaugucauacguaaugugcacuggcuccuucaaauuagagaaagaagucgcagagacacaacacggaacaguccugguacaaauaaaauaugaggguacagaugcaccuugcaaaauucccuuuagcacacaggaugagaaagggguaacccaaaauggucgccuuaucacugcgaacccgaucguaacagacaaggagaaaccgguaaacauagaggccgaaccaccauuuggcgaaagcuauaucguuauaggggcaggcgaaaaagcguuaaaacuaagcugguucaagaaagggucaagcauaggaaagauguucgaggcgacagcacgaggcgcgcggagaauggccauacucggcgacacugcgugggacuucggaagcguaggggguguguucacgucgguaggaaaacucgugcaucaaauauucggcacagcauauggaguacuauuuaguggcgucucguggacaaugaaaauaggcaucggugucuugcuuacauggcucggacuaaacagccgcuccacaaguuuaagcaugaccugcaucgcagugggccuugucacauuguaccugggggucauggugcaagcagauuccggaugcguaaucaauuggaagggaagagaacuaaaaugcgggagcgguaucuucgggacaaacgagguacauacguggaccgagcaguacaaauuucaagccgacagccccaagagauuaucggcggcgaucggaaaaccaugggaagagggcgucugcggcauacgaagcgccacccgccucgaaaacauaauguggaaacagauuagcaaugaguuaaaucacauauuacucgaaaaugauaugaaguuuaccgucguggugggugacgugguggguauccucgcccaaggaaagaagaugauucgcccacaaccgauggaacacaaauacaguuggaaaucgugggggaaggccaaaauuaucggcgcagaugugcaaaacaccacauuuauaaucgauggaccaaacaccccagaaugcccagaugaccagagggccuggaacauaugggaaguggaagacuacggcuucggaaucuucaccacaaauauauggcuuaaacuacgcgacucccacacccaagucugcgaccaccgccuaauggccgccgcaauuaaagacagaaaagcaguccacgcagacauggguuacuggauagaaagcgaaaagaacgaacccuggaaacucgcgcgcgccucauuuauagaaguaaaaacaugcauuuggccaaaaucccacacccuguggagcaauggcguacuagaaagugaaaugaucaucccgaaaauauauggaggacccaucagccagcacaacuaccgccccggauacuucacccagacagcugggcccuggcaccuaggaaaacucgaacuagauuuugaccuuugcgagggcacuacggugguugucgacgagcacugcgguaaccgaggaccuagucuacgcacgacgaccguaaccggaaaaauaauucacgaauggugcugccgaucaugcacccuaccaccccuccgguucaaaggagaggacggaugcugguauggaauggagauccgccccgucaaagaaaaagaggagaaucuggucaaaucgaugguaagcgcgggcagcggagaagucgacuccuuuucccuuggccuguuaugcauaaguauaaugauagaagaaguaaugcgaagcagauggagcagaaaaauguugaugacagggacacuugcaguauuccugcuacucaucauggggcagcugaccuggaaugaccugauccgccuauguaucaugguuggagcgaaugcaagcgaccgcaugggcaugggcacaacguaucucgcccucauggcgaccuucaagaugagaccgauguuugccgucggacuccuguuccgcagguuaacaagccgcgaagugcuacugcuaacgauagggcuaagccucgucgcaucagucgaacuacccaauagccuggaagaacuaggcgauggacuagcaauggggauuaugauacuaaagcuacuaacagauuuccagagccaucaacuuugggcaacucuccuauccuugacuuuuauaaaaacgacacucagccuacacuaugcauggaaaaccauggcaaugguccugagcaucgucagccucuucccacuguguuugaguacuacaagucaaaagacgacauggcugccaguauugcuagguucucuaggguguaaaccucucaccauguuccucaucaccgaaaacaagaucugggggcgcaaaucguggccuuugaaugaaggaauuauggcugugggugucguuaguauccuccugagcagccugcugaagaaugacguaccccuggccggcccacuaauagccggaggaaugcucauagcuuguuacgucauauccggcagcuccgcugaccuaagccuagagaaggcagccgaagucagcugggaggaagaggcagaacacuccggggcgucacauaacauucucgucgaagugcaagacgacgggacaaugaaaauaaaggacgaggaacgagacgacacgcucacaauucuucuaaaagcuacacugcucgccgucagcggcguguacccgcucuccauaccagccacacucuucgucugguacuucuggcagaagaaaaagcagcgcuccggcgugcuaugggacaccccgagcccuccggagguagaaagagccguucuagaugauggaaucuacaggaucaugcagcgaggccuauuagcucgaagccaagucggggugggcguauuccaagagaacguauuucacacgauguggcaugucacgcguggagccgugcugauguaccaaggaaaacgcuuagaaccaaguugggcuagcguuaagaaagauuuaauuucuuauggcggcggcuggagacugcaaggaucauggaacacgggagaagagguccaaguuauagcggucgagccaggcaagaauccuaaaaacguccagacagcaccggggacguuuaagacaccagaaggagaaguaggagcgauagcccuagacuucaagccagguacgucugguagcccuaucguaaacagggagggcaagauagucggccucuacgggaacggcgugguaaccaccaguggaaccuacgucucggcaauagcgcaagccaaagcgucacaagaaggcccacugccagaaaucgaggacgagguauucagaaaaagaaaccucaccauaauggaccugcaccccggaaguggaaaaacaagaagguaccucccggcaauaguaagagaggcgauaaaacgcaaacugcgaacacucauccucgccccgacucgcguaguugccagcgaaauggcagaggcccucaaaggcaugccaauaagguaccaaacaacggcggugaaguccgagcauaccggaaaggaaauaguugaccuaaugugccacgcaacauuuacuaugcgacuuuuaagccccguucgcguacccaacuauaacaugauaauuauggaugaagcgcauuucacggaccccucguccaucgcggcccgcggguacauuaguacccgugucggcaugggggaagccgcugcuaucuucaugacagcaacacccccggggucaguggaggcuuucccacaaagcaacgcgguaauacaagacgaagagagagacauacccgaaagaaguuggaacagcgguuacgaguggauaaccgacuucccuggaaaaaccgucugguucguccccuccaucaaaagcggaaacgacauagcgaacugccucaggaaaaauggcaagagaguaauccagcuauccagaaagaccuuugauaccgaguaccaaaagacgaagaacaacgauugggacuauguggugacaaccgacauaagcgagaugggggcgaacuuccgugcagauagagucaucgacccccgccgcugccugaaaccugucauucuuaaggacggccccgaacgagucauacuagcgggaccgaugcccgugacagucgcaagugcagcgcaacggcgaggaaggauuggacgcaaucauaacaaagaaggugaccaauacaucuacaugggacaaccauugaacaacgacgaggaccacgcccauuggacggaggcaaagaugcuucuagauaacaucaauacgcccgaaggcaucaucccggcucuauucgaaccggagagagaaaaauccgccgcaauagacggggaauaccggcuccggggcgaggccagaaagacuuucgucgaguuaaugagaagaggcgaucugccagucuggcuauccuauaagguagcaagcgagggauuccaguacuccgaucgacggugguguuuugacggcgaacgcaacaaccaggugcuugaggaaaauauggacguagaaauauggaccaaagagggagaacgaaagaaacuucguccgagauggcuagacgcacgcacuuacagcgacccucucgcucuacgagaguucaaggaguucgccgcaggacgaagaagugucaguggagaccuaauauuagaaauagguaaacugccacaacacuuaacacaacgagcacagaaugcgcucgauaaucuagucaugcuacacaacucagagcaaggagggagggccuaccggcacgcaauggaggaacugccagacaccaucgagacccuaauguugcuagcgcucauugcgguucugaccggugguguaacauuauucuuccuaucgggacgcggacugggaaagacgaguauuggucuacucugcguaauggccagcaguguucuccucuggauggcaagcgucgaaccacacuggaucgcagcuagcaucauacuggaguucuuccucaugguccuacugauaccugaacccgaucgucagcgcacaccucaggacaaucagcucgcuuacgucgugauaggacugcucuuuaugaucuugacaguugcggccaacgaaauggggcugcucgaaacuacuaaaaaggaccucgggauagggcaugucgccguugaaaaccaccaucacgccaccaugcucgaugucgaccuccaccccgccucagcguggacauuauaugcagucgcaacgacaaucauaaccccuaugaugcgccacacaauagaaaacacaacggcgaacauaucccugacggcaaucgccaaccaagcggccauccucauggggcuggauaagggguggcccauaucgaaaauggacaucggugucccauuacucgcgcucggaugcuauucacaaguaaacccccuaacccuaacagcagcuguacucauguugguugcccacuacgcaauaaucggaccgggacuacaggcgaaagcaacgcgugaggcacagaagcggacugcggccgggauaaugaaaaaccccacgguagacggaauagucgcgaucgauuuggacccgguagucuacgacgcgaaauuugaaaaacaacuuggacaaauuaugcuccuaaucuuguguaccucgcaaauucuccucaugcggacuacaugggcacuaugcgagucuaucacacuagcaacaggcccccugaccacacuaugggagggcucaccggggaaauuuuggaacacgacgaucgccguaucaauggccaacaucuuucgaggaucauaucucgcuggagcgggacucgcauucucgcugaugaaaagucugggagggggaaggcgcggcacaggggcgcaaggggaaacauugggagaaaaguggaagcggcaacuaaaccagcucucgaagucugaguucaauauauacaagcgaagcggcauaauggaggucgaccgcuccgaggcuaaggaaggacugaaacgcggcgagacaacacgccaugcggucucacgcggaacagccaaacugcgaugguucgucgaacgaaaucuagugaaacccgaggggaaaguuaucgaccucggcugcggacgcggcggcugguccuauuauugugcuggacucaaaaagguuacagaggugaaaggguacaccaagggagggccaggccaugaagaaccuauuccgauggcaaccuacggguggaaccucgucaaacugcacucagggaaagacguauucuucacaccaccagaaaaaugcgacacguuacuaugugacaucggagaaagcucuccuaauccaacgauagaagaagggcgcacauuacggguucugaaaauggucgaacccuggcuaagaggcaaccaauucugcaucaaaauucuaaauccuuacaugccauccgucgucgaaacgcuggagcaaaugcaaaggaaacacggcgggauguuagugcgcaauccacugagucguaacagcacgcacgagauguacugggucaguugcggaacaggcaacauugugagcgccguaaacaugaccucaagaaugcuccuaaaucgauuuacaauggcccacaggaagccaaccuacgaacgggacgucgaccucggagcaggcacuaggcaugucgcagucgaacccgaagucgcgaaccuugauauaaucggacaacggaucgaaaauaucaaacacgaacacaagagcacauggcacuaugacgaagacaaucccuauaaaacuugggccuaccauggaucguacgagguuaagccaagugggucagcauccucaaugguaaacgggguaguaaaacuucuuaccaagcccugggaugucauaccuauggucacccaaauagccaugacagacaccacuccguucgggcagcaacgcguuuucaaagaaaaggucgacaccaggacaccaaaagcaaaaaggggcaccgcucaaauuauggaagucacagcucgcuggcuaugggguuuccugucccggaauaagaagcccagaauuugcacgcgagaagaguucacgcgaaaaguccguagcaaugccgccaucggcgcgguguuugucgacgaaaaucaauggaacucagcuaaagaagcggucgaagacgagagauucugggauuuaguccaaaaagaacgcgaauugcacaagcaaggcaaaugcgcaaccugcguauacaacaugauggggaaacgagagaaaaagcuaggcgaguucggaaaagcaaaaggaagcagagccaucugguacauguggcuaggcgcaagguuccuggaguucgaggcccucggcuuuaugaaugaagaccauugguuuaguagagaaaauucucugucuggaguggaaggagagggacuccacaaacuaggcuacaucuugagggacaucuccaagaucccaggaggaaacauguaugcagaugauacugccggcugggacaccaggauaacagaggaugaccuacaaaacgaggcgaaaauaacagacaucauggaacccgaacacgcgcuccuugcaaccagcauauucaaauuaaccuaccaaaacaaagucguacgaguccagaggccagccaaaaacggcacgguaauggacguaauaagucgcagagaccagagaggcucgggacaaguggggacauacggauugaauaccuuuaccaacauggaggcacaacuaauacgccaaauggaaagugaaggcaucuuccugccgagcgaacuggagacgccaaaucuggcagaaaggguacuagacugguuagaaaaauauggaguugaacgauugaagcgcauggcaaucagcggcgacgacugcguggugaagccaaucgacgaccguuucgcaacagcccugacagcccuaaacgacaugggcaaggugcgaaaggacauaccacagugggaacccagcaaaggcuggaaugacuggcaacaaguacccuucugcucccaucacuuccaccagcugaucaugaaggacggccgggaaauaguggugccaugcagaaaccaagacgaguuggucggaagggcacgagucucucagggagccggcuggagccuccgggaaacggccugccuaggcaaguccuaugcacaaauguggcaacucauguacuuucaccggcgugaccuucgauuagcggcaaaugcaauuugcagugcuguucccguagacuggguccccacgagccgcacgacguggagcauucacgcgcaccaucaguggaugacgacugaagacaugcuaagcguauggaaccgaguguggaucgaggagaacccguggauggaagacaaaacacauguaucgucauggggagauguaccguaccuuggaaaacgagaggaucaauggugugggaguuuaauuggauugacagcaagggcgacaugggccaguaacauccagguagcgauaaaccaagucaggaggcuaaucgggaaugagaacuaccucgacuauaugaccuccaugaaaagauuuaaaaacgaaggcgauccggaaggggcacugugguag

SEQ ID NO: 24496 - RNA, 9879 nt, Artificial Sequence
  derived and/or modified CDS sequence (opt11) from DENV-1__HM488256__SS-prME
agcgucaccaugcuacucaugcugaugcccaccgcccucgccuuccaccucacuacccggggcggggagccccacaugaucgugagcaagcaggaacggggcaagagccugcuuuucaagaccagcgccggcguuaacaugugcacccucaucgccauggaccugggggagcucugugaggacacgaugaccuacaagugcccccggauuaccgaaaccgagcccgacgacgucgacugcugguguaaugccacagacacuuggguaacauacggaaccugcagccagacgggcgagcaccggcgcgacaagcggagcguggcccucgcgccccacguuggccuggggcuggagacccgaaccgagaccuggaugucuuccgagggcgccuggaagcagauccaaaggguggagacgugggcccucaggcacccaggcuucaccgugauugcacuguuccuugcccacgccaucggaaccagcaucacccagaaggggauaaucuucauucuccugauguuagugacaccauccauggcuaugcggugcguaggcauuggcucgcgugacuucguugaggggcucuccggcgccaccuggguggacgucgugcuggagcacgggagcugcgugaccaccauggccaaggacaagcccacgcuggacaucgagcuccugaaaaccgagguuaccaaccccgccgugcugcguaagcucugcauagaggcgaagaucuccaacaccacuaccgacagccgcugcccgacccagggggaggccaccuuagucgaagagcaggacgccaacuucgugugccggcgcacguucguugaccggggaugggggaauggcuguggucuguucggcaaagggucccuaaucacgugcgccaaguucaagugugugaccaagcuggagggcaagaucguccaguacgagaaccugaaguauagcgugaucgugaccguccacacgggggaccagcaccagguggggaacgagucuaccgagcacggcaccaccgccaccaucacgccccaggcacccaccaccgagauccagcuccccgacuauggggcccugacccuggacugcaguccgcgcacgggacucgauuucaacgagaugguccugcugaccaugaaggaaaagucuuggcucgugcacaaacagugguuucuggacuugccccugcccuggaccagcggggccagcaccucccaggagacguggaaccggcaggaccugcucgucaccuucaagaccgcccacgccaaaaagcaagagguaguggugcugggcagccaggagggcgcgaugcacacggcccugacaggggccaccgagauccagaccuccggcacuacgaccaucuucgccgggcaccugaagugucgccucaaaauggacaagcugacucugaaagguaugagcuacgucaugugcaccggguccuucaagcucgaaaaggagcuggcugagacgcaacacggcaccguucucgugcagaucaaauacgagggcacagacgcgcccugcaagauaccguucuccacucaggaugagaagggggucacgcagaacggccggcucauaaccgcgaaccccaucgucaccgacaaggagaagcccgugaauaucgaagcugagcccccuuucggggaguccuacauugucauuggcgccggcgagaaggcgcucaagcugagcugguucaaaaagggguccucaauaggcaagauguucgaggccacugcacgcggggcccgacgcauggcaauccugggcgcgcccgccugggacuucggguccaucggcgguguguucacgagcgugggcaagcucguccaucagaucuucgguacagccuauggggugcuauucuccggcguuagcuggacaaugaagaucgggaucggcguccuguugacauggcuggggcugaauucccgcagcacgucguuaagcaugaccugcaucgccguagggcuuguuaccuuguacuugggcgucauggugcaagccgauuccgggugcgugauuaacuggaagggucgggagcucaagugcggguccggcauuuucgucacuaacgagguacauacguggaccgagcaguacaaauuccaagcggacucccccaagcgccuguccgccgcuaucggcaaggccugggaggaggguguuugcggcauccgaagcgccacccgcuuggagaacaucauguggaaacagaucuccaacgaacugaaccacauccugcuagagaaugacaugaaguucaccgugguggugggggaugucgcggguauccuggcacaggggaagaagaugauccggccgcaaccgauggagcacaaguacagcuggaaguccuggggcaaggccaagaucauaggcgccgacgugcagaacaccacguucaucauugaugggcccaacacccccgaaugcccagacgaccagcgagcguggaauaucugggagguugaagacuacggcuucgggaucuuuaccaccaacaucuggcugaagcuccgggacagcuacacgcagguuugcgaccaccgccucauguccgcagccauuaaagacagcaaggccgugcacgccgacaugggcuacuggaucgaguccgagaagaaugagacauggaagcuggcgcgggccucguucaucgaagugaagaccugcaucugggccaagucacacacccucuggagcaauggggugcuggaguccgagaugauuauaccaaagaucuacgggggccccaucagccaacacaacuacagacccggcuacuucacgcagaccgcaggcccguggcacuuagguaagcuagagcuggacuucgaccugugcgaggggaccaccguuguggucgacgagcacugcggcaaccgcgggccgucgcuccgcacgaccacggugaccggaaagaucauccacgaguggugcugucguucgugcacgcuuccgccccugcgauuccgaggggaagacgggugcugguacggaauggagauauccccggugaaggagaaggaagagaaccuggucaagagcauggugagcgccggcucuggcgagguggacagcuuuucccuggggcugcucugcaucagcaucaugaucgaggaagucaugcgcucccgguggagccgcaagaugcugaugaccggcacgcuggcgguuuucuuucugcugauaguggggcagcugcccuggaacgaccugauccgguugugcauuauggucggcgccaccgccucagcccgcauggggaugggcacgaccagccuggccuuaauggcgaccuucaagaugcgccccauguucgccgugggccugcuguuucgccgccugaccuccagagaggugcugcugcucacgaucgggcugagccuggucgccagcguggaacuccccaacagccuggaggagcugggcgacgggcucgcaauggggaucaugauccuuaagcugcucaccgauuuccagucccaccagcugugggcgacccugcucagccugaccuuuauaaagacaaccuucucccuacacuacgcguggaagaccauggccauggggcucagcgucgugucccuguucccgcugugccucagcaccacgucccagaagaccaccuggcugccggugcugcucgggagccugggcugcaagccguugaccauguuucucaucgccgagaacaagauaugggggcguaggagcuggcccuugaacgagggcaucauggcuguagggaucguguccauucugcucagcucccucuuaaagaacgauguuccgcucgcgggaccccugauagccggcgggaugcugauagccugcuacgucaucagcggcuccagcgccgaccucucccuggagaaagccgcggaggugagcugggaggaggaggccgaacacuccggugcaagccacaacauccugguggaggugcaagacgacggcacgaugaagaucaaggacgaggagcgggacgacacccucaccauccugcucaaagccacgcuccuggccguuuccgggguguacccccugucaauccccgccacccucuucgugugguacuucuggcagaagaaaaagcagcgguccggcgugcugugggacacaccguccccgcccgagguggaacgugccguccuggacgacgggaucuacaggaucaugcagcgcgggcugcucgggcggucccaagugggggugggcgucuuccaggagaacguguuccacaccauguggcacgugacccgcggggccguccuaauguaucagggaaagcgguuagagcccagcugggccuccgugaagaaggaccuuauuagcuacggcggcggcuggaggcugcaggggagcuggaacaccggugaggaggugcaggucaucgcuguugaaccgggcaagaacccaaagaauguccagacggcgcccggcaccuucaagacccccgagggagaggucggggccaucgcccuggacuuuaagccggggaccagcgggagccccaucgugaaucgggagggcaagaucgugggccucuacgggaacggagucgugacgaccucugggaccuacgugucagccauagcgcaggccaaggccucccaggagggcccccugccggagauugaggacgaggucuuucgcaagcggaaccugaccaucauggaucuccacccugggagcggcaagacacgucgguaccuccccgccaucgugcgcgaggccaucaagcggaagcuucgcacccuuaucuuggcgcccacccgcguggucgccagcgagauggccgaggcccugaagggcaugccgauccgguaccagacaacggccgucaagucggagcacacugggaaggagaucguggaccucaugugccacgcgaccuucaccaugcgccugcugucccccguccgggugccaaacuacaauaugaucauuauggacgaggcgcacuuuaccgaucccagcucgauagcugccagaggcuacaucagcacccggguggggaugggcgaggccgcggcgaucuucaugacagccaccccccccggguccguugaggccuuuccacagagcaacgcggugauccaggacgaagagcgcgacauccccgagagauccuggaauucuggcuacgaguggaucacggacuucccggguaagacugucugguucguccccuccaucaaguccgggaacgacaucgccaacugucuccgcaaaaacggcaagcgcgugauccagcugucccgcaagaccuucgacaccgaguaccagaagacuaagaauaaugacugggacuacguggucaccaccgauaucagcgagaugggggccaacuuucgggcagaccgcgugaucgacccucggcgcugccugaagcccgugauccuuaaggacgguccggagcgggucauccuugccgggcccaugcccgugaccguagcguccgccgcccagaggcgaggccgcaucggccggaaucacaacaaggagggggaccaauacaucuacaugggccagccgcugaacaacgacgaggaccacgcacauuggacugaggcgaagaugcuacuggacaacaucaacacccccgaggggauaauacccgcgcuguucgagcccgagcgcgagaaguccgccgccaucgacggcgaauaccggcuccguggagaggcccgcaagaccuuuguggaguugaugcgccgcggcgaccugcccgugugguugagcuacaaagucgcuuccgaaggauuccaguacucagaccggcgcuggugcuucgacggugagcggaacaaccaggugcuggaggagaauauggauguggaaaucuggaccaaggagggcgagcgcaagaaacuacggccuagguggcuugacgcccggacguacuccgacccccuggcccugcgcgaguucaaagaauucgccgccggccggcgcagcguauccggcgaccugauccuggagaucggcaaacugccccagcacuuaacccagcgggcacaaaacgcccuagacaaucugguaauguuacauaacucagagcaaggaggccgagcauaccggcacgccauggaggagcugcccgacaccaucgaaacccugaugcuucuggcccugauugcugugcucaccggcggugucacccuuuucuuccuguccgggaggggucucgggaagaccagcaucggccugcugugcguuauggccuccagcguuuuacuguggauggccuccgucgagccucacuggaucgccgcgagcauuauccuggaauucuuccucauggugcugcugaucccggagcccgaccggcaacgcaccccgcaagacaaccaguuggcguacguggucaucggguuacuguucaugaucuuaaccguggccgccaacgaaaugggucugcucgaaacgaccaaaaaagaccugggcaucggucacgucgccgucgagaaccaccaccacgccgcgaugcucgacguggaccuccaccccgccagcgccuggacccucuacgccguggccacgacgaucaucacccccaugaugcggcacaccaucgagaacaccacggcgaauaucagccugaccgccaucgccaaccaggcggcgaucuugaugggucucgacaagggcuggcccauuuccaagauggauaucggggucccgcuucuggcccucggaugcuacagccaggugaacccccugacccugaccgccgccgugcucaugcuggucgcccacuacgcaaucauugggcccggcuugcaggccaaagcgacgcgcgaggcccaaaagagaaccgcagcgggcaucaugaagaacccgaccguggacggcaucguagcaauagaccucgauccggucguguaugacgccaaauucgagaagcagcugggccagaucaugcugcucauccugugcaccagucagaucuugcucaugcggacgacgugggcccugugcgagucaauaacccuggccaccgggccccucacaacccugugggagggcucuccugggaaguucuggaacaccacgaucgcagugagcauggccaacaucuuccgcggcucauaccuggcgggugccgggcucgcguucucccugaugaagucauuagguggcggccgucgcgggacaggggcccagggcgaaacccucggugagaaguggaagcggcagcugaaucagcuguccaagagcgaguucaacaccuacaagcgcagcgggaucauggagguugaucgaagcgaggcuaaagagggccucaagcgcggcgagaccaccaagcacgccguguccagaggcaccgccaagcugcgcugguucguggagcggaaccuggucaagcccgaggguaagguuauagaccugggcugcggacgcggcggguggucuuacuacugcgcgggccucaagaaggucaccgaggucaaggguuauacgaagggcgggccggggcacgaggagcccauccccauggccacguacggcuggaaucuggugaaguuacacucugggaaagacguguucuucauaccacccgagaagugcgacacccuuuuaugcgacaucggcgagagcucccccaaccccaccaucgaggaggggcggacccugcgcguucucaagaugguggagccauggcugcgggguaaccaguucuguauuaagauucugaacccauacaugccaucaguggucgaaacucucgagcagaugcagcgcaagcauggcggcaugcuggugcggaacccucuaucucgcaacucaacccaugagauguauugggucucuugcggcaccgggaacauugucagcgccgugaacaugaccucacggaugcuccugaaccgcuucaccauggcccaccgcaagcccacuuacgagcgggacguggaccugggcgccggcacccgccacgucgcgguagagccggagguggccaaccucgacaucauugggcagcggaucgagaacaucaagcaugagcacaagagcacauggcauuaugaugaagacaacccuuacaagaccugggccuaccacgguuccuacgagguuaagccguccggguccgcauccagcauggugaacggaguggugaagcugcuuaccaagcccugggacgugaucccgauggucacgcagaucgccaugacugacaccacgcccuuugggcagcagagagucuuuaaggagaagguugacacacggacccccaaggcgaagcgcggcaccgcccagauaauggaggugacagccaaguggcucuggggguuccugucccggaacaagaagccgcguaucugcacccgggaggaauucacacgcaaggugcggagcaacgccgccaucggggccguguuuguggaugagaaccaguggaacucagccaaggaggcgguggaggacgaaagguucugggaccuggugcaccgggagcgcgagcuccacaagcagggcaagugugcgaccugcgucuacaacaugauggggaagcgggagaaaaagcugggggaguuugggaaagcgaagggcucccgcgcgaucugguacauguggcugggcgcccgguuccucgaguuugaggcccugggcuucaugaacgaagaccacugguucucacgcgagaacagccuguccggcguugagggggagggacuccacaagcugggauacauccugcgggacaucagcaagauccccggcggcaauauguacgccgacgacacggcggggugggacacccgcauuaccgaggaugaccuccagaaugaagcgcggaucacugacaucauggagcccgagcaugccuugcuggccaagucaaucuucaaguugacguaucagaauaaggugguucgcgugcagcgucccgccaagaacgggaccgugauggacgucaucagccggcgcgaccaacggggguccggccagguagguaccuacgggcugaacaccuucacgaacauggaggcccagcugauccgccagauggagagcgagggcauuuuuuccccgucggagcucgagaccccaaaccuggccgagcgggugcuggacuggcucgagaaguauggggucgagcgccugaagcggauggccaucuccggcgacgacuguguggugaagcccaucgacgauagguucgccaccgcucuaaccgcucucaacgauaugggaaagguucguaaggacaucccacagugggagccgagcaaaggcuggaacgacuggcagcagguacccuucugcagccaccauuuccaccagcugauuaugaaggacggccgcgagaucgugguacccugccggaaccaggacgaguuaguaggacgagcccgggugucccagggcgccggguggagccuucgagagacggccugccugggaaagagcuacgcgcagauguggcaguugauguacuuccacaggcgcgaccugcggcuggcugccaacgcuaucugcagugccguccccguggacuggaucccgaccucccgcacuaccuggagcauccacgcccaccaccaguggaugaccaccgaggacaugcuguccguguggaaccgggucuggaucgaggaaaaccccuggauggaggacaagacgcacaucagcuccuggggcgacgugcccuaucucggcaagcgggaggaccaguggugcggcagcuugaucgggcucaccgcccgggccacuugggcgaccaacauacagguggccaucaaucagguccggagacuuaucggcaacgagaacuaccucgauuacaugacauccaugaagcgcuucaaaaacgagagcgaccccgagggagcgcugugguga

SEQ ID NO: 24497 - RNA, 9879 nt, Artificial Sequence
  derived and/or modified CDS sequence (opt11) from DENV-1__GU131793__SS-prME
ucugugaccaugcugcucaugcugaugccuacugcccuggccuuccaccucacuacccgcggcggugaaccccacaugaucgucaguaaacaggagaggggcaagagccugcuauucaaaacauccgccgggguuaacaugugcacccucaucgccauggaccugggggagcugugugaggacaccaugacauauaagugcccucgaaucaccgagacagaacccgacgacguggauugcuggugcaacgccaccgacaccugggugaccuaugggaccuguucgcagaccggugagcaccggcgcgacaagcgguccgucgcucucgcgccgcacgugggccuggggcucgaaacucggaccgagacguggaugagcucggagggcgccuggaaacaaauccagcggguugagacuugggcccuccgacaccccggguuuaccgugauugcccuuuuccuggcccacgcgaucggcacuagcaccacgcagaaggggaucaucuucauucuuuugaugcuggugacccccucaauggcgaugcggugcgucggcauuggcagccgagacuucguggaggggcucuccggcgcgaccuggguugacguaguacuggagcacgggaguugcgugaccacgauggccaaggacaagcccacccucgacaucgaguuacuuaagaccgaggucaccaaucccgccguacuucggaaacucugcauagaggcaaagaucaguaacacgacaaccgacagccgcugcccaacccaaggcgaggccacgcugguagaggaacaggacgccaacuucguaugucggcgcacguuuguggaccgggggugggggaacgguugcggccuguucggcaagggaucccucaucacgugcgcuaaguucaagugcguaaccaagcuggagggcaagaucguccaguacgagaaccugaaguauagcgugaucgugacgguccacaccggcgaccagcaccaggucgggaacgaguccaccgaacacggcacgaccgcuacgaucacgccccaggcgcccacgacugagauccagcucacagacuauggagcccugacgcuggauuguagccccaggacgggccucgacuucaacgagaugguucugcugaccaugaaggagaagaguuggcucgugcacaagcagugguuccuggacuuaccucuccccuggacaaguggcgcgagcacuucccaagaaacuuggaaccgacaggaccugcugguaacauucaagacggcacaugccaagaagcaggaggucgucguccuaggcucgcaggagggcgcgaugcacaccgcccugaccggugcaaccgagauccagaccagcggcaccaccaccaucuucgccggucaccugaagugccgccucaagauggacaaguuaacgcugcgcggcaugagcuacguaaugugcaccgggaguuucaagcuugagaaggagguggccgagacccagcauggcacuguguugguccagaucaaguacgaaggcacggacgcgcccugcaaaaucccauucucgacucaggacgagaagggagugacccagaaugggaggcuaaucaccgcgaacccgaucguaacggacaaggagaagcccguuaacauagaggccgagccgcccuuuggagaguccuacaucguaaucggcgccggagaaaaggcucugaagcuaaguugguucaagaaagggucgucuaucggcaagauguuugaggccaccgcucgcggggcccgccgcauggccauucugggugauacggcgugggacuucggaagcaucggcggcguguucacgucaguugggaagcucguacaccaaaucuuuggaacggcauacgggguguuguucuccggcgugucauggaccaugaagaucggaaucggcguguuacugacaugguuaggccugaacucccggagcaccucccuuucuaugacgugcaucgcggucgggcucgucacccuguaccuuggcgugaugguacaagccgacucgggcugcgucauaaacuggaagggccgggaacucaagugugggucaggcaucuucguuaccaaugagguacacaccuggaccgaacaguacaaauuccaagcggacagcccgaagcggcugucugcggccaucggcaaagcgugggaggaaggggugugcggcauccggucugcgacccggcucgagaacauuauguggaagcaaaucuccaacgagcucaaccacauccugcuggagaacgacaugaaguucaccgugguggucggggacguggcugggauacucgcacagggcaagaagaugauccgcccccaacccauggaguacaaguauagcuggaaauccuggggcaaggccaagaucaucggcgccgauguucaaaacacgacauuuauuauagacggacccaauacgccggaaugcccggacgaucagcgggccuggaauaucugggaggucgaagacuacggcuucgggauauucaccacuaacaucuggcugaagcugcgugacaguuacacccaggugugcgaucaccgccucauguccgcggcuauuaaggacaguaaggccgugcaugccgacaugggcuacuggaucgaauccgagaaaaacgagacguggaagcuggccagggcgagcuucauagaggucaagaccugcaucuggcccaagucccacacccucuggaguaacggcgugcucgaguccgagaugauaauccccaagaucuaugggggcccuaucagccagcacaacuaccggcccggguacuucacgcagacggcuggccccuggcaccuggggaaacuggaacucgacuuugaccugugugagggcaccaccguggucguggaugagcacugcggcaaccgugguccgucacugcggacaacgaccgugacaggcaagauaauucacgaguggugcugccgcagcugcacguuacccccccuccgauuucgcggggaggacggcugcugguacggcauggaaauaaggcccgucaaggagaaagaggaaaacuuggugaaguccauggugagcgcggguucaggcgaggucgacuccuucagccucgggcuauuguguaucuccauuaugaucgaggaggugaugcgcucccgauggagccgcaagaugcucaugacggggacccuggcaguguucuucuuacucauaauggggcagcugaccuggaaugaccugaucagacucugcaucauggugggcgccaacgcaagcgaccggaugggcaugggcaccacguaccuagcccuuauggccacguucaagaugcgaccgauguucgccguaggacuccuguuccgacgccugacgucccgggaggugcuccuguuaacuaucgggcuaagccuuguggcguccguggagcugcccaacagcuuagaggagcuuggagacggguuagcaaugggcaucaugauccucaaauuacugaccgauuuccagagucaccaacucugggccacucugcucucccugaccuucaucaagacgaccuucagccugcacugcgcguggaagacuauggccaugguccucagcaucgugucccucuucccacugugccugagcaccacgucccaaaagacgaccuggcuccccgugcugcuaggcucacucggguguaagccgcugaccauguuucugaucgcggagaauaagaucuggggucgccggagcuggccacuaaacgaggggauuauggcugucggcauugugagcauccugcuguccucucuccuuaagaacgaugugccccuggccgggccccucaucgcaggcggcaugcugaucgccuguuaugucaucagcggguccagcgcagaccugucgcucgagaaagccgcugaggugucgugggaggaagaggcugagcauuccggcgccagccacaacauccugguagaaguccaggaugacggcacuaugaaaaucaaagacgaggaacgagaugacacccugacgauccuccucaaagcgacccugcucgcugugucuggcguuuacccuuugucuauccccgccacccuguucgucugguauuuuuggcaaaaaaaaaagcagcggaguggggugcuaugggauacccccagcccgcccgagguugagagggccguacuggaugacggcaucuaccggaucaugcagcgcggccugcucggccggucccaggugggcgugggggucuuccaggagaacguguuucauacuauguggcacgugacccgcggcgcaguucucauguaccaggggaagcgguuggagccaagcugggccuccguuaagaaggaccugauuuccuauggaggcggguggcgccuccagggcuccuggaacaccggggaggagguacaggucaucgcuguagagcccggcaagaacccgaagaacgugcagacugccccggggacguucaagacccccgagggcgaggucggugccauagcccuggacuucaagcccggaaccuccggaucccccaucgugaaccgggaggggaagaucguggggcuuuacggaaacggggucgucaccacauccggcacauacgugagcgccauagcacaggccaaggcgagucaggaggguccgcuccccgaaauugaagaugaggucuuucgcaagaggaaucuaacaaucauggaccugcaucccggauccgguaagacccgccgguaucucccugcgauaguccgcgaagcuaucaagcgcaaacugcggacgcugauccucgcccccaccaggguggucgccuccgaaauggcggaggcucugaagggcaugccuauccgguaccagaccaccgccgucaagagcgagcacacagguaaggagauaguugaccugaugugccacgcuaccuucaccaugcggcuuuuaagccccgugcgugucccgaacuacaauaugauuaucauggaugaggcccacuucaccgacccaagcuccauugcggcgcgcggguacaucagcacgcgggugggcaugggggaggccgccgccaucuucaugaccgccaccccgcccggcuccgucgaggcguucccgcagucaaacgcugugauccaggacgaggagagggacauacccgaacggucguggaacagcggguacgaguggauuaccgacuucccgggcaagaccgugugguucguccccuccauaaagagcggcaacgacaucgccaacugucuucgcaagaacgggaagcgcgugauccaacucucccgcaaaaccuuugacaccgaguaccagaagacaaagaacaaugacugggacuacgucguuacgaccgacauuucagagaugggugccaacuuccgggccgaccgcgucaucgacccgcggaggugccugaagcccgugauccugaaggauggucccgagcgggucauacucgccggaccgaugcccgugaccgucgccuccgccgcucaacgucgggggcggauaggccggaaucauaacaaggagggcgaccaauacauuuacauggggcaaccacugaacaacgacgaggaccaugcacacuggacagaggccaagaugcuccuggacaacaucaacacgcccgaggggaucauuccggcccuguucgagccggagcgcgagaaguccgcagccauagauggggaguaccgcuuacggggcgaggcacgcaagaccuuuguggaacucaugcggcguggcgaucugcccguauggcugucauacaaggucgccagcgagggcuuucaguacucagaccggaggugguguuucgacggcgagcggaacaaucaggugcuagaagaaaauauggaugucgaaaucuggacuaaggagggggagcgcaagaagcugcggccccggugguuagacgcaagaaccuauuccgacccgcucgcccugcgagaauucaaggaguuugccgccggccggcgaucuguauccggggaccugauccucgagaucggcaagcugccgcaacaucugacgcagcgggcccagaaugcacucgacaaccuaguuaugcugcacaacagcgagcagggggggcgcgccuaucggcacgcgauggaggaacuuccugacacaaucgaaaccuugauguuacucgcccuaaucgccgugcugaccggcggggucacccuguucuuucuguccggccgcggcuuaggcaaaacgagcaucggccuacuguguguuauggcgucgucagugcuguuauggauggccuccguugagccccauuggaucgcggcuagcaucauccuggaguucuuccuaaugguucugcugaucccggagccggacaagcagcggacgccccaggacaaccagcuggcguacguggucauagggcuacuauucaugaucuuaaccguagccgccaacgaaaugggccuucuggagaccacgaaaaaggacuuagggaucggccacguggcgguugagaaucaccaccacgccgcuaugcucgacguggaccugcaccccgccucugccuggacccuguacgcuguggccacuacaauuaucacaccuaugaugcgccacacgauugagaacacgaccgccaauauuagccugacggcaaucgccaaccaggcggcgauccugauggggcuagacaaaggcuggccaauauccaagauggacaucggcguuccgcuucuggcccuggggugcuauagccaggugaacccgcuaacucugaccgccgcggugcucauguuaguggcccauuacgccauuaucggcccggguuuacaggccaaagccacccgugaggcccagaagcggacggccgccggcaucaugaagaaccccaccguggauggaaucguggcaauagacuuagauccugucgucuacgacgccaaguucgagaagcagcucggucagauuaugcugcugauccucugcacgucacaaauucuucugaugcggaccacgugggcccucugugagucaaucacucuggccacaggacccuugaccacguugugggagggguccccgggcaaguucuggaacacaacuaucgccgugagcauggcaaacaucuuucggggguccuacuuggcaggcgcgggccuggcuuucucguugaugaagagucuggggggcggccggcgcgguacaggggcccagggagaaacucuuggcgagaaguggaagcgccaacucaaccagcuauccaagagcgaguuuaauaccuauaagcggaguggcauaauggagguugauaggagcgaggccaaggagggacugaagcgcggggaaaccacaaagcacgcgguuagucgcggcacggccaagcuccggugguucgucgagcgcaaccuggucaagccugaggggaaagugaucgaccugggcugcgggcgcggcggguggagcuacuauugcgccggccugaaaaaggugacagaagucaagggguacacuaagggcggccccggccacgaagagccgaucccaauggccaccuauggguggaaccuggugaaacuacacagcggcaaggacguuuucuucaucccgcccgagaaaugugauacgcuacugugugacaucggcgagagcagucccaaccccaccauagaggagggcagaacccugcggguguuaaagaugguggagcccugguuacgcgggaaccaauucugcaucaagauccugaauccuuauaugcccagcguagucgagacucuggagcagaugcagcggaagcacggcggaaugcucguucgcaacccgcugucgcguaacagcacccaugagauguauuggguauccugcgggacgggcaacaucgucagcgccgugaauaugaccagucgcaugcugcucaaucgcuucacgauggcgcaucggaagccgaccuaugagcgugacguggaucugggugccggcacgcggcacgucgccguggagcccgagguagccaacuuagacaucauaggccaacgcauagagaacaucaagcacgagcauaagagcaccuggcauuacgacgaggacaaccccuacaagaccugggccuaucacggcuccuacgaggugaaaccgagcggaagcgcgucaucuauggugaacgggguagucaagcuccuaaccaagcccugggacguuauccccauggucacgcaaaucgccaugaccgacaccacaccguuuggccagcagcggguguucaaggagaagguugauacuaggaccccaaaagccaaacggggcacugcgcagauuauggaggucacagcgaaguggcucugggguuuucucucacgcaacaagaagccacgcauuugcacacgcgaggaauuuacccgcaaggugcguuccaacgcugcaauuggggcgguguucgucgacgagaaccaguggaacuccgccaaggaggcgguagaggacgagcgguucugggaccucguacaccgcgagagagagcugcauaagcaggggaagugcgcaaccugcgucuacaacaugaugggcaagcgcgagaaaaagcuaggggaguucggcaaagccaagggcagcagagccauaugguacauguggcugggcgcccgcuuccuggaguuugaagcccucggcuuuaugaacgaggaccacugguucucccgggagaacagccuguccggcguggaaggcgaggggcugcauaagcucggcuacauuuuaagagacaucagcaagauaccugggggcaacauguacgcggacgacacugcaggaugggacacgcgaaucacugaggacgaccugcagaacgaggcacguaucacugacaucauggagcccgaacaugcccuccuugcaaagucgaucuuuaagcuaaccuaucagaacaagguuguccgcgugcagcggcccgcuaagaacgggaccgugauggacgugaucagcagacgggaccagcgcggcucgggccaagugggcaccuacggccucaacaccuucacgaacauggaggcccaauuaauccgccagauggagagcgaggggaucuucuccccuucugagcuugagacgcccaaucucgccgagcgcgugcuggacuggcuggagaaguacggggucgagcgacuuaagcgcauggcuauauccggggaugacugcguggugaagccgaucgacgaccgguucgcaaccgcccugaccgcucugaaugauaugggcaaggugcgcaaggauaucccccagugggagcccagcaagggguggaacgacuggcagcagguccccuucugcucccaccacuuccaucaacugaucaugaaggacggucgggagaucguggucccgugccgcaaccaggacgaacuggugggcagagcccgaguaucgcagggagccggcuggagccuccgggagaccgcgugcuuagguaaguccuacgcccaaauguggcaacugauguacuuccaccgccgggaccugaggcucgccgccaacgcgaucuguucugcgguccccguggauuggaucccuacgucaaggaccacguggagcauccacgcccaccaccaguggaugaccacggaagauaugcuguccguguggaaccgcgucuggaucgaggagaaccccuggauggaggacaagacccacaucucuuccuggggcgacgugccguaccuugggaagcgggaagaucaauggugcggcagccucaucggccuaaccgcccgggccaccugggcgacgaacauacagguggcgauaaaccaggucagacgauuaauagggaacgagaacuaucucgacuauaugacuucaaugaagagguucaagaacgaaagcgacccagagggugcucugugguag

SEQ ID NO: 24498 - RNA, 9879 nt, Artificial Sequence
  derived and/or modified CDS sequence (opt11) from DENV-1__GU131794__SS-prME
agcguuaccaugcugcugaugcugaugccuaccgccuuggccuuccaccucacgacccgcggcggggaaccccacaugaucgugagcaagcaggaacgggggaagucacugcuguuuaagaccagcgcaggggugaacaugugcacccucauagccauggaccugggcgaguucugugaagacacaaugaccuacaagugccccaggauuaccgaggccgagccagacgauguggacugcuggugcaacgccacugacacgugggucaccuacggaaccugcagucaaacuggcgagcaccggcgcgacaagagguccguggcccuggcaccacacguaggacucgggcuggagacgagaaccgagaccuggaugucuuccgagggcgccuggaagcaaauccagcggguugaaaccugggcccugcgccacccgggguucacggugaucgcccucuucuuggcccacgccauaggcaccagcaucacgcagaaggggaucauuuucauauugcucaugcuggugacccccaguauggccaugcgauguguaggcauaggcagccgcgacuuuguugaggggcuauccggcgccacuuggguggacgucgugcucgagcacgggagcugcgugaccaccauggccaaggauaagcccacccuggacaucgaguugcucaagacggaggucacgaaccccgcgguuuuacggaagcugugcaucgaggccaagaucuccaauaccaccacugacagccgcuguccuacccagggcgaggccacacucguggaggagcaggacgccaacuucgucugccggagaaccuucguggaccgggggugggggaacggcugcgguuuauuuggcaaggggagccucaucacgugcgccaaguucaagugcgugacgaagcucgagggcaagaucguacaguacgagaaccuuaaguacagcgugauagugaccguccacacaggcgaccagcaccaggugggcaacgaguccacggaacauggcaccaccgcgaccaucacaccucaggcccccucaacggagauccagcugaccgacuacggggcccucacccuggacugcagcccccggacuggacuggacuuuaacgagaugguauugcucacgaugaaggaaaaguccuggcucguucacaagcagugguuccucgauuuaccgcuacccuggaccagcggggccuccaccagccaggaaaccuggaacagacaggaucuccugguuacguucaaaacggcccaugcgaagaagcaggaagucguagugcugggcucccaggaaggcgccaugcauacggcccucacuggggccacggagauccagaccagcggcaccaccacgaucuucgcggggcaccugaagugccgccugaaaauggacaagcucacgcugaaaggcauguccuacgucaugugcaccgguucguucaagcuggagaaggagguugcggagacccagcacggcacggugcuaguccagaucaaguacgagggcaccgacgcgcccugcaagauccccuucuccacccaggacgaaaaggggguaacccaaaacggacggcucauuacggccaauccgauugugaccgacaaggagaagcccgucaacaucgaggccgagccgcccuucggggaaagcuacaucgugauuggagcgggcgagaaggcccucaaacuguccugguucaaaaaggggagcuccaucggaaagauguucgaggccaccgccaggggagcccgucgcauggcgauacucggagacacggccugggacuucgggucaaucggcggcguguucacgaguguggggaagcuggugcaccagaucuucggcaccgccuauggggugcuguucagcggcgucuccuggaccaugaagaucgggauaggcguguuacugaccuggcugggccucaacucgcgcucgacgagccuguccaugaccugcaucgccgugggucuggucacgcucuaccugggcgugauggugcaggcagacagcgggugcgucaucaacuggaagggccgggagcuuaagugcgggagcggcaucuucgugaccaaugagguucacacguggaccgaacaguacaaguuccaggcggauuccccaaagcgccucagcgccgccaucggaaaggcuugggaggagggcgucugcggcauucgguccgccacccgacucgagaacaucauguggaagcagaucaguaacgagcugaaccacauccuccuggaaaaugacaugaagcugaccgugguggugggggacguggcggguauauuggcacaggggaagaagaugauccgaccacaacccauggaguacaaguacuccuggaaauccuggggaaaggccaagauaaucggcgcggacgugcagaacaccacguucaucauagaugguccgaacacaccggagugucccgacgaccagcgugcguggaauauaugggaagucgaggauuacggcuucgggaucuuuacaaccaacaucuggcugaagcugagggacuccuacacccaggugugcgaccaccgcuuaaugucagccgcgaucaaggacuccaaagccgugcacgccgacauggguuauuggaucgagagcgaaaagaaugagaccuggaagcuggcgcgugcauccuucaucgaggucaaaaccugcaucuggcccaagucgcauacucugugguccaacggggugcucgaaagcgagaugauaauccccaagaucuaugggggcccgauaucgcaacacaacuaucgccccggauauuucacgcagaccgccgguccguggcaccuggggaaacuugagcucgacuucgaccugugcgaaggcaccaccguggucguugaugagcacugcggcaacagggggccgagccuccgcacgaccacagugaccggcaagaucauccacgaguggugcugccgguccugcacucugccgccgcuccgauuuaagggagaagacgggugcugguacgggauggagauccggcccgucaaggagaaggaagagaaccuagucaagagcauggugucggccggcuccggcgaagucgauucguucuccuuagggcugcugugcaucagcauuaugaucgaggaggugaugcggucucgguggagccgaaagaugcucaugaccggcacguuagccguguucuuccugcucaucauggggcagcugaccuggaacgaccugauucggcucugcaucauggucggcgcgaacgccuccgacagaauggggaugggcacgacauaccuggcacugauggcgaccuucaagaugcgcccgauguuugcugugggguuguuguuccggcgccucaccagccgagaagugcuccugcucacgaucgggcuaucccuggucgcaagcguggagcugccaaacagccucgaggagcugggggacgggcuggccaugggcaucaugauccucaagcugcugaccgacuuccagagccaccagcucugggcuacccugcuguccuuaaccuucauccgcacgaccuucagccugcauuacgccuggaagacuauggcgaugguucuguccaucgugagccucuuccccuugugccuauccacgacgucccagaagacuaccuggcuccccgugcugcugggcucccucggguguaagccgcugaccauguuucugaucgcagagaacaagaucuggggucgcaagucguggccacucaacgaggggaucauggcggucggcaucgugagcauccugcuguccagccuccugaagaacgacguaccccuggccgguccccucauagccggaggcaugcugauagcgugcuacgucaucucggggagcuccgcagacuuaagccucgagaaggccgccgugguguccugggaagaggaggccgagcauagcggcgcaagccacaacauccuggucgaggugcaggacgacgggacgaugaagaucaaggacgaggagcgcgaugauacucugaccauacuucugaaggccacccugcucgcaguaucuggcguguacccgcugagcauacccgccacccuguucgugugguacuucuggcagaagaagaagcagcggucuggcgugcucugggacacacccagcccgcccgaagucgagcgugcagugcuugacgacgggaucuaccggauuaugcaacgcggucugcucgggagaagccaggugggggucggagucuuucaagagaacguuuuccacaccauguggcacguaacccgcggcgcagugcugauguaccaggggaaacggcuggagcccuccugggccagcgugaagaaggaccuaaucuccuacggcggcggguggcgccuucagggcagcuggaauaccggggaggagguccaggugaucgcuguggagcccggaaagaaccccaagaacguucagacugcccccgggacguuuaagaccuccgagggggaagucggcgccauagcgcuggauuucaagcccgggaccucaggaagccccaucgugaauagggaggggaaaaucgucggccuguacggcaacgguguggugacgaccucaggaaccuacgucagcgccaucgcccaagcuaaggcuucccaggaggggccacucccggagaucgaggacgaaguguuccgcaagcggaaccugacaaucauggaucugcaccccggcagcggaaagacacgccguuaccuccccgccaucgugcgcgaggccaucaagcggaaacuucgcacccuaauccucgcaccgacccgcgucguggccagugagauggcggaggcgcuuaaggggaugccuauccgguaccagacgacggccgucaagagcgagcacacgggcaaggagaucgucgaccugaugugccacgccaccuucaccaugcggcuccucuccccaguucgagugcccaacuacaauaugaucaucauggaugaggcccacuucacggaccccagcuccaucgcggcccgcgguuacaucagcaccagagucggcaugggggaggcggcagccauauuuaugaccgccacuccgcccggcuccguggaggccuucccccagagcaacgccgugauccaggacgaggagcgcgacauccccgagaggagcuggaacagcggguaugaguggaucacggacuuucccggcaagaccgugugguucgugcccuccauuaagagcggcaacgacaucgccaacugccugcgcaagaacgggaaacgggugauccagcuaucccgcaagaccuucgacaccgaguaccagaagacgaagaauaaugacugggauuacgucgugaccaccgacauaagugagaugggagcgaacuuccgggcugaccgcgucauugacccccggcggugccugaaaccagucauauugaaagacggaccggagcgggugauccucgcuggcccuaugccagucaccguggcguccgccgcgcaacggcgggggcgcaucggucggaaccacaauaaggagggcgaccaauacauuuacauggggcagccacugaacaacgaugaagaccacgcccauuggacggaggcaaagaugcugcucgacaacauuaauacccccgagggcaucauccccgcgcuguuugagcccgagcgcgagaaguccgccgcgauugacggugaguaccgccugcggggcgaggcccgcaagaccuucguagagcuuaugcggcgcggggaccugccggucuggcuuuccuacaaggucgccucggagggauuccaguauagcgaccggcgauggugcuucgacggcgagcggaauaaccaggugcuugaggagaacauggacgucgagaucuggaccaaggagggggagcgcaagaagcugagaccucgcuggcuggacgcccggacguacuccgacccucucgcccuacgcgaguucaaggaguuugcggccggccggcgcucaaucuccggggaccugauacucgaaauuggcaaacuuccccagcaccugacccagcgcgcucagaacgcccucgacaaccugguuaugcugcacaacagcgagcagggaggccgcgcauaccgucaugccauggaagaacuccccgacaccaucgagacacugaugcuccucgcccuuaucgccguacugacgggcggcguaacgcucuuuuuccuguccggccgcgggcugggcaaaacgagcauuggacuccuaugcgugauggccuccagcgugcugcucuggauggcguccgucgaaccccacuggaucgccgcauccaucauccuggaguucuuucugaugguuuuacuuauacccgagcccgaucggcagcggaccccgcaagacaaccagcuggcauacguggucaucgggcuccuguucaugauauuaaccguagccgcgaacgaaaugggccuccuggagacgaccaagaaggaccuggggauaggccacguggccgucgaaaaucaccaccacgcagccauguuagacguagaccugcaccccgccucggcuuggacccucuacgccguggcaacaacgaucaucaccccaaugaugcggcacaccauugagaacaccacggccaacauaagccuuaccgcgaucgccaaccaggccgccauacuaauggggcuggauaagggcuggcccaucuccaagauggacaucggcgucccccuccucgcccuggguugcuacagccaggugaacccccugacuuugaccgccgccguccugaugcucgucgcccacuacgccaucaucgggcccgggcugcaggccaaggcgacgcgcgaagcccagaagcgcacggcagcgggcauuaugaagaacccgacuguggacggcaucguagccaucgaucuggaccccguaguguaugacgcgaaguucgagaagcagcucggccaaaucaugcugcugauccucugcacgucccagaucuuacuuaugcggacgacgugggccuuaugcgaaagcauaacccuggccaccggcccccugacuacccucugggagggguccccggguaaguucuggaacacuaccaucgccgugucaauggccaacauuuuccgggggucuuaccuggcgggcgccggacucgccuucucccucaugaagucccuuggaggcgggcggcgggggacgggugcccaaggcgagacccugggcgagaaguggaaacgacagcugaaucagcuguccaaaagcgaguucaacaccuacaagcgcucugggaucauggaggucgaccggagcgaggcgaaggagggccugaagcgcggggagaccacgaagcaugccgugucgcggggcaccgccaagcugcguugguuuguggagcggaaccuggucaagcccgaggggaaggugauugaucugggcugcggccgcgggggcuggagcuacuacugugccgggcugaagaaggugacagaggucaagggcuacaccaagggcgggcccggucacgaggagccaauccccauggccacguacggguggaaccucgugaaacugcacuccggcaaagauguguuuuucauuccacccgagaagugcgacaccuugcucugcgacauaggggaaagcucccccaaccccacuaucgaagagggccggacccugcgcguacugaaaaugguggagccguggcuccgggggaaccaguucugcauaaagauccugaacccauacaugccgagcgugguugagacucuagagcagaugcagcgcaagcacggcggcaugcucgugcggaaccccuugucccgcaacaguacccacgagauguacuggguguccugcgguaccggcaauaucgucagcgccgugaacaugaccucccggaugcugcucaaccgcuucaccauggcccaucgaaagccgacguacgagcgagauguggacuuaggugccggcacccgccacgucgcgguggaaccugagguggcuaaucuggacaucaucggccagcggaucgagaauaucaagcacgagcauaagagcaccuggcacuacgacgaggacaaucccuacaaaaccugggcguaucacgggucguacgaagucaagcccagcggcagcgccuccagcauggugaacggggucgugaagcuccugacgaagccgugggacgugauccccauggucacccagaucgcaaugacagacaccacgcccuucggccagcagcguguauucaaggagaagguggacaccagaacgccaaaggcaaagcgcgguaccgcccagauuauggaggucacugccaaguggcuguggggguuccucucccggaacaagaagccgcgcaucugcacccgggaggaguucacccgcaaggugcggaguaacgccgccaucggugccguguucgucgacgagaaccaguggaacuccgcgaaggaggccguggaggacgaacgcuuuugggaucuggugcaccgggagcgcgagcugcacaagcaggggaagugcgcgacgugcgucuacaacaugaugggcaagcgggagaagaaacucggggaguucgguaaggccaaggggagccgcgccauaugguacauguggcugggcgcgcgguuccuggaguucgaggcccucggcuucaugaacgaggaucacugguucucccgcgagaacagccuguccgggguggagggcgaagggcuucauaagcugggcuacauucuucgggacaucagcaagauucccggagggaauauguacgccgacgacacagccggcugggauacucgcaucaccgaggacgaccuacagaacgaggccaagauuaccgacaucauggagcccgaacacgcucuccuggccaaguccauuuucaagcugacauaucagaacaagguggucagagugcagcguccggccaagaacgggaccgugauggacgucaucagcagacgggaccagcgcggcuccggccaggugggcaccuacgggcucaacaccuucacgaacauggaggcccagcugauccggcaaauggaaagcgaggggaucuucucccccagcgagcucgagaccccuaaccuagccggccgcguacuggacuggcuggagaagcacggagucgagagacucaagagaauggccaucaguggcgacgacugcgugguaaagcccaucgacgaccgauucgcuaccgcccucacugcccugaacgacaugggcaagguccgcaaggacaucccgcagugggagcccagcaaaggcuggaacgacuggcagcagguacccuucugcucgcaucacuuccaccaauuaaucaugaaggacggacgggagaucgugguccccugccgcaaccaggacgagcuugugggccgggcccgcguaucccagggcgcgggguggagccugcgggagacggccugcuuaggcaaauccuacgcccagauguggcagcugauguacuuccaccgucgggaccugcgccuggccgcgaacgccaucugcagcgccgucccgguggacugggugcccaccucccggacaaccuggagcauccaugcccaccaccaguggaugacgaccgaggauaugcuguccguauggaaccgaguguggaucgaggagaaccccuggauggaggacaaaacccacaucagcuccuggggcgaugugcccuaccugggcaagcgugaggaccaguggugcggcucacucaucgggcugaccgccagagcaacgugggccacuaauauccagguggccauuaaucaggugcgccggcugcucggcaacgagaacuaccucgauuacaugaccuccaugaagagauucaagaacgagucagacccggaaggugcccugugguga

SEQ ID NO: 24499 - RNA, 9879 nt, Artificial Sequence
  derived and/or modified CDS sequence (opt11) from DENV-1__GU131796__SS-prME
uccgugaccaugcugcugauguugaugcccaccgcccuggccuuccaccuaacgacccggggaggggagccacacaugaucgugagcaagcaggagcggggcaagagcuuacuuuucaagaccagcgcgggggugaacauguguacccucauagccauggaccugggggaguucugugaggauaccaugacguauaagugcccccgcaucaccgaggcugagcccgacgauguggacugcuggugcaaugccaccgacacgugggugaccuacgggaccugcagccagaccggcgagcaccggcgggacaagcgguccguggcccuggcgccccacgucggccucgggcuggagacgcguaccgaaacuuggaugagcuccgagggugcauggaagcaaauccagcgggucgagaccugggcccugcgccaccccggguucaccgugaucgcccucuuucuggcgcacgccaucggcaccagcaucacucagaaggggaucaucuuuauccuacucaugcuggugacccccuccauggccaugcggugcgucggcauuggcucccgugacuucguggaggggcuguccggugccacuuggguggacgucgugcucgagcaugggagcugcgugacuacaauggcaaaggacaaacccacccuggauauugagcugcucaagacggaggucaccgaccccgcggugcugcggaagcugugcguggaggccaaaaucuccaacacgaccacggacagccgcugcccgacccagggugaagcgacccuagucgaagagcaggacgccaacuucguuugccggcgcaccuucguggaccggggcugggggaacgggugcgggcuguucgguaaggggucccuaaugacgugcgccaaguucaagugcguaaccaaacucgagggcaagaucgugcaguaugagaaccugaaguauagcgugaucgucaccgugcacaccggcgaccagcaccagguuggaaacgaauccacggagcacggcaccaccgcgaccaucacgccccaggccccuagcacggagauacagcucaccgacuacggggcccucacucuggacugcucgcccaggacgggccuggacuuuaacgagaugguauuacugacgaugaaggagaaguccuggcuagugcacaagcagugguuucucgaccugccgcugcccuggaccagcggggcauccaccagccaggagaccuggaaccggaaagaccuccuggucaccuucaagaccgcccacgcgaagaagcaggagguggugguacugggcucccaggaaggagccaugcacacugcucuuaccggggccacugagauccagaccucuggcaccaccacgaucuucgcagggcaccugaagugccgccugaagauggacaagcuuacccugaagggcauguccuacgugaugugcaccgggagcuucaagcuggagaaagagguggcggagacacaacacgggacgguacuugugcagauaaaguacgagggcacagacgccccauguaagauccccuuuuccacccaggacgagaagggagugacccagaacggccggcugaucacugccaauccgaucgucacugacaaggagaagcccgugaacaucgaagccgagccgcccuucggcgaaagcuacaucgugaucggcgcgggggagaaggcccugaagcuguccugguucaagaaggggagcucuaucggcaaaauguucgaggccaccgcccgcggggcccggaggauggcgauccucggcgacaccgccugggacuucgggagcaucggcggcgucuuuacguccgugggcaagcuggugcaccagaucuucggcaccgccuacgggguccuguucagcgggguguccuggaccaugaagaucgguaucggcgugcuccugaccuggcugggccucaauucccgcuccacgagcuuauccaugaccugcaucgccgucgggcuggugacccucuaucuggggguuaugguccaagccgacagcgggugcgugaucaacuggaagggccgggagcugaagugcgggagcgggaucuucgugacaaacgaggugcacacguggaccgagcaguacaaauuccaggcggacuccccgaaacgacucucagccgccaucgguaaggccugggaagaggggguaugcggcauccgguccgcgacccgcuuagaaaacaucauguggaagcagaucagcaacgaacugaaccacauccuccuggaaaacgacaugaagcugaccguggucgugggggacguggccggaauccuugcccaagggaagaagaugaucagaccccagccuauggaguacaaguacuccuggaaguccuggggaaaggccaagaucaucggcgccgacguccagaacaccacguucaucaucgacggacccaacacaccggagugccccgacgaucagcgcgcauggaacauaugggagguggaggauuauggcuucgggaucuucacgaccaacauuuggcugaagcugcgggacuccuauacccaggugugcgaccaucgccugauguccgccgccauuaaggacagcaaagcgguccacgccgacaugggcuacuggaucgagagcgagaagaacgagaccuggaagcuggcgcgcgccagcuucaucgaggucaagaccugcaucuggcccaagagccacacccucuggaguaacggcguccucgagagcgagaugaucauccccaagauuuacgggggcccgaucucccagcacaacuaccgcccagguuacuucacgcagaccgccggccccuggcaccuggggaaacuggagcucgacuucgaccugugcgagggcaccacgguagugguggacgagcacuguggcaaccgggggccgagccugaggacgaccaccgucaccggcaagaucauccacgaauggugcugccggucgugcacccugccgccccuccgcuucaagggggaggacgguugcugguacgggauggaaauccggcccgugaaggagaaggaggagaaucuggucaaaagcaugguuagcgccggcuccggcgagguggacagcuucucccucggacugcugugcaucagcaucaugaucgaagaggugaugcggucccgguggagccgcaagaugcucaugaccggcacccuggccguauucuuucuguuaaucauggggcagcugaccuggaacgaccugauccggcucugcaucauggugggcgccaacgccuccgaccggauggggaugggcacgaccuaccuggcccugauggccaccuucaagaugcgcccgauguucgccgugggccucuuauuccggcgccuuaccagccgggagguccuccugcugacgaucgggcucucccugguggcgagcgucgagcugcccaacucucucgaggagcugggcgacggacucgccauggguaucaugauucucaagcugcugaccgacuuccagucgcaccagcucugggccacccugcugucccucacuuucaucaagacgaccagcagccugcacuacgccuggaagacgauggcgauggugcugagcauugugucccucuucccccucugcuugagcaccacgucccagaagaccacuuggcugccaguccugcuggguagccucgguugcaagccgcugaccauguucuugaucgccgagaacaagauuugggggcgcaagagcuggccccucaacgaggggaucauggccgugggcaucguguccauccugcugagcgcccuccugaagaacgacgucccccuggccgggccccucaucgcggguggcaugcugauagccugcuacgugaucuccgguagcuccgccgaccugucgcucgagaaggccgccgagguguccugggaggaggaggcggagcauagcggcgcuucccacaacaucuuaguggaggugcaggaugacgggacgaugaagaucaaggacgaagaacgggacgauacgcugacaauacuccugaaggccacccuguuagccgugucaggcgucuacccgcugaguaucccggcgacccuguucgugugguacuucuggcagaagaagaaacagcggagcggggugcucugggacacacccagcccgcccgaggucgagcgggcggugcuggacgacggcaucuaccgcaucaugcagcggggccugcuugggcgcagccaggugggugucggaguuuuccaggagaacguguuccacaccauguggcacgucacgcggggcgccgugcucauguaccaggguaagcgccuggagcccaguugggccagcgugaagaaggaccugaucaguuacggcggcggguggcggcuccagggcagcuggaacaccggggaggaaguccaggugaucgccguggagcccggcaagaaccccaagaacguccagacggccccggggaccuuuaaaaccucggagggggaggugggcgcuaucgcccuggacuucaagcccggaacgagcggcagcccgaucgugaaucgcgaagggaagauaguaggccuguacggcaaugggguggugacgaccuccggcacguacgucagcgccaucgcccaggcaaaggccucccaggaggggccccucccggaaaucgaagacgagguguuccggaagcgcaaccugaccaucauggaccugcaccccggcagcgggaagacgcggcgcuaccuucccgccaucgugcgagaggccaucaagagaaagcuucggacccugauccucgccccgacgcgcgucgucgccuccgaaauggccgaggcccugaaaggcaugccgauccgcuaccagaccacggccgucaagagcgagcacaccggcaaggagaucgucgaccugaugugccacgcuaccuucaccaugcgccuccuguccccggugcgcgugcccaacuacaacaugaucaucauggacgaggcacauuucacggacccgagcuccaucgccgcccggggguacaucagcacccgcgucgggaugggagaggccgccgccauauuuaugaccgccacgccgcccggcuccguggaggccuucccccagagcaacgccgugauucaggacgaggagcgggacauaccggagaggucguggaacucgggguacgaguggauaaccgacuuccccggcaagaccgugugguucguuccuuccaucaagagcggcaacgacaucgcgaacugccugcggaagaaugguaagcgcgugauccagcucucccggaagaccuucgacaccgaguaccaaaagacgaagaauaacgauugggacuacgucgucaccacugauaucagcgagaugggcgccaauuuucgcgccgaucgggugaucgaccccagacggugccugaagccggucauccugaaggacgggcccgagcgcgucauucucgccggucccaugcccgucaccguggccuccgcggcccagcggcgcggacgcauuggccgcaaccacaacaaggagggcgaccaguacaucuacauggggcagccgcugaacaacgacgaggaccacgcccauuggaccgaggccaagaugcugcuugacaacaucaacacccccgagggcaucauccccgcucuguucgagcccgagcgggaaaagucugcggccaucgacggggaguaccgccugcgcggagaagcccggaagaccuucguggagcucaugcgccgcggggaccugccggucuggcuuagcuacaagguggccagcgagggguuccaguauuccgaucgccggugguguuucgacggcgagcgcaacaaccagguucucgaggaaaacauggacgucgagaucuggaccaaagagggggagaggaagaagcugcgcccccggugguuagaugcccgcaccuacuccgacccccuggcgcugcgggaguucaaggaguucgccgcagggcgccgguccguguccggggaccugaucuuagagaucggcaaacugccccagcaccugacccagcgcgcccagaacgcgcucgacaaccuggugaugcugcacaacagcgagcagggcgggcgggccuaccgacacgccauggaggagcucccugacaccaucgaaacccugaugcugcucgcccuaaucgccguccuaacgggcggggugacccucuucuuucuguccggccgggggcugggcaagaccucuaucggccuucugugugugauggcguccuccguccugcucuggauggccuccguagagccgcacuggauugccgccuccaucauccuugaauucuuccugauggugcuccugauucccgaacccgaccgccagcguacuccgcaggacaaccaacuggccuacgucguuaucgggcuccuguucaugauccugaccgucgcggccaacgagaugggccucuuagagacgacgaagaaggaccuggggauaggccacgucgccguugagaaucaucaccacgccgccaugcucgacguggaucugcaccccgcguccgccuggacgcuguaugccgucgccaccacgaucauaaccccgaugaugcgccacaccaucgagaacaccaccgccaacaucagccucaccgccaucgccaaccaagccgcaauccugauggggcuggacaagggcuggccgaucuccaagauggacaucggcgugccccuccuggcgcugggaugcuacagucaggugaacccccucacccugaccgcugccguccugaugcucguggcccacuacgccaucaucggccccggguuacaggccaaggccacccgcgaggcccagaagcgaaccgccgccggcaucaugaagaacccgaccguggacgggauugucgcaaucgaccuggaucccguggucuaugacgccaaauucgagaaacagcucggucagaucaugcugcuaauccucugcaccucccagauccugcugaugcgcaccaccugggcccucugugagagcauaacccuggccaccggcccccugacaacccucugggaggggucccccggcaaguuuuggaacaccaccaucgcggucagcauggccaacauuuuccgggggagcuaccuggcaggcgccggacuggccuucucuuuaaugaagagucucgggggcggacgucgggggacuggggcucagggcgagacccugggcgaaaaguggaagcgccagcucaaccagcuguccaaguccgaguucaacaccuacaagcgguccgggaucauggagguggaccgcagcgaagccaaggagggccugaagcgcggggagacaacgaaacaugccgugagccgcgggaccgcuaagcuccggugguucgucgagcgcaaccuggugaaaccugaggggaaggugaucgaccugggcugcggccgcggcggguggagcuacuacugugcagggcugaagaaggucaccgaggugaagggguacaccaagggcggccccggccaugaggagcccaucccaauggcaacguacggcuggaaccucgugaagcugcacuccggcaaggacguguucuucaucccgcccgagaagugcgacaccuuauugugcgacaucggggagagcucccccaaccccaccauugaagagggccgcacacugagaguacugaagaugguggaaccguggcuccgggggaaccaguuuuguaucaagauccugaaccccuacaugcccagcgucguggagacccuggagcagaugcagcggaagcacggcggcaugcuagugcgcaacccccugucccggaacagcacccacgagauguauugggucuccugcggaaccggcaacaucguaagcgccgugaacaugaccucccgcaugcugcucaaccgguucaccauggcccaccgaaagccgacguacgagcgcgauguugaccugggggccggcacccggcacguggccguggagcccgaaguugcgaaucuggacaucaucggccagagaaucgagaacaucaagcacgaacacaagucgaccuggcacuacgacgaggacaaccccuauaagaccugggccuaccacggguccuacgaggugaagcccagcgggagcgccuccucaauggucaauggaguggugaaacuccugacgaaaccuugggacgucauucccauggugacccagaucgccaugaccgacaccacgcccuucgggcagcagaggguguucaaggagaaggucgacacacgcacccccaaagcaaagcgggggaccgcccagaucauggaggugacggccaaguggcugugggguuuccucucccgcaacaagaagccgcggaucuguacccgcgaggaauucacccggaaggugcgcagcaacgccgccaucggagcggucuucguggacgagaaucaguggaacuccgccaaggaggccguggaggacgagcgguucugggaccugguccaccgcgagcgggaacugcacaaacaggggaaaugcgcgaccuguguguauaacaugaugggcaaacgcgagaaaaagcucggcgaguucggcaaggccaaggggucccgagcgaucugguacauguggcugggcgcccgcuuucucgaguucgaggcccucggcuucaugaaugaagaccacugguuuucccgggagaacagucuguccgggguggagggcgaggggcugcacaagcucggcuacauccuccgcgacaucagcaagauucccgggggcaacauguacgccgacgacacggccggcugggacacccggaucaccgaggacgaucugcagaaugaggcgaagaucaccgacauuauggagccggagcacgcccuccuggccaaauccaucuucaagcugacuuaccaaaacaaggucgugcgcgugcagcggccggccaagaacgggaccgugauggacguaaucagccgccgcgaccaacggggcuccggccaggugggcacauacggccuaaacaccuucacgaacauggaggcucagcugauccgccagauggaguccgagggcaucuucagccccagcgagcuggagaccccaaaccucgcuggccggguccuagauuggcuggagaagcacgggguggagcgccucaagcggauggccauuaguggcgacgacuguguugucaagccaaucgacgaccgcuucgccgccgcccugaccgcgcuaaacgacauggguaaggugcggaaagacaucccccaaugggagcccagcaagggcuggaacgacuggcagcagguccccuucuguagccaucacuuccaccagcucaucaugaaggacggccgcgagaucguggugccaugcagaaaccaagacgaacuggucgggcgagcccgggucucacaaggcgcaggguggagccugcgcgagaccgccugccuuggcaaguccuacgcgcaaauguggcagcugauguacuuccaucggcgcgaccugcggcucgcugccaacgcgaucugcagcgccgugccgguggauuggguccccacgucccgcaccaccuggagcauccacgcgcaccaccaguggaugaccacugaggacaugcuguccguguggaaucggguuuggaucgaggagaaccccuggauggaggacaagacacacaucagcuccuggggcgacguccccuacuugggcaagcgcgaggaccaauggugcggcagccucaucgggcugaccgcccgggcgacgugggccacgaauauccagguggccaucaaccaggugcgccgccugaucggcaacgagaacuaccucgacuacaugaccuccaugaaacgguucaagaacgagucugacccggagggugcgcugugguga

SEQ ID NO: 24500 - RNA, 9879 nt, Artificial Sequence
  derived and/or modified CDS sequence (opt11) from DENV-1__GU131797__SS-prME
agcguuaccaugcugcucaugcugaugcccaccgcccuggcguuccaccucaccacccggggcggggaaccccacaugaucgugagcaagcaggaacggggcaagucacuacucuucaagacgagcgcuggggugaauaugugcacucucaucgccauggaccuuggcgagcugugcgaggacaccaugaccuacaaaugcccccguaucaccgagaccgaaccugacgacguggacugcuggugcaacgccacggacaccugggugaccuacggaacuuguucacagacgggcgagcaucggcgcgacaagcgaucuguggcccucgcaccccacgugggccuggguuuagagacccggacugagacuuggaugucaucggagggagccuggaagcagauacagcggguggagaccugggcccuccgccacccuggguucaccguaaucgcacuuuuucuggcccaugcgaucggcacuucaaucacccagaaagggaucaucuucauacuccuuaugcugguaacgccguccauggccaugcgguguguuggcaucggcucccgggacuuuguggaggggcucuccggugccaccuggguggacgucguucuggagcacgggagcugcgugaccaccauggccaaggacaagccgacgcuggacaucgagcuccucaagaccgaggucacgaaucccgccguccugcggaaacucuguaucgaggcgaagaucucaaauaccacuacagacucuaggugcccgacccagggcgaagccacuuugguagaggaacaggacgccaacuucgucugccgccgcacuuucguggaccggggcuggggcaacggcugcgggcuguucggcaaggggucucugauaacgugugccaaauuuaagugugugaccaagcuggaggggaagaucguccaguaugagaaccugaaguacagcgugaucgugacuguacacacaggagaucaacaccaaguggggaaugagucaaccgagcacgggaccaccgccacaaucacgccacaggcuccgaccaccgagauccagcucaccgacuacggggcccucacgcuagacugcagcccccgcaccggccucgacuucaacgagaugguccuauugacgaugaaggagaaguccuggcugguacacaagcagugguuccuggacuuaccccucccguggacaagcggggccagcacgagccaggagaccuggaaccgccaggaccugcuggugaccuucaagacugcccaugcgaagaagcaggaagucgucgugcucgguagccaggagggcgcgaugcacacggccuuaaccggggcgaccgaaauccagaccuccggaaccacaacgaucuucgccgggcaucugaaaugccgacucaagauggacaagcugacccugcgggggaugagcuacgucauguguacggguagcuuuaagcucgagaaggagguggccgagacacagcacggcaccgugcugguccagaucaaguacgaaggcacagacgcacccugcaagauacccuucagcacgcaggacgagaagggggugacccagaaugggaggcuaauaaccgccaacccgaucgugaccgacaaagagaagcccgugaauaucgaggcugagccacccuuuggggaauccuauauagugauaggcgcaggcgagaaggcacuaaaacucagcugguuuaagaaggggucgagcauaggaaaaauguucgaggcaacagccagaggggcuaggcgcauggccauacuaggcgacacugcuugggauuuuggguccaucggcggcguguucaccagcgucgggaagcugguucaucagauuuuuggcacugccuacgggguguuauuuuccggugucagcuggaccaugaagaucgggauaggggugcugcugaccuggcucggcuugaacucccggaguaccucccugaguaugaccugcaucgccgugggguugguaacgcuguaccuaggcguaaugguccaggccgauuccgggugcguaaucaacuggaagggccgcgagcuaaagugcgguaguggcaucuucguaaccaacgaggugcacaccuggacggaacaguacaaauuccaggccgauagcccgaagcgucuauccgcugccauaggcaaagccugggaggagggggucugcggcauccgcagcgccacccggcuagagaacaucauguggaagcagaucucaaaugaguuaaaccacaucuuacuggagaacgacaugaaauucacugugguggucggugacguagccggaauccucgcgcagggaaagaagaugauuagaccgcagccgauggaguacaaguacagcuggaaauccuggggcaaggccaagaucaucggagcggaugugcagaacacgaccuucaucaucgacggaccgaacaccccagagugccccgacgaccagcgggccuggaacauuugggaggucgaggauuacggcuucggcaucuucacuaccaauaucuggcugaaacuucgcgacagcuacacacaggugugcgaccacagacucauguccgcggccaucaaggacucuaaggccgugcacgccgauauggguuacuggaucgagucggaaaagaacgagaccuggaagcuggcucgcgcuagcuucaucgaggucaagacgugcauauggcccaaaucccacaccuuguggagcaacggcgugcuggagagcgagaugauaauccccaagaucuacgggggaccgauuucacagcacaacuaccgccccggguauuucacgcaaaccgcggggcccuggcaccugggaaaacuugaacuagacuucgaucucugugagggcacgaccguuguaguagacgagcacuguggcaaucgagggccgucccugcggaccacuacgguaaccgguaagaucauccacgaguggugcugccggagcugcacccuaccuccacuccguuuccgcggggaagacggcugcugguaugggauggaaauccggcccguuaaggagaaggaagagaacuuaguaaagagcauggugagcgccggcagcggcgaaguagacuccuucagccuagggcugcugugcaucucaauuaugaucgaggagguuaugcggaguagguggucgcgcaaaaugcucaugaccgggacgcuggcugucuuuuucuuacucaucauggggcagcucaccuggaaugaccugauccgccugugcauuaugguaggcgccaaugcgagcgaucguauggggaugggcaccaccuacuuagcccugauggccacauucaagaugcgcccuauguucgcaguaggacuccuguuccggcggcuuaccucccgggagguucuacugcugaccaucggguugagucuaguagccucgguggaguuacccaacagccucgaggaacugggcgacgggcuggcgauggguauaaugauccucaagcuguuaacugauuuccagagucaccagcucugggccacccugcugagccucaccuucauaaagaccacauucucccugcacugugcguggaagacgauggccaugguccuaagcauaguaucccuuuucccccugugccucucaaccaccucacagaaaacgacguggcuccccgugcugcugggcagccucgggugcaaaccgcugaccauguuccuaauagcggaaaacaaaaucuggggcaggcgauccuggccccuaaaugaagggauaauggcugucggcaucgugucaauucuacugucaucccuccugaaaaaugacgugccacuggccgggccauuaauugcaggcggcaugcuuaucgccugcuacgucaucuccggguccagcgcagacuuaucccucgagaaggccgccgaggugagcugggaggaggaggccgagcacuccggcgccagccacaacauccucguagagguccaggacgacggaaccaugaagauuaaggacgaggaacgcgaugacacacuuacgaucuuacugaaggcgacgcugcuagccguguccggcguguacccgcugagcauccccgcuacccuuuucgucugguauuuuuggcagaagaagaaacagcgguccggggugcucugggacacccccagcccacccgaggucgagcgcgcugucuuagacgacggaaucuaccggaucaugcagcgcggacuuuuggggcggucccaggugggcgugggaguuuuccaagagaacguguuccauaccauguggcaugugacgagaggggccguccucauguaucagggaaaacgccucgagcccagcugggcauccgugaagaaggaucugaucucuuacggcggaggguggcgccuccagggcagcuggaauacgggugaggaggugcaggucaucgcagucgagccuggcaagaaucccaagaaugugcagaccgcccccgggacguucaagacgcccgagggcgaggucggcgccaucgcccuggacuucaagcccgggaccagcggcuccccgaucgugaaccgggagggcaagauagugggacuauaugguaauggggucgugaccaccagcgguacguacgugagcgcgaucgcccaggccaaggccucccaggaggggccguugccagagaucgaggacgagguguucaggaagcguaaccugacaaucauggaccuccaccccggcagcgggaagacccgccgguaucucccggcgauaguucgcgaggccauaaaaaggaagcugcggaccuugauccucgcccccacucgcguuguggcgucggagauggccgaggccuugaagggcaugcccauccgguaucagacaaccgcugucaagucugagcacacuggaaaggagaucgucgaccugaugugucaugcgaccuucacgaugcgccuacuaucccccguccgggugccgaacuauaacaugauuaucauggacgaggcccauuucacugaccccagcuccaucgcugcgcgcggcuacauauccaccagagucgguaugggcgaggccgccgcgaucuucaugacggccacgccgcccggaucaguggaggcguucccgcaaagcaacgccgugauucaggacgaggagagggacauccccgagcggucguggaauagcggguacgaguggaucacugacuucccuggcaaaacugugugguucguccccuccaucaagagcgggaaugacauagccaacugccuacgcaagaacgguaagcgggugauucagcucucccgcaagacguucgauaccgaguaccagaaaacuaaaaacaacgauugggacuacguugucacuacagacaucagcgaaaugggcgcgaacuuccgggcggaccgcguuaucgauccgcggcgcugccugaagcccguuauccugaaagacgggccggagcgggucauccucgccggccccaugccggucacggucgccagugccgcccagcgcagagggaggaucggcagaaaccacaacaaggagggcgaucaguacaucuacaugggccagccgcugaacaacgacgaagaccacgcacacuggaccgaagcaaagaugcugcucgauaauaucaacacgcccgaaggcauaauccccgccuuauucgagccggagagagagaagucggccgccaucgauggagaguaccgccuacgcggugaggcgcgcaagacguuuguugagcucaugcggagaggggaucugcccguguggcugagcuacaaggucgccucugagggguuccaguacagcgaccggcgaugguguuucgacggcgagcggaacaaccaggugcucgaagagaacauggauguugaaaucuggaccaaggaaggugagcgaaagaagcugcgaccccgcuggcuggacgccaggaccuacuccgacccgcucgcguugcgugaguuuaaggaguuugccgcggggagacgaagcgucuccggcgaccugauccucgaaaucggcaagcugccgcagcaccucacccagcgggcccagaacgcacucgacaaccuuguaaugcugcacaauagcgaacagggaggucgcgccuaccggcacgcgauggaggaguuacccgacacgauagagacgcugaugcuccucgcucuuaucgcugugcugacgggcggcgucacacucuucuuccucuccggacgcgggcucggcaagaccucuaucggucuccugugcgugauggcauccagcgugcugcucuggauggcaucuguugagccgcacuggaucgcggccagcauuauucuggaguuuuuccugauggugcuccugauaccagagccggacaagcagaggacgccccaggacaaccagcuggcguacguagugaucgggcuccuguucaugauccugaccguggccgccaacgagauggggcuccuggagacgacuaagaaagaccuggggaucggccacguugcgguggagaaccaucaucaugccgcuaugcucgacguggacuuacaccccgccagugccuggacgcuguacgcgguugccaccaccaucaucacuccgaugaugcgccauacuauagagaauacuacggcuaauauuagcuugaccgccaucgcaaaccaggcggccauucucaugggauuagacaagggauggccuaucuccaaaauggauaucggcgucccccuccuggcucugggauguuacagucaggugaaucccuuaacacugaccgccgcgguguuaaugcucguggcccauuacgcaaucauuggcccggggcugcaggcaaaggccacccgcgaggcgcagaagcggaccgccgccgguaucaugaagaaccccacgguggacgggaucguugccaucgaucuggaccccgucgucuacgacgccaaguucgagaagcagcucggccagaucaugcugcugauccucugcaccucccaaauccuguugaugcgcaccaccugggcgcugugcgaaagcaucacccuugccaccggcccccugacgacccucugggagggaagcccgggcaaguucuggaauacgaccaucgccguaagcauggccaacaucuuccggggguccuaucuggccggcgcaggacuggccuucucucuaaugaagucacuaggaggcggccgccgcgggaccggggcccagggcgaaacccugggcgagaaauggaaacggcagcucaaccagcuauccaaaagcgaguucaauacguacaagcgauccgguaucauggaggucgaccgcagcgaggcaaaggagggccugaaacgcggggaaaccacaaaacacgcggugucccgcgggacggccaagcuacggugguucguugagaggaaccugguaaagccggaggggaaagucaucgaucugggguguggcagggguggguggucauacuauugcgccgggcugaagaaagugaccgaagucaaaggauacacuaagggcggccccggacacgaggagccaaucccgauggccacauacggguggaaccucgugaaacugcacucuggcaaggacguguucuucauuccgccggagaagugcgacacacugcucugcgacaucggggaaagcucccccaacccaacgaucgaggagggccgcacccuaagaguucugaagaugguagagcccuggcucagggggaaccaguucugcaucaaaauccugaaccccuauaugcccagcgugguagagacucuugaacagaugcagcggaagcaugggggaaugcucgugcgcaacccgcugucccggaauagcacgcacgagauguacugggugaguugugggacagggaacaucgucucugccguaaacaugacaucccgcaugcuccucaaccgcuuuaccauggcgcaccguaagcccacauacgagcgcgacguggaccugggcgccggcaccaggcacgucgccguggagcccgagguagccaaccuggauaucauaggacagcgcaucgagaauauuaagcaugaacacaagucgacauggcacuacgacgaggacaacccguacaagacuugggccuaccauggguccuacgaggugaagcccagcggcuccgcgucuucaauggugaacggcgucgucaaacuuuuaaccaagcccugggaugugaucccgauggucacccagaucgcgaugacagacaccacacccuucggccagcaacgggucuucaaggagaaaguggacaccagaacgccgaaggccaaacggggaaccgcacagaucauggaggucacggccaaguggcuguggggguuccucucccgaaacaagaagccgcggaucugcaccagggaggaauuuacacgaaaggugcgcucaaacgcugcuaucggggcaguguuugucgacgagaaccaguggaacuccgccaaggaggcgguggaagacgaaagguucugggaccuggugcaccgcgagcgggaguuacacaaacaggggaagugcgcuacaugcgucuauaacaugaugggcaagcgcgagaagaagcucggggaguucgggaaggccaaagggagccgggccaucugguauauguggcugggcgcccgcuuccuggaguuugaagcguugggcuucaugaaugaggaccacugguucucccgugagaacucauuauccgggguggagggagaggggcugcacaaacucggguacauccugcgcgacauaagcaagaucccagggggcaacauguacgccgacgacacggcuggcugggacacccggaucacugaggacgaccugcaaaaugaggcccgcauuaccgacaucauggaaccggagcacgccuuacuggccaaauccaucuuuaagcugacauaccagaacaagguggugagagugcagcgucccgccaaaaaugguaccguaauggacgucaucagccgccgggaccagcgcggcucuggccaggugggcacguacggccuuaauaccuuuaccaacauggaggcccagcucauccggcagauggagagugaggggauuuucuccccgagugagcuggagacccccaaccucgccgagcgcguccuggacuggcuggagaaguauggcguugagagacucaagagaauggccauaaguggcgaugacugcguggugaagcccaucgacgaccgguuugcaaccgcccugaccgcucucaacgacaugggcaaaguccgcaaggacauaccccagugggagcccagcaagggguggaaugacuggcaacaggucccauuuugcucacaccacuuccaucagcuaaucaugaaggacggccgggagaucguggucccaugccgcaaccaggacgagcuggugggccgggcccgcgugagucaaggggccggcuggucucugagggagaccgcuugcuuggggaaguccuacgcgcagauguggcagcugauguacuuccaccgcagagaucugcgccucgcggcuaacgcgaucugcagcgccguuccaguagacuggauccccacuucacggacgacuuggaguauucacgcucaucaccaguggaugaccaccgaagauaugcucaguguguggaaccgcguguggauagaggagaacccguggauggaggacaagacccacaucagcagcuggggcgacgugccguaucuggggaagcgcgaagaccaguggugcgggucgcucaucggccucaccgcacgcgccacuugggcgaccaauauccagguagcgauaaaucagguccgcaggcuuauugguaacgagaacuaccucgacuacaugacuuccaugaagcgcuucaagaacgaguccgacccagagggcgcccugugguag

SEQ ID NO: 24501 - RNA, 9879 nt, Artificial Sequence
  derived and/or modified CDS sequence (opt11) from DENV-1__GU131801__SS-prME
ucugugaccaugcugcucaugcuaaugcccacugcgcuggccuuccaccuaaccacccggggcggcgaaccccacaugaucgugagcaagcaagagaggggcaagagucugcuguucaagaccagcgcuggcgugaacauguguacccugaucgccauggaccugggggaacucugugaggacaccaugaccuacaaaugcccccgcaucaccgaagccgagccugacgacguggacugcuggugcaacgccaccgacacuuggguaacguacgggaccuguagccagaccggcgagcaccggcgcgagaagcggagcguggcccucgcaccccaugugggucuggggcuggagacucgcaccgagaccuggaugagcuccgagggggccuggaaacagauccaacgggucgagacuugggcccuccgccaccccggguuuacggugaucgcucuauucuuagcucacgccauaggcacaagcaucacccaaaaagggaucaucuucauccuccuaauguuagugaccccguccauggcgaugcggugcgugggaaucggcucccgcgacuucguggaggggcucuccggcgcaacguggguggacgucgugcuagagcacgggagcugcguaaccaccauggccaaggauaagcccacacuggacaucgagcuccugaaaaccgaggucaccaaccccgcggugcugcguaagcucuguaucgaagcaaagauuuccaacaccacaacggacagccgcugcccuacccagggcgaggccacccugguggaggagcaggacgcuaacuucgucugccggaggaccuucguggauaggggcugggggaacgggugcgggcuguuuggcaaggggucauuacugacaugcgcaaaguucaagugcgugaccaagcuggagggcaagaucguccaguacgagaaccucaaguacagcgucaucgugaccguccacaccggcgaucagcaccagguggguaaugagagcacagaacacggcaccacagcgacaaucacgccccaggcccccacaaccgagauccagcugaccgacuauggugcccugacccucgacugcagcccccgaacgggacuggacuucaacgagaugguucuguugaccaugaaggaaaaguccuggcuagugcacaagcaaugguuccuagaccucccccuacccuggaccagcggggccagcaccucccaggagaccuggaaccggcaggaccugcuggugaccuucaagaccgcccacgcgaagaagcaggagguagugguucugggcagccaggagggugcgaugcacaccgcccugacgggggccaccgagauccagacaaguggcacaacuaccauuuucgccgggcaccucaagugccgguuaaagauggacaagcugacccucaagggcaugagcuacgucaugugcacaggguccuucaaacucgagaaggaaguggcggagacgcagcacgguaccgugcugguacaaaucaaguacgaagggaccgaugcucccugcaagauacccuuuucuacccaggaugagaaaggugugacgcaaaacggacggcugaucaccgcgaaccccaucguuaccgacaaggaaaagccgguaaacaucgaagccgagccgcccuucggggaguccuauaucggcaucggcgcgggggagaaggccuuaaagcucagcugggugaagaagggaucuucaauagggaagaugguagaagccacggcccgcggcgcucggcgcauggcgauccugggugacacggcgugggacuuugguuccaucggaggggucuucacgagcguggggaagcucgugcaccagaucuucgggacggccuacggcgucuuauucagcggagugagcuggaccaugaagauagguaucggcgugcuucucacguggcuugggcugaacucccgcagcacaucccucagcaugaccuguaucgccgucggccuggugaccuuauaccucggggugauggugcaggcggacuccggcugcguaaucaacuggaaggggcgggaguuaaagugcgggagcggcauuuucgugacgaacgaggugcacaccuggaccgagcaguacaaguuccaggcggacagcccgaagcgccuguccgcugcgauugggaaggcgugggaggagggcgucugcgggauccggagcgccacccgucuggaaaauauuauguggaaacaaaucuccaacgagcugaaccacauccuguuggagaacgacaugaaguuuaccguggucguuggcgauguggcgggcauccuuguccagggcaagaagaugauacguccccagcccauggaguacaaauacaguuggaaaagcugggggaaggccaaaaucaucggggcggacguacagaauagcacguucaucaucgacggccccaacacuccggagugucccgacgaucaacgcgcguggaauaucugggagguggaggauuacggauucggcaucuucaccaccaauaucuggcugaaacuucgggacuccuacacccaggucugcgaccaccgccugaugagcgcggcuaucaaggacagcaaggccguacaugccgacaugggauacuggaucgagagcgagaagaacgagaccuggaagcuggcgcgggcguccuucauugaggugaagaccugcaucuggcccaagagccacacccucuggagcaacgggguccuggagagcgagaugauuauccccaaaauacauggcgggccgaucucccagcacaacuaccggcccggguacuucacgcagaccgcagggcccuggcaucugggcaaacucgaacuggacuucgauuugugcgagggcaccaccguggugguugacgagcacugcgggaaccguggccccagccuccggacgaccaccgugacgggaaaaaucauucaugaguggugcugucgauccugcacgcugccaccccuucgcuuccggggcgaggauggguguugguaugguauggagauccgcccugugaaggagaaggaggaaaaucugguaaagagcaugguaucagccggcuccggagagguagacucuuucucccugggacuacucugcauuagcaucaugauugaggaggucaugcggucccgcuggucccggaagaugcugaugaccggaacccuggcuguguucuuccuccuuaucaugggccaauugaccuggaaugacuugauccgccuguguaucauggugggagccaacgcgucagaccgcaugggcaugggaacgaccuaccuggcccucauggccaccuuuaagaugcggcccauguucgcuguggggcugcuguuccgccggcucaccagccgcgaggugcugcugcucacgaucggccugucccuggucgccagcguggagcuccccaauagccuggaggaacugggggacggccuagcgaugggaaucaugauccuuaaacugcucaccgacuuccagagcuaccagcugugggccacccuccucucacugacguucaucaagacgaccuuuagcuuacacuacgccuggaagacaauggcuaugguccucucuauuguaagccuguucccccugugccucagcacaacaagccagaagaccaccuggcugcccgugcugcuggguagccugggcugcaagccgcugaccauguuccucaucgcggagaacaagaucugggggcggaaguccuggcccuuaaacgagggcaucauggccguggggaucgugucuauccuccuuuccuccuugcugaagaacgacgugcccuuggccggcccucugaucgccgggggaaugcugaucgccugcuacguuaucagcggcagcuccgccgaccucagccuggagaaggcugccgagguuuccugggaggaagaagcugagcacagcggggcuucccacaacauccugguggaggugcaggacgacggcacgaugaagaucaaggaugaggagcgcgacgacacccucacaauccuccugaaggcuacccucuuagccgugagcgggguguacccgcuuaguaucccagccacacuuuucguguggcacuucuggcagaagaaaaagcagaggaguggcguccugugggacacgcccagcccgcccgagguggagcgcgccguacuggacgacgguaucuaucggaucaugcagcggggucuccuggggcggagucaagucggggucggaguguuccaggagaaugucuuccacacuauguggcacguaacccgcggggccguucugauguaccagggcaaacgacuugagcccuccugggcuagcgugaagaaggaucucaucagcuacggcgggggauggcgcuuccaggggagcuggaacacaggcgaggagguacaggugauagcagucgagcccgggaagaaucccaagaaugugcagacggcccccgggaccuuuaagacccccgaaggcgaggucggugccaucgcacuggacuucaaacccggaacguccgggucgcccauugugaaccgggagggcaagaucguggggcuguacgggaacggcguagucacgaccucagggacguacguguccgcgaucgcccaggccaaggccagccaagaaggaccgcuucccgagaucgaggacgagguguuccggaagcggaaccugaccauaauggaccugcaccccgggucaggcaagacgcgccgguaccucccagcgaucguacgcgaggccaucaagcggaagcugcgcaccuugauacuugcucccacccgcgugguggccagcgaaauggcugaggcgcucaagggcaugcccauccgguaccagaccacggcugucaaaucugagcacaccggcaaggagaucguggacuugaugugccacgcgaccuucaccaugagacuccucagccccgugcggguccccaacuacaacaugaucauaauggacgaggcccacuucacagaccccuccagcaucgccgcgcguggcuacauuuccacccgggucgggaugggcgaggccgccgcuaucuucaugaccgccacgccacccgggagcauggaggcuuucccacagucuaacgccgugauacaagacgaggaacgugacaucccagagcggagcuggaacuccggcuacgaguggaucacugacuuccccggcaaaaccgucugguucgugcccaguauaaaagccggcaacgacaucgccaacugucugcggaagaauggcaagcgggugauucaacucucccgcaaaaccuucgacaccgaguaccagaagacgaagaacaacgauugggacuacguuguuaccaccgacauaagcgagaugggcgcgaauuuccgggcugacagagugaucgacccacgucgcuguuuaaaacccguuaucuuaaaggauggccccgagagagugauccucgcagggccuaugccggucaccguggccuccgccgcgcagcgacggggccgcaucggcagaaaccacaauaaggagggggaccaguacauauacaugggccagccccugaacaacgacgaggaccacgcgcacuggacggaggcaaagaugcuacucgauaacaucaauacccccgaggggaucauccccgcgcuguuugagccggagcgcgagaaguccgcggcgaucgacggcgaguaccgccugcgcggagaggcccgcaaaaccuuuguggaacucaugcggagaggcgaucugccugucuggcuguccuacaagguggccagcgaaggcuuccaguacagcgaucggcguuggugcuucgacggggagcggaacaaccagguguuagaggaaaacauggacgucgagaucuggaccaaggagggcgagcgcaaaaagcugcgaccgcgcuggcuggacgcacggacguacuccgacccccuagcgcugcgcgaguucaaggaguucgcggcuggccggcgcagcguguccggcgaccugauccuggaaaucggcaaacugccgcagcaccugacccagcgggcccagaacgcacucgacaaccugguaaugcuucacaacagcgagcaaggcggccgcgcguaccggcacgccauggaggagcuccccgacacgaucgagacccucaugcugcucgcccugaucgcaguccugaccggaggggugacccuauucuuccuguccgggaaggggcugggcaaaaccagcauaggauuacugugcgugauggcauccagcguccugcucuggauggcguccguggagccccacuggauugcggccagcaucauacuggaguuuuuccugauggugcuccugaucccggaaccggaccggcagcggacgccccaggacaaccagcuggccuacgucgugauugggcucuuguuuaugauccugaccguagccgccaacgagauggggcugcuggagacgaccaagaaagacuuggguauagggcaugucgccguagagaaccaccaucacgccgcuaugcucgacguggaccugcacccggcauccgcguggacccuguaugcggucgccaccaccauaaucacgccgaugaugcgacacacuaucgagaauaccacggcgaacaucagccucacagccaucgcgaaccaggccgccauacugaugggccuggacaagggcuggcccauauccaagauggacaucggggugccccuccuggcguuaggcuguuauagccaggugaacccccucacccugacugccgccguccuuauguuaguugcccacuacgccaucaucgggccgggccugcaggcaaaggcgacgcgggaggcacagaagcggaccgccgcugguaucaugaaaaacccuaccauugacgguauaguggccauagaccuggaccccguggucuacgacgcgaaguucgagaagcagcucggccagauaaugcugcugauccucugcaccucccagauacuccugaugcgcacgaccugggccuugugcgagagcauuacccuggcaaccggucccuugacaacccucugggagggcuccccggggaaguucuggaauaccaccauagcagugucgauggccaauaucuuucggggcuccuaccuggccggcgccggucuggcauuuagccucaugaagucccugggcgguggccgacgugggacaggcgcccagggcgagaccuugggugaaaaauggaagagacagcuaaaucagcuguccaaaagcgaguucaacaccuacaagcggucuggcaucauggaggucgacagauccgaagcgaaggaggggcugaaaagaggggagaccacaaagcacgccgugucccgcggaaccgccaaacuuagaugguucguggagcgcaaccuggucaagccugaaggcaaggugaucgaccuaggcugcgggcggggcgggugguccuacuacugcgccggccugaagaaggugaccgaggucaaggguuacaccaaaggcggccccgggcacgaggagcccaucccaauggccacguacggcuggaaccuggugaagcuccacucugguaaggauguauuuuucauucccccagaaaagugcgacacccugcucugcgacaucggcgaaagcucccccaaccccacaaucgaagagggacgcacccuucggguccugaagaugguggagcccuggcuccgcgggaaccaguuuugcaucaagaucuuaaaccccuacaugccuagcguggucgaaacccucgagcaaaugcagcggaagcacggcggaaugcuagugcgcaacccgcugucgaggaauagcacccacgagauguacuggguguccugcggcacugggaacaucgucagcgccgugaacaugacaucccgcaugcugcucaacagguucaccauggcccaucgcaagcccacguacgagcgcgacguggaccugggcgccggcacccggcacguagccgucgagcccgagguggcgaaccuggacaucaucggucagcgcauagagaacaucaagcacgagcauaagagcacguggcacuacgacgaggacaaccccuauaagaccugggcguaucacggguccuacgaggugaagccgagcgguucggcuagcagcauggugaacggcgucgucaagcuccugacgaagccuugggacgugauccccauggucacacagaucgccaugaccgacaccacgcccuucgggcagcagaggguguucaaggagaagguggacacucgcaccccaaaggccaagcgggguaccgcccaaaucauggaggugaccgcgcgcuggcugugggguuuccuaagccggaauaagaaaccccgcauuugcacccgggaggaguucaccaggaaaguacguagcaacgccgccauuggggcgguguuugucgaugagaaccaguggaacuccgccaaagaggcuguggaggaugaccgguucugggaucuuguucaccgggaacgugagcugcauaaacagggcaagugcgcgaccuguguguacaacaugaugggcaagagagagaagaagcucggggaguucgggaaggcgaagggcucucgcgccaucugguacauguggcugggcgcgcgcuuucuggaguucgaagcccucgguuuuaugaacgaggaucacugguucucccgcgagaacagccuauccggcguggaaggagaggggcuucacaaauugggauacauucugcgggacaucucgaagauccccggcggcaacauguacgccgaugacacggccgggugggacacacgcaucaccgaggaugaucugcagaaugaggccaagaucaccgacaucauggagccggagcacgcgcuguuagccaaguccaucuucaagcugacguaccagaacaaaguuguccgggugcagcgcccugccaagaacggcaccgugauggacguaaucucccgcagagaucagcgcgggucaggccaagugggcaccuauggguugaacaccuucaccaacauggaagcucagcugauacggcagauggagagcgagggcaucuuccugccuaacgagcucgagacccccaaccuggccgggagagugcuggauuggcucgagaaguacggcguagagcggcugaagaggauggcgaucuccggcgaugacugcguggugaagccgauagacgaucgguucgccacagcccugaccgcucucaacgacaugggaaagguccgcaaggacauaccccagugggagcccagcaaaggcuggaacgauuggcaacagguaccauucugcucccaccacuuccaccagcucaucaugaaggacggacgggagaucguggucccgugccgcaaccaggacgaguuggugggccgggcccgcgugagccaaggggcgggcuggagucuccgggaaaccgccugucugggcaagucauacgcccagauguggcagcuuauguacuuccaccgcagagaccuccggcuggcagcgaacgccauuugcagcgccgugcccguggauugggugcccaccucccggacgaccuggagcauccacgcccaucaccaguggaugacgaccgaagacaugcugucggucuggaaucgcguguggaucgaggagaaccccuggauggaggauaagacuaggaucucaagcugggaggacgugccguaccucggcaagcgagaggaccaguggugcggcucguugaucgggcugaccgcccgggccacgugggccacgaauauccaggucgccauaaaccaggugcgacgccuuaucggcaacgagaacuacuccgauuacaugacuagcaugaaacgguucaaaaacgagagugagcccgagggggcccugugguga

SEQ ID NO: 24502 - RNA, 9879 nt, Artificial Sequence
  derived and/or modified CDS sequence (opt11) from DENV-1__GU131804__SS-prME
agcgugacgauguuccugaugcucaugcccacugcccuggccuuccaucuaaccacucggggcggggagccucacaugaucgugucgaagcaggagcggggcaagagccuccuguucaagaccagcgccgggguaaacaugugcacccugaucgccauggaccucggcgagcugugcgaggacaccaugacuuacaagugcccgcgcaucacugaaacggagcccgaugaugucgacugcuggugcaacgccacggacaccugggugaccuauggaaccugcagccagacgggcgagcaucggcgcgacaagcguuccguggcccuggcgccgcacgugggccuagggcuggagaccaggaccgagaccuggaugagcucagagggcgccuggaagcagauccagcgugucgagacuugggcccugcgccaccccggguuuaccgugaucgccuuguuucuggcacacgcuaucggcaccagcaucacccagaaggggaucaucuucauccuguuaaugcugguuacgcccuccauggccaugcguugcgucggcaucgggagccgagacuucguggaaggguuauccggcgcgaccuggguagacgucgugcuggagcaugggagcugcgugaccaccauggccaaggauaagcccacgcuggauauugagcuucucaagaccgaggucaccaaccccgcagugcugcgaaagcuguguaucgaggcgaagauuucgaacaccaccaccgacucuagaugcccgacccagggcgaggccacccuuguggaagaacaggacgccaacuucgucugccggcgcacguucguugaccggggcuggggcaacggcugugggcuguucggcaaggggucccugaucacgugcgcuaaguuuaaaugcgugaccaagcucgaaggcaagaucguccaguacgagaaccugaaguacucagugaucguaacuguccacacgggggaccagcaccagguggggaacgaauccacagagcacgggacaaccgccaccaucacgccccaggcgcccaccaccgagauccagcugaccgacuacggcgcccuaacguuagauugcagcccccgcacgggccuugacuucaacgagaugguccugcugaccaugaaggagaagaguuggcuggugcacaaacagugguuccucgaccugccgcuacccuggaccucgggggccagcaccagucaggagaccuggaaccgucaagaucuucuggugaccuuuaagacggcccacgccaagaagcaagaggucguggugcugggcucccaagagggcgcgaugcacaccgcccugaccggugccaccgagauccaaaccuccggcacgaccaccaucuucgccgggcaccugaagugccggcugaagauggacaaacucacuuuaaagggcaugagcuacgucaugugcacaggguccuucaagcuggagaaggagcucgccgagacacaacacggcacagugcuggugcagaucaaguacgagggcacugacgcgcccugcaagauccccuucagcacacaggacgaaaagggugucacccagaacggccggcugaucaccgccaauccgaucgugaccgauaaggaaaaaccgguaaacauugaggcagagccgccguucggggaaucguacaucguuaucggcgcuggcgagaaagcgcugaagcucagcugguucaagaagggcucuagcaucggcaagauguucgaggccaccgcccgaggggcccggcgcauggccauacugggcgauaccgcaugggacuucggauccaucggcgggguguuuacaagcguagggaagcugguccaccagaucuuuggcaccgccuacggggugcuguucucaggcgugagcuggacgaugaaaaucgggaucggcguucugcugaccuggcuaggccucaacucccgcagcaccuccuuaucaaugaccugcaucgccguugggcuaguuacgcuguaucugggcguaauggugcaggccgacuccggguguguaaucaacuggaagggccgggaacucaaaugcgggagcggcaucuucgucaccaacgaggugcacaccuggaccgagcaguacaaauuccaggccgacagcccgaagcgccucuccgcggccaucggcaaggccugggaagagggcgugugcggcauucggagcgccacccgccuggagaacauuauguggaagcaaaucucgaacgagcuaaaucacauccugcuggaaaacgauaugaaguucacuguuguggugggugacgucgccgguauucucgcgcagggaaagaagaugauccggccgcagccaauggaauacaaguauagcuggaaaagcuggggcaaggccaagaucauaggcgccgacgugcagaacaccaccuucaucaucgacgggcccaacaccccugagugccccgacgaccagcgugccuggaacauuugggagguagaggacuacggcuucgggaucuucacgaccaacaucuggcugaagcugcgggacagcuacacucaagucugugaccaccgccucaugucagcggccaucaaggacucuaaggccgugcaugccgacaugggcuacuggaucgaguccgagaagaacgagaccuggaagcuggcgcgagcgucauucaucgaggugaagacuugcaucuggcccaagucccacacccuauggagcaacggcguacuugaguccgagaugaucauccccaagauuuaugguggaccgaucagccaacauaauuacaggcccggguacuucacccagacugccggccccuggcaccuggggaagcuggagcucgacuucgaccuuugugagggcacgaccgugguggucgacgagcacugcggcaaccgcgggccguccuuacgcaccaccacagugaccggcaagaucauccacgaguggugcugccggagcugcacccuuccaccccuccgcuuucgcggggaggacggcugcugguacgggauggagauccgccccgugaaggaaaaggaggagaaucuggucaagucuauggugagcgccggcagcggcgaaguggacuccuucagccucgggcugcuguguauuuccaucaugauugaggaggugaugcggagccgcuggucccggaagaugcucaugaccggcacgcuggccguguucuuccuacucauaauggggcaacugaccuggaacgaccugaucaggcucugcaucauggugggcgccaacgcguccgaccgcauggggaugggaaccaccuaccuugcucugauggccacguucaagaugcggccaauguucgccgucggucuucuguuccgccgacugaccuccagagagguacuccugcugacgaucgggcugagcuugguggcuuccguugagcuccccaacagccucgaggaacugggcgacgggcuggcgaugggcauaaugauccuuaagcugcugacugacuuccagucccaccagcucugggccacccugcugagccucaccuucaucaagaccacuuuuucccugcacuaugccuggaagacgauggccauggugcuguccaucguaucauuauuuccacugugccugagcaccacaucccagaagacuaccuggcuccccgugcugcuuggcagucucgguugcaagccgcuuaccauguuccugaucgcggagaacaagauauggggccggcgcuccuggccccucaacgaggggaucauggccgugggcaucgucagcauccugcugagcagccuccugaagaacgacgucccacuugcggggccccucaucgcgggcggcaugcugauugccugcuacgugaucagcggguccucugcggaccugucccucgaaaaggccgccgaggucuccugggaagaggaggcugaacacuccggcgccagccacaacauccugguggaggugcaggacgacgggaccaugaagaucaaggacgaggagagggaugauacccucacgauccucuuaaaggcgacucugcucgcggucucuggcguguauccguuaagcaucccugccacccuguuugucugguacuucuggcagaaaaagaaacagcguucagggguccucugggacacuccaucuccgcccgagguggagcgggccguccuggacgacggcaucuaccgcaucaugcagcgcggucugcuggggcgcucccagguaggcgugggggucuuccaggagaacgucuuccacaccauguggcacgugacccggggcgccgugcucauguaccaggggaagagacuagagcccucgugggcguccgugaagaaggaccugauuagcuauggcggggguuggcgguugcagggcuccuggaacaccggggaggagguccaggugaucgccguggaacccggcaagaaccccaagaacgugcagaccgcucccggaaccuucaaaacucccgagggagaagugggugccaucgcccuggacuucaagcccgggaccagcggcucccccaucgucaaccgcgaggggaaaaucgugggcuuguacgguaacgguguggucacgaccagcggcaccuacguguccgcgauugcccaggcccgggccucgcaggagggaccucuccccgagaucgaggacgagguguuccgcaagcggaaucugaccaucauggacuuacaucccggcagcgggaagaccagacgguaccucccggcgaucguccgagaggccaucaagcgcaagcugcguacacucauccucgcgcccacgcgcgugguggcgucugagauggcggaggcgcugaagggaaugcccauacguuaucagaccaccgccgucaagagugagcacacggguaaggagaucguggaccugaugugccacgccacguucaccaugcgccuccucucccccgugcgggucccgaauuacaacaugaucaucauggacgaggcccacuucaccgaucccagcuccauagcggcgcgcggguacaucagcacaaggguaggcaugggggaggccgccgccauuuuuaugacagcuacgccgcccggcuccguggaggcauuuccgcagagcaacgccgucauacaagaugaggagcgugacauccccgaacguuccuggaacagcggauaugaguggaucacagacuuccccggcaagaccgugugguucgugcccuccaucaagucaggcaacgacaucgccaacugccugcgcaagaacgggaaacgggucauccagcuuucccgaaagacauucgauaccgaguaccagaagaccaagaacaacgauugggacuacguuguaacgacggacaucagcgaaaugggcgccaauuuccgggcggacagagucaucgacccgcggcguugucugaagcccgugauccugaaagacggucccgagcgagugaucuuagcugggcccaugcccgucaccguggccuccgccgcccagcgccgggggcgcaucggucgcaaccacaacaaggagggcgaccaguauaucuacauggggcaaccccugaacaacgaugaggaccacgcgcacuggaccgaggccaagaugcugcuagacaacauuaacaccccagagggcauaauccccgcccuguucgagccggaacgggagaaguccgccgcaaucgacggggaguaccggcugcggggcgaagcgagaaagacguucguagagcucaugcggcgcggggaucugcccguguggcugagcuacaagguggccagcgagggcuuucaguacagcgaccggcgcuggugcuucgacggcgagcguaacaaccagguccucgaggagaacauggacguggaaaucuggaccaaggaaggggaacgcaagaaacugcggccgcgcuggcuggacgcccggacuuauagcgacccccucgcacugcgcgaauuuaaggaguucgccgcgggccggcgcagcguuuccggggaucugauccuugaaaucggcaagcugccucagcaccugacccagcgggcgcagaacgcccuugacaaccuggucaugcugcacaacagcgaacagggagggcgcgccuaccggcacgcgauggaggagcugcccgacacgaucgaaacccugaugcugcucgcucuaauagccgugcuuaccggcgggguuacacucuucuuuuugucaggccgcgggcucggcaagaccagcauaggccuccugugcgugauggcuuccagcgugcuacuauggauggccucuguggagccccacuggaucgcggccagcauuauccuggaguuuuuccuuaugguccuguuaaucccagagccggaucggcagcgcacgccccaggauaaccagcuggccuacguugugauagggcuucuguucaugauucugaccguugccgcaaacgaaaugggauuguuggagaccaccaaaaaggaccugggcaucggccacgcggccgucgagaaccaccaccacgccgccaugcucgacgucgaccugcaucccgccuccgcguggacacuguacgcgguagccaccaccaucaucaccccgaugaugcgccacacgauagaaaacaccaccgccaauaucagccucaccgccaucgcgaaccaagccgccauccugauggggcuggacaagggauggccuaucucuaagauggacaucggcgugcccuuacuggcccugggguguuacagccaggugaacccccucacgcugaccgccgccguccugaugcucguggcccacuaugcuaucauaggcccggggcugcaggcgaaggcuacacgggaggcccagaagcgcaccgccgccggcaucaugaagaaccccacgguggacggcaucguugccaucgaccuggaccccgugguguacgacgccaaauucgagaagcagcucggccagaucaugcugcugauccucugcaccucccagauccugcucaugcggacgaccugggcccucugugagagcaucacgcuggccacugggccccugaccacccucugggaggguuccccgggcaaguuuuggaacacaacuaucgcugugaguauggccaacaucuuccgcggcuccuaccuggcgggcgccggacuggccuucucucucaugaagucccucgguggugggcggcgcgguacgggcgcucagggcgagacucugggugagaaguggaagcggcagcucaaccagcugaguaagagcgaguucaauacguacaagcgcuccgggaucauggagguggaucggagcgaggcuaaagaaggccugaagcgcggggagaccaccaagcaugccgucucccgaggcaccgccaaguugcgcugguucgucgagcggaaccugguuaagcccgaggggaaggugauagaccuaggcugcggucgcggaggauggagcuacuacugcgccgggcugaagaaagucacggaggugaaaggcuacacgaagggcggccccggccacgaggagcccaucccgauggcuaccuacggguggaaccucguuaaacugcacuccgggaaggaugucuucuucaucccgccugagaagugcgauacccugcucugcgacaucggagaaagcucccccaauccgacuaucgaggagggccggacccugagggugcugaagaugguggaacccuggcucagagggaaccaguucugcaucaaaauccugaaucccuacaugcccagcgucguggagacucuggagcagaugcagcgcaagcacggcggcaugcucgugcggaacccgcugucccgcaacagcacccaugagauguacugggucuccugcgggaccggcaacauugugagcgcggugaacaugacgucccgcaugcugcucaacagguucaccauggcccacagaaaaccuaccuacgagcgggacgucgaccugggggccggcacucgccacguggccguggagcccgagguugcgaauauagacaucaucgggcagcgcauagagaacauaaagcacgagcacaagagcacauggcacuacgacgaagacaauccauacaagacgugggcguaccacggauccuacgaggugaagccgagcggcagugccagcucgauggugaacggggucgugaaacuucucaccaagcccugggacgucauccccauggugacccagaucgccaugaccgacaccaccccuuucggucagcaacgcguguucaaggagaaggucgacacccggacgccgaaggccaagcgggggaccgcccagaucauggaggugacggcgaaguggcuguggggcuuuuuaucccggaacaagaagccccgaaucugcacccgggaagaguucacgagaaaggugagaagcaacgccgcgaucggcgccgucuucguggacgaaaaccaguggaacuccgcgaaggaggccguggaggacgagcgcuucugggaccucgugcaccgggagcgcgagcugcacaagcaggggaagugcgcgacaugcguguacaauaugauggggaagcgagagaagaagcugggggaguucggaaaggccaaaggcagccgcgcuaucugguacauguggcuaggcgcgcgauuccucgaguucgaggccuugggauucaugaaugaggaccacugguucucccgagagaacagccucuccggggucgagggggaggggcugcauaagcugggcuacauacuccgggauauaagcaaaauccccggcggcaacauguaugccgacgacacugccggcugggacacccgcaucacggaggacgaucugcagaacgaagcccgcaucaccgacaucauggagccggagcacgcgcugcucgccaaguccaucuuuaagcugaccuaucagaacaagguugugcgggugcagaggccggccaagaacgggaccgucauggacgugauaagccggagagaccagcggggcuccggccagguggggacguacggacugaacaccuucacuaacauggaggcccagcucauccggcagauggagagcgagggcaucuucucccccagugagcuggagaccccaaaccuggccgaacggguucuggacuggcuggagaaguacggcguggagcgccugaagcggauggccaucuccggggacgacugcguggucaagccgaucgacgaccguuucgcaacggcacuaaccgcccugaacgacaugggcaaggugaggaaagacaucccccagugggagcccagcaaaggguggaacgacuggcaacagguccccuucugcucgcaucacuuucaccagcuaaucaugaaggauggccgggagaucgucguaccgugcagaaaccaggacgagcucgugggccgcgcccgggucagccagggggccggguggagccugcgcgagacugccugccuggggaaguccuacgcccagauguggcagcucauguacuuccauagacgcgaccugcgucuagccgcgaacgccaucuguuccgccgugccuguggacuggaucccuaccuccaggacgaccuggagcauccacgcccaucaccaguggaugaccaccgaggacaugcucuccgucuggaaccgcguguggaucgaggagaaccccuggauggaagacaagacgcacaucuccuccuggggcgacgugccguacuuagggaagcgagaggaccaguggugcgggagccuaaucggccuuaccgcccgggcgacuugggcgaccaacauccaggucgccaucaaccagguucggcgccugaucgggaacgagaacuaccuggacuacaugaccuccaugaagcgcuucaaaaacgagagcgaccccgaaggcgcucucugguag

SEQ ID NO: 24503 - RNA, 9879 nt, Artificial Sequence
  derived and/or modified CDS sequence (opt11) from DENV-1__GU131805__SS-prME
agcgugaccaugcugcucauguugaugcccaccgcccuggcguuccaccucaccaccagaggaggagagccccauaugaucgugucgaagcaggagcgcggcaagagcuugcuguucaagaccagugcggguguaaacaugugcaccuugaucgccauggaccugggcgaauuuugcgaggacaccaugaccuacaagugcccacgcaucaccgaggccgaacccgacgacguugacugcuggugcaaugccacugacaccugggucacuuacggaaccugcagucagaccggugaacauaggcgcgacaaacgguccguggcccuggcgccccacguuggccugggcuuggaaacgcgcacggagaccuggaugucguccgaaggcgccuggaaacaaauccagcggguggagaccugggcccugcgccaccccggcuucacgguuaucgcacuuuuccuggcacacgccaucggcaccagcaucacgcagaaggggaucaucuucauccugcucaugcuggugacccccucuauggccaugcggugcguggggaucgggagccgcgacuucgucgaagggcuguccggcgccacguggguggacguugugcucgagcacgggagcugcgugacuaccauggccaaggacaagcccacucucgauaucgagcuucucaagacggaggucaccgauccugccgugcugcgcaagcuuuguauagaagccaagaucuccaacaccaccacggacucccgcugcccaacucagggugaggcaacacucguggaggagcaggacgcuaacuuugucugccggcgcaccuucguggaucggggcugggguaacggcuguggacuguucggcaaagggagccuuaugacuugcgccaaguucaagugcgugaccaagcucgaaggaaagaucguccaauacgagaaucugaaguacagcgugauaguuacaguacauacuggcgaucaacaccaaguggggaacgagaguacggagcacggcaccaccgcuaccaucacuccgcaggcccccagccccgagauucagcugcccgacuacggggcccucacgcuggacugcagccccagacccggccuggacuucaaugagaugguucuccugccaaugaaggaaaaguccuggcuggugcacaagcagugguuccucgaccuaccgcugccauggacaagcggggccuccaccagccaagagacguggaaucggaaggaccuccugggcacguucaagaccgcccacgcgaaggagcaggaaguggucgugcuggguucccaagagggggccaugcacaccgcccugacaggcgcaacagagauccagaccagcgggaccaccacuauauuugccggccaccugaagugccggcugaagauggacaagcucacccugaaggggauguccuacguuaugugcacgggcagcuucaagcuggagaaggaagucgcagagacccagcacggcacggugcucgugcagaucaaauacgaggggacagacgccccaugcaagauccccuucuccacucaggacgaaaaaggcgucacacagaacgggcggcugaucaccgcuaacccgauugugacagacaaggagaagcccgugaacaucgaggcggagcccgccuucggcgagagcuacaucgucaucggcgccggggagaaggcccugaagcuguccugggugaagaaaggcagcucuaucgggaaaauguuugaagccaccgcacgcggcgcgagacgcauggccauccucggggacaccgccugggauuucgguagcauaggagggguuuucacauccguagguaaguuggugcaccaaaucuucgggaccgcauacggcgugcuguucucgggggucuccuggaccaugaagaucggcaucggcgugcuacugacuuggcucggccucaacagccgcaguacgagccuauccaugaccuguauugccguuggucuggucacacucuaucugggggugauggugcaggcggauagcggcugcgucaucaacuggaaggguagggagcugaagugcggcagcggaaucuucggaaccaacgaggugcacacguggaccgaacaguacaaguuucaagcugacucucccaagcgucucagcgccgccauagggaaggccugggaggagggggugugcgggauccgguccgcgacccgucuggagaacaucauguggaagcagaucagcaacgagcugaaccacauccuccuggagaacgccaugaagcugaccgugguggugggggacgucgccggcauucucgcccagggcaagaaaaugaucagaccgcaacccauggaguacaaguacucuuggaaguccugggggaaggcgaagaucaucggcgccgacguccagaacacuaccuucaucaucgacgggccgaacacccccgagugcccugacgaucagcgcgccuggaacaucugggagguggaggacuacggcuucggcaucuucaccaccaacaucuggcugaagcugcgggacaguuacacgcaagucugcgaccaccgccugaugagcgccgcuaucaaggacuccaaggcggugcacgccgacaugggcuauuggauagagagcgagaagaacgagcccuggaaacuggcccgggcgaguuucaucgaggugaaaacgugcaucuggcccaagagccacacccuguggagcaacggcgugcucgagagcgagaugaucaucccgaagauuuacgggggucccaucucccagcacaacuaccgcccaggguacuucacccaaacggccggcccauggcaccugggcaaacuagagcucgacuucgaucucugcgaagggaccacagugguggucgacgagcacugcggcaaucgggggccuagccugcgcaccacgaccgugcccggcaagaucauccaugaguggugcugccggaguugcacucugccgccccuccgcuuuaagggggaggauggcugcugguacggcauggagaucucuccggugaaggagaaggaagagaaucuggucaagagcauggugagugcggggucaggcgaaguggacucguucagccuagggcugcugugcaucuccaucaugaucgaggagguaaugcggagccguuggucuaggaaaaugcucaugacaggcccccugccaguguucuucuugcucauaauggggcaacuccccuggaacgacuugauccgccucugcaucauggugggcgcuaaugccagcgaucggaugggcauggggacgccguaccuggcauuaauggccaccuucaagaugcgccccauguucgcgguaggccuccuguuccgccgguuaaccagccgcgaaggacuacugcugaccauuggccuaagccugguggcuuccguggagcuucccaacucgcucgaggagcugggcgacgggcuggccaugggcaucaugauccucaagcugcugaccgacuuccagucccaccagcucugggccacccugcuggcgcuuaccuuuaucaagaccacuuucagccuggauuacgccuggaagaccauggcaaugguccugucaaucgugagccucuucccccugugccuguccaccaccagccagaagacaacauggcucccaguacugcugggguccuuaggcugcaaaccccugacuauguuucugaucgccgagaauaagaucuggggucgcaagagcuggccccucaacgaggguaucauggccgugggcaucguaagcauccugcuaucagcgcuccugaagaaugacgucccccuggccgggccccucauugccggcgggaugcuuauugccuguuacgugaucagcggguccucugccgaucucucacucgagaaggccgccgaggugagcugggaggaggaggccgagcacuccgggggcagccacaacauucuagucgagguccaggacgacggcaccaugaagaucaaggacgaggaaagggacgcgacacugaccauacuccugaaggcuacgcugcuggcgguguccggggucuauccucuaucuauccccgccacccuguuugugugguacuucuggcagaagaagaagcagcgcucaggcgugcucugggacacgcccagcccgcccgaggucgagcgcgcagugcuggacgacgggaucuaccggaucaugcagcgcggauugcucgggcggucccaggugggcgucggaguguuccaggagaauguguuccacaccauguggcaugucacgcgcggcgccguguuaauguaccagggcaagcggcuggagcccuccugggccuccguaaagaaggaccugaucagcuauggaggcggguggcgccuccagggguccuggaacacgggcgaggagguccagguuaucgcgguggagccggggaagaaucccaagaacguccagacagccccgggcaccuucaagaccagcgagggggaggugggcgcgaucgcccuggacuucaagcccggcaccucuggcaguccgaucgugaacagagagggaaagaucgucggacuguacgggaacgggguugugaccacaagcggcacguacgucuccgcgaucgcccaggccaaggccagccaggagggcccccuccccgagauagaggacgaaguguuucgcaagcggaaccugaccaucauggaccugcaccccggguccggcaaaacccgccgguaccuaccggccauugugcgcgaagcgauaaaacgcaaguugcgcacucugauccucgcccccacccgggucguggccagcgagauggcggaagcccuuaaggggaugcccauccguuaccagaccaccgcggugaaaagcgagcacacgggcaaggagaucgucgaccugaugugccacgccaccuucaccaugagacuccugagcccggugcgggugccgaacuauaacaugauaaucauggacgaagcccauuucaccgauccauccagcaucgcugcucgcggcuacaucucuacgagagucgggaugggggaggcggcugccaucuucaugacggccacgccgcccggguccguggaggcguuuccgcaauccaacgccgugauccaggacgaggagcgcgacauccccgaaagaagcuggaacuccgguuacgaguggaucaccgacuuccccggcaaaacggucugguucgugccaagcauuaagucgggcaacgauaucgccaacugccugcgcaagaacgggaagcgggugauccaacucagccgcaagaccuucgacaccgaguaccagaagaccaagaacaaugacugggauuaugucgugacgaccgacaucuccgagaugggcgcuaacuuccgggccgaccgcgugaucgacccgcgucgcugccugaagccugucauccugaaggauggccccgagcgggugauccucgcggggccaaugccggugacagucgccagcgccgcccagcgccggggccgcauagggcgcaaccacaacaaggagggcgaccaguacaucuacauggggcagccacugaacaacgacgaggaccacgcccacuggaccgaggcgaagaugcugcuagacaacaucaauacgcccgagggcauaauccccgcacuguucgaaccggagcgcgagaaaucagccgccauugacggcgaguaccggcugcgcggggaggcccggaagaccuucguggagcucaugcggcgcggcgaccugcccguuugguugagcuacaagguagcgagcgagggguuccaguacuccgaucggcgauggugcuucgacggcgagcggaacaaucagguacucgaggaaaacauggaugucgagaucuggacuaaagagggagagcgcaagaagcugcggccccgcuggcuggacgcccggaccuacucagacccgcuugcccugcgcgaguucaaagaguucgcggcggggcggcgcucaguguccggggaccugauccucgaaauugggaagcugccccagcaccucacgcaaagggcacagaacgcccucgacaaccugguaaugcugcacaacuccgagcagggggggcgcgccuaccggcacgccauggaggaacuccccgacaccaucgagacccugaugcugcucgcccugaucgccguccugaccggcggcgugacacuguucuuccugagcggccgcggccuggggaaaaccuccaucggccuacugugcguaauggcgagcagcguccugcuguggauggccagcguggaaccccacuggauugccgcgucgauuauccuggaguucuuccugauggugcuccugaucccggagcccgaccggcagcgcacuccccaggacaaccagcuggccuacgucguaauagggcugcuguuuaugauccuaacgguggccgccaacgagaugggacuccuugagaccaccaagaaggaucugggcaucggucacgucgcaguggagaaccaccaccaugcggccaugcucgacguggaccugcaccccgccagugccuggacacuauacgccgucgcgaccacgaucaucaccccgaugaugcggcacaccaucgagaacaccaccgccaauaucucccucacggccaucgccaaccaggcggccauacucauggggcuggacaaggguuggcccaucagcaagauggacaucggcgugccccugcuggcccuggggugcuacucccaggugaaccccuugacccugaccgccgccgucuuaaugcucguagcucacuacgccaucaucgggccgggccuacaggccaaggccacucgcgaggcccaaaagcggacggccgccgggauuaugaagaaccccacugucgauggcaucgucgccaucgaccuggaccccgugguguaugacgcaaaauucgagaagcagcucggucaaaucauguugcucauccucugcaccagccagauccugcugaugcguaccacgugggcccucugcgaguccauaacucuugcgaccgguccgcuaaccacguuaugggagggcaguccggggaaguucuggaacaccaccaucgccgucucgauggcaaacaucuuucgcggcagcuaccuggccggggccggccuggccuuuagccuuaugaagucccucgggggcgggcgccgcgggaccggcgcccaaggcgagacgcugggagagaaguggaagcggcaacucaaccagcugagcaagagcgaguucaacaccuauaagcggagcggcaucauggagguggaccgguccgaggccaaggagggccugaagagaggcgagaccaccaaacacgcagugagcagggggacugcgaaacuccgcugguucgucgagcggaaccuggugaagccggaaggaaaggugauagaccuggggugcggccgcgggggcugguccuacuacugugcuggccugaagaaggucacggaggugaagggguacaccaaaggcggucccggccacgaggaacccaucccuauggcgacguacggguggaaccucgucaagcugcacagcggaaaggacguuuucuucauucccccagagaagugcgacacgcuguuaugcgacaucggcgaguccaguccaaacccgacaauagaggagggucggacccugagaguacugaagaugguggagcccuggcuccggggcaaccaguucugcaucaaaauccugaacccauacaugcccucggucguggagacccuggagcagaugcagcgcaagcacgggggcaugcucgugcggaacccacugagcagaaacuccacacacgagauguacugggucucaugcggcaccgggaauaucguguccgccgugaacaugaccagccggaugcugcucaaccguuucacuauggcccaucggaaacccacguaugagagggacgucgaccugggcgcgggcaccaggcacguggccguggagcccgagguugcuaacuuggacaucaucgggcagcgcaucgaaaacaucaaacacgagcacaagucaacauggcauuaugaugaggacaacccguauaagacuugggccuaccacggaagcuacgaagugaagcccuccggcuccgcuagcagcauggugaacggcgucgugaagcuacugacuaagcccugggacgucauccccauggugacccagaucgcgaugaccgacaccaccccguuugggcaacagcgcguguucaaggagaagguggacacgagaaccccuaaggccaagcguggcaccgcccagaucauggagguuaccgccaaguggcuguggggauucuugagccggaacaaaaagccccgcaucugcacgcgggaagaguucacccgcaaggugcgguccaaugcggccaucggcgcaguguucguggaugagaaccaguggaacagcgccaaggaggccguggaggacgagcgcuucugggaucuaguccaucgggagcgcgaguuacacaagcaggggaagugcgcgacuuguguguacaacaugaugggcaagcgggagaagaaacucggcgaguucgggaaggccaagggcucacgcgccaucugguacauguggcugggggcccgguuccuggaguuugaggcccucggguucaugaaugaagaccacugguucagccgcgaaaauucccugagcgguguggagggcgagggccugcacaagcucggguacauccugcgggacaucuccaagauccccggcgggaacauguacgcggacgauacggccgguugggauacucgcauaaccgaagacgaccugcagaacgaggccaagauaaccgauaucauggagccggagcacgcccuccuggccaagucuaucuucaaacugaccuaccagaacaaggucgugcgggugcagcgccccgcgaagaacggcacgguuauggacguuaucucccggagggaccagcgcggcagcggccagguggggaccuacgguuugaacacauucaccaauauggaggcccaacugauccggcagauggaguccgaggggaucuucucgcccucggagcuggaaacgcccaaccucgccggccgcguccuggacuggcuggagaagcauggcgucgagcggcucaagcgcauggccauuagcggggaugacugcguugucaagccgaucgaugaccgguucgccgcggcacuuaccgcccugaacgacaugggcaaggugcgcaaggacaucccccagugggagcccuccaagggguggaacgacuggcagcagguuccuuucuguucgcaccacuuccaucagcucaucaugaaggacggcagagagaucgucgugccgugucgaaaucaggacgaguuggugggacgggcccgggugucucagggcgcgggcuggucccugcgggagaccgccugccucggcaagagcuacgcccagauguggcaguuaauguacuuccaccgacgggaccugcgccucgccgcaaacgcgauaugcuccgccgugcccguggauugggugcccaccagcaggacgacuugguccauccacgcacaccaccaguggaugaccaccgaggacaugcugagcgucuggaaccgaguguggaucgaggagaacccauggauggaggacaagacgcacauauccagcuggggugacgucccauaccugggcaagcgggaggaucaguggugcggcagucucaucgggcucaccgccagagcuacuugggcaaccaauauccagguggccauuaaccaggugcggcgccugauugguaacgagaacuacuuggacuacaugacgagcaugaagcgcuucaagaaugaguccgaccccgagggcgcccuuugguag

SEQ ID NO: 24504 - RNA, 9879 nt, Artificial Sequence
  derived and/or modified CDS sequence (opt11) from DENV-1__GU131806__SS-prME
agcgugaccauguuucugauguugaugccaacagcccuggccuuccaccugaccacccggggcggagagccacacaugaucguuagcaagcaggaacgggggaagagccugcuuuucaagaccagcgccgggguaaauauguguacccugaucgccauggacuuaggcgagcugugcgaggauaccaugaccuacaagugcccucggaucacagaaacugagcccgacgacguggacuguuggugcaacgccacggacaccugggucacuuacgguacaugcagccaaacgggcgagcaccggcgcgacaagcgguccguggcauuagcgccccacgugggccucgggcuggaaacccgcaccgagacuuggaugagcuccgagggugcguggaagcaaauccaacgggucgagacgugggcccugcgucauccgggguucaccgugaucgcccucuuuuuagcucacgcgaucggcaccucaaucacccagaagggcaucaucuucauccugcucaugcuggugacgcccuccauggcgaugaggugcgucggcauaggaagccgcgauuuuguggagggucucaguggcgccaccuggguggacguaguucucgagcacgggagcugugugaccacaauggccaaggacaagccgacacuagauaucgagcuucucaagaccgaagucaccaaccccgcggugcugcggaagcugugcaucgaagcaaaaauuagcaacaccacgacagauucccgcugucccacacaaggggaggcaacccugguggaggagcaagacgccaacuucgugugccggagaacuuucgucgaccggggguggggcaauggaugcggccuguucggcaaggggucccugaucacgugcgccaaguucaagugugugacaaaacucgaggggaaaaucguccaguacgagaaucugaaguauuccguaaucgugaccguccacaccggugaccaacaucaggugggcaaugagucaaccgagcauggaacaaccgccaccaucacgccccaggcacccaccaccgagauccaguugacugacuacggggccuugacgcuggauugcagcccgcgaacuggcuuagacuucaacgaaaugguacuccugacuaugaaggagaaguccuggcuggugcacaaacagugguuccucgaccugccgcuggcuuggacuagcggcgguucuacgucccaggagaccuggaaccggcaggaucucguggucaccuucaagaccgcccacggcaagaagcaagagguagugguacuggggucccaggagggggccaugcacaccgcucugaccggggccaccgaaauacaaacuucgggcacgaccacuaucuucgccgggcaccucaagugcaggcugaaaauggauaagcugacacucaagggcaugucauacgugaugugcacgggcuccuuuaaacuggagaaggaacuggcagagacucagcaugggaccguccucguacagauaaaguacgagggcaccgaugcaccuugcaagauccccuucagcacgcaggacgagaagggugugacccagaacggacgacugaucaccgccaauccaaucgugaccgacaaggaaaagccgguaaauauugaggccgaaccgccguucggcgaguccuauaucgugauaggagccggagagaaggcccugaagcugagcugguucaagaaggggucgagcaucggcaagauguucgaggccacggcccgcggugcccggcgcauggccaucuugggggacacagccugggacuucggguccauaggugggguguucaccucugucggaaaacuugugcaucagaucuuuggcaccgcguacggggugcuguucagcggcguaagcuggacgaugaagaucggcaucgggguuuuacugaccuggcugggacuuaacucccgcucgacaagccuuagcaugacaugcauugcuguggggcuggucacgcuuuaccugggcguaauggugcaggcggacagcgggugcgucauuaacuggaagggccgggagcuaaagugcgguagcgggaucuucgugacaaacgaggugcacaccuggaccgagcaguacaaguuccaagcugacucccccaagaggcucuccgccgcgauagguaaggccugggaggagggggucugcggaauccggucugccaccagauuggaaaacaucauguggaagcagaucucuaaugagcugaaccacauacuccuagagaacgauaugaaguuuacggugguggugggggaugucgcggggauccuggcccagggcaaaaaaaugauccguccgcagcccauggaguacaaguacucguggaaguccugggggaaggcgaagaucauuggcgccgacguucagaacaccacuuucaucauagaugggcccaacacacccgagugcccugacgaccagcgcgcuuggaacaucugggagguagaagacuauggcuuuggcaucuucacgacuaacaucugguuaaaguuacgggacuccuauacucagguuugcgaccaccgccugaugucggcagcgaucaaggacagcaaggcagugcaugcagacaugggguacuggaucgaguccgaaaagaaugagacuuggaaauuggcgcgggccagcuucauugaggucaagacguguaucuggcccaagucacacacccuguggagcaacggcgugcuagagagcgagaugaucauccccaagaucuaugggggcccuauaagccaacacaauuaucgcccugguuacuucacccagaccgcgggaccuuggcaucucgcaaagcuggagcucgacuucgaccuaugugagggcacgaccgugguuguggacgaacacugcggcaaccggggcccuuccuugcgcaccaccacggugaccgggaagaucauacaugaguggugcugccgcucuuguacccuuccgccccugcgcuuccggggcgaggacggaugcugguacggcauggaaauccggcccgucaaggagaaagaggaaaaccuggugaaguccauggugagcgcuggcagcggagaggucgacaguuuuagccugggguuacuuugcaucuccaucaugauagaggaggugaugcggagccgauggucucggaagaugcucaugacgggaacacucgcagucuucuuccuguuaauuaugggccaguuaacguggaacgaccugauacgcuuauguaucauggucggcgccaaugcgagcgaucgcauggggauggggaccacguaccuugcccuuauggccacguucaagaugcggcccauguuugccguggggcuccuguuccgccggcuuaccagucgcgaggugcuucuccugacaaucgggcuuucacucguagccagugucgagcuaccgaauucucuugaggagcugggcgacggccuggcgaugggcaucaugauccugaaacuccugaccgacuuccagagccaccagcugugggccacgcuccugagccugaccuucaucaagaccaccuuuagucuccacuacgccuggaagacgauggccaugguccugucgaucgucucauuguucccccucugccugagcaccacaucccagaaaacuacguggcugcccgugcuccuggguaguuuagggugcaagccccucacuauguuccugaucgcugagaacaagaucugggggcggcgcuccuggccgcugaacgaaggcauuauggccgucggaauugugagcauccuccugagcucccugcucaagaacgaugugccccucgccggcccccugaucgccggagggaugcucaucgcaugcuacgucaucagcggauccagcgcggaccugucgcuagagaaggccgccgaggugagcugggaggaggaggcugaacacagcggccccucacacaacauacucguggagguccaggacgacggcccaaugaagaucaaggacgaggagcgggacgauacccuaacaauccucuugaaggcaacccuacucgccguguccgggguuuacccccucagcauccccgccacccuguuuguaugguacuucuggcagaaaaagaagcagcgcuccggagugcugugggacacuccgagcccgcccgagguggagcgagccguccuagacgacggcaucuaccgcauaaugcaacggggucugcugggccggucccaggugggugugggcgucuuccaggagaacgucuuccacacuauguggcacguuacccgcggggcgguacugauguaccagggaaagcgucucgaacccagcugggccuccgugaagaaggauuugaucagcuauggcgggggcuggcgccugcaaggguccuggaauacgggcgaagagguccagguaaucgcgguggagcccgggaaaaacccgaagaacguccaaaccgcacccgguacauucaaaacccccgaaggcgaggugggggccauugcccuggacuucaagcccggcaccagcggguccccuaucguaaauagagagggcaagauccugggacuguacgguaacggcgugguuacgaccagcgguaccuacguuagugcaaucgcccaggcccgggccucccaagagggcccccuccccgaaaucgaggacgaaguguucaggaaaaggaaccugacaaucauggaucugcaccccgggucgggcaaaacccgccgguaccucccugccaucgucagggaggccaucaagcgcaaacugagaacucuaauccuagcacccacccgcgugguugcguccgaaauggcagaggcgcuuaagggaaugcccauccgguaccagacgacggcgguaaaaagcgagcauacggggaaagagaucguggaccugaugugccacgccaccuucaccaugcgucuccuguccccggugcgggucccaaacuacaacaugauaaucauggacgaggcccacuuuaccgaucccuccuccaucgccgcccgcgguuauaucucgaccagagugggaaugggcgaggcggcagccaucuucaugaccgccacgcccccgggguccguggaggccuucccccagagcaacgcgguaauccaggacgaggagcgcgacauccccgagcgcaguuggaacagcggguacgaguggaucacggacuuccccggcaaaaccgugugguucgugccguccaucaagagcggcaacgauaucgcuaacugccuacguaagaacggcaaacgggugauccagcugucccgcaagaccuucgacacggaguaucagaagaccaagaacaacgacugggauuacguggugaccacagacaucagcgagaugggagccaacuucagggcugaccgggucaucgacccacggcgcugccugaagcccgugauccugaaggacggccccgagagagugauccucgcaggaccaaugcccgugaccguggccuccgcggcucagcgccggggccgcaucggccgcaaucacaacaaggagggggaccaguacaucuacaugggccagccccugaauaaugaugaagaccacgcccauuggaccgaagcgaagauguugcucgacaacauuaacacccccgaagggaucauuccggcauuauucgagcccgagcgggagaagucggcggcgaucgauggcgaguauagacugcgcggggaggcccgcaagacguucgucgaauuaaugcggaggggcgaucugcccguguggcucuccuauaagguggcuucagagggcuuucaauacagcgaccggcgcuggugcuucgacggcgaacguaacaaccagguucucgaggagaacauggacguggagaucuggacgaaggagggcgagcgcaagaagcugaggccccgcuggcuagacgcccggacuuacuccgauccguuagcccuucgcgaguucaaggaguucgcagccgggagacgcagcgugaguggcgacuugauccuagagauuggcaagcugccccaacaccugacgcagcgggcccagaacgccuuggauaaccuggucaugcuacacaauucugagcagggcgggagagccuaccggcacgccauggaggagcuaccggacaccaucgagacgcugaugcuccucgcgcuuaucgccguccuaaccgggggcgugacccucuucuuccugaguggacgcggccugggcaagaccagcauuggguuacugugcgucauggcgagcagcguucuguuauggauggcaucgguggagccccacuggauagccgcgagcaucauccuggaguucuuccugaugguucuccugaucccggagcccgaucggcaacgcacgccacaagauaaccagcucgccuacgucgugaucggccuccuguucaugauccugacggucgcugccaacgagaugggacuucuggaaaccaccaaaaaagauuuaggcaucgggcacguggccguggagaaccaccaucaugcggccaugcuagacguggacuuacacccggccuccgccuggacccucuacgccguggcuacgacuaucauuacccccaugaugaggcauacuaucgagaacacgacggccaacaucagccucaccgcuaucgcgaaccaggccgcuauacugaugggacuggauaagggcuggccgaucuccaagauggacaucggaguucccuuacuggcacugggcugcuacagucagguuaacccgcucacgcugacggccgcaguacucaugcucguggcgcacuacgccaucaucgguccaggccugcaggccaaagccacccgggaagcccagaagcgcacggcggcggggaucaugaagaacccaaccgucgacggcaucguggccaucgaccuggaccccguggucuacgacgccaaguucgagaaacagcuagggcaaauaaugcugcugauacucugcacgucccagauucugcugaugcggaccaccugggcucucugugagucuauuacccuggcgacugggccgcuaaccacccucugggagggcucccccggcaaguuuuggaacaccacuaucgcagugagcauggccaacaucuuccgcggauccuaccuggcgggcgccggguuagccuucucucucaugaaaucccugggcgggggccgacgcgguaccggagcacaaggcgagacucugggggagaaguggaagcggcagcucaaccagcuguccaagucggaauucaacacuuacaagaggucaggcaucauggagguggaccggagcgaagccaaggaggggcugaaacgcggcgagacuaccaagcaugccgugucgcggggcacagcgaagcuccgcugguucguagagcguaaccuggugaaacccgaaggaaaggucauugaucugggaugugggcgcgguggaugguccuacuacugcgccggccugaaaaaggugacugagguaaagggcuauacgaaaggcggccccgggcacgaggagccgaucccuauggccacauacggcuggaaucucguuaagcugcacuccgguaaggacguguucuucaucccacccgagaagugcgacacccugcuuugugauauuggcgagagcuccccgaaccccaccaucgaagagggacggacgcuacgagugcugaagaugguagagcccuggcuuagagggaaccaguuuugcaucaagauccugaaccccuacaugccgucuguaguggagaccuuggagcagaugcagagaaagcacggggggaugcuaguccggaacccgcugucccgcaacagcacgcaugaaauguauugggucagcugcgggacggggaacaucgugagcgcuguaaacaugaccucccgaaugcugcucaaucgguuuaccauggcgcaccguaaacccaccuacgagcgggacguggaccugggcgcgggcacccggcacguggcagucgaacccgagguggccaaccuggacaucaucggacagcggauugagaacauuaagcacgagcauaaaagcacauggcacuacgacgaggauaaucccuacaagacgugggcguaccacggcucuuacgaggucaaaccaucuggauccgccuccucgauggugaacggcguagugaaacucuugacuaaacccugggaugugauccccauggugacucagaucgcgaugaccgacacaaccccguucggccaacagcgcgucuucaaagagaagguggauacccgcacccccaaggccaagcgcggcaccgcccaaauaauggaggugacggccaagugguuauggggcuuccucucccggaacaagaagccgagaaucugcacccgugaagaguuuacgcggaagguucggagcaacgccgcgaucggggcgguguuuguggaugagaaccaguggaacuccgccaaggaggcgguggaggacgaaagguucugggaccugguucaccgcgagcgagaacugcacaaacagggcaagugcgcaacuugcguguacaauaugauggguaagcgggagaagaaguugggggaauucgguaaggccaaggguagccgcgccaucugguacauguggcugggugccagguuuuuggaguucgaggcacuuggguuuaugaacgaagaccauugguuuucacgugaaaacagccugucaggugucgagggggagggccugcacaaguuaggcuacauccuccgggacaucagcaaaauuccaggcgggaacauguacgccgaugacacagccgguugggacacacgcaucaccgaagacgaccugcagaaugaggcccgcaucacggacauuauggagcccgagcacgcgcuccuggccaagagcauauucaaguugacauaucagaacaaggugguccggguccaacgccccgcaaagaauggcaccgugauggacguuaucagccggcgcgaccagcgggggagcggacaggucggcaccuacggucucaacacguuuaccaacauggaggcucaguugauccgccagauggaaagugagggcaucuuuucccccagcgagcuggagaccccgaaccucgccgagcgggugcuggacugguuagagaaauaugggguggagcguuuaaagcggauggccaucuccggcgacgacugcguagugaagcccaucgacgaccgcuucgcgacagcgcugacagccuuaaacgacauggggaaggugagaaaggauaucccccagugggagccaagcaaaggcuggaacgacuggcagcaaguaccguuuugcucucaucacuuccaccagcucauaaugaaggaugggagggagauugucgugcccugcaggaaccaggacgagcucguggggcgcgcccggguuagccagggcgccggguggagccugcgagagaccgcuugccucggcaagucuuacgcucagauguggcaauuaauguacuuccaccggcgcgaccugcgccucgccgccaaugcuaucugcagcgcaguccccguugauuggauccccacgucccgcaccacgugguccauucacgcccaccaccaguggaugacaaccgaggacaugcugucgguguggaaccgcguauggaucgaggagaacccguggauggaggacaaaacgcacaucucauccuggggugacguccccuaccugggcaaacgggaggaucaauggugcggaucccucauuggacugacggcacgcgccaccugggccaccaacauccagguggcgaucaaccaggugcggcgacuuaucggcaaugagaacuaccucgacuauaugacaucaaugaagcgcuucaaaaacgaaagcgacccagagggggcacugugguag

SEQ ID NO: 24505 - RNA, 9879 nt, Artificial Sequence
  derived and/or modified CDS sequence (opt11) from DENV-1__GU131807__SS-prME
agugugaccaugcugcucauguugaugcccacggcccuagccuuccaccucaccacccggggcggggagccccauaugaucgugucuaagcaggagcggggcaaaagccuguuauuuaaaacuagcgccggggucaacaugugcacgcuuaucgccauggaccugggugagcucugugaagauaccaugaccuacaaguguccgcgcaucacagagaccgagcccgaugauguggauugcuggugcaacgcaacugacaccuggguuacguacgggaccuguagccagacuggcgagcaccggagagauaagcgaagcguggcccucgcgccccaugugggucugggauuggagacccgcaccgagacauggaugagcuccgagggugccuggaagcaaauucagcggguugagaccugggcgcuccgucaccccggguuuaccgucaucgcgcuguuucuggcacacgcuaucggaaccagcaucacgcagaaggggauaaucuucauccuccugaugcuggucacgcccuccauggcuaugcggugcgucggcaucggaagccgcgauuucguagagggacucucgggggccacauggguggacgucguguuagaacacgggucaugcgugacgaccauggccaaggacaagcccacccuugacauugagcugcugaaacccgaggucaccaacccggccgugcugcggaaguugugcaucgaagcgaagauauccaauaccacuacagacucucgcugccccacccagggcgaagcgacccugguggaggagcaagacgcaaacuucguuugucggcgcaccuucguggaccggggcugggggaacggcugcgggcuguucggcaaggggagccugaucacgugcgcaaaguucaagugugugacgaaacuagagggaaagaucguccaguacgagaaccugaaguacagcgugauagugaccguccacaccggggaucagcaccagguggggaacgaguccacggaacacggcaccaccgcgaccaucacgccucaagcgccgacaacggagauccagcucacagacuacggugccuugacucuggacugcucaccccgcaccggccucgacuucaacgagaugguccuugugacaaugaaagagaaguccuggcucgugcacaagcaaugguuccucgaucuucccuuaccuuggaccagcggggcaaguaccucccaggagaccuggaaccggcaagaccuccuggucacauuuaagaccgcgcacgcgaaaaagcaggaagugguuguuuugggcagucaggagggcgcgaugcacaccgcccugacaggggcaaccgagauacagaccuccggcaccacgaccaucuucgccgggcaucugaagugccgccugaagauggacaagcuaacccugagggguaugagcuacgugaugugcaccggguccuuuaagcuggagaaggagguggcugaaacgcaacacggaaccgucuuagugcagaucaaguacgagggcaccgacgcucccugcaagaucccguucagcacccaggacgagaagggagugacgcagaacgggcgcuuaaucaccgccaacccuaucgucacugauaaggagaaacccguuaacauagaggcggagcccccguucggggaguccuacaucgucauuggggccggugagaaggcgcugaagcuaucaugguucaaaaagggguccagcaucggaaagauguucgaggccaccgcgcgcggggcccgccggauggccauccugggcgauacggcaugggacuucggauccaucggaggcguguucaccucaguagggaagcuggugcaucagaucuucggacccgccuacggaguucuuuucucgggggugucuuggcccaugaagaucgggaucggcguuuugcugaccuggcucggccucaacucccggagcaccagccugagcaugacgugcaucgccgucgggcugguuacucucuaccugggcgucaugguccaggcagauuccgggugcgugauuaacuggaagggccgcgagcuaaagugcgggagcggcaucuucgucaccaacgaggugcacaccuggacggagcaguacaaguuccaggcugauagccccaagcgccucuccgccgcgauuggcaaggcaugggaagagggcgugugcggcauccgcagcgccacccggcuggagaacauuauguggaaacagaucagcaacgagcuuaaccacauccuccuugagaacgauaugaaguucaccgucgucgugggggacguggcuggcauccuggcgcaagggaagaaaaugauacgaccgcagcccauggaguauaaguacagcuggaaauccuggggcaaagccaagaucaucggcgccgacguccaaaacacuaccuucaucauugacggacccaacacaccugaaugcccagacgaccagcgggccuggaacauaugggaagucgaggauuacggcuucggaaucuucaccaccaacaucuggcucaaguugagggauagcuauacccaggugugugaccacagacugaugagcgcugcuauaaaggacagcaaggccguucacgccgacaugggcuacuggauugaguccgagaaaaaugagacauggaagcuggcucgcgcgagcuucaucgaagugaagaccugcauuuggcccaagucccacacacuguggagcaacggcguucuggagagugagaugauaaucccuaagaucuaugggggcccaaucucgcagcacaacuaucggccaggauacuuuacccagacagcuggccccuggcaccucggcaaguuagagcuggacuucgaccucugcgaggggacaaccgucguaguggacgaccacugcggcaaccgcgggccuucucugaggacuacgaccgucacgggcaagaucauacaugaguggugcugccgcaguugcacccugccgccucuacgguuccgcggugaggacggcuguugguauggaauggaaauccggcccguaaaggagaaagaggagaauuuaguuaagucgauggucagcgcuggcagcggcgagguggauuccuucagccugggcuugcugugcauuaguauuaugauugaagaggugaugcguagucgguggucgcgcaagaugcugaugacgggcacccucgccguauucuuccugcuuauuaugggacagcucaccuggaacgacuuaauucggcuguguaucauggugggcgccaacgcgagugaccgcauggggaugggcaccacuuaucuagcccuuauggccaccuucaaaauucgcccuauguucgcaguuggucugcuguuucgucgccugaccucccgagaggucuugcuccuuacaaucgggcugagccucguggccuccguagagcugccgaacucguuggaggagcucggugacgggcuggcgauggggaucaugauccugaaacuccugacagacuuccagucccaccagcuaugggcuacccucuugagccugaccuuuaucaaaaccacuuucucguugcacugcgccuggaagacgauggccauggugcuaagcaucgugucccuguuuccccuaugccugagcaccaccucccagaagacuaccuggcugcccguucuccugggaucacuggguugcaagccccucaccauguuccuuaucgcggagaacaagauuuggggccgacguucauggccgcugaacgaggggaucauggccgugggcaucgugagcauccuccuuagcuccuuguuaaagaacgauguaccccuugcaggcccccuuaucgccggcggcauguugauagccugcuaugugaucaguggguccagcgcggacuugucccuggagaaggcugccgaagugagcugggaggaggaagcggagcacuccggggccagccacaauauacucguagaggugcaggacgacgggaccaugaagauaaaagacgaggagagggacgacacgcucacgauccuacuuaaggcgacccugcuggccguguccggcgucuacccgcucucaaucccugcuacccuguucgugugguauuucuggcagaagaaaaagcagaggucggggguauugugggauacccccuccccgcccgagguagaacgagccguccucgacgacggcaucuaccggaucaugcagcgcggccugcuggggcgcagucaggucggcgucgguguguuccaagagaaugucuuccacacgauguggcacgucaccaggggugccgugcucauguaccagggaaagcgacucgagccgagcugggcgucggucaagaaggaucugaucagcuacggagguggauggcgucugcagggcucguggaauaccggggaggaaguccagguuauugccgucgaacccggaaagaacccuaagaacguccagaccgcccccggcacguuuaagacucccgagggagagguaggcgccaucgcccuagacuucaagcccgggaccagcggcucccccaucguuaaccgcgaaggaaaaaucguuggcuuauacggcaacgggguggugaccacaagcggcaccuaugucucggcuaucgcccaggccaaggccucccaagaggggccgcugcccgagauugaggacgaagucuuccgcaagcggaaucucacuaucauggaccuacacccgggcagcgggaagacccggcgguaccugccugcgauaguuagggaggccauaaagcgcaagcuccggaccuugauccuggccccgacccgagucguugcguccgagauggcggaggcauugaaaggcaugccgauccgguaucagacaaccgccguaaagucugagcacacuggcaaagagauugucgaccuaaugugccacgccaccuucaccaugcgccugcucucccccgugcgggugcccaacuacaacaugaucauaauggacgaggcgcacuucaccgacccgagcuccaucgccgcucgcggguacaucagcacgcggguagggaugggggaggccgcugcuaucuucaugaccgcuacaccacccggcuccgucgaggccuucccgcagagcaacgccguaauccaggacgaggagcgcgacaucccggagcgguccuggaacucuggguacgaauggaucaccgacuuccccggcaagacgguuugguucgugcccuccauaaaguccgggaaugacauugcuaacugccugcgcaagaacgguaagcgggucauucagcugagccgcaagacuuucgacacagaauaccagaagacuaagaacaaugauugggauuacguggugacgaccgacauuagcgaaaugggagccaacuuccgggcggaccgcgucaucgaccccaggcgcugucucaagcccgucauccucaaggacgggccagaacgggugauucuagccggccccaugcccguuaccguagccucagccgcacagcgucgggggcgcaucggccgcaaccacaauaaggaaggcgaucaguacaucuacauggggcagccgcucaacaacgacgaggaccacgcacacuggaccgaagccaagaugcugcuggacaacauuaacacgcccgaaggcaucauccccgccuuauuugaaccugagagagagaaaagcgcugccaucgacggggaauaccggcugcggggcgaggcucgcaaaaccuucguagagcugaugcggcgcggggacuugccugucuggcugucauacaagguggcgagcgagggcuuccaauacagcgaucguagguggugcuucgacggagagaagaacaaucaggugcuggaggagaacauggacguugagaucuggaccaaggagggagagcggaaaaagcuccgcccucgguggcuggacgcccgcaccuacucggauccccuggcccuccgggaguuuaaggaguucgccgcggggcgccggucggucucuggagaccuaauucuagagaucgggaagcucccccagcaucucacgcagcgugcccagaacgcucuggacaaccucguuaugcugcacaacucggagcagggaggucgggccuaccgccacgcgauggaggagcugcccgacacaaucgaaacccuuauguugcucgcccucaucgcuguucugaccggaggggugacgcuauuuuucuugucagggcggggacugggcaagaccagcaucggucugcucugugugauggcauccagcguccugcuguggauggccucgguggagccucauuggauagcagccucaaucaucuuggaguuuuuccugaugguccuacugauaccggaaccagacaaacagcgcaccccgcaagacaaccaacuggcuuaugucguuaucgggcucuuauucaugauacugacaguagcagcuaacgagaugggccugcucgagacgaccaagaaggaccuggggaucggucaugucgcggucgagaaucaccaccaugcugcgaugcucgacguggaucuccacccugccucugccuggacccuauaugcggucgcaaccacgauuaucacgcccaugaugcggcauaccaucgagaacaccaccgccaacauuagccugacggccaucgccaaccaggcggccauccuuaugggccucgacaagggcuggccgauauccaagauggacaucgggguaccccuccucgcccuggggugcuacucacaggugaacccccugacccucacugcugcgguccugaugcugguggcucauuacgccaucaucggccccggucuccaggccaaagcgacccgcgaagcucagaagcgaacggccgccggcaucaugaagaacccaacuguggacgggaucgucgccaucgaccuggaucccgugguguacgacgcgaaguucgaaaagcaguuaggucagaucaugcuccugauccugugcaccucccagauucuccugaugaggacgacgugggcgcuaugcgaaagcaucacccucgccaccggcccccuuaccacgcugugggaggggucccccggcaaguuuuggaacaccaccaucgccguaucuauggccaacaucuuucgcgguagcuaccucgccggcgcuggccuggccuucucucucaugaagucccucgguggcgggcgucggggcaccggugcccagggcgagacccugggcgagaaauggaagcgccaacugaaccaacucuccaaaagcgaguucaauacuuauaagcgcuccggcaucauggaaguggaccggucagaagccaaagagggccuuaaacgcggggaaacaacgaagcacgcugugagucgcgggacggccaagcugagaugguucgucgagcgcaaccuagugaagccggaagggaaggugauagaccuaggcuguggcagagggggcuggagcuacuacugcgcuggucugaagaaagucaccgaggugaagggcuauaccaagggcggcccuggccacgaagaacccauccccauggccaccuauggguggaaccuuguuaaacuucauuccggcaaggacgucuucuucauaccacccgagaagugugacacauugcugugugacauuggcgagucuucgcccaacccuaccaucgaagagggccggacuuugcgcguguuaaagaugguggagccguggcugcgagggaaucaguucugcaucaagauccugaaucccuacaugcccagcgucguggagacccuggagcagaugcaacgcaagcacggaggaaugcucgugcgaaacccccuaucccgcaauagcacgcacgagauguauuggguauccugcgggaccggcaacaucguuagcgccgucaauaugacaucacggaugcuguuaaaucguuucacgauggcgcaccgcaaaccgaccuacgagagagacgucgaccucggggccgguacccgccacguggccguagagcccgagguugccaaccuggauaucaucggccaacggaucgagaacauaaaacacgagcacaagagcaccuggcacuacgaugaggacaaucccuacaaaaccugggccuaccacggguccuaugaggugaagcccuccggcuccgcaucuagcauggucaacgguguggugaagcuauuaaccaagccgugggacgucauuccgauggugacacagaucgcaaugacggacaccaccccuuucgggcagcagagaguguucaaggaaaagguugacacucggaccccgaaggccaagcgcgggaccgcgcagaucauggaggugacagcgaaguggcuguggggguuuuugucucggaacaagaaacccagaaucugcacgcgcgaggaguucacccgcaaggugaggucgaacgcggccaucggcgcggucuucguugacgagaaucaguggaacuccgccaaggaggccgucgaggacgagagguucugggacuuggugcaccgggaaagagaguugcacaaacaggggaagugugcaaccugcguguacaacaugaugggcaagcgugagaagaagcugggggaguucggcaaggccaaaggcagccgcgccaucugguacauguggcucggcgcccgauuccuugaguucgaagcacuuggcuucaugaacgaggaccacugguucucccgcgaaaacucauugagcgguguagagggcgaaggccugcacaagcuggguuauauccucagggauaucucuaaaauccccggagguaauauguacgcugacgacaccgccgggugggacacgcgcaucaccgaggacgaccugcagaacgaagccagaaucaccgauaucauggagcccgagcacgcccugcuugcgaagucgaucuucaagcugaccuaucagaacaaggucgugagggugcaacgaccggcuaagaaugggacggucauggacguuaucucucggagagaccagcgaggaagcggccaggugggcaccuacggccugaacacuuucaccaauauggaggcccagcucaucaggcagauggagagcgaagguaucuucuccccuagugagcuggaaacaccaaaccuggccgaacgggucuuggauuggcuggagaaauacgggguggagcggcuuaagagaauggccauuuccggggacgacugcguuguaaaaccuaucgacgaccgauucgcgacagcccucaccgcccugaacgauaugggaaaagugcggaaggacaucccgcagugggaaccgagcaagggguggaacgacuggcagcaaguccccuucuguagccaucacuuccaccagcugaucaugaaagacggccgcgagaucguaguacccugccggaaccaggacgagcucgugggccgcgcccgggucagucaaggggccggguggagccugcgcgagaccgcgugccuugggaaguccuacgcccagauguggcagcucauguacuuccaccgccgcgaucugagguuggccgcuaaugccauaugcuccgccgugccuguagauuggauccccacauccaggacuaccuggagcauccacgcccaucaccaguggaugacaacugaggauaugcucuccgucuggaaccggguguggaucgaggagaacccauggauggaggacaaaacgcacaucuccuccuggggcgacgugcccuaucucggcaagcgcgaggaccagugguguggcagccugaucgggcuuacugcccgcgccaccugggcaacaaacauacagguggccaucaaccaggugcggcgccugaucgggaacgagaacuaccuggauuauaugaccucgaugaagcgguucaaaaaugagagcgacccagaaggugcgcucugguga

SEQ ID NO: 24506 - RNA, 9879 nt, Artificial Sequence
  derived and/or modified CDS sequence (opt11) from DENV-1__GU131811__SS-prME
agcgugaccaugcugcuaaugcugaugcccacugcccuggccuuucacuugacaacaagaggaggugagccacacaugauagugucgaagcaggaacgggguaaaagccugcucuuuaagaccuccgcggggguuaacaugugcacucucaucgccauggaccugggcgaauuuugugaagauacuaugaccuacaaauguccccgcaucaccgaagcugaacccgacgacguugacuguugguguaacgcuaccgacacgugggugacuuauggcaccugcucccagaucggugagcaccggcgcgacaaacguucgguggcccucgcaccucacgugggccucgggcuggagacgcguacugagaccuggaugagcagcgagggcgccuggaagcagauccaacggguggaaaccugggcccugcgucacccggguuuuacggugaucgcacucuuucuggcccacgccauugguacaagcaucacccagaaggggauaaucuucauucugcucauguuagugacccccuccauggcgaugcggugcgucgguaucggaagccgcgacuucguagagggacuuaguggcgccaccuggguagacgucguacucgagcacggaagcugcgugacgacuauggcgaaggacaaacccacgcuugacaucgagcuacuuaaaacggaagucacuaaccccgcggugcugcggaaacuguguaucgaagccaagauuuccaacacaaccaccgacagccgcuguccgacucagggcgaggccacccuaguggaagagcaggacgccaacuucgucugucgccguaccuucgucgaccgcggcugggggaacgguugugggcuguucggcaaggggucccuaaucacaugcgcaaaauucaagugcgugacgaagcucgaaggaaagaucguucaauaugagaaccugaaguacaguguuaucguuaccgugcacaccggcgaccagcaccaaguuggaaaugaguccacggagcaugguacgaccgcgacuaucacgccacaggcaccaucgaccgaaauccagcugacggacuacggggcccucacccuggacugcagcccccggacaggccuugacuuuaacgagauggucuuacugacuaugaaagaaaaguccuggcuagugcacaaacagugguuccucgaccuaccgcugcccuggacuagcggggccucaaccagucaagagacuuggaaccggcaggaccuccuuguaaccuuuaagacggcgcaugcgaaaaagcaggaggucguuguccugggcucccaggaaggagccaugcacacugcgcucacuggagccaccgagauccagacgucuggcaccaccacgauuuuugcugggcauuugaaaugucgccuaaagauggauaagcuuacgcugaaaggcauguccuaugugaugugcaccggcagcuucaagcucgagaaggagguggccgaaacccagcacggcaccguguuaguccagauaaaguacgagggcacggacgccccuuguaagauccccuucucuacccaggacgagaagggggugacccaaaauggacggcugauuaccgcaaacccgaucgugacggacaaagaaaagccugucaauaucgaggccgagccgccguucggggagagcuauaucgugaucggggucggcgaaaaggcgcugaagcuguccugguucaagaaagguagcagcaucggcaaaauguucgagaccacagcgagaggagcaagacgcauggcaauccucggugauacagcuugggacuuugggagcauaggcggugucuucacgucaguagggaaacuggugcaccagauuuucggaaccgcguacgggguucuguucaguggcguuaguuggaccaugaaaaucggaauuggggugcuccugacuugguuaggguuaaauagccgcuccaccagccuauccaugaccuguaucgccgugggacuggugaccuuauaccugggcgugaugguccaggccgacagcgguugcgugaucaacuggaagggccgggagcugaagugugggagcggcaucuuugugacgaacgaaguccacacuuggacggagcaauacaaauuccaggcugacucccccaagagacucagcgcugcgauuggcaaagccugggaagagggcgucugcggcauacggagugcaacccgccuagagaacaucauguggaaacaaaucagcaacgagcuuaaccacauacuacuggagaacgacaugaagcuaacaguuguggugggggacguggccggaauccucgcccaggggaagaagaugauccggccccagccuauggaauauaaguauucauggaaguccuggggcaaggcuaagaucaucggcgccgauguucagaauaccacguuuauaaucgacgggccgaacacccccgagugccccgacgaccaacgcgccuggaacauaugggagguagaggacuauggauuuggaaucuuuaccaccaacauauggcuuaaguugcgggauuccuacacacaggugugugaccacagacucaugagcgcggcgauuaaagauuccaaggccgugcacgccgacaugggguauuggaucgaaagcgagaaaaacgagacguggaagcuggcccgggccuccuucauugaagugaagaccugcaucuggcccaagagccacacauugugguccaacggaguguuggagagcgagaugaucauccccaagauuuacggaggcccgauuucccagcacaacuaucgcccuggcuacuucacgcagaccgcuggccccuggcacuuagguaaguuggaguuagacuucgaccucugcgagggcacuaccgucguggucgacgagcacugcggcaaucgcgggcccagccugcgcacgacuaccgucacaggcaaaaucauccaugaguggugcugccgguccugcaccuuacccccccuccgauuuaagggggaggauggcugcugguacgggauggagauucggccuguaaaggaaaaggaggagaacuuagucaagagcauggucucugcuggauccggcgagguggacagcuucucccucgggcuuuuaugcaucagcaucaugauagaggaaguuaugcgcagucgguggagcaggaagaugcucaugaccggcacccuggccgucuucuuccugcucaucauggggcagcucacuuggaaugaccugauccgccucugcaucauggugggcgccaacgccuccgaccgcaugggcauggggacaacauaccuggcgcugauggcgaccuucaagaugcgcccgauguuugccgucggccuccuauucagacgccucaccucccgggaagugcuccugcugacuauaggguuaucccugguagccucuguugagcugccgaacucgcuugaggagcugggugauggccuggccaugggcaucaugauccucaagcugcugaccgauuuucaaagccaccagcucugggcgacucuacuuuccaugaccuucaucagaacuacuuucuccuugcauuacgcguggaaaaccauggccaugguucuguccaucgugucguuguuuccacucugccuguccaccacaagccaaaagaccaccuggcugccaguccuccuggguucacucgggugcaagccgcuuaccauguucuuaaucgccgagaacaaaaucuggggacgcaaauccuggcccuuaaacgaggggauuauggcggugggaaucgugagcauccugcuaagcagccugcuaaagaaugacgugccccuggccgggccccugaucgccgguggcaugcucauagccuguuacgugaucuccgggagcuccgcugauuugucacuggagaaagcggccguagucagcugggaggaggaggccgagcacagcggggccucucacaauauccuuguggaggugcaggacgacgggacaaugaagaucaaggaugaggaacgcgacgacacgcugacuauucugcugaaggcaacucugcuggcggucagcggcguguacccucucaguauaccggccacccuguucgucugguacuucuggcagaagaagaagcagcgcagcgggguccugugggacacgcccagcccacccgagguggagcgcgccguucucgacgauggcaucuaccggaucaugcagcgaggucugcuuggccggagccaggucgggguggguguuuuccaggagaacgucuuccacaccauguggcacgugacccgcggcgccguccuuauguaucaggggaagcggcuugaacccucuugggccagcgucaagaaggaccugaucuccuacggcggcggauggcgccugcagggcucguggaacacaggagaggagguccaggugaucgcugucgaacccgggaagaacccuaagaacguucagaccgccccgggaaccuuuaaaaccucugagggcgaagugggagccaucgcccucgacuucaagcccgggacaucgggcagcccuaucgucaaccgggagggcaaggugguaggccuguaugguaacggggucgugaccaccucuggcaccuaugugagcgccauagcgcaggcaaaggccucccaggaggggccccuuccggagaucgaggacgaggucuuccgaaagcgcaaucucacuauuauggaucugcaucccggaagcgggaagacgagacgguauuugcccgccauugugcgcgaagcuaucaaacggaaacuccgaacuuugauacuagcccccaccagaguggucgccagugaaauggccgaggcacucaagggaaugccuauccgguaucagaccacggcggucaagagugagcacaccgggaaggagauagucgaccugaugugccacgccaccuucacuaugcgccuguugucccccguccgagugcccaacuauaauaugaucaucauggaugaggcacacuucacggaccccuccuccaucgcagcccgcgguuacaucucuacccgggugggcaugggcgaggcugcggcgaucuucaugacggcuaccccaccgggcucggucgaagccuucccccagagcaaugccgucauacaagacgaggaacgcgauaucccagaacgguccuggaacagcggguaugaauggauuaccgacuuccccgggaagaccgugugguucgucccguccaucaaguccgggaacgacauugccaacugccugagaaaaaauggcaaacgggugauacaacucucccgaaaaaccuuugacacugaguaccagaaaacgaagaacaacgacugggacuacgucgucacgaccgacaucagcgagaugggcgccaauuuccgcgccgaccgcgugaucgacccgcggcgcugccucaagccggucauccugaaggacgggcccgagagagugauccuagcggguccaaugcccgugaccgucgcuuccgcugcccagcgucgagggaggaucggccggaaccacaacaaggagggcgaucaguacaucuauauggggcaaccgcucaacaacgacgaggaucacgcccacuggacggaggcgaagaugcuacuggauaacaucaacacuccugagggcaucauucccgcccuauucgagcccgaacgcgaaaagagugccgcuauugacggggaguaucgccugcggggcgaggcccgaaaaaccuucguggagcuaaugcgucguggagacuugccgguguggcuguccuacaaggucgcuuccgaggguuuccaauacagcgaccgucgcuggugcuucgacggagagcggaacaaccaagugcuggaagagaauauggacguggaaaucuggaccaaagagggggagcgcaaaaagcuccggccccgauggcuugacgccagaacguacuccgauccccuggcccuccgagaguuuaaggaguucgccgcggguaggagaagcgucuccggggaccugauccuagagaucggcaagcucccacagcacuugacccaacgcgcgcagaacgcguuagauaacuuggugaugcuccacaacagcgagcagggagggcgcgcauaccggcacgcaauggaagagcugccggauaccaucgagacccucauguuacuggcgcuuauagccgugcugacgggcggggucacccuguucuuucucuccggccgcggacucggcaaaacgaguaucggacugcucuguguaauggcauccagcgugcuccuguggauggccuccgucgagccacacuggaucgccgccagcaucauacuagaguucuuucugaugguacugcucaucccugagccagacagacaacgcaccccgcaagauaaccaguuagccuacguggucauagguuuacucuucaugaucuugaccguugccgcgaacgagaugggauugcucgagaccaccaagaaggaccuggggaucggccacguggccguugagaaccaccaccacgcagccaugcuggaugucgaccuccaucccgccucugccuggacacuguacgccguggcgacuacgaucauaacccccaugaugcggcacacaaucgagaacacaacagccaacaucagucucaccgccauagcuaaccaggccgccauacugaugggacuagacaaaggguggccgauuuccaagauggauauaggggucccuuuacucgccuuagggugcuauucacaggugaauccccugacccucacagccgcaguuuuaauguuagucgcccacuacgccauuauaggacccgggcuccaggccaaggcgacgcgcgaggcccagaagcgaaccgcggccggcaucaugaagaacccgaccguggaugguauaguggccaucgaccucgacccggucguuuacgaugccaaguucgagaagcaguuaggccagaucaugcuacugauccugugcaccucccagaucuuacugaugcguacgaccugggcguuaugcgagucaaucacccucgcgacgggaccccucaccacccugugggaggggucucccggcaaguucuggaauaccacgauugccgugagcauggccaacaucuucagggggagcuaccucgccggcgccggccuggcuuucagucugaugaaaucacucgggggcggccggcgcggcacgggcgcucagggcgaaacucuuggcgaaaaguggaaacgucagcugaaccagcuuuccaagagcgaauucaacacauacaaacgguccggcauuauggaaguagacagguccgaagcgaaggaaggccugaagcgaggggaaaccacgaaacaugccgugagccgugguaccgcgaagcugcggugguucguugaaaggaaccucgucaaaccggagggaaaagugaucgaccugggcugcggccgcgggggcuggagcuacuacugcgccgggcucaagaaggugacagagguuaagggcuacaccaaaggcgggcccggccacgaagagcccaucccgauggccacuuacggguggaacuuggugaagcuacacuccgggaaagauguguucuucaucccccccgagaaaugugacacccuccugugcgauauuggggagucgucgcccaacccuaccauugaagagggccggacccuccgcguccuaaagauggucgagcccuggcugcgugggaaccaauuuugcaucaagauccuaaaccccuacaugcccucggucgucgaaacgcuggagcaaaugcaacgcaagcacgggggcaugcugguccggaacccuuugagucgcaauagcacacacgaaauguacugggugucgugcgguacggggaacauagugagcgccgugaacaugacgagccgaaugcugcuaaaccgcuuuaccauggcgcaucgcaaaccgacauacgagcgggacguggaucucggggcgggcacccgccacgucgccguggaacccgaggucgccaaucucgacauuaucggucaacggaucgagaacauaaagcacgagcacaaaagcacguggcacuaugacgaggacaacccauacaagacgugggccuaccacggguccuacgaggucaagccaucaggcucugcaucuaguauggugaauggggucgugaagcugcuaacaaaaccgugggaugugauccccauggucacccagaucgcaaugaccgauaccacgccauucggacagcagcgcguguucaaggaaaagguggacacccggacucccaaggccaagcgcgggaccgcgcagaucauggaagucaccgcuaaguggcucuggggcuuccugucgcgaaacaagaagccgcgcaucugcacccgggaggaguucacccgcaaaguacgaagcaacgcggcgaucggcgccguguucgucgaugagaaucaguggaauucagccaaggaggccguagaggacgaacgcuucugggaccucguacaucgcgagcgcgaacugcacaagcaggggaagugcgcgaccugcgucuauaacaugauggguaagcgggagaaaaagcugggggaguuugggaaggccaaaggaagccgcgcaauaugguacauguggcuaggcgcccgguuccuggaguucgaagcacugggcuucaugaaugaagaccacugguucucccgcgagaacucgcugagugggguagagggagaggggcugcacaagcugggcuacauccugcgggacaucagcaagauccccggcggaaauauguacgcugacgacacggcgggcugggacacccggauaaccgaggacgaucugcaaaacgaggccaagauuacggacaucauggagcccgaacacgcacuccuugccaaguccaucuucaaacuaacguaccagaacaaggucgucaggguacagcgccccgcaaagaacgggacuguaauggacgucaucucucggcgcgaccagaggggguccggccagguaggcaccuacggucugaauacguucacgaacauggaggcccaguuaauucggcagauggagagcgaggggaucuucagcccgagcgagcuugagacccccaaucuggcugggcgcgcucuugacuggcuggagaaacacggaguagagcggcugaagcguauggccaucucuggcgaugacugcgucguuaaacccauugacgacagauuugcgaccgcccuaacggcguugaacgauaugggaaaagugcggaaagacaucccgcaaugggagcccagcaagggcuggaacgauuggcagcagguccccuucugcucucaccacuuccaccaacugaucaugaaggacggccgggagauaguggugcccugcaggaaucaggaugaacuugucgggcgggccagaguaucccaaggggccggguggagcuuacgggagacggcgugucuuggaaagaguuacgcacagauguggcaacucauguauuuccaccgucgggaucucaggcuggccgccaacgcaauuuguagcgccguuccugucgacugggucccuaccucccgaacuaccugguccauccacgcccaccaucaauggaugacgaccgaagacaugcucuccguguggaaccgugucuggaucgaggagaaccccuggauggaggacaaaacccacauaaguagcuggggggacguaccauaccugggcaagcgggaggaucaaugguguggcucccugaucggucucacugcccgcgcuacgugggccaccaacauccagguggccauuaaccagguccgccggcugcuugguaacgagaacuaccucgacuacaugacuucuaugaagagauucaagaacgagucugaucccgagggggcccugugguga

SEQ ID NO: 24507 - RNA, 9882 nt, Artificial Sequence
  derived and/or modified CDS sequence (opt11) from DENV-1__JF937615__SS-prME
agcguuacuaugcugcucaugcuaaugcccaccgcccuggccuuccacuuaaccacccgugguggugagccccacaugaucgugucgaagcaggagcgcggcaagagccugcuguucaagaccucggccggggugaacaugugcacauugaucgcgauggaccugggcgaguucugcgaggacacuaugaccuacaagugcccccggaucaccgaggccgagcccgaugauguggacugcugguguaacgcgacugacacaugggugaccuaugggaccugcagccagaccggugaacaucgccgggacaagagaaguguagcuuuagcgccccacguaggccucgggcuggagacccgcaccgagacauggaugaguuccgagggcgccuggaagcagauucagcgggucgagaccugggcucugcgucaccccggcuucacggugaucgcccucuuucucgcgcacgccauuggcaccagcaucacccaaaagggcaucaucuucaucuuacuaaugcuggugacccccuccauggccaugcggugcguugguaucggcagccgugauuucguggaagggcuguccggagccacguggguagacgucguccucgagcacgguaguugcguaaccaccauggccaaggacaagcccacccuggacaucgagcugcuaaagacagagguaaccgacccagccgucuugcggaagcugugcaucgaggccaaaaucagcaacacaaccacggacagccgauguccaacacagggcgaggcaacgcucguggaagaacaggacgccaacuuuguuugccggcggacuuuugucgaccggggguggggcaacggcugcggcuuguucggaaaggggucccugaugacgugcgcuaaguuuaagugcgugaccaaguuggaaggcaagaucguccaguaugagaaucugaaguacagcgucaucguaacgguccacaccggcgaccagcaccaaguagggaaugagucuacugagcacggcaccaccgcaaccaucacgccccaggcuccuagcacggaaauucaacucacggacuauggggcccucaccuuggacuguucuccccgcaccggucuggacuucaacgagaugguccugcugacgaugaaagagaagucauggcuuguacacaaacagugguuccucgaccugccgcugcccuggacgagcggagccuccacaagucaagagaccuggaauaggaaggauuuacuagugacauucaagaccgcccaugccaagaaacaggaggucguggugcugggcagccaggaaggcgccaugcacaccgcucucaccggagcaacggaaauacaaaccuccgggaccaccacaaucuucgcgggccacuuaaagugcagacucaagauggacaagcucaccuuaaagggcaugagcuacgugaugugcacugacucauucaagcuggagaaggagguggcugagacucagcacgggacgguguuaguucagaucaaguacgaagggaccgaugcaccgugcaagauuccuuucuccacccaggacgagaagggaguuacucagaauggacggcugaucacagccaaccccaucguaaccgacaaggaaaagcccgucaauaucgaggcugagccgcccuucggcgagaguuacaucgugaucggggcgggagagaaggcccugaagcugucaugguucaaaaagggcucguccaucggcaaaauguucgaagccaccgcccgcggcgcucggcgcauggcuauauugggggacaccgcaugggacuucggcagcaucggaggaguauucacauccguuggaaagcuggugcaccagauauuugggaccgccuauggcguacuguucagcgggguuuccuggacaaugaagauagguauugguguucuccugacuuggcuuggacuaaacagccgcuccacgucgcuuagcaugaccugcaucgccgucggucuagucacgcucuaccugggggucauggugcaggcggacuccggcugcgucauuaacuggaagggucgggagcugaagugcgggucggggaucuuugugaccaacgaggugcacacguggaccgaacaguacaaauuccaagcggacagcccgaagcgccucucagccgccaucggcaaggcgugggaggaaggugugugcggcauccgguccgccacccgccuagagaacaucauguggaagcagaucuccaacgagcugaaccacauccuacuagagaaugauaugaaguucacagugguggucggggaugucgcggguauacuggcccagggcaagaagaugauacggccccagcccauggaauacaaguacuccuggaaauccugggguaaagcuaaaaucaucggcgccgacgugcaaaacacaacguucauaaucgacggccccaacaccccggagugcccugacgaucaaagggcauggaacaucugggaaguagaggacuacggguucggcaucuuuaccaccaacaucugguugaagcugcgcgacuccuacacccaggucugcgaccaucgcuugaugagugccgccaucaaggacaguaaggccguacacgccgacaugggguacuggaucgagagcgagaaaaacgagaccuggaaguuggcgcgggccagcuuuaucgaggugaagacuugcaucuggccgaaaagccacacccuguggagcaacgggguguuagaaagcgagaugaucauccccaaaaucuacgggggacccaucucccaacacaacuacaggcccggcuacuucacgcaaaccgccgggccuuggcaccucggcaagcuggagcuugacuucgaucucugcgaagggaccaccgugguagucgacgaacacugcggaaacagaggcccgagccuucgcaccaccaccgugacugggaagaucauccacgaguggugcugccgguccuguacgcugccgccccugagguucaagggagaggacggcugcugguacggaauggagauccgacccguuaaggaaaaggaggagaacuuagucaagagcauggugagcgccgguuccggugaggucgacagcuucucucugggccugcugugcauuagcaucaugaucgaggaagugaugcgcucccguuggucucgcaaaaugcugaugacagggacccucgccguuuucuuucugcugaucaugggacagcucaccuggaacgaccugauccggcugugcaucauggucggagcgaacgccuccgaucggauggguauggguaccaccuaccucgcccugauggccaccuuuaagaugcgcccuauguucgccgugggccuccuguuccggagacugaccaguagggagguguuacuccugacgaucggccucucucucguggcgagcguagagcugcccaacucccucgaggagcucggcgacggccuggcgauggggaucaugauucugaagcucuugaucgauuuccagucacaccaacucugggccacccuccugaguuuaacuuucaucaagaccacguuuagccuccauuaugccuggaaaaccauggcgaugguccugucaaucgugaguuuguucccccuccugcccgugcaugaccugccaaagaagacuaccuggcucccaguccuguuaggcucccuaggcuguaagccccuaacgauguuccugauagccgagaacaagaucuggggucgcaagagcuggccccucaaugaggguauuauggccguggggaucgugaguauccugcuuagcgcccuccuaaagaacgacgugccgcuggcaggcccccucauagccggcggaaugcuaaucgccugcuacgugaucagcggaucauccgccgaccuaucccucgagaaggccgccgaggugagcugggaagaggaagcggagcauuccggggccagucacaacauucuagucgagguccaagacgacggcaccaugaagaucaaggacgaggagcgggaugacacgcuuaccauccuccugaaggccacgcugcucgccgucuccgggguuuacccccugagcaucccugccaccuuguuugugugguacuucuggcaaaagaagaagcagcguuccggcguguugugggacaccccuucaccccccgaagucgagcgggcuguguuggaugacgguauauaucgcaucaugcagcgggggcugcuggggcgcucccaggugggggucgguguuuuucaggaaaacguguuucacaccauguggcacgucacccgcggugcuguacucauguaccagggcaagcgguuggagccaucuugggccuccgugaaaaaagaccugaucagcuacgggggcggcuggcggcuacaagguucuuggaacacgggagaggagguccaggugaucgccguggagcccgggaagaaccccaaaaacguccagaccgccccggguaccuucaagacuucggagggggaggugggggcgaucgcccuggauuucaaacccggcacauccgggagcccgaucgucaacagagagggcaagaucguaggccuguauggcaauggcguagugaccaccucugggacuuauguaagcgccaucgcucaggccaaggccagucaggagggccccuuacccgagauagaggacgaggucuuucggaaacguaaccugacgaucauggaucugcacccgggguccggaaagacccggcgcuaucucccagcgauugugcgcgaggcaaucaagcguaagcugcggacccugauccuggcccccaccagagucgucgcgagcgagauggcagaggccuuaaaggggaugcccauccgcuaccaaacgaccgccgugaagagugaacacaccggcaaagaaauagucgaccugaugugccaugccaccuuuaccaugcggcuacugagcccgguacgcgugcccaauuacaacaugaucauaauggacgaggcgcacuucacggacccaucgucgauugcggccagaggcuauauuagcacacgcgucggcaugggugaagccgcagcgaucuucaugaccgcaacgcccccagggagcguggaggcguucccccaguccaaugccgugauccaagacgaggagcgggauauccccgagagaucauggaauucuggcuaugaguggaucacagacuuccccgggaagacggucugguuugugccguccauaaaauccggcaacgacaucgcgaacugucugaggaagaacggcaagcgcgugauccagcuaagccggaaaaccuucgauacggaguaccagaagaccaaaaacaacgacugggacuacgucgugaccaccgacaucucggagaugggggccaacuuccgcgcggaucgggugaucgacccccgacgaugccugaagcccgugauauugaaagacggcccugagcgcgugauccuagccgggccaaugcccgucacgguggccagcgcggcccagcggcgaggucggaucgggcguaaccacaacaaggagggagaucaguacaucuacaugggccaaccacugaacaaugacgaggaucacgcacacuggaccgaggcgaagaugcugcucgacaacauaaauaccccagagggcauaauuccagcgcuuuucgagccggagcgggaaaagucugcggccauagacggcgaguaccgccugcgaggagaagcgcggaagaccuucguggagcuuaugagacggggugaccugcccguguggcuuagcuacaaaguggccuccgagggguuucaauauucagaccgccgcugguguuucgacggcgagcgcaacaaucagguguuagaggagaacauggacguugaaaucuggacgaaggagggcgaacggaaaaagcuccgcccccgguggcuugaugcccgcaccuacagcgacccgcucgcgcugcgagaguucaaggaguucgccgcuggccgccguuccgugagcggcgacuugauacucgagauaggaaagcugccccagcaccugacccaacgcgcucagaacgcgcucgacaaccuagugaugcugcacaacuccgagcagggcggccgggccuaccgccacgccauggaggagcuccccgauaccauugaaacucugauguuccuggcacuaauagccguccugacaggaggcguaacccuguucuuccucagcgggcggggccugggcaagacaucaaucggccugcuuugcgugauggcgaguaguguccuccucuggauggcaaguguggagccgcacuggaucgcggccuccaucauccucgaguuuuucuuaaugguguuauugauuccggagcccgaccggcaacgaacaccccaggacaaccagcuggccuauguagugaucggccuacucuucaugauacugaccguggccgccaacgagauggggcugcuggagaccaccaagaaggacuuagguaucgggcacgucgccguggagaaccaccaucacgccgcuaugcuggacguggaccuccauccggcuagcgcguggacccuguacgccgucgccacgaccaucaucacccccaugaugagacacaccaucgagaacacgaccgccaacaucucccugaccgcgauugccaaucaggcggccaucuuaaugggccuggacaagggguggcccauuagcaaaauggauaucggcgugccccugcucgcacugggcugcuacucccaggugaacccucuaacccuuacggccgcgguccucaugcugguugcccacuacgccaucaucgggccaggccuccaagcgaaggccacucgagaggcacagaagcgcaccgccgcagggaucaugaagaaccccaccgucgaugguaucgucgcaauagaccuggacccggugguguacgacgcgaaguucgagaagcagcugggccagaucaugcuucugauccugugcacgucacaaauccuccugaugcgcaccaccugggcccugugcgaguccaucacccucgccacuggcccgcugaccacacugugggaaggcagucccggaaaguuuuggaauacaacgaucgcaguguccauggcgaauauuuucagaggcagcuaucuagccggggccggccuggccuucagccugaugaagucccucggcggaggccggcgggggacuggggcgcagggggagacccucggagagaaguggaagcgccaacugaaucagcucucuaaguccgaguucaacaccuacaagcggucagggaucauggagguggaccgcucggaggccaaggagggucuaaagagaggcgagacgaccaagcacgcugucagccgcgggacagccaagcugcggugguucgucgagcgcaaccuggugaagccagaggggaaagugaucgaccugggguguggccggggcgggugguccuacuauugcgccggucugaagaaaguaaccgaggugaaaggguacacgaagggcgggccuggacacgaggagccaauccccauggcgacuuacggcuggaaucuggugaagcuccacagcgggaaggacgucuuuuucaucccgccggagaagugcgauaccuugcuaugugacauaggcgaaucaaguccaaacccuaccauagaggaagggagaacgcuccgagugcugaaaauggucgagcccuggcugcgugggaaccaguucugcaucaagauccuuaaccccuacaugcccagugucguggagacacuggagcaaaugcagcggaagcacggaggcaugcuagugcgcaacccccucucacggaacuccacccacgagauguacugggucagcugcggcaccggcaacaucguguccgccguaaacaugacuagccgcaugcuucuaaacagauucacgauggcccaccgcaaacccaccuacgagcgcgauguggaccucggugccgguaccaggcacguagccguggagcccgaggucgcgaaccuggacauaaucggccagcgcaucgagaacaucaagcacgaacacaagaguaccuggcacuacgacgaggacaacccguacaagacgugggccuaccacggcagcuacgagguaaagcccuccgggagcgcuuccaguauggugaacggcguggugaagcuccucacaaagcccugggacgucaucccuauggucacgcagaucgcgaugacagacacgacucccuuugggcagcaacggguguucaaagagaaggucgacaccaggaccccuaaagccaagcgaggcacugcgcaaauuauggagguaaccgccaaguggcuauggggguucuugagccgcaacaagaagccccggaucugcacuagagaggaguucacccggaaggugcguucaaaugcagcgaucggagcggucuuugucgaugagaaccaguggaacucggcuaaggaggcaguggaggaugaacgguuuugggaccugguccaucgcgagcgggagcugcacaagcaggggaagugcgccacuugcguguacaacaugaugggaaaacgugagaaaaagcugggcgaguuuggaaaagcaaaggguagucgggcaaucugguacauguggcuaggggcgcgcuuucuggaauuugaagcgcugggcuucaugaacgaggaccacugguucagccgggaaaacucauuauccggcgucgagggggagggacuacacaagcuuggguacauccuucgcgauauuucaaagauuccuggugggaacauguacgccgaugacaccgcgggcugggacacccggauaaccgaggacgaucuccagaacgaggccaagaucacggauauuauggagccagagcacgcccugcuugcgaaguccaucuucaagcugacguaccagaacaagguugugcgcguacagagacccgccaaaaacggcaccgucauggacgugauuucccgcagagaccagcgugggagcggccaggugggcaccuauggccucaacaccuucaccaacauggaggcccagcucauacgccagauggagucugaagguauuuucagccccucggaacuggagaccccgaaccuggcgggccgaguauuagacuggcuggagaagcaugguguggagcgccugaagcggauggccauuagcggcgacgacuguguggucaagcccaucgacgaccgcuuugccgccgcccucacggcucuuaacgacaugggaaagguccggaaagacaucccccagugggagccguccaagggguggaacgacuggcagcagguacccuucugcucucaccacuuccaccaacugauuaugaaggacggcagggagaucguugugccgugccggaaccaagacgaguugguaggccgugcgcgagucucccagggggcuggauggucucugcgugagacggccugccugggcaaaagcuacgcccagauguggcaacuaauguacuuccacaggcgcgaucugcguuuggcagccaaugcuaucugcuccgccgugccugucgacuggguucccaccucccgcaccaccugguccauccacgcccaccaccaguggaugaccaccgaggacauguuauccguuuggaacagaguauggaucgaggagaacccguggauggaggacaagacgcacaucuccagcuggggcgacguccccuaccuuggcaagagagaagaucaauggugcggcagucuaaucggccucacugcgcgggcaacuugggcgacuaacauacagguggcuaucaaucaagugcggcgccugaucgggaacgagaacuaccucgacuauaugacuuccaugaaacgguuuaagaaugagucugaccccgagggagcgcucugguaa

SEQ ID NO: 24508 - RNA, 9879 nt, Artificial Sequence
  derived and/or modified CDS sequence (opt11) from DENV-1__GU131814__SS-prME
agcgugaccauguuacucaugcugaugcccacggcccuggccuuucaucuaaccacccgaggcggagaaccccacaugauaguuuccaagcaggaacggggcaagucccugcuguucaagaccagcgccggggugaauaugugcacccucauugccauggaccuaggcgaacugugcgaagauaccaugacguacaaguguccgaggaucacggaaacagaaccagaugacguggauugcuggugcaaugccacagacaccugggugacuuaugggacauguagucagaccggcgaacacaggcgggacaagcggagcguggcccucgccccacaugucggucugggucuggagaccaggacugagacauggaugagcucagagggcgcguggaagcagauccagcggguugagacgugggcccuccgccaccccggauucacagugauagcacucuuccuugcccaugcgaucggaaccucgaucacccaaaaggggaucaucuucauauuacugaugcuggugacuccgucuauggccaugcggugcgugggaaucgguagucgagacuucguggaggggcugucgggcgccaccuggguggacgucguguuagagcauggcaguugcgugaccacaauggccaaagacaagcccacgcuggacauagagcuccugaagaccgaggucaccaauccggcgauccuacggaaacuauguaucgaagcuaagauuuccaauaccacaaccgacagccguugcccuacccagggcgaagccacccugguggaggagcaggacgccaacuuugucugccggcguacuuucguugaccguggcuggggcaacggcugcgggcuguucggcaaggggucucucaucacgugcgccaaguucaagugcgugaccaagcuggaggggaagaucguacaguacgagaaccugaaauacagcgucauugugacagugcacacgggggaucaacaccaggucggaaacgaguccaccgagcacggcaccaccgccacgaucacgccccaggcgccgacuacggaaauccagcucaccgacuauggggcucucacccuggacugcaguccccgcaccggacuugacuuuaacgagauggugcuccugaccaugaaagagaaauccuggcucguccauaagcagugguuccuggaccugcccuuacccuggacaagcggugccucgacaucccaggagacuuggaaccggcaggaccuguuagugaccuuuaagacggcccacgcgaagaagcaagagguuguaguguuggggagccaggagggggcuaugcacacggcccugacaggcgccaccgagauccaaacguccggcacuaccaccaucuucgccgggcaccuuaagugccgccuuaagauggacaaguugacgcugaagggaaugagcuacgugaugugcacuggguccuuuaaacucgagaaggaaguugccgagacccagcacggcaccgugcuagugcagaucaaauaugagggcaccgaugcgccgugcaaaauuccauucaguacgcaggacgaaaaaggggugacccagaauggccggcugauaacggccaaccccauuguuaccgauaaagagaagccggugaacaucgaggcugagccgcccuucggggaguccuacaucgucaucggcgccggugagaaagcgcugaaguuaagcugguucaaaaagggguccaguaucggcaagauguucgaggccacggccagaggggcccggcgcauggccauccugggggacacagcaugggauuucgggucaaucggcgguguguucacaucuguggguaagcugguccaccagaucuucggcaccgccuacgggguacucuucuccggcgugucguggacuaugaaaaucgggaucgggguccugcugaccuggcugggccugaacucccggucuacaucauugagcaugaccugcaucgcugugggacucgugacguuguaccugggggucauggugcaggccgacuccgggugugugaucaauuggaaaggccgggagcuaaagugcggcagcggcauuuucgucaccaacgaaguacauaccuggaccgagcaguacaaguuucaggccgacagcccaaagcgacuguccgcggcgauaggaaaggccugggaggagggcgugugcggcauccggucagccacgaggcuagagaacauaauguggaaacaaaucucaaacgagcucaaucauaucuugcuagagaacgauaugaaguuuacggucguggucggagacgucgccggcauccuugcgcagggcaagaaaaugaucagaccgcaacccauggaguauaaauacaguuggaaguccugggguaaggccaagauaauaggcgcugauguccaaaacaccaccuuuaucaucgaugggcccaauaccccggagugccccgaugaccaacgcgccuggaacaucugggagguggaagacuacggcuuugggaucuuuacgaccaacauuuggcuaaaacuccgggacagcuacacacaggucugcgaccaccgccucauguccgcggcgauaaaggauucaaaggccguucacgcugacaugggcuacuggauagagucggagaagaaugagaccuggaaguuagcccgugcgucuuucauugaggugaaaacuugcaucuggccaaagucccacaccuuguggucgaacggagugcucgaaucagaaaugaucauccccaagaucuacgguggcccgauaucucagcauaacuaccgccccgguuacuuuacccaaaccgcuggccccuggcauuugggcaaacuggagcucgacuucgaccugugcgagggcacgacggucguggucgacgagcacugcggcaaccggggaccaagucugcgcaccaccacugugaccggcaaaaucauccacgaguggugcugccgauccugcacucuacccccgcuccgcuucagaggcgaggacggcugcugguacgggauggagauccgcccggugaaagagaaagaagagaaccuagucaaauccaugguaagcgcagggucuggagaaguggacuccuucagccucggucugcucugcaucuccauaaugauugaggaagucaugagaagccgcuggucucguaagaugcucaugaccggcacucuggccgucuucuuacucuugaucauggggcagcugaccuggaacgaccucauccgccuguguauuauggugggcgccaacgcgucggaccguaugggcaugggcacuaccuaccuggccuuaauggcaacguucaagaugcggccgauguuugcggucgggcuacuguuucggcgguugaccucccgcgagguacugcugcuuaccaucggacuaagccugguggccuccgucgagcugcccaauagccuggaagaacugggggacgggcucgcgaugggcauaaugauacucaagcugcugacagacuuccagucacaucagcuaugggccacccuucuaagccucacuuucauuaagaccaccuuuagucuacauuacgcauggaagacgauggccauggugcucuccaucgucagucuuuuccccuuaugcuugagcaccacuucccagaagaccacgugguugcccgugcuacucgguagccuggggugcaagccgcugacuauguuccucaucgcggagaauaagaucuggggccggcgcagcuggccccuuaacgaggguauaauggccgugggcauugucagcauacugcucaguucccugcucaagaacgacgugccccuugccgggccccugauagccggcggcaugcuuaucgccugcuacgucaucucaggguccagugcggacuuauccuuggagaaggccgcggaggucuccugggaagaggaggcagaacauuccggggcgagucacaacauucugguugaggugcaggacgacgggaccaugaagaucaaggacgaggagcgggacgauacccucacgauauuacuaaaggcuacucucuuggcuguuuccggcguguacccgcugucgauccccgccacacucuucguuugguacuucuggcagaagaagaagcaaagguccgggguacugugggacacccccucaccgccugagguggaacgggcggucuuggacgacggcaucuaccgcaucaugcagcgaggccugcucggacgcucacagguuggcguggggguguuucaggagaaugucuuucacaccauguggcacgugacgcggggcgcugugcugauguaucaggguaagcggcuggagcccagcugggcguccguaaagaaggaccucauaaguuacggcggcggguggcgcuugcagggcucauggaacaccggagaagagguccagguaauagcagucgagcccgguaagaaccccaagaacguucagaccacucccggcacguucaagacucccgagggcgaaguuggcgccaucgcgcuugacuucaagccgggaaccagcggaucccccaucguuaaccgugaggggaagauagugggccucuacggcaaugguguggucacaacgucgggcaccuacgugagcgccaucgcgcaggcaaaggccagucaggaagggccgcugcccgagaucgaagaugagguguuccggaagcggaaucugaccauaauggaccugcacccgggcagcggaaaaacccggcguuaucugccggccaucguccgggaggcgauuaagcgcaagcugcgcaccuugauccucgcccccacgcgcgugguggcguccgaaauggcggaagcacuaaaggguaugccgauucgcuaccaaaccaccgcggucaaaagcgaacacacuggcaaagagaucguagacuuaaugugccacgcaaccuucaccaugcgacuucugucccccguacgcguaccaaacuacaacaugaucaucauggacgaagcgcacuucaccgaccccagcuccauagcugcaaggggguauaucucaacacgcgugggaaugggagaggcggcagcgauuuucaugacggcaacgccgccaggcuccgucgaggcuuucccacagagcaacgcggucauccaagaugaggaacgcgauaucccagagcgcaguuggaauagcggauaugaauggaucaccgacuucccaggcaagacggugugguucguacccucaaucaaaucuggcaacgacauugccaauugccuccggaaaaacgggaaacgugucauacaacugucucggaaaacguuugauaccgaguaccagaagaccaagaacaacgacugggauuacgugguaacgaccgauaucagcgagaugggcgccaacuuccgcgcagaucgggucaucgauccgcgucguugccugaaaccggugauccucaaagacggccccgaacgcgugauccuagcgggacccaugccggucaccguggcuagcgccgcccagcggagagggcggaucggcaggaaucacaacaaggagggcgaccaauauauuuacauggggcagccccugaauaacgaugaggaucaugcccauuggaccgaggcgaaaaugcuacuggauaacaucaauacgcccgagggcaucauuccugcguuauucgagccggagcgcgagaaauccgccgccauagacggggaguaccggcuccggggagaagcccggaagaccuucgucgaacugaugcguagaggcgaucuccccguuugguuauccuauaagguggcaagcgagggcuuucaguauucagaucgccgcuggugcuuugauggcgagcgaaacaaccagguccucgaggagaacauggauguugagaucuggacuaaggagggggagcgcaagaagcugagacccagauggcucgaugcccgcaccuacagcgaccccuuagcccugcgggaguucaaggaguuugccgcaggacgacggucgguguccggggaccucauccuggagauagguaaacugccgcagcaccucacgcagcgcgcgcagaaugcgcuagacaaccugguuaugcuccacaauuccgaacagggcgggcgggcguacaggcacgcaauggaggagcugcccgacaccauugaaacccugaugcuccuggcgcugaucgcugugcucacagggggcgugacccuguucuuucuaucggggcgcgggcucgguaagacgagcauaggcuugcuaugcgucauggccucaagcgugcuccucuggauggcuuccguggagccccacuggauagccgcgagcaucauccuggaguucuuucucaugguccuguuaaucccggagccggaccgccagagaaccccacaagacaaucagcucgcuuacguggugauuggucugcuguucaugauccuaaccguugcugccaaugagaugggccugcuagagacuacgaaaaaggaccucggcaucggccacguagcgguaggcaaccaccaccacgccgcaaugcuagacgucgacuugcaucccgccuccgcauggacccuauacgccguggcgaccaccauaaucacaccuaugaugcgccacaccaucgagaacacaacugcuaauauuagcuuaacggccaucgcaaaccaggcggcgauucuaaugggccucgacaagggcuggccgauauccaaaauggacaucggagugccccugcuagccuugggcugcuacagucaggucaacccccugacccugaccgccgccgugcugaugcugguggcgcacuaugccaucauaggaccugggcuacaagccaaggccaccagagaggcccaaaagcggaccgcggccgguauaaugaaaaaccccaccgucgauggcauuguggccauugaccuggacccaguggucuacgacgcaaaguuugaaaagcaacuggggcagauuaugcugcucauccucugcaccagucagauccugcucaugagaacgacgugggcucuuugugagagcaucacgcuugcgacagggccccugaccacgcugugggagggcuccccagggaaguuuuggaacaccaccaucgccgugucgauggcaaauaucuuccggggcucuuaccuggcgggagcagggcucgcguucagccugaugaaaagccuuggugguggacgccgggggaccggagcccagggcgagacgcucggggagaaauggaagcgccaguugaaucaacuuuccaagagcgaguucaacaccuacaagcgauccggcaucauggaaguggauagauccgaggcaaaggagggguuaaagcgaggcgagaccaccaaacaugccgucucccgcgguacggcuaagcugcgaugguucguugagcgcaaucuggucaagccggaggggaaggucaucgaccugggcugugggcgggguggguggucauauuacugugccggccuaaagaaagugaccgaggugaaaggcuauacgaaaggcgggccggggcacgaggagcccaucccgauggccacauacggauggaaccuaguaaagcugcacuccgggaaggauguguucuuuaucccgccggagaagugugauacucuccucugugacauuggagagagcagccccaacccuaccauagaggaagggcgcacccuacggguacuaaagauggucgagcccuggcugcgaggaaaccaguuuugcaucaagauccuuaaccccuacaugcccagcgugguugagacccucgagcaaaugcagcgcaagcacggcgggaugcuaguccgcaacccccugucccggaauagcacccacgagauguacuggguguccuguggaacgggcaauaucgugucggcugucaacaugacgucccguauguuacuaaaccgcuucaccauggcgcacagaaagccaacauacgagcgcgacguggacuugggggcgggcacgcggcacguggccguugaaccagagguggccaaccuugauauaaucgggcaacgcaucgagaacaucaagcacgagcacgaaucuacguggcacuacgacgaggacaacccuuacaagaccugggcguaccacggaagcuacgaaguuaagccgagcgggagcgcgagcagcauggugaacggcguuguaaagcugcugaccaagccgugggacgucauccccauggugacgcagaucgcgaugaccgacaccaccccauuugggcagcaacggguguucaaagaaaagguggacacgcgcaccccuaaggccaaacgcggcaccgcucagauaauggaggugaccgcgaagugguuguggggcuucuugucgcguaacaagaaaccccgaaucugcacgcgcgaggaguucacccggaaggucagaagcaaugccgcuaucggggccguguucguugaugaaaaucaguggaacuccgcaaaagaggccgucgaggacgaacgguucugggaucuuguucaucgggagagagagcuacauaagcaggguaaaugcgcgaccuguguguauaacaugauggggaagcgcgagaagaagcugggcgaguucgggaaggcgaagggcuccagagcgauaugguacauguggcugggggcgcgcuuucuagaguucgaggcgcugggguucaugaacgaagaccacugguucuccagagaaaacagccuguccggcgucgaaggggagggccuccacaagcugggauacauccuccgagauaucagcaagauccccggcgggaacauguacgccgaugacacagccgggugggacacgaggauaacagaggacgaccuucagaaugaagcccgcaucaccgauaucauggagccggagcaugcccugcucgccaagucgaucuucaagcuaaccuaccagaauaagguagugcgaguccagcgccccgcgaagaauggcaccgugauggaugugauaagcagacgggaccagcgcgggagcggccaaguaggcaccuacggauugaacaccuuuaccaacauggaagcgcagcugauccggcagauggaguccgagggcauauuuagccccagcgagcuagagacuccaaacuuagccgaacgagugcuggacuggcuagagaaauacgggguggagcggcucaagcggauggcgaucuccggugaugacugugucgugaagccgauagacgaccguuucgccaccgcacugaccgcucucaacgacauggggaaaguucgaaaggacaucccgcagugggagccgagcaaggguuggaacgauuggcagcaggucccuuuuuguucccaccacuuccaccagcugauuaugaaggacggccgggagaucguaguaccgugccgcaaccaggaugagcuagucggucgagcgcgggugucccaaggggcaggcuggucccucagagaaaccgccugucugggcaagaguuacgcgcagauguggcagcuuauguacuuccaccgucgagaccucagacuggcggccaaugccaucugcagcgcuguucccguagauuggaucccaacgagccggacgacaugguccauccaugcccaccaccaguggaugacaacggaggacaugcugaguguguggaaucggguguggauagaggagaaucccuggauggaggacaaaacgcacaucagcuccuggggcgaugugccguaccuaggcaagcgcgaggaccaguggugcgguagccugauuggucugaccgcccgggccaccugggcaaccaauauccaaguggcgaucaaccaaguacgccggcuaaucggcaaugaaaacuaccuggacuauaugacguccaugaagcgcuucaaaaacgagagcgaccccgagggagcacugugguga

SEQ ID NO: 24509 - RNA, 9879 nt, Artificial Sequence
  derived and/or modified CDS sequence (opt11) from DENV-1__GU131815__SS-prME
ucagugacgaugcugcucaugcuuaugccaaccgcccuggccuuccaccucaccacccgggggggggaaccgcacaugaucgugagcaagcaggaacggggcaagucucugcuguucaagaccuccgccggggugaacauguguacccucaucgccauggaucugggugagcugugcgaggacacaaugaccuauaaguguccccgaaucaccgagaccgagccugacgacguggacugcuggugcaacgccaccgacaccugggucaccuacgggaccuguagccagacgggugagcaccggcgcgacaagagguccguugccuuggccccccacgugggccuuggcuuggaaacucgcacugagaccuggaugagcuccgagggcgcuuggaagcagauccagcggguagagacuugggccuuacgccaccccggguucaccgugauugcgcuauuccuggcccacgccaucggcaccagcaucacccaaaaggguauaauauucauccuccugaugcuggugacgcccucuauggcuaugcggugcgucgggaucgggagccgcgacuucguggaggggcuauccggcgcgaccuggguggacgucgugcucgaacacgggagcugcguuaccacgauggccaaagacaagccaacguuagacaucgagcuccugaagaccgagguaaccaacccugccgugcugcggaagcucugcaucgaggcgaaaauuuccaacaccacgacugacagccgcugcccgacgcagggcgaggccacccugguggaggaacaagacgccaacuucguaugccgucgcacguuuguggaccgaggcuggggaaacggcugugggcuguuuggcaaggggucccuaaucacgugcgccaaguuuaagugcgugacgcgccuugaggguaaaaucguccaauacgagaaccugaaguacagcgucaucgugaccguccauacgggcgaccagcaucagguuggcaacgaaaguaccgaacacgguaccaccgccaccauaacgccccaggcgcccaccaccgaaauccagcuaaccgacuacggggccuugacgcuggacugcagcccacggacugggcucgacuucaacgagaugguccugcugacuaugaaggaaaagaguuggcucgugcacaagcagugguuccuggaccugccccucccguggacaagcggugccaguacgucccaagagaccuggaaccgccaagaccugcuagucaccuucaagaccgcccaugccaagaaacaggaggugguggugcucggcucccaggagggcgcgaugcacacugcuuugacgggggcuacggaaauccagaccucaggcacgaccaccaucuucgccgggcaccugaagugccgacucaagauggauaaacuaacccugaagggcaugagcuacgucauguguacggggaguuucaagcucgagaaagagguggcugaaacccaacacgggaccguacugguccagauaaaguaugaaggcacggacgcgccauguaagauccccuuccugacucaggacgagaaaggggucacccaaaaugggcgccugauaacagccaacccaaucgugaccgacaaggagaagcccguaaacaucgaggccgagccacccuucggggaaagcuacaucacgaucggcgccggcgaaaaggcgcucaaguuauccugguucaagaaggggagcagcauuggcaagauguucgaggccacagcucgcggggcucgccgcauggccauccugggcgauaccgcgugggauuuugggucaaucggcggcguuuucacguccguggggaagcucguccaucagaucuucggcacggcuuauggugugcuguucuccggcguauccuggaccaugaagaucgguaucggcguccuacucaccuggcugggccugaacucucgauccacaagccucuccaugacgugcauagccguggggcuggugacacuguaucucggcgucauggugcaggccgacagcgguugcgugauuaacuggaaaggucgcgagcugaagugcggauccggcaucuucgucaccaaugaggugcacaccuggaccgagcaguacaaauuccaagcugacagcccgaaacggcugagcgcggccaucggcaaggccugggaggagggggugugcggcauccgcuccgcuacccggcucgaaaauaucauguggaagcagaucagcaacgaacugaaucacauccugcucgaaaaugauaugaaguucaccgucguggugggcgacgucgcaggcauucuagcgcaggggaagaagaugauucggccgcagcccauggaguauaaauacaguuggaaguccugggggaaggcgaaaaucaucggcgccgacguacagaacacaaccuucaucaucgaugggcccaacacgccggagugcccggaugaccagagagccuggaauaucugggagguugaggacuauggcuuugggaucuucaccaccaauauauggcugaaacuacgcgacucuuacacucaggucugcgaccaccgguugaugucggcggccaucaaggacucaaaggcugugcacgccgacaugggcuacuggauugagagcgagaagaaugagacguggaagcuggcccgagcgaguuuuaucgaggugaaaaccuguauuuggccgaaaucacacacccucugguccaauggcguccuugaaagcgagaugaucaucccaaaaaucuacgggggaccgaucucccagcacaacuaccggcccggguacuuuacgcaaacggccggcccauggcaccugggcaagcucgagcuggauuucgaccugugcgaaggaaccaccgugguugucgacgagcacugcgguaaccgcgggccgagccuccggacuacgaccguuaccggcaagaucauccacgaguggugcugccgcuccugcacccuuccgccccugagguucaggggggaggacggcuguugguacgggauggaaauccggcccgugaaggagaaggaggagaaucucguaaagagcauggugucagccggaagcggcgagguggacagcuucuccuuggggcugcucuguauuagcaucaugaucgaggagguuaugcgcucccgguggagccgcaagaugcugaugacaggaacucuggccguguuuuuccuccugauuauggggcagcuaacauggaaugaccucauucgucugugcaucauggucggcgccaacgcauccgauagaauggggaugggaacgacuuaccuagcccucauggccaccuucaaaaugcgcccgauguucgccgucggcuugcuguucaggcgcuugaccagccgcgagguccugcugcucaccaucggacucucauuaguugcaagcgucgagcuccccaacucccuggaggagcugggcgacgggcuagcgaugggcauuaugaucuuaaaauuacucacggacuuccagucgcaccagcugugggccaccuuacucucccugaccuucaucaaaacuacguucagccugcacuacgccuggaagaccauggcgauggugcucucgaucgucucccuguucccucugugccuaucaaccacaucccagaagacgaccuggcuaccggugcugcucggcucccuggggugcaaaccacugaccauguuccuuaucgcggagaacaagaucugggggcgccggagcuggccucugaaugaggggaucauggcuguugggaucgucagcauacuacuauccagccugcucaaaaacgacgugccccucgccgggccuuugaucgcuggcggcaugcugaucgcguguuacguuauauccgggagcuccgccgaccuaagccuggagaaggccgcugagguguccugggaggaggaagccgagcauagcggagccucacacaacauucugguggaagugcaggacgacgggaccaugaagaucaaggacgaggagcgcgacgacacacucacgauccugcuaaaggcaacacuccuggccgccagcggagucuacccucuguccauuccggccacucucuuugugugguauuucuggcaaaagaaaaagcagcggucgggggugcugugggacacccccagcccgcccgaggucgaacgcgccgugcuggacgacggcaucuaccggaucaugcagcgcggccuguuggggcggagccaggugggcguggguguguuucaggaaaacguguuucacaccauguggcauguuacccgcggggcugugcugauguaccaggggaagagacuggaaccuuccugggcuagcgugaagaaggaccucaucuccuauggcgggggguggcgacugcagggcucauggaacacaggggaggagguccaggugaucgcuguugagcccggcaagaaccccaagaacguccaaaccgccccagggacguucaagaccccagaaggagaggugggcgccaucgcgcuugacuuuaagcccggaaccuccggcagcccgaucgugaaccgggaggggaaaaucgucggccucuacggcaacgggguugugaccacguccgggaccuacgucagcgccaucgcacaagccaaggcgucgcaggaggggccuuuacccgagaucgaggacgagguuuuucggaagcggaaccugaccaucauggaucuccaccccggcuccggcaagacuaggcgcuacuugccggccauaguucgcgaggcgaucaagcgcaagcugcggacgcuuauccucgccccuacgcgcguagucgccagcgagauggcggaggcccugaagggcaugcccaucagauaucagacuaccgcggugaaaucagagcacacgggaaaagagaucguagacuuaaugugccacgcaaccuucaccaugcgccuucugagccccgugcggguacccaauuacaacaugaucauuauggacgaggcucacuucaccgacccauccagcgucgcagcccgcggcuacaucuccacgcggguugggaugggagaggccgccgcuauauucaugaccgcgacgccgccuggcagcguggaggccuucccgcaguccaaugccgucauccaggaugaggagcgcgacaucccggagcggagcuggaacuccggcuaugaguggaucaccgacuuccccgggaagacggugugguuugugcccaguaucaaauccggcaacgacaucgcgaacugucuccgcaaaaacgggaagagaguuauccagcugagccguaagacauucgacaccgaguaccagaagaccaagaacaacgacugggacuacguugugacgaccgacauuuccgagaugggugcgaacuuccgggccgaucgcgucaucgacccgcggcguugccugaagcccgugauccucaaggacggccccgaacgggugauccuggccggcccaaugccggucaccguggccucggccgcgcaaagacgggggcgcauaggucgcaaccacaauaaggagggcgaucaguacauuuacauggggcagccccuuaacaacgacgaggaccacgcccacuggacggaggccaagaugcuccuugauaauaucaacacccccgagggcauaaucccagcacuguuugaaccggaacgggagaagucggccgcgauagacggggaguaccgccuccguggugaagcgagaaagacuuucgucgagcuaaugcggcgaggggaccugcccgugugguugagcuacaaaguggccuccgagggguuccaauauucagauagacgcugguguuucgacggcgagcggaacaaccagguccuggaagagaacauggacgucgagaucuggaccaaggagggagaacgaaagaagcugcggccccgcuggcucgacgccagaaccuacagcgacccccuugcccuccgagaguucaaggaguucgccgccggccgacgcucggugaguggggaccucauccuugagaucggcaaacugccgcaacaucugacgcaacgggcccagaacgcacuggacaaucugguaaugcuccacaacuccgagcagggcggacgugcguaccggcacgcaauggaagaguugccugacaccaucgagacacugauguugcuagcgcucaucgccguucucaccgguggggugacccuguucuuccugagcggccgcgggcucggcaagacgaguaucggccugcuuugcguuauggccagcuccguucucuuauggauggcauccguggagccccacuggaucgccgcuuccauaauccuggaguucuuccucaugguccugcugauccccgaaccggaccggcagcgcacgccccaggacaaucaacucgcuuacguugugaucgggcuucuguucaugauccucaccgucgccgcgaaugaaaugggccuccuggagaccacgaaaaaagaccuagggaucgggcauguggccgcggagaaucaccaucaugcggccaugcuggacgucgauuuacaccccgcgagcgccuggacccuauacgcuguggcaaccaccauuaucacgccgaugaugcgccacaccauugagaacaccaccgccaacaucucccugacggccauugccaaccaggccgccauccugauggggcucgacaaggguuggcccauuagcaagauggacaucggcgugccccugcuggcgcuggguugcuacucccaggugaauccccuuacccugacugccgccguucucaugcugguggcucacuacgccauaauugggccggggcugcaagcaaaggcuacgcgggaggcccagaagcgcacggccgccggcaucaugaagaaccccaccguggacggcaucguggcgaucgaccucgacccagugguauacgacgccaaguucgagaagcaguuggggcaaaucaugcuguugauuuuaugcaccagccagauccuucucaugcggaccacgugggcccugugcgagucuaucacccuggccaccggcccccucaccacgcugugggaagggaguccgggcaaguucuggaacaccacaaucgccgucuccauggccaacaucuuccgcggcagcuaccucgccggcgccggccucgccuuuucccugaugaagucccuggguggcgggcggcgcgggaccggggcgcaaggcgagacgcucggcgaaaaguggaagcggcagcugaaccaguuaucgaaauccgaguucaacacauacaagaggagcgggauuauggaaguggaccgguccgaggccaaggagggccugaagcgcggggagaccaccaaacaugcggugagccggggcacggccaaauuacgcugguucgucgagcggaaccuagugaagcccgagggaaaggugauagaccugggcugcggucgcgggggcugguccuacuacugcgccgggcucaagaagguuaccgaagugaagggcuacaccaagggcgggcccggccaugaggagcccaucccaauggcgaccuacggguggaacuugguaaaacugcacucuggcaaagacgucuucuucaucccgcccgagaagugcgacacgcuccugugcgacauuggugaguccagcccaaacccgaccaucgaagagggccggacacugcgcgugcucaagauggucgagcccuggcugcgagguaaccaguuuuguaucaagauccuaaacccguacaugcccuccgucguggagacacucgagcaaaugcagcgcaaacacgggggcaugcuggugcggaacccgcugucaagaaacuccacccacgaaauguacugggucucgugcgggacgggcaauauugugucggcggugaacaugaccagccgcaugcucuugaaccgguucaccauggcccaccgcaaacccaccuacgaacgggacgucgaucugggugccggcacgcgccacguggccguggagcccgagguagcgaaucucgacaucaucggccaacgaaucgagaacaucaagcacgagcacaagucuaccuggcacuacgacgaggauaaccccuacaagaccugggccuaccacgggagcuacgaggugaagccgucgggcagcgccagcagcauggugaaugggguugugaagcugcugacgaagccuugggacgucauccccauggugacgcagaucgccaugaccgacaccacgcccuucggccaacaacgaguguucaaggaaaaaguagauacgaggacaccgaaagcuaagcgcgggacagcacagaucauggagguuaccgccaaguggcucuggggauuccuuagccggaacaaaaagcccaggaucugcacgagggaggaguucacccgcaagguccgguccaacgccgccaucggcgcgguauucguggaugagaaccaguggaauagcgccaaggaggccguugaggaugagcgcuucugggaucugguccaucgggagcgcgagcuccacaagcaagggaagugcgccacuugcguguacaauaugaugggcaagcgugagaaaaaacugggggaguucggaaaggccaaggggucccgcgcgaucugguacauguggcugggcgcccgguucuuagaguucgaggcccugggguucaugaacgaggaccacugguucagcagggagaacucucugucagggguugagggcgaggggcuccacaaacugggcuacauccugcgggacauuuccaagauucccgggggcaacauguacgccgacgacacagccgggugggauacgcgcaucaccgaggacgaccuccagaacgaggcucgcaucaccgacaucauggagccagagcaugccuuguuggccaagagcaucuucaagcuaaccuaccagaacaaagucgugcgagugcagcgccccgccaagaacggcaccgucauggacgugaucagucggcgcgaccaacgggguagcggucagguggggaccuauggccugaacacuuucacgaacauggaggcccaauugaucagacagauggagagcgagggaaucuucagccccuccgagcucgagacgcccaaccuggcggaacgcguucuggacuggcucgagaaguacggcguggaacgccucaaacggauggccauuucuggugacgauugcguggucaagccgaucgacgaucgcuuugccaccgcccugaccgcccucaacgacaugggcaaggugagaaaagacauuccccaaugggagccuucuaagggcuggaacgacuggcagcagguccccuucugcagccaccacuuccaccagcugaucaugaaggacggccgcgagaucgucgugccgugccgcaaccaggacgaacuggugggccgcgcgcgggucagccagggcgccggcuggucgcuccgcgagaccgccugccugggcaaguccuacgcacagauguggcagcugauguauuuccaccggcgcgaccuccggcuggccgccaaugcaaucugcuccgccguccccguggacuggauccccacuagcagaacgacuuggucgauucaugcccaccaccaguggaugaccacggaggacaugcugagcgucuggaaccgcguguggauagaagagaacccauggauggaggacaaaacccauaucuccucauggggcgacgugccguaccucgggaagcgagaggaccaguggugcggcucccugaucggacugaccgcgcgcgcuaccugggccacgaacauccaggucgccaucaaucagguccgccgucucaucgggaacgagaacuaccuggacuauaugacgagcaugaagagauucaagaacgaaucggacccagagggcgcccugugguga

SEQ ID NO: 24510 - RNA, 9879 nt, Artificial Sequence
  derived and/or modified CDS sequence (opt11) from DENV-1__GU131818__SS-prME
ucagugacuaugcugcuuaugcugaugccaaccgcuuuagcauuccacuuaaccacccgaggaggggagccccacaugauagugaguaagcaagagagaggcaagagccugcuguucaagaccagugccggugugaacaugugcacccuuauagccauggaccuaggcgaguucugcgaggacaccaugaccuacaaguguccccggaucacggaagccgaaccggacgacguggacugcuggugcaacgcuacggacacaugggugaccuacgguaccuguagccaaaccggcgaacaccggagggacaaacgcuccguugcucuagcgccgcacgugggcuuggggcuggagacgcgcacugagaccuggaugucgagcgagggcgccuggaagcagauacagaagguggagaccugggcccugcggcaccccggguucacgguuaucgcacuauuucuggcgcaugccauugggacgagcauuacccagaaggggaucaucuucauucuuuuaaugcuggugacgcccucaauggcuaugcgaugcgucggcauaggcucccgggacuuuguggaaggccuguccggugccacguggguggacguagugcucgagcaugggagcugcguaacuacgauggcaaaagacaagcccacccuggauaucgagcuuuuaaagacagaggucaccaacccagcggugcuacgcaaacugugcaucgaggcaaagaucuccaauaccaccacggacucucgguguccgacacagggcgaggccacccuuguggaggaacaggacgccaacuucgucugccgacgaaccuucguggaccgcgguuggggcaacgggugcggucuguucggcaaggggucacugaucacuugcgccaaguucaaaugcguuacgaagcucgagggcaagaccguucaacaugagaaccugaaguacagcgucaucgugaccguccacacgggcgaucaacaucagguggguaacgaguccaccgaacacggcaccaccgcgacuaucacaccccaggccccgagcaccgagauucaacugacugacuacggggcccuuacacuggacugcuccccucggacgggccuggacuucaacgagaugguccuccuuacgaugaaggaaaaguccuggcuggugcauaaacagugguuccucgaccugccguugcccuggaccucaggugcauccaccagucaggagacauggaaccgcaaggaccuccucguaaccuucaagacggcacacgcgaagaaacaggaggucguggugcugggcucccaggagggcgccaugcauaccgcccucaccggggccacugaaauccagaccaguggcaccacgacaaucuucgcagggcaccugaagugccgacugaagauggacaaacucacucugaaggguaccuccuacgucaugugcacaggcuccuucaaguuggagaaagaggucgccgagacccagcacgggacagugcucguccagaucaaauacgagggcacggacgcacccugcaagaucccguucuccacgcaggacgaaaagggggugacccagaacggccgccugaucacggccaaucccaucgucaccgacaaggagaagcccgucaacauagaggccgagccgcccuucggagaaucauacaucgugaucggcgcgggcgagaaggcccugaaguuguccugguucaagaaggggaguucgauaggaaagauguucgaagcaacagcccgcggggcgcgccggauggcuauccucggggacaccgcgugggacuucgggucaauaggagggguguuuaccuccgucggcaagcuggugcaccaaauuuucggaacugccuacggugugcuguucucugggguuucguggacgaugaagaucgggaucggggugcuccugacguggcuggggcuaaacagccgcagcacuucacuguccaugacuugcauagccguagggcuggucacguuguacuuaggcgugaugguacaggcugauuccggcugcguaaucaacuggaagggccgagagcugaagugcgggagcggcaucuuugugaccaacgaggugcacaccuggaccgagcaguacaaguuucaggcggacuccccgaagcggcucucagccgcgauaggaaaggccugggaggaaggggucuguggcauacguuccgccacccggcuggaaaauaucauguggaagcagauaucgaaugagcugaaccacauccuccuggagaacgacaugaaguucacggucgucguuggggacguggccgguauccuagcucaagggaagaaaaugauccggccgcagcccauggaguauaaguacuccuggaaguccuggggcaaggccaagaucaucggagcugacgugcagaacaccacguuuaucauagacgggccgaacacuccugaguguccugacgaccagcgggcguggaauaucugggagguggaggauuauggcuucgggaucuuuacaaccaacaucuggcucaagcucagagacaguuacacucaggugugugaccaccggcugaugagcgccgccauaaaggacuccaaagccguucaugccgacaugggauacuggaucgagagcgagaagaaugagacguggaagcucgcccgugcuuccuucaucgagguaaagacaugcaucuggccaaagagccacacccugugguccaacgguguacuggagagcgagaugaucauccccaagaucuaugggggaccgauaucccagcauaacuaucgucccggguacuucacccagacugccggccccuggcaucucgggaaacuugagcuggacuucgacuugugugagggaaccacugucguuguggacgaacacugcggaaaccgaggaccgagccuucgaaccaccacggugaccggcaagaucauccacgagugguguugccgcagcugcacccugccgccccuccgguucaaaggagaggacggcugcugguacgggauggaaaucagacccgucaaggagaaggaggagaaccucgucaaauccauggucagcgcaggguccggcgaggucgacagcuuuagucuggggcuccugugcaucagcauuaugauagaagaaguaaugcgcucccgcuggucaagaaagaugcugaugaccggcacccucgccguguucuuccuguuaauaauggggcagcuaaccuggaaugaucugauacgccucugcaucauggucggcgcgaacgcuagcgaccgaauggggaugggcaccacguaccucgcccugauggccacauucaagaugcguccgauguucgccguggggcuccuguuccgucggcugaccagcagagaggugcugcucuuaaccaucgggcuaucccucgucgcaagcguggagcuccccaacucccuggaagaacugggcgacgggcuggccaugggcaucaugaucuugaaacuucugaccgacuuucaaagccaccaacugugggccacucucuugucccugacguucauuaaaaccaccuucagccuccauuacgccuggaaaacuauggcgaugguccucuccaucgucagccuguucccgcucugccuguccaccacgagucagaaaaccaccuggcugcccguacuccugggcuccuuagggugcaagccucucacgauguuccugaucgccgaaaauaagaucuggggccgcaagucauggccucugaacgaaggaaucauggccgucggcaucgugaguauacuccucucuagccugcucaagaacgacguucccuuagccggaccgcuaauagccggcggcaugcucaucgcgugcuacguuauauccgggagcuccgccgaccugucucuugagaaggccgccgagguuucgugggaggaggaggccgagcauucuggcgccucccauaacauauugguggaggugcaggacgacgggaccaugaagauuaaggacgaggagcgagaugacacgcuaaccauccugcucaaggcuacgcugcuggcggugucggggguguauccgcuuuccauacccgccacccuguucgucugguacuucuggcagaagaagaagcaacggucugggguccucugggacacccccagcccgccggagguggagagggccguccuagacgauggaaucuaccggaucaugcagcgcggucugcuggggagaagccaggugggcgugggagucuuccaagagaacguuuuccacaccauguggcacgugacgcggggugcgguccugauguaccaggggaagagacucgagcccuccugggcuagcguuaagaaggaccugaucaguuacggaggcggcuggcguuugcagggcagcuggaauaccggggaggagguacaaguaauagccguggaacccggcaagaaccccaaaaacgugcaaaccgccccugggaccuuuaagacgagugagggagaggucggcgcgaucgcuuuagacuucaagccuggaaccagcgguagccccauagugaaccgggaggggaagaucguaggucucuacggaaaugggguggugaccaccuccgguacauacgugagcgccauagcacaagcuaaggcgucacaggaggggcccuuaccggagaucgaagacgaagucuuccgcaagcggaaccucaccaucauggaucugcacccagguucgggcaagacccgccgauaccuucccgccaucguucgcgaggccauuaagcggaagcuccgcacgcugauucuggccccgacacgggugguagcuuccgagauggcggaggcccucaagggcaugccgauacgcuaucagaccaccgcagugaaaagcgagcacacuggaaaggagauaguggaccugaugugccaugccacguucaccaugcgccugcucucccccguucgggugcccaacuacaacaugauaaucauggaugaagcgcacuucaccgaucccagcucuauagcggcuagaggguacaucagcacgcgggucggcaugggggaagccgccgcgauauucaugacggcgacgccgccgggcuccguagaggcuuucccccagagcaaugcggugauccaagaugaggagcgcgacaucccggaacggucguggaacagcggguacgaguggaucaccgacuuccccggcaagaccgugugguucguacccucaaucaagucgggcaacgacaucgcgaauugcuuacgcaagaacgggaaacgggugauccagcugucccgcaagacguucgacaccgaguaccaaaagaccaagaacaacgacugggacuauguggucaccacggacauuucggagaugggcgcgaauuuccgggccgaccgcgugaucgacccccgacgcugccucaagccggugauccuuaaggacgggcccgagagaguuauccuggccggccccaugccugugaccgucgcguccgccgcgcaacgccgcgggcgcaucggccggaaccacaacaaggagggcgaccaguacaucuacauggggcagccgcucaauaacgacgaagaucacgcccacuggaccgaagccaaaaugcuacuggacaacaucaacacccccgagggcaucaucccugcccuguucgaaccggagcgcgaaaagagcgccgcgaucgauggggaguaccggcugcgcggcgaagcccgcaagacguucguggagcuaaugcggaggggugaccucccuguguggcugagcuacaaggucgccuccgaaggguuucaauacagcgacaggcgcuggugcuuugacggcgagcgcaacaaccaggugcuagaggaaaacauggauguggagaucuggacgaaggagggggagcgcaaaaagcuccguccccgauggcuugaugcucggaccuauuccgaccccuuagcucuccgcgaguucaaggaguucgcggccggccggagguccguuuccggugaccugauccuggaaaucgguaaguugccucagcaccugacccaacgcgcccaaaacgcccuggacaacuugguaaugcugcacaacagcgagcagggcggccgcgccuacaggcaugccauggaggaacugccggauacuaucgagacccucaugcuacuggcucucaucgcaguucugaccgguggggucacucuguucuucuugagcggcagagggcugggcaagaccaguauaggacugcucugcgucauggcuucuagcgcgcuucuguggauggccuccguggaaccccacuggaucgccgcuaguauaauccucgaguucuucuuaaugguccugcucauccccgagcccgaccggcagcggacgccgcaggacaaccagcuggccuacguggugaucggacuucucuuuaugauccuuaccgucgcugcaaaugagaugggucugcucgagaccaccaagaaggacuugggcaucggccacguggccguggaaaaucaucaccacgcggcaaugcuggacgucgaccuccaccccgcguccgcuuggacgcuuuacgccguugccacuaccaucaucacccccaugaugcggcacacgaucgagaacaccacugccaacaucaguuugaccgccaucgccaaccaggcagccaucuugaugggccuggauaagggcuggcccauuuccaaaauggauauaggugugccccuacucgcguuggggugcuacucccaagucaacccucugacgcucacugccgcagugcugaugcugguggcccacuacgccaucaucggcccgggguuacaggcgaaagccacgcgcgaggcccagaaacggaccgcugccggcaucaugaagaacccgaccguggacgggauaguggcaauagacuuggaccccguugucuacgacgcuaaguuugagaagcaacuuggccaaauuaugcucuuggugcugugcaccucacagauccuccugaugcgcaccaccugggcccuuugugagucaaucacucuagccaccggcccgcugaccacgcugugggaggggucccccgguaaguucuggaacacgaccaucgcugugagcauggcgaauaucuuuagggggagcuaccucgcuggugccagccuggccuuuagccuaaugaagucccuuggaggaggccggcgagggaccggagcgcagggggagacgcugggcgagaaguggaagcggcagcugaaccagcucagcaaauccgaguuuaacacguauaaacgcuccggcauuauggagguugacagguccgaggccaaggaagggcugaagagaggcgaaacaacgaagcacgcuguaagccgggggaccgccaaacuccgcugguucgucgagcggaaccuggucaagccggaggguaaggugauugaccuggggugcggucgcggaggguggaguuacuauugcgccggccugaaaaaggugacugagguuaagggguacacgaagggcgggcccggccacgaggagcccaucccaauggcgaccuauggauggaacuuggugaagcuccacagcgggaaggacguguucuucaucccuccggagaagugcgacacccugcugugcgacaucggugagucgucuccuaaucccacgaucgaggaggggcggaccuugcgcgugcugaagauggucgagccgugguuacgggggaaccaguucugcauaaagauccucaaucccuacaugcccagugucgucgagacccuggagcagaugcagagaaagcacggcggcaugcuagugaggaacccccugucccgcaacuccacccaugagauguacugggugagcugcgguaccgggaauaucgucuccgcagugaacaugacgagccggaugcuguugaaccgcuucacgauggcccaccgaaagccgacauacgagcgcgacguggacuugggcgccgggacacgccacgucgccguggagcccgagguagcgaaccucgauaucaucggccagcggaucgaaaacaucaagcaugaacacaagucaacauggcacuacgacgaggacaaccccuacaagacaugggccuaccacggcucuuacgaggucaagcccucgggguccgccagcaguauggugaacggagucgucaagcuacucaccaagccgugggacgucauuccuauggucacccaaaucgccaugacggacaccacgcccuuuggccagcagaggguguucaaggagaagguugacacccggacgcccaaggcgaaaagagguacugcgcagaucauggaggugaccgccaaguggcugugggguuuccuaagccgcaauaagaaaccgagaaucugcaccagggaggaguucacucgcaaggugcgguccaacgccgccaucggggcgguguucgucgacgagaaucaguggaacucagcuaaagaagccguggaggacgaacgcuucugggaccucgugcaccgggaacgggagcugcacaagcaaggcaaaugcgcuaccugugucuauaacaugauggggaagcgcgagaagaaacugggcgaguucgggaaggccaaggggucccgcgcuauaugguauauguggcucggggcccgguuccuggaguucgaggcccugggcuuuaugaacgaggaccacugguucucucgcgagaacuccuuaucuggcguggagggagaaggucugcacaagcugggguacauacuacgcgacaucuccaagauccccggcgggaacauguacgccgacgacacggccggaugggauacccgcauuacggaagacgaccugcagaacgaagcgaagaucaccgacaucauggagcccgaacacgcccugcuggccaaaucaauauucaaguugaccuaccagaacaaggugguccgggugcagagacccgccaaaaacggcaccgucauggacgucauaucccggcgcgaccagcgcgggagcggccagguggggacguacggacugaacacauucacgaacauggaggcucaacucaucaggcagauggaaagugaggaaaucuucagccccuccgagcuggaaacgcccaaucuagcuggccgcgugcuagacuggcuggagaaacacggugucgagcggcugaagcgcauggccaucagcggggacgacugcgucgugaagcccaucgacgacagauucgccacagcccucaccgcgcuuaaugauaugggaaaaguccgcaaggacaucccgcagugggaacccaguaagggcuggaacgacuggcagcaagucccauucuguucccaucacuuccaccagcugaucaugaaggaugggagggagauagugguccccugccgcaaccaggacgagcucguuggccgcgcaagaguaagucaaggugccggguggucacugaaggagaccgccugccuaggcaagagcuacgcccagauguggcagcucauguacuuccaccggagagaccuccggcuggcagcgaacgcaaucuguuccgccgucccggucgacuggguccccaccagccguacgaccugguccauucacgcccaccaccaauggaugacaaccgaggacaugcucagcguuuggaaccggguguggaucgaggagaaccccuggauggaggacaagacccacaucucgaguuggggcgauguucccuaccuugguaagcgcgaagaccaaugguguggaucccugaucggccuuacugcgcgggccaccugggccacaaacauccaggucgccaucaaccaggugcgcaggcucaucgguaacgagaacuaccucgauuacaugacuagcaugaagagguucaaaaaugaguccgacccggagggagcccucugguga

SEQ ID NO: 24511 - RNA, 9879 nt, Artificial Sequence
  derived and/or modified CDS sequence (opt11) from DENV-1__GU131820__SS-prME
agcgugaccaugcugcucaugcugaugcccacagccuuggcuuuccaccucaccacccggggcggggagccccacaugaucgugacgaaacaagagcgggggaagucccuucuguucaaaaccagcgcgggggugaauaugugcacccucaucgcgauggaccugggugaguugugugaggacaccaugacauacaagugcccacggaucaccgaggcugagcccgacgacguagacuguugguguaaugccaccgauacaugggucacuuacgggacgugcucccagaccggugagcacagaagagacaagcggagcguugcacucgcgccccaugugggccuuggguuggaaacucguacugagaccuggaugaguagcgagggugccuggaaacagauccaacgggucgaaacgugggcccuccgccaccccggcuuuaccgugauagcccuguuucuggcccacgccauuggcaccaguaucacccagaaggggaucaucuucauacuccugaugcuggugacgcccagcauggccaugcgcugcguaggcaucgguaguagagacuuuguggagggcuuauccggcgccaccuggguugacguaguauuagaacacggaagcugcgucaccaccauggcaaaggacaagcccacgcuggacaucgagcuccugaagaccgaggucacgaaccccgcagugcugcggaagcugugcauagaggcgaagauaucgaacacgacgaccgacuccagguguccgacacagggagaggcaacccuaauggaggagcaggaugccaacuucgugugccgucgcaccuucgucgaucggggcugggguaacgggugcgggcuguucgguaagggaagccucaucacaugcgccaaauucaagugcguaaccaagcuggagggcaaaaucgugcaauacgagaaccugaaguacuccgucauagugaccguccacacuggcgaccagcaccaagucgggaacgagagcaccgaacacggcaccaccgcgaccaucacgccccaggcgcccaccagcgagauccagcucaccgacuacggggcccugacgcuugauugcagccccagaacgggccuggacuucaacgagaugguacugcugacuaugaaggagaaguccuggcucguucacaagcagugguuccuggauuuaccacucccuuggaccuccggcgcgagcacuucccaggagacuuggaaccgucaggaccugcuugugaccuucaagacugcccacgcgaagaagcaagaaguggucguucugggcagccaggagggugccaugcacaccgcacugacaggggccaccgaaauccagacuaguggcacuacgacaauuuucgccgggcaccugaagugccgccucaagauggacaagcugacacugaaggguauguccuacgugaugugcacugggaguuuuaagcuugagaaggaagucgccgaaacucagcacggcacuguguuaguacaaaucaaguacgaaggcaccgacgcccccugcaagauccccuucuccacgcaggacgagaaggguguuacgcagaacggccgacugauuacagccaaccccauugugaccgauaaagagaagccugugaacaucgaggccgagccgcccuucggggaguccuacaucgucauuggcgcgggcgagaaggcucugaagcucagcugguucaagaaaggcuccagcauagggaagauguuugaagccaccgcccggggagcccgucgcauggcgauccugggugauacggccugggacuucgggucuauuggcggaguguuuacaagcgucggcaagcugguccaccagaucuucggcaccgccuacggggugcuuuuuuccggggugucuuggaccaugaaaaucggcaucgggguuuuauugacuugguuaggccugaacucccgaagcacgucacugagcaugacauguaucgcuguggggcucgugacacuguaccugggcgucaugguacaggccgacuccgggugcgugaucaacuggaaggggcgggagcucaaaugugggaguggcaucuuugucaccaacgaagugcauaccuggacugagcaguacaaguuccaggcggacagcccgaagcgccugucugcagcuaucggcaaggccugggaggagggggugugcggcauacguagcgccacccgccuggaaaacaucauguggaaacagauuaguaacgagcucaaucacauccugcuggagaacgauaugaaguuuaccguaguggugggcgaugucguggguauccucgcgcagggcaagaagaugaucaggccgcagcccauggagcacaaguauucguggaaaucuugggguaaggcuaagaucaucggcgcagacguacagaacacgaccuucaucaucgacgggccgaauaccccggagugccccgacgaccaacgcgccuggaacaucugggagguagaagacuacggguuugggaucuucaccacaaauaucuggcuuaaacuacgggauagcuacacacaggucugcgaccaccgccucauguccgcugccauuaaggacucgaaggcuguucacgcggauaugggcuacuggaucgaguccgagaagaacgagaccuggaagcuggcccgggcguccuucauugagguaaagacauguaucuggcccaaaagucacacgcuguggagcaacggggugcucgaguccgagaugauaauccccaaaaucuacgggggcccgauaagucagcauaacuaccgacccggguacuucacccagaccgccggccccuggcauuuagguaaguuggagcucgacuuugaccugugcgagggcaccacaguggugguagacgagcacugcggcaaccgagggcccaguuugcgcacuaccaccguuacgggcaagaucauccacgagugguguugccggagcugcacccugccgcccuuacgauucaagggggaagauggcugcugguacggcauggagauccggcccgucaaggagaaggaggagaaccuggugaagaguauggucagcgcuggccucggcgagguagacagcuuuucccugggacuucucugcaucuccaucaugaucgaggaggugaugcgguccagauggucacgcaagaugcuuauggccggcacccucgccguuuuucuccugcucauaaugggucaacuuacuuggaaugaccugauccggcuauguauaauggucggagcgaacgccucggaccgcauggggaugggcacgaccuaccuagcguugauggccaccuuuaagaugcgcccgauguucgccgugggccuccuguuccggcgcuuaacgagccgggaggugcuguuacugacgaucgggcugucccucguagcgucgguggaacugcccaacucccuggaagagcucggcgacgggcuggccaugggcaucaugauccugaagcuucugaccgacuuccagagccaccagcugugggcuacccuccugucacugacauucaucaagacgacucucucccugcacuacgccuggaagaccauggccaugguccuguccaucguaagccucuuuccccugugccuguccacgacgucgcagaagaccaccuggcugcccgugcugcugggaucccucgggugcaaaccccucaccauguucuugaucgccgagaacaagaucuggggccgaaagagcuggccgcuuaacgaaggcaucauggccgucggcguggucuccauccugcugucuagccuccucaagaacgauguuccccuggccggaccccucaucgccggcggcaugcuaaucgcgugcuacgugauuuccggcagcucugccgaccugaguuuagagaaggccgccgaaguguccugggaagaagaggccgagcacagcggggcgucccacaacauccuggucgaggugcaggacgacgggacgaugaagauaaaagaugaggaacgggacgacacccugacaauccucuuaaaggccaccuugcucgccauuagcggcguguacccgcuuucgauccccgcgacccuguucgucugguacuucuggcaaaaaaaaaaacagcgcagcggggugcuuugggauacacccagcccgccggagguugagagagccguccucgacgacggcaucuaccgcaucaugcagcggggccugcuggggcgcagccagguugguguggggguguuccaggagaacguguuucacaccauguggcacgugacccgcggcgcgguccucauguaccaggggaagcgccuggagccuucgugggccagcgugaaaaaagaccucaucagcuacggcggcggguggcggcuccagggcuccuggaacaccggugaggaggugcaagucaucgcuguggagcccggcaagaacccgaaaaacgugcagacggcacccgggaccuucaagacacccgagggcgaggucggugcuaucgcgcucgacuucaagccagguaccuccggaagccccaucgugaaucgagaggggaagaucguuggccuuuacggcaacggagucgugacgacauccggcaccuacgugagcgcgauugcccaggccaaggcgagccaggaggggccgcuccccgagauagaggacgaggucuuucggaagcgcaaccugaccaucauggaccuccaccccggcucagggaagacgcggcgauaucuccccgccaucgugcgggaggccaucaagcgcaaacugcggacccugauccucgcgcccacccgcguggucgccagcgagauggcggaagcccugaaggggaugcccauccgcuaucagaccacggccgugaaguccgaacacacgggcaaggagaucguggaccugaugugucacgccacguucaccaugagacuccucagccccguccgcgucccgaacuauaacaugaucaucauggacgaggcccacuucaccgaucccucaagcaucgcggcccgggguuacauaucaacccgcguaggcaugggggaagccgcagccaucuucaugaccgccaccccgcccggcagcgucgaggccuucccucaguccaaugccgugauccaggacgaggagcgggacauaccggagcgcagcuggaauuccggguacgaauggaucacggauuuccccggcaagaccgugugguucguccccagcaucaaguccgggaacgacaucgccaacugucugcggaaaaacggcaagcggguaauccagcugagccgcaagacauucgauaccgaguaccagaagacgaagaacaacgacugggacuacgucgucaccacggacaucagcgaaaugggcgcuaacuuccgcgccgaucgggugaucgacccgcgccggugucugaaaccugugauccucaaggacgggcccgagcgcgucauccucgccgggccgaugccggugaccgucgccagcgccgcgcagcggcgcgggagaaucggucgcaaccacaacaaggagggcgaccaguacauauacauggggcagccauuaaacaaugacgaagaccacgcgcacuggacugaggccaagaugcugcuagacaauaucaacacucccgagggcaucauccccgcccuguucgaaccggagcgggagaaauccgcggcuaucgacggagaguaccgucugcgcggcgaggcccggaagaccuucguggagcucaugcgucgcggggaccugcccguguggcuaagcuacaaggucgccuccgagggcuuccaguauucugaccgccgguggugcuucgacggcgagcgaaacaaucaggugcucgaggagaauauggacguggagauauggaccaaggagggggagcggaagaagcuucgccccagguggcuggacgcccgcacguacagcgacccacucgcccuucgggaguucaaggaguucgcggccggccggcgguccgucagcggugaccugauccucgagaucgggaagcugccgcagcaccuaacccagcgcgcccagaacgcccucgacaacuuggugaugcugcacaacuccgaacagggcgggcgugcguaucggcacgccauggaagagcuccccgacaccaucgagacccugaugcugcucgcccugaucgccguacuaacuggcggagucacccucuucuuccugagcgggagaggacugggcaagaccuccaucggccuccugugcgugauggcuucauccgugcuacucuggauggcgagcgucgagccgcacuggaucgccgccuccaucauccuugaauucuuccucauggugcuccugauccccgagccggaucgacagcggacgccccaagacaaccagcuggccuauguagucauugggcuccuguucaugauccugacgguggcagccaacgagaugggccuacuggagacuaccaagaaggaccuggggaucggccacguggcugucgagaaccaccaccaugccacaaugcucgacguggaucugcaccccgccagcgcguggacccuguacgcgguggcuacaacaaucauaaccccgaugaugcgacauacuauugagaacacuaccgccaacaucucccucaccgccauugcaaaccaggcggccauccugauggggcucgacaagggcuggcccaucagcaagauggacaucggcguuccccuccuggccuuagggugcuacucccaggugaaccccuuaaccuuaacggccgcugugcugaugcucguggcccacuacgcaaucaucggcccagggcugcaggcuaaggccaccagagaggcucagaagcgaaccgccgccggcaucaugaagaaccccaccguggaugguaucguggcgaucgaccuggaccccguuguguacgacgccaaguuugagaagcaguugggccagaucaugcugcugauccucugcacgucacagauccugcuuaugcguaccaccugggcguugugugagucgaucaccuuagcgacgggcccgcugacgaccuuaugggaggggaguccgggcaaauucuggaauacgacgaucgccgugucgauggccaacaucuuccgugggagcuaccuggcgggcgcgggccuggccuucucacucaugaagagucuggguggcggacgccgagggaccggggcacagggcgagacgcugggcgaaaaguggaagcgccaacucaaccagcugagcaaguccgaauucaacaucuacaagcggagcgggauuauggaagucgaccgcuccgaggcgaaggagggucugaagcguggggaaaccacgcgccacgcggucagccggggcaccgccaaacucaggugguucguggagcgaaaucuugucaagccugaaggcaaggugauagaccuggguugcggccguggggggugguccuacuacugugccggucugaaaaaggugaccgaggucaagggcuacaccaagggcggacccggccacgaagagcccauccccauggccacauauggcuggaaccucguuaaacuacacagcggcaaggacguguucuuuacgccgcccgagcggugugacacccuacuuugcgauauaggcgaaucuagcccaaacccgaccaucgaggagggccgcacgcugcgggugcugaagaugguagagcccuggcuccgcgggaaccaguucugcaucaagauccugaauccuuacaugcccuccguggucgagacccuggagcagaugcagcgcaagcacgggggcaugcucgugagaaauccguuaagccggaacuccacucacgaaauguacugggugagcugugggaccggcaacaucgucuccgccgugaacaugaccagccgcaugcugcuuaaccgcuucacgauggcccaccggaagcccaccuacgagcgugacguggaccuuggggccggcacccggcacguggccguggagccagaagucgccaaccuggacaucaucggccagcguaucgagaacaucaagcacgagcacaaguccaccuggcauuaugacgaggacaaccccuacaagacgugggcauaccacgggagcuacgaggucaaaccguccggguccgcguccaguauggugaacggggucgugaagcuccucacuaaacccugggacgugauccccaugguuacucagaucgcaaugaccgauacgacccccuuuggccagcagcggguguucaaggagaagguggacacccgaaccccgaaggccaaaagagguacggcucagaucauggaagugaccgcacguugguuguggggcuuuuugagccggaacaagaagccccgcaucugcacccgggaggaguucacccgcaagguccgguccaacgcggccauaggagccguguucgucgacgagaaccaguggaacagcgccaaggaggcgguggaggacgagcgcuucugggaccuggugcagaaggagcgggagcugcacaagcaggggaagugcgccacgugcgucuacaacaugaugggcaagcgcgagaagaagcucggggaguucggcaaggccaaggggucccgggcgaucugguauauguggcugggcgcucgcuuccuggaguuugaggcuuuagguuucaugaaugaagaccacugguucucgagggagaauucccugagugggguggagggcgagggucugcacaaacucggcuacauccugcgugacaucuccaagaucccagggggcaacauguacgccgacgacaccgcggguugggacacucggaucacggaggacgaccuccagaacgaggccaagauuacggacauuauggagccggaacacgcccuccucgcaaccagcaucuuuaagcugaccuaccagaacaaggucgucagaguccaacgccccgccaagaacgggaccgugauggacguaauuucccgucgagaccagcggggcagcggccaggugggaacguacggccucaacaccuucacgaacauggaggcccaacucauccgccagauggaguccgaagggaucuucuuacccagcgagcucgagaccccuaaccuggccgaacggguccuggacuggcucgagaagcacggcguagagcgccugaagcggauggccauuuccggggacgauugcguggugaagccgauagacgaccgcuucgcgacggcccugacagcccugaacgacaugggcaaggugcggaaggauaucccgcagugggagcccucaaaaggguggaacgacuggcagcaggucccauucuguucccaccauuuccaucagcugaucaugaaagacggccgcgaaaucgugguuccgugccggaaccaggacgagcugguaggccgagcccgugugagccagggggcagguugguccuugcgcgagaccgcgugccugggcaaauccuacgcacagauguggcagcugauguacuuucaccggagagaccuccggcuggccgccaacgcuauaugcagugcaguacccguggacugggugccaaccucgcguacgaccuggagcauccaugcacaccaccaguggaugacuaccgaggacaugcuguccguguggaacaggguguggaucgaggagaaucccuggauggaggacaagacgcacgugucuuccuggggcgauguucccuaucucgggaagcgggaggaucaauggugcggcagccugauaggcuuaaccgcccgcgcgaccugggcuuccaacauacagguggccaucaaccagguccggcgacucaucgggaacgaaaacuaucucgauuacaugaccucaaugaaacgguucaaaaacgaaggcgacccugaaggggccuuaugguga

SEQ ID NO: 24512 - RNA, 9879 nt, Artificial Sequence
  derived and/or modified CDS sequence (opt11) from DENV-1__HM181970__SS-prME
agcgugaccaugcugcuaaugcuaaugcccaccgcacuggcguuccaccucaccacccgcgguggcgagccccauaugaucgucagcaagcaggagcggggcaagucccugcuguucaagaccuccgccggggugaacaugugcacccucauagccauggacuugggagagcuaugcgaggacacgaugaccuacaagugcccgcgcauuaccgaggccgagcccgacgacguggacugcuggugcaacgccacugacacgugggugacauacggcaccugcagccagacgggagagcacaggcgcgacaagcggagcguggcucucgcgccccacgugggccuggggcuggagacgcguaccgaaaccuggaugagcuccgagggcgcuuggaagcagauccaacggguugagaccugggcccuccgccaccccggguucacggugauagcccuauuccuggcgcacgccaucggcaccuccaucacccagaaggggaucaucuucauccugcugaugcuggugaccccauccauggccaugcggugcgucggcaucggcagccgagacuucguggaggggcucaguggcgccacguggguggacgucguucuggagcacggguccugcgugaccacaauggccaaggacaagcccacgcucgacaucgaacuccuaaagacggaggucacaaaccccgcgguccugcggaagcucugcaucgaggccaagaucuccaacaccaccacagacagcagaugcccgacucagggcgaagccacccugguggaggaacaggacgccaacuucgucugccggcgcacguucguggaccguggcugggggaacggcugcgggcuguucggcaaggggucccuuaucacgugcgccaaauucaagugcguaacgaaguuagagggcaagaucgugcaguacgagaaccugaaauacagcgugaucgugacgguucacaccggcgaccaacaccaagucgggaaugagagcaccgagcacggcaccaccgcgaccaucacgccacaagcccccacgaccgagauacagcucacagauuacggggcccugacacuggauugcucuccccgaacgggccucgacuucaacgagaugguccugcugacuaugaaagaaaagucuugguuggugcacaaacagugguuccuggaucugccccugcccuggaccagcggcgcgagcaccucccaggagacguggaaccggcaggaccugcugguaaccuuuaaaacagcccacgcgaagaagcaggaggucguggugcuagguucgcaagagggugccaugcacacugcccugacgggggccaccgagauacagaccuccggcaccacaaccaucuucgcgggacaccuaaagugccgccucaagauggacaaauugacccugaaggguaugagcuacguaaugugcaccgggaguuucaagcucgagaaggaaguggcggagacgcagcacggcacggugcucguccaaaucaaauacgagggcaccgacgcccccugcaagauccccuuuucgacccaggacgagaagggggugacucagaacgggcggcugaucaccgccaacccaauugugaccgauaaagagaagcccgucaacaucgaggcggaaccgcccuucggggaguccuacaucgugaucggagcgggcgagaaggcccugaaguuguccugguucaagaagggguccuccaucggcaaaauguuugaggcaaccgcccgcggggcccggcgcauggcgauccugggcgacacggccugggauuucggguccaucggaggcguguucacuagcgucgggaagcugauacaccagaucuucgggaccgccuacgggguacucuucuccggagugagcuggaccaugaagaucgggauaggcgugcugcuuacguggcucggccugaacucaaggagcaccucccugagcaugaccugcaucgccguggggcuagugacucuguaccucggcgucauggugcaggccgacuccgggugcgugaucaacuggaagggccgggaguugaagugugggagcgggaucuucgugacgaaugaggugcacacguggaccgagcaguacaaguuccaggccgacagcccgaagaggcuguccgccgccaucggaaaggccugggaggaaggcgugugcggaauccggagcgccacccgccuagagaacauuauguggaagcagaucuccaacgagcucaaccacauacugcuggagaacgacaugaaacucaccgucgucgugggagacgucgcgggcauccucgggcaggggaagaagaugauacggccccaacccauggaguacaaguacagcuggaaguccuggggcaaggccaaaaucaucggugccgacgcccagaacacgacguucaucaucgacggucccaauacuccggagugccccgacgaccagcgcgcguggaacaucugggagguggaggacuacggguucggcaucuucaccacgaacaucuggcugaagcuccgggacucuuacacccagguuugcgaccaucgccugauguccgccgccauaaaggacagcaaggccguccacgccgacaugggcuacuggauugaguccgagaagaacgagacuuggaagcuugcgcgggccucguucaucgaggugaagacaugcaucuggcccaagucccacacgcucuggagcaacggaguguuggaguccgagaugaucauccccaaaaucuacggagggccgaucucacaacacaacuaccgccccgguuacuuuacucagacagcggggccauggcaccugggcaagcuagagcuggacuucgaccucugcgagggcaccacaguagugguggacgagcacugcggcaaccggggcccgucccuccgcaccaccaccgugacgggcaagauaauccacgaguggugcugccgaagcugcacccuuccgccccuucgcuuccggggcgaggauggguguugguacggcauggagauccgccccgugaaagagaaggaagagaaccucgugaagaguauggucagcgcagguagcggcgagguugacucuuucucacugggccugcucugcaucuccaucaugaucgaggaggugaugcggucacgcugguccagaaagaugcugaugaccgggacccuggccgucuucuuccuccugaucaugggccagcugacguggaacgaccucauaagacuguguaucauggugggggcgaacgccuucgaccgcaugggcaugggcacuaccuaccuugcccuuauggccaccuucaagaugcggccgauguucgccgugggacugcuguuuaggcgucucacgucccgcgagguccugcugcuuacgaucggccugucccugguggcgagcguugagcucccaaauucccuggaggagcuaggggacggccucgccaugggcaucaugauacugaaacuacucaccgauuuccagucacaccagcugugggccacccugcucucccugacguucaucaaaaccacguucagccugcauuaugccuggaagacgauggcgaugguccucuccaucgugagucuguucccccugugcuuauccacgaccagccagaagaccaccuggcugcccguacugcuugggucccucggcugcaagccgcugacgauguuucucaucgccgagaacaaaaucugggggcggaaaagcuggccccugaacgaggggaucauggccgucgggauugucuccauccuucucagcagccugcugaagaaugacgucccccucgccggcccccucaucgccggcgggaugcuaauugcguguuacgugaucuccgggucguccgccgacuugagccuggagaaggcggcggaggugucaugggaggaggaggccgagcacagcggggcgucccacaacauccuggucgaggugcaggacgacgggaccaugaagaucaaggacgaggagcgcgacgacacccugacgauccugcugaaggccacacuccuggcugugagcggagucuacccgcugucuauccccgccacccucuuugugugguauuuuuggcagaaaaagaagcaacggagcggcguacugugggacacccccagcccgcccgaaguugagcgcgccgugcucgaugacggcaucuacagaaucaugcagcgcgggcuguuaggccggucgcaggugggaguagguguauuccaggaggacguguuccacaccauguggcacgucaccagaggugcggugcugauguaccagggcaaacgccuggagcccuccugggccucugugaagaaggacuuaaucuccuacggcgggggcuggcgccugcgggggagcuggaacacgggcgaggagguccaggugauagccguggagccagggaagaaccccaagaacguccagaccgcccccgggaccuucaagaccccugagggcgaggugggggcaauugcgcuggacuucaaacccggaacguccggcucccccaucgucaaccgcgagggcaagaucgucggccucuacggcaacggcguggugaccacuuccgggaccuacgucuccgccaucgcccaggccaaggcgagccaggagggcccgcuccccgagauagaagacgaggucuuccggaagcgcaaccugacgauaauggaccuacaccccggguccggcaagacccggcgcuaccucccggccaucguucgugaggcgauuaagcgaaagcugcgcacccucauccuggccccgacccgggucguagccagugaaauggcggaggcccugaagggcaugccaauacgcuaucagacgaccgccguuaaguccgagcacacggggaaggagaucgucgaccugaugugccaugccaccuucacuaugcggcugcugagccccgugcgagugcccaacuacaauaugaucaucauggacgaggcccacuucaccgauccgucguccauugcagccaggggcuacaucuccacacgcgucgggaugggcgaggccgcggccauauucaugaccgcgacuccgcccgggagcgucgaggcuuucccgcaguccaacgcugugauccaggacgaggagcgggacauccccgaacgcucauggaacuccggccacgaguggaucaccgacuucccgggcaagaccguaugguucgugcccagcaucaaguccgggaacgacaucgccaacugcuugcguaagaacggaaagcgugugauccagcugagccggaagaccuucgacaccgaguaccaaaagaccaaaaauaacgacugggacuacguugugaccaccgacaucuccgaaaugggggcaaacuuccgcgccgaccgggucaucgacccgcgccgaugccugaagcccgucauccucaaggacggcccggaacgcgugauccuggccgggcccaugccugucacagucgccucagccgcacagcggcgcggccggauuggccgcaaccauaacaaggagggggaccaguacaucuacaugggacagccccugaacaacgaugaggaccacgcccacuggaccgaggccaagaugcuacuggacaacaucaacacaccggaggggaucauccccgccuuguucgagccggagcgcgaaaaauccgccgcgguggacggagaauaccggcuccgcggcgaggcccgaaagaccuuugucgagcugaugcgccggggcgaccugcccguguggcucagcuacaagguggccuccgagggcuuccaguacucagaccgccggugguguuucgacggggaacgcaacaaccagguacuggaggagaacauggacguggagaucuggacgaaggagggcgagaggaagaagcugcgucccagguggcucgacgccagaaccuacagcgacccucuggcacugcgggaguucaaggaguucgcggcggggcgccgguccgugagcggcgaccucaucuuggagaucggcaaguuaccucaacaccugacccagcgcgcgcagaacgcgcucgauaaucuggucaugcugcacaacagugagcagggugggcgggcguaccgccacgccauggaggagcugcccgacaccaucgagacgcugaugcuccuggcucugaucgccgugcucaccgggggcgugacucuguucuuccugagcgggcggggcuuagggaagaccucuaucggguugcugugcgucauggccagcuccguacuccuguggauggcaucgguugagccccacuggaucgcggcauccaucauccuggaguucuuucucaugguccuacugauccccgagcccgacaggcagcggacgccccaggauaaucagcuagcauacgucgugaucggccuguuguucaugauccuaacugucgccgcgaacgaaauggggcugcuagagaccaccaagaaagaccucggcaucgggcacguggccguugagaaccaccaccacgccgccaugcuugacguugaccuacaccccgcgagcgcguggacccucuacgccguggccacgaccauaaucaccccgaugaugcgccacaccaucgagaacacgaccgccaauaucagccugaccgcaaucgcgaaucaggccgcaauccugaugggccuagacaaagguuggcccaucagcaagauggacaucggugugccccugcuggcccucggcugcuauucccaggugaacccccugacgcugacggcggccgugcucaugcuuguggcccacuacgcuaucaucgggccgggccuccaggcuaaggcgacacgcgaggcccagaagagaaccgcagcagggaucaugaagaauccgaccgucgacggcaucguggcaauugaccucgaccccguggucuacgacgcgaaguucgagaaacaacugggccagaucaugcuucucauacugugcacgagccagauccugcugaugcguaccaccugggccuugugcgaguccaucacucucgccacgggaccccucaccacucugugggagggcagcccggggaaguucuggaacacgacgaucgccguauccauggccaacaucuuccggggcagcuaccuggcgggggcugggcucgccuuuucccugaugaagucucugggagggggccgccgagggaccggcgcacaaggcgagacucuaggggagaaguggaagcggcagcugaaccagcugagcaagagcgaguucaauaccuauaagcggaguggcaucauggagguggacagauccgaggcgaaggagggucucaagcggggcgagacgaccaagcacgccgucagccgggggaccgccaagcugcggugguucguggagcgcaaucugguuaaaccggagggcaaggucaucgaccuggggugugggcggggaggcugguccuacuacugugcuggccucaagaaggugaccgaggugaagggguacacaaagggcggccccgggcacgaggagcccaucccgauggccaccuacggcuggaacuuggugaaacugcacagcgggaaggacguguucuucaucccgcccgagaagugcgauacccuccugugugacaucggcgagucguccccuaacccgaccaucgaggaggggcgcacgcuacgggugcucaagaugguggagcccuggcugcgcggcaaccaauucugcauaaagauccugaaccccuacaugcccucugugguggagacccucgagcagaugcagcggaagcacggcgggaugcugguccgcaacccgcugagccggaauuccacccacgagauguauuggguaucgugcggcacggguaacaucguguccgcgguaaacaugacuagccgcaugcuccucaaccguuucacgauggcccaccguaagcccaccuacgagcgcgacguggaccugggaaccggcacccggcacguggcaguggagcccgagguggccaaccuugacaucaucgggcagcgcaucgagaacaucaagcacgaacauaaguccacguggcacuacgacgaagauaaccccuacaaaaccugggccuaccacggcuccuacgaggugaaaccuuccgggagcgcgagcucgauggugaacggcgucgucaagcuacucaccaagcccugggacgugaucccuauggugacccagaucgcgaugacggauaccacccccuucgggcagcagcgugucuuuaaggagaagguggacacccgcacgccuaaagccaagcggggcaccgcccagaucauggaggugaccgcccgcuggcucuggggcuucuugucacggaacaagaagccccgaaucugcacccgggaggaguucacgagaaagguccgguccaacgcagcuaucggggcgguguucguggacgagaaccaauggaacagcgcuaaggaggcggucgaggacgagcgcuucugggaccuggugcaucgggaacgcgaguugcacaagcaaggcaagugcgcgacgugcguguacaauaugauggggaagcgggaaaagaagcugggggaauucgguaaagccaagggcucacgcgcaaucugguacauguggcugggagcccgguucuuagaguucgaggcgcugggguucaugaacgaggaucacugguucagccgcgagaacucccugucgggcgucgagggggaaggccuccauaagcucggguauauccugcgggacaucuccaagaucccgggcggcaacauguacgccgacgacaccgccgggugggacacacgcaucacggaagacgaccuccagaacgaggccaaaaucacugacaucauggagcccgagcacgcccuccuggccaaggccaucuucaagcucaccuaucagaacaagguggugcgcgugcagcgucccgccaagaacggcaccgugauggacgucaucagccggcgggaccagcggggguccggccagguaggcacauacggacugaauacauucaccaacauggaggcucagcugauacggcagauggaaucugagggcaucuucucccccagcgagcucgagaccccuaaccuagcggagcgugcgcuggacuggcucgagaaauacgggguggagcggcugaagcgaauggccaucuccggugacgacugcgugguuaagccgaucgacgaucgguucgccaccgcccugacugcccucaacgacaugggcaaagugcgcaaggacaucccccagugggaacccagcaagggauggaacgacuggcagcaggucccauuuuguagccaccacuuucaucagcugauaaugaaggacggucgggagaucgucgugcccuguagaaaccaggacgagcuuguggggcgggcccgcguaucacagggcgccggcuggucccuccgggagacugcuugccugggcaagagcuacgcccaaauguggcaguugauguacuuccaccgccgggaccugcgcuuagcggccaacgccauaugcagcgccguacccguggacugggucccgaccucccggaccaccuggagcauccacgcccaccaccaguggaugaccaccgaagauaugcugucuguguggaaccgcguuuggauagaggagaacccuuggauggaggacaagacgcacaucagcuccugggaggacgucccguaccucgggaagcgcgaggaucaguggugcggcucccuaaucgguuugacggcgcgcgccaccugggccaccaauauacagguagccaucaaucaagugaggagacucaucgggaacgagaacuaccuagacuacaugaccuccaugaagcgcuuuaaaaacgagagugacccugaaggugcccugugguga

SEQ ID NO: 24513 - RNA, 9879 nt, Artificial Sequence
  derived and/or modified CDS sequence (opt11) from DENV-1__GU131821__SS-prME
agcgugacaaugcugcucaugcugaugccuaccgcccuggccuuucaccucacuacccgaggcggggaaccucacaugauaguaagcaagcaggagagaggcaagagccugcuguucaagacgagcgccggcgugaauaugugcaccuuaaucgcuauggaccugggcgaguucugcgaggacacgaugacauauaagugcccacgcauaacggaggcagagcccgaugacgucgauugcuggugcaacgcaacagacacgugggugaccuaugggaccugcagccagaccggcgagcaucgucgggacaagcggaguguggcgcuagcgccucauguggggcucggccuugagacacgcacagaaaccuggaugagcuccgaaggggccuggaagcagauucagaaaguggaaaccugggccuuacggcauccaggguuuacuguaaucgcccucuuucuggcgcaugccauaggcaccagcaucacccagaaggggaucaucuucaucuuacucaugcuggugacaccuaguauggcgaugcgaugcguaggcaucggcucccgggacuuuguggaggggcuguccggcgccacuuggguggacgugguucucgagcaugggagcugugugaccacgauggccaaggacaagccuacccuggacaucgagcuguugaaaacggagguuaccaacccggcggugcuccgcaagcuguguauugaagccaagauaaguaacacuacgacggacagccggugcccgacucagggcgaggccacacucguggaggagcaagaugccaauuucguuugucgccggacauucguggaccgcggcuggggcaacggcugcggucucuuuggcaaagggucucugauaacgugcgccaaauuuaagugcgugaccaagcucgagggcaagacaguccagcacgagaaccugaaauacagcguaauugugacaguccacacaggagaccagcaccaagucgguaacgagucaaccgaacacggcaccaccgcgaccauaacaccucaggcacccagcacggagauccagcugaccgacuacggggcccucaccuuagacugcagcccgcggacgggccuugacuucaacgagaugguacuccuaaccaugaaggagaaguccuggcuggugcauaagcagugguucuuagaccucccgcugccguggacgucaggggccucgacgucacaggaaacuuggaaccgcaaggaccuauuggugaccuucaagaccgcacaugcuaagaagcaagaggucgugguauuaggcucacaggagggcgcgaugcacaccgcccucacaggggccacagagauccaaaccuccggcaccacgaccauuuucgcagggcacuuaaagugccggcugaagauggacaagcucacccugaagggcaugagcuacguuauguguacagggagcuucaagcuggagaaggagguggcggagacgcagcacggaacugugcucguacaaaucaaguacgagggcaccgacgcgccuugcaagauacccuucuccacgcaagacgagaaaggggugacgcaaaacggccgccucaucaccgccaauccgauugugacugacaaagagaagcccgucaacaucgaggcagagccgccguucggggagagcuauauugugauaggugccggcgagaaagcacugaagcuguccugguucaagaaaggaagcuccaucggaaaaauguucgaggccaccgcccguggggcccgccggauggcgauccucggugacacggccugggacuucgggucuaucggcgguguguucacuuccguagggaaauuagugcaccagaucuucggcacagccuacggugugcucuucagcggcguauccuggacaaugaagaucgggaucggagugcuccugacauggcucggccucaacucucgcaguaccucucuguccaugaccugcaucgccgugggccuugucacccucuaccugggcgugaugguacaagcugacagcgggugcgucaucaacuggaaagggcgcgaguugaaaugcgggucgggcaucuucgugacgaacgaggugcacaccuggaccgagcaguauaaguuccaggccgacuccccgaagcgguuaagcgcggccaucggcaaagccugggaagaaggggucuguggcauccgaagcgccacccggcuggagaacauuauguggaagcagaucagcaacgaacugaaccacauccuccuugagaacgauaugaaguucacugugguggugggggauguggcgggcauccuggcucaggggaagaagaugauuagaccccaacccauggaguacaaguacuccuggaagucguggggcaaggcuaagauaaucggcgcugacgugcagaacacgaccuucaucauugacgggccuaacaccccggaauguccggacgaccagcgggcguggaacaucugggaggucgaggacuauggcuucgggaucuuuacuacgaacauauggcucaaguugcgcgauaguuacacucagguuugugaucacaggcucaugagcgcagcuauaaaggacuccaaggccgugcacgcagauaugggauacuggauugagucagagaagaaugagaccuggaaacucgcgagagcguccuuuaucgagguaaaaaccugcaucuggcccaagagccauacgcugugguccaacggcguguuagaaagcgagaugauaauaccaaagauauaugggggcccgaucucucagcacaacuaccggcccggguacuucacccagaccgcgggccccuggcaccucggaaagcuggagcucgacuucgaccucugugaagggaccacuguggucguggaugagcacugcgguaaccgcgguccgagccugcgcaccacuaccgugaccggaaaaaucauccacgagugguguuguagauccugcacguugccgccccuccgguuuaaaggggaggaugguugcugguacgggauggagauccgccccgucaaggaaaaggaggaaaaccuggucaaaagcaugguaagcgccgguuccggcgaggucgacuccuucucccugggguuacugugcauuucaauaaugauagaagagguaaugcgcucucgcuggagcagaaagaugcugaugaccggcacacucgccguguuuuuccuacucaucaugggucagcucacguggaacgaccugauccgccuauguaucaugguaggcgcgaacgccucugauaggauggggaugggcaccacuuaccucgcccugauggcuacguucaaaaugcgcccuauguucgcugugggcuugcuguuucgccgucugacaucacgcgagguuuugcuccugacaaucggacugucucuugucgcgucaguggaacugcccaacaguuuggaggagcucggcgaugggcuagcuaugggcauuaugauccugaaauugcugacggacuuccagagccaccaacugugggccacacuccugucucugacguucaucaagaccacuuucagccuccacuacgccuggaagaccauggcgaugguccugucuauugugucacuguucccccuaugcuuguccacgaccucccagaagaccaccuggcucccaguucuccugggcagccugggaugcaagccguuaaccauguuccugaucgccgagaacaaaaucuggggccggaagagcuggccacugaacgagggaaucauggccgucgggaucgugagcauuuuauuguccagccuucucaagaacgaugugccccuggcagggccacucaucgcuggcggcaugcugauagccugcuacgucaucucugggucauccgccgaccugagcuuagagaaggccgccgagguguccugggaggaagaggcugagcacagcggcgcgucccacaacauccucguggaaguacaggaugacgggaccaugaagaucaaggacgaggagcgugaugauacucugaccauccuccucaaagcgaccuugcucgccguaagcggaguuuacccucucuccauccccgccacgcuguucgucugguacuuuuggcaaaagaaaaagcagcgcagcggggugcucugggacacgcccagcccaccugagguugaacgagccguccucgaugacggcauauacagaaucaugcagcgcggcuuguuagggaggagccaggucggcguuggaguguuccaggagaacguguuccauaccauguggcacgugacgcgaggcgcgguacugauguaccaggggaagcgauuagaacccuccugggccucagugaagaaagaccugaucuccuacggcggcggguggcgccuccaaggcaguuggaacacaggggaagaggugcaggucaucgccguugagcccgggaagaaccccaagaacguucagaccgcccccgggacguuuaaaaccuccgagggcgaggugggcgccaucgcccucgauuuuaagcccggaacgucuggcucgccuauuguaaacagagaggggaaaauagugggccuguacggcaacgggguggugaccaccuccggcacauacguguccgccaucgcccaagccaaagcgagccaagaagguccccugccggagauugaggacgagguguuucguaaacggaaccuaacgaucauggaccugcaccccggcagcgggaagacccgccgguaccugcccgccauuguuagagaggcuauuaagcggaaacuccguacccuaaucuuagcuccaaccagagucgucgccuccgagauggcggaggcccuuaagggaaugccgauccgcuaucaaacuaccgccguuaagagcgagcacacuggcaaggagauuguggacuuaaugugccaugccaccuucacgaugagacugcucuccccagucaggguacccaacuauaacaugauaaucauggaugaggcccauuucaccgacccguccucgaucgccgcccguggauacauuagcacccgggugggcaugggggaggccgcagccaucuucaugacggcgacgccgccuggcuccgucgaggcguucccccagagcaacgcggugauacaggacgaagagcgcgacauucccgagcgguccuggaacagcggguacgaauggaucacggauuuccccggcaagacggugugguuuguacccucaaucaaguccgguaacgauaucgcgaacugcuugcgcaaaaacgguaagcgcguaauccagcugucccggaagaccuucgacacggaauaucagaaaacaaaaaacaacgacugggacuaugucgugacuacggacauaagcgagaugggagcaaauuuccgugcugaccgcguaaucgacccccggcgcugucucaagccggucauacucaaggacggucccgagcgagucauccuggccggucccaugcccgugacagucgccuccgccgcgcaacgccguggacgcauaggccggaaccauaauaaagagggcgaucaauacaucuacauggggcaaccguuaaacaacgaugaggaccacgcccacuggacagaggccaagaugcuccuagacaacaucaacacacccgagggaaucauccccgcccucuucgagcccgagagggagaaguccgccgcgauagauggggaguauagauuacgcggcgaggccagaaagacguucguggagcugaugcggcgcggggaucucccgguguggcugagcuacaagguugccuccgagggguuccaguacagcgaccggcgcugguguuucgacggagaacggaacaaccaggugcuggaggaaaacauggauguagagaucuggaccaaggaaggggaacgaaagaaauuacggccgcguuggcuggaugcacggaccuacuccgacccccucgcccuccgugaguucaaagaguuugcggcaggccggcgcagcguauccggggaccuaauccuggagauaggcaaacucccacagcauuuaacacagcgggcccagaacgcccuggacaaccuggugaugcugcacaacagcgaacaaggcgggcgcgcguaucgacacgccauggaggagcugcccgauacgaucgagacgcucauguuguuagcccucaucgccgugcugacuggcggggugacacuguucuuccucucggggaggggacugggcaagacgagcaucggccuguuaugcgugauggccuccagcgcacuucuguggauggccucaguggaaccgcacuggaucgccgcuucgauuaucuuggaguucuuccugaugguccuucucauacccgaacccgaccggcagcgcaccccucaggacaaccagcuggccuauguggugaucggccuccucuucaugauacugacggucgcggcaaacgaaaugggccugcuugagacaacaaaaaaggaccuggggauaggccacguagccguggagaaccaccaucacgcaacuaugcuggaugucgaccuucaccccgccucagcguggacucuauacgccguagccaccacuauuauaaccccgaugaugcgacauacgaucgagaauaccaccgcuaacaucagucugacugccaucgcaaaccaggccgcaauucucauggggcuggacaagggcuggccaaucuccaagauggacauaggcguuccacuucucgcccugggguguuauagccaggucaacccccugacgcugaccgcagcggugcugaugcugguggcccacuaugccaucauaggccccgggcuacaggccaaggcaacccgcgaggcucagaaacggacagccgccggcaucaugaagaacccaacggucgacggcaucguggccaucgaccuggacccuguggucuaugacgcgaaguuugagaagcagcuaggccagaucaugcuccugauucugugcaccagccaaauccuauugaugcgcaccaccugggcgcugugcgaaagcaucacgcucgcgaccggcccuuugaccacccucugggagggcucgcccggcaaguucuggaacacgacuauagcugugagcauggccaacauuuuccgagggagcuaccucgcgggagcuggauuggccuuuucccugaugaaaucacucggaggcgggcgccguggaacuggggcccagggagagacccugggcgaaaaguggaagagacagcucaaccagcucaguaagagcgaguuuaacacguacaaacgcucugggaucauggaagucgaccggucagaggccaaagagggacugaagcgcggggaaaccaccaagcacgccgucucgcgaggaaccgcgaagcuaaggugguucgucgagcgaaaccucgugaaaccggagggcaaggucauugacuugggcugcggccguggaggauggagcuacuacugugcgggccuuaaaaaaguuacagaggucaagggcuacacgaagggugggcccggccaugaggagcccaucccaauggccacauaugguuggaaccuggucaagcuacacucuggcaaggacguauucuucaucccgcccgagaagugcgauaccuuacugugcgacaucggagaaagcucacccaacccuacgaucgaggaaggccggacccuccgagugcugaaaauggucgagcccuggcuucgugggaaccaguucugcauaaagauccucaaccccuauaugccgaguguuguggagacccuggagcagaugcagcgcaagcacggcgggaugcuagugcggaacccccucucuaggaacagcacccacgagauguauuggguguccugcgggacaggcaacaucguuagcgcggucaauaugacgagucggaugcugcuuaacagauucacuauggcccaccggaagccaacguacgagcgcgauguggaccuuggugccggcacacgccauguugccgucgaacccgaaguggccaaccuggacaucaucggccagcgcaucgaaaacaucaagcacgagcacaagucuacguggcauuacgacgaggacaaccccuacaaaaccugggcauaccauggaaguuacgaagugaagcccagcggcagcgccagcagcaugguuaacgguguggucaagcugcucacuaaaccgugggacgugauccccauggugacccagauugccaugacagacacgacccccuucggccagcagcgcguguucaaggaaaagguggacacccggacacccaaagccaagcgagggaccgcccagaucauggaggugaccgcgaaauggcuguggggcuuucuaucgcggaacaagaagccucgcauaugcaccagggaagaguucacgcgcaaagugcggagcaacgccgccauuggugccguuuucguagacgagaaccaguggaauucagcgaaggaggccguggaagacgagcgguucugggaucuaguucaccgggagagggagcugcacaaacaggggaagugugccacaugcgucuacaauaugaugggcaaaagagaaaagaaacugggggaauucgggaaggcuaaggggagucgcgccaucugguacauguggcugggcgcgcgguuccuggaauucgaagcucugggcuucaugaacgaggaucacugguucucccgcgaaaacagccucucaggcguagagggcgagggccugcacaagcugggauacauucuccgugauaucucuaagauacccggcggcaacauguacgccgaugacacugcgggcugggacacccgcaucacggaggacgaucuccagaaugaggccaagaucaccgacauuauggagcccgagcacgcgcugcucgccaaguccauauucaagcugaccuaccaaaacaaggugguacgcguccagcgcccugccaagaacgggacgguuauggaugugauuagucgccgcgaccagcguggcagcggacaggugggaacguacggccucaacaccuucaccaacauggaggcucaacugauccggcagauggagucagagggcauuuuuagucccuccgagcuagagacccccaacuuggcgggccgcgugcucgacuggcuggaaaaacacgggguggagagacuuaagcgcauggcgaucuccggcgacgacugcguugugaagcccaucgacgaccgguuugcuacggcucucaccgccuuaaacgacauggggaagguacgcaaggacaucccgcagugggagcccagcaaagguuggaacgacuggcaacaaguaccuuucugcagccaccacuuucaccagcugaucaugaaggacggccgggaaauagugguccccugccgcaaccaggacgaguugguugggcgcgcucgcgugagucaaggcgcggggugguccuuaagagagacagcgugucugggcaagagcuacgcacagauguggcagcucauguacuuccaccgccgggaccugcgccuugccgccaaugccaucugcucagccgugccggucgagugggugcccacaaguagaacuacauggagcauccacgcgcaccaccaguggaugaccacugaggacaugcucucuguuuggaaccgcgucuggaucgaggagaaccccuggauggaggacaagacgcauaucagcuccuggggcgacgucccauaucugggcaagcgagaggaucaauggugcggcucacugauuggacucacugcccgcgcgacaugggccaccaacauccagguggccaucaaccaaguccgacggcugaucggcaaugagaacuacuuggacuacaugaccuccaugaaaagguucaagaaugaguccgacccggagggggcccucugguga

SEQ ID NO: 24514 - RNA, 9879 nt, Artificial Sequence
  derived and/or modified CDS sequence (opt11) from DENV-1__JF937617__SS-prME
ucagucacaaugcuuuuaauguugaugccuacagcacuggccuuccaccugaccacgagaggcggggagccccauaugguaguuucaaagcaagaacgggggaaaagccuacuauucaaaaccagugcgggggucaacaugugcacguuaaucgcuauggaucugggagagcugugcgaagacaccaugacguacaaaugcccgcgcauaacagaagcagagcccgacgacguggacugcuggugcaacgccacggauacgugggucacauacggcacguguagccaaaccggggaacaccggagggacaaacgaucagucgcgcucgcaccgcacguuggacuaggccuagaaacucgaacggagacguggaugaguagugagggcgccuggaaacaaauacaacgaguggagacgugggcacuccgacacccuggcuucacggugaucgccuuauuccucgcgcacgcaaucggcaccagcauaacacaaaaaggaaucauauucauacuacuuaugcugguaacgccuagcauggcaaugcggugcgucggcauaggcagucgggauuucguagagggacucucgggugcgacuuggguagaugugguauuagagcacggcucuugcguaaccacaauggcuaaggacaagccgacacuagauauagaacuccuuaagaccgaaguuacaaacccagcgauucugagaaaacuauguaucgaggccaagauaaguaacacgacuacggacagucgaugcccaacgcaaggggaagcuacgcugguggaagaacaagaugcgaacuucguaugcaggcggaccuucguggaccggggcuggggcaacgggugcggauuauucggaaaaggaucccugaucacgugugccaaauucaagugugugaccaagcuggagggaaagauugugcaguacgaaaaccucaaauauaguguuaucgugacgguccauaccggcgaucaacaccaagucgguaaugagaguacugagcacgggacaaccgccaccauaacgccgcaagccccaaccacggaaauccagcucacagauuacggagcacucacgcucgacugcagcccgcggaccggacucgacuucaacgagaugguacuauuaacgaugaaggagaaaagcuggcuuguucauaaacaaugguuccucgauuugccccuaccauggacgagcggagcaagcacuucucaagagacguggaaccgccaagaccuccuagugacauucaagacggcacacgccaagaaacaggaaguagucguucucggcagccaagaaggagccaugcacacagcacucacgggcgcaacggaaauacagacgucgggaacuaccaccauuuuugcgggccaccuuaagugccgguuaaagauggacaaacucacgcucaagggaaugucauacgucauguguacugggaguuucaaauuggaaaaagaagucgcagaaacacaacacggcacaguacugguccaaaucaaguaugaaggcaccgacgcacccuguaaaauccccuucagcacgcaagacgaaaaaggggucacacaaaacggccgccucaucacggccaacccaauaguaacagacaaggaaaaaccugucaacauagaggcagaacccccauucggagaguccuacauagugaucggcgcuggcgaaaaagcucuaaaacugaguugguucaagaaagguuccucaaucggcaagauguucgaggcuacggcgagaggugcgcgccgaauggccauacuaggcgacacugcuugggacuuugggagcauaggagggguguucacgagcgucgggaagcugguacaucaaauauuuggaacagcauaugggguacuguucucugggguuaguuggacaaugaagauuggauuaggcgugcuacuaaccugguugggguuaaacagccgcucgacgagcuugucaaugaccugcaucgccgucggauuagucacacuguaccuaggugugaugguacaggcugacucagggugcguuauuaauuggaaaggcagggaauuaaaaugcggcagcggaaucuuuguaacaaacgaaguucacaccuggaccgagcaauacaaauuucaggccgauagccccaagagacuguccgcugcaauaggcaaggcgugggaagagggcgucugcggaauacguucggcaacccgguuggaaaacguaauguggaaacagaucagcaacgagcugaaccacauauuacuugagaaugacaugaaguucacggugguugucggugauguugcagggauccucgcucaagggaaaaagaugauacgaccacaaccgauggaauacaaauacagcuggaaauccuggggaaaagcgaaaauuaugggagccgacgugcaaaauacuaccuuuaucaucgauggcccgaauacccccgagugucccgacgaucagcgagcuuggaauauaugggagguagaagacuacggauuuggaauauuuaccaccaacaucuggcucaaacuccgagacagcuacacacaaguaugugaccaccggcugaugagcgccgccauaaaggacagcaaagcaguacacgcagacauggguuacuggaucgaaagcgagaaaaaugagacauggaagcuagcgcgcgccucauucaucgaggucaaaacaugcauauggcccaaaagucacacccuguggagcaacgguguccuugaaucugagaugauaauccccaaaaucuacgguggacccauaucucagcacaacuaccgcccaggauacuucacacagacggcgggaccauggcaccuagggaagcuggaacuagacuuugaccucugcgaaggcacaacggucguagucgacgagcacugcggcaaccgcgggccuagcuugagaacaaccacaguaacagggaaaaucauccacgaguggugcugcagaagcuguacccucccaccccugagguuucgaggagaggacggcuguugguauggcauggaaauacguccuguaaaagaaaaagaagaaaaccuugugaaaucaaugguaagugccggcuccggggaagucgauagcuucucgcuaggacuccuauguauaucaauuaugaucgaagaaguuaugagaagccgaugguccaggaagaugcugaugacgggcacccuagucguguuccugcugcuaauaaugggccaacuaacauggaacgaccucaucagacuaugcaucaugguaggcgccaacgccagugacaggauggguaugggaacaacauaccucgcccugauggccacauucaagaugaggccgauguuugcaguuggacuacuauuccggcgguuaacaagucgcgaggugcuacuacugacuaucggccucagccuagucgcgagcguggaauuaccuaacucacuagaggaacuaggugacgggcuggcuaugggaauaaugauacuuaagcuccugacggacuuccagucccaccagcuuugggcgacacuacucucauuaacguucaucaaaaccacguucagcuugcacuacgccuggaaaaccauggccauggugcuuaguaucguaucucuauucccucuaugccucagcacaaccucgcagaaaaccacauggcucccaguacuccuuggcucacugggcugcaagccgcuaacgauguuucugauugcggagaauaagaucuggggccggaggagcuggccgcugaaugaaggcauaauggccgugggaauaguaagcauacugcuaucgucacuacucaaaaacgacguaccucucgccgguccacugauagccggaggcaugcuaauagcgugcuacguuauaagcggcuccagugccgaucuaagucuagagaaggcagcagaagugucuugggaggaagaagccgaacacuccggagccagucacaacauucuaguggaaguacaggacgacggcaccaugaaaauaaaggacgaggaacgagacgacacacuuaccaucuuacucaaagcaacccugcuggcuguaucuggcguauaucccuuaagcaucccggcgacacuguuugucugguacuucuggcagaaaaagaaacaacgaucgggagugcucugggacacuccuucaccgcccgaggucgagcgcgcgguccuggaugacgggaucuaccgaaucaugcaacgcggccucuuaggacgcagucaaguaggcgucggaguauuccaggagaacgucuuucauaccauguggcacgucacucgcggcgccguucuaauguaccaaggaaaacgcuuggagcccucaugggcuaguguuaagaaagaccucauuucauacggugguggauggagacuccaaggcaguuggaacacaggcgaagagguccaggugaucgcaguagaaccgggcaagaaccccaaaaacguccagacagcgccaggaaccuuuaagaccccagagggggaaaucggcgccauagccuuagacuuuaagccggggacaaguggguccccaauaguaaaucgggaaggcaaaaucgucggccucuauggaaauggugucguaacaacaagcgguacguacguuucggcgauugcacaagcaaaagccagccaggaaggaccgcucccugaaauagaagacgaggucuuccggaagcgcaacuugacuaucauggaccuccacccgggcucagggaaaaccagacgguaccugccggccaucgucagggaagccauaaagcgcaagcugagaacgcuaauauuggcuccgacccgcguuguggcaagcgagauggcugaagcccugaaaggaaugccuauacgguaccaaaccacugcaguaaagucggaacauacagggaaggaaauaguagaucuaaugugucacgcaacauucaccaugcgacuacucaguccgguacguguccccaacuacaacaugauaaucauggaugaagcgcacuucaccgauccaagcaguaucgcagcacgcggguacaucaguacccgagucgggaugggagaggcggccgcgauuuuuaugacggcgacgccaccgggaucgguugaggcauuuccgcagagcaaugcagugauccaagaugaggaacgcgauaucccagaaaggagcuggaauagcggguacgaauggauaacagauuucccagguaaaacugucugguucguaccuagcauaaagucggggaacgacauagccaauugccucaggaagaacggaaagcgggucauacaguuaagccgcaaaaccuucgacacugaauaucagaagacaaagaacaacgauugggauuauguagugacgacggacauaucagagaugggcgccaacuuuagggcggacagaguuauagacccgcgacggugccuaaaaccagugauccuuaaggacggaccagagcgaguaauucuagcgggaccuaugccagugacgguagccagcgcugcgcagagacgagguagaauuggcaggaaucacaauaaagaaggggaccaauacaucuauaugggacaaccgcuaaacaaugacgaagaccacgcacacuggaccgaggccaaaaugcuccucgacaacauuaacacaccugagggaauaauacccgcacuauucgagcccgaaagagagaaguccgcggccaucgacggugaauauaggcuacgaggugaagcucgcaaaacguuuguagagcuaaugcggaggggagacuuaccugucugguuaaguuacaaaguggcguccgagggauuucaauacagugaccgacgcuggugcuucgacggagaaagaaauaaccaggugcuagaagaaaauauggacguagaaaucuggaccaaagaaggcgaaagaaagaaacugaggccaagauggcucgaugcgcgaacuuauagcgacccgcucgcucucagagaguuuaaagaguuugcagcaggcagaaggucagucagcggagaccucauacuagagaucggaaaauugccccaacaccuaacccagcgggcccaaaaugccuuggacaaccucguaauguugcauaauagcgaacagggcggucgagcguacagacacgcaauggaagaacugccggacaccaucgagacccuaaugcuccucgcacucauagcgguacuaacggguggcguaacccuauucuuccucagcggaagagggcuaggcaaaacgucgauaggcuuacuaugcgucauggcgucgaguguacuacuauggauggcaagcgucgaaccacauuggaucgcagccagcaucauacuggaguuuuuccucaugguacuccucauuccggaaccggacaggcaaagaacaccacaggacaaccaacuagccuaugucgucaucggucuucucuucaugauucuaacggucgccgccaaugaaaugggacuccuagagaccacgaaaaaggauuuaggaauaggacacgcagcgguggggaaucaccaccaugcagcaaugcucgacgucgaccugcaccccgccagcgcguggacauuauacgcagucgcaacaacgaucaucaccccaaugaugcggcacacuauagaaaacaccaccgcaaacaucagccucaccgcaauagcaaaucaagcagcaaucuugaugggccuggauaagggauggcccaucagcaagauggauauuggaguaccccugcuugcuuuaggauguuacagucaagugaacccgcugacauuaacggccgcaguccugaugcucguagcgcacuacgcgauaauaggaccgggacuucaggcaaaggcaaccagagaagcucaaaaacgcacagccgcagggauuaugaaaaaucccaccguagauggcauaguagccauagacuuggaccccgucguauacgacgcuaaauucgaaaagcagcuggggcaaauuaugcuucucauccuuugcacaucacaaauauugcugaugcgcaccaccugggcacugugugaauccauaacccuagccacaggaccacuaaccacgcuuugggagggaaguccaggaaaauucuggaauacgacgaucgcggugucaauggcuaauauauuccgcggaagcuaccuagcgggagcagggcuagcguuuucccucaugaagagucucggaggaggacgccggggcacgggcgcacaaggcgaaacgcuuggcgaaaaauggaaaagacaacugaaccagcuaagcaaaucagaguucaacaccuacaagagaucgggcaucauggaggucgaccgcagcgaggcaaaagaggggcuaaaaagaggggagacaacaaaacaugccguuucgcgaggaaccgcgaaacuacgcugguuugucgaaaggaaccucgugaaaccggagggcaaagugauugaccuaggcuguggacgaggaggcuggucuuauuacugcgcaggccuaaagaaagucacugaggucaaaggauauacgaagggaggaccaggccacgaagaaccaauaccaauggccacauacggcuggaaucugguaaaacuccacuccggcaaggacgucuucuucauaccacccgaaaagugugauacccuccucugcgacauuggagaaagcucaccgaauccaacaauagaagaaggaagaacucuaagagugcuaaagaugguggaaccauggcuacgcggcaaccaguucuguaucaaaauucugaauccauacaugccuagcguuguagagacacuagagcaaaugcaacggaagcacggggguaugcuagugcggaacccacuaucccgcaacaguacccacgaaauguacuggguuagcugcggaacaggaaacaucguaucagcaguaaacaugacaucccgaaugcucuuaaaucgguucacaauggcccaucguaagcccacauacgaacgcgacgucgaccugggagcaggaacgagacacguagcagucgagccggaaguagcaaacuuagacaucauaggacaacggaucgagaauauaaaacacgaacauaagucaacauggcauuacgaugaggacaauccguauaagacaugggcguaccacggcagcuacgaagugaagccgucagguagcgcgaguucgaugguaaacggagucguaaagcugcugaccaaaccaugggacgucaucccaaugguaacacagaucgccaugacugacaccacaccauuuggacagcagagaguguucaaagagaaaguagauaccaggacgcccaaagcgaagcgcggcaccgcgcaaaucauggaggugacugcaaaaugguuauggggcuuucucucccgcaacaaaaagccgaggaucuguacaagagaagaguucacgagaaaagugcgcucuaacgcggcaaucggagccguuuuuguagacgaaaaccaguggaacucggcuaaagaagccgucgaggacgagcgcuucugggauuugguccaucgagagagagaacuacauaagcaaggaaagugcgcuaccuguguguacaacaugauggggaagagagagaaaaagcucggugaguucgggaaagcuaagggcagccgggccaucugguacauguggcuaggagcaagauuccuagaauuugaagcccuuggauuuaugaacgaagaccacugguuuaguagagaaaacucacucagcgggguggaaggggaaggguuacacaaacucgguuauauccugcgggacaucucaaaaauacccgggggcaacauguacgccgacgacaccgcaggaugggacacacgaaucacugaagacgaccugcaaaacgaggcgagaauuaccgacauaauggaaccugagcaugcccuucuggccaagagcaucuucaagcuaaccuaucaaaacaaagugguaagaguucaaagaccagccaaaaacgggaccgucauggaugucauuucgcggagagaucagaggggaucaggucaagugggcacauacggucuaaacacguuuacgaacauggaggcacagcucaucaggcaaauggaaucugaaggaaucuucagcccgagugaacuagagaccccaaaccucgccgaacgaguccuagacuggcuggaaaaauaugggguagaaagacucaaacgaauggccauaagcggggacgacugcgucguuaaacccaucgacgacagauucgccacagccuuaaccgcauuaaacgacaugggcaaagugcguaaggacauaccccagugggaaccgagcaagggauggaaugacuggcagcaaguucccuuuugcucucaucacuuucaccaacuaauaaugaaagacggacgcgaaauaguaguacccugcaggaaucaagacgaacucguaggcagggcccgugugucacaaggggcuggguggagcuugcgcgagaccgcaugccuugguaagagcuacgcacagauguggcaacugauguacuuccauaggagggaccuaaggcuagccgcgaaugcgauaugcuccgcaguaccaguugacuggaucccaacgaguagaaccaccuggucaauacaugcccaccaucaguggaugacgacugaagacaugcucaguguauggaaccgugucuggaucgaggaaaacccguggauggaggacaagacacacauaucgucguggggagauguuccauaucuaggcaagagggaagaccaauggugcgggucgcucaucggccuaacugcgagagccacgugggcaacgaacauacaagucgcaaucaaucaggugagaagacuuaucggcaacgaaaauuaucuggacuacaugacgucgaugaagagauuuaagaacgaguccgauccugaaggagcacucugguga

SEQ ID NO: 24515 - RNA, 9879 nt, Artificial Sequence
  derived and/or modified CDS sequence (opt11) from DENV-1__JF937618__SS-prME
agcgugacaaugcugcucaugcugaugcccaccgcccuggccuuccaucucaccaccaggggcggggagccccauaugaucguaagcaagcaagagcgggggaagagccugcuguuuaagaccagugccggggugaauaugugcacccucauugccauggaccugggcgagcugugcgaggacaccaugaccuacaagugcccccgcaucaccgagaccgagcccgacgacguggacugcuggugcaaugccaccgacaccugggugacguacgggaccugcagccagacgggagagcaccggcgagacaagcggucaguagcccucgcgccacauguuggccuggggcuggagacccggaccgagaccuggaugucuuccgagggcgcuuggaagcagauccagcgggucgaaacuugggcccuccgccaccccggguuuaccguuauugcccuguuccuggcccaugcgaucgguaccuccaucacacagaaggggaucaucuucauucuccugauguuggugacgcccaguauggccaugcggugcgucggcauuggcagccgggacuucguggaagggcuguccggcgcaaccuggguggacgucgugcuggagcacgggagcugcgugaccacuauggccaaagacaagcccacgcuggauaucgagcuccugaagacugaggucaccaauccagccauccugcggaagcuauguaucgaggcgaagaucuccaauaccacaaccgacucgcguugcccgacccagggcgaggcuacccuggucgaggagcaggacgccaacuucgugugccggcgcacguucgucgaccguggcugggggaacggcugcgggcuguuuggcaaggggucccucaucacgugcgccaaguucaagugcgugaccaagcuugagggcaagaucgugcaauacgagaaccugaaguacagcgucaucgugaccgugcacacgggcgaccagcaccaggucgguaacgaguccaccgaacacggcaccacagccaccaucacgccccaggcgcccaccaccgaaauccagcucacagacuacggggcauugacgcuggacugcagcccccggacuggccuggacuucaacgagaugguucugcugacuaugaaggaaaaguccuggcucguccacaagcagugguuucuggaccugccccuccccuggacuagcggggcgagcacgucccaggagaccuggaaccggcaggaccugcuggugaccuucaagaccgcccacgccaagaagcaagagguggucgugcugggcagccaggaaggcgcgaugcacacggcgcucaccggggccacugagauccagaccaguggcacaaccaccaucuucgccgggcaccugaagugcagacucaagauggacaagcugacccugaaaggcaugagcuaugugaugugcacgggguccuucaaguuagagaaggaggucgccgagacccagcacggcaccgugcugguccagauuaaguacgagggaaccgacgcgcccuguaaaauccccuucagcacccaggacgagaagggggucacccaaaacggccggcugaucaccgccaacccgaucgugaccgacaaggagaagcccgugaacaucgaggccgagccgcccuucggcgaguccuacaucgucauuggcgccggcgagaaggcgcuuaagcucucaugguucaagaagggguccucgauuggcaagauguuugaggccacggcucguggggcgcggcgcauggccauccuuggcgacaccgcgugggacuucggguccaucggcggcguguucaccagcguggggaagcugguccaccagaucuuuggcacggccuacgggguacucuucaguggcgugucguggacaaugaagaucgggauaggaguccuguuaaccuggcucggacugaacucaaggagcaccucgcugaguaugaccugcaucgccguuggacucgucacgcucuauuuaggcguaauggugcaggccgacuccgggugcgugaucaacuggaagggccgggagcucaagugcggaucggggauuuucgucaccaacgaagugcacaccuggacugaacaguauaaguuccaagccgacagcccgaagagacugucugcggcaaucggcaaagccugggaggagggcgugugcggcauccggagcgcgacccgccuggagaacaucauguggaaacaaaucuccaacgagcucaaucacauccugcuggagaaugacaugaaauucacggucguggugggggaugucgccggcauccucgcgcagggcaaaaagaugauccggccccagcccauggaguauaaguacagcuggaaguccuggggcaaggcaaagaucaucggcgccgacguccagaacaccaccuucauaaucgacgggcccaacacgccugagugccccgaugaccagcgcgcguggaacaucugggagguggaggacuacggcuucggcaucuucacgacaaacaucuggcugaagcuacgggacagcuacacccaggucugcgaucaucgccucauguccgcugccauaaaggacagcaaggccgugcaugccgauaugggcuauuggaucgaauccgagaagaacgagaccuggaaacuggcccgggcgagcuuuaucgaaguaaagacauguaucuggcccaagucccauacacuguggagcaacggcguccucgaauccgaaaugaucauccccaagauauacgggggcccuaucagccagcacaauuaccgacccggguauuucacccaaacugccggcccguggcaccuggggaagcuugaacuagacuucgaccugugcgagggcacgacugugguggucgacgagcacugcggcaaccggggcccgucacugcgcaccaccacggugacuggcaagaucauacacgaauggugcugccgcagcuguacccugccgccccuccgcuuccgcggggaggacggcugcugguacgggauggagauccgccccgugaaggagaaggaggagaaccuggucaaguccaugguguccgccggcagcggcgagguggacuccuuuagccucgggcugcuaugcaucuccaucaugaucgaggaagucaugcgcagccgcuggagucggaagaugcuuaugaccggcacucuggccguuuuccugcuccugaucauggggcagcugaccuggaacgacuuaauacguuuaugcaucauggugggcgccaacgcgagcgaccgcauggggaugggcaccaccuaccuggcccucauggcaacguucaagaugcggccgauguucgccguggggcugcuguuccgccggcucaccuccagagaagugcugcuccucaccaucgggcugagcuuagucgccuccgucgagcuccccaacagucuggaggagcugggcgacggguuagcgaugggcauuaugauucugaaacugcuuaccgacuuccaaucccaccagcugugggcaacccugcucagccugaccuucaucaaaaccaccuucucccuucacuacgccuggaagacaauggccauggugcucagcaucgucucccuguucccacuuugucucucaaccaccucccagaagaccaccuggcugcccgugcugcuaggcagccugggguguaagccgcugaccauguuccuaaucgcagagaacaagaucuggggccggcgcuccuggccucuuaacgaggggauaauggccgugggcaucgucagcauacugcuuagcucccugcuuaagaacgacgugccccucgccgggccccucaucgcgggcggcauguugaucgcuugcuacgucauaagcggguccuccgcggaccucucccuggaaaaggcggccgagguuagcugggaggaggaggcagagcacuccggugccagccacaacauccugguggaagugcaggacgacgggacgaugaagaucaaggacgaggagcgggacgacacccucaccaucuugcugaaggcaacgcugcuggccgucuccgguguguauccgcugagcauccccgccacccucuuuguuugguacuucuggcagaagaagaagcagcgcuccgggguccugugggacacgcccagcccucccgagguagagcgggccgugcuggacgacggcaucuaccgcaucaugcagcggggccugcucgggcgcagccaaguuggcguggggguguuccaggagaacguuuuccacacuauguggcacguaacgcggggcgccgugcugauguaccagggaaagcgccuagagcccaguugggcguccgucaagaaggaccucauaagcuacggcgguggguggcgacugcagggcagcuggaacaccggggaggagguccaggugaucgccgucgagcccggcaagaacccacgcaacgugcagaccacccccgggacuuucaagacucccgagggcgaggugggcgccaucgcccuggacuucaagccggggaccagcgggucccccaucguaaacagagaagggaagauagugggccucuacggaaacgggguggucaccacgucuggcaccuacgugagcgcgaucgcgcaggccaaggccucccaggaggggccucugcccgagaucgaggacgagguuuuccgcaagcggaaccugaccaucauggaucuccacccuggcagcgggaagacccgcagguaccuaccggccaucguccgcgaggcgaucaaacgcaagcugaggacgcucauucuggccccaacccgcgugguggccuccgagauggccgaggcccugaagggaaugcccauccgguaccagaccaccgcggucaagagcgagcacacgggcaaagagaucguggaccucaugugccaugccacauucaccaugcgccuguuaagccccgugcggguccccaacuacaacaugaucaucauggacgaggcccacuucaccgacccgucuuccaucgccgcccguggauacaucucaacgcgggugggcaugggugaggccgccgccaucuucaugaccgccacgccaccaggcuccguggaggccuucccucaaagcaacgcggucauacaggaugaagagcgugauauacccgagcgguccuggaacagcggguaugaauggaucaccgacuuccccggcaagacggugugguuuguacccaguaucaaaagcgggaacgacaucgccaacugucuccgcaagaacgggaagcguguaauccagcugucccgcaagaccuucgacaccgaguaccagaaaaccaagaacaaugacugggacuaugugguuacgacagacaucagcgagaugggcgccaacuuccgggcagacagagucaucgacccgcgacgcugccugaagcccgugauccucaaggacggacccgagcgggugauccuggccggccccaugccgguaaccguggccuccgccgcccagcgcagggggagaaucggccggaaccacaacaaggagggcgaccaguacauauacaugggacagccccugaauaacgaugaggaccacgcccauuggaccgaggcaaaaaugcuccuggacaacaucaauacucccgagggcaucaucccugcacuguuugagccggagcgggagaaauccgccgcgaucgacggggaauaccgcuuaagaggagaggcucgcaagaccuucgucgagcuuaugaggcgcggcgaccugcccguguggcucuccuacaagguggcgagcgagggcuuccaguacagcgauagacgcuggugcuucgacggugagcggaacaaccagguccuggaggaaaacauggacguggagauuuggaccaaggaaggggagcggaagaaauugcggccccgcuggcucgacgccaggaccuauuccgacccccuggcgcugcgcgaguuuaaagaguucgccgccggccggcgcucuguguccggggaccucauccuggagaucggcaaacugccgcagcaccuuacgcagcgggcgcagaacgcccuggacaaccuggucaugcuccauaacagcgagcagggcgggcgcgccuaccggcaugccauggaggaguuacccgacaccaucgagacccugaugcuccuagcauuaauagccgugcuuaccgggggggugacacuguucuuccuguccggccgcggguugggaaagacuaguaucgggcugcugugcgucauggccuccaguguccuccuuuggaccgccuccguggaaccucacuggauugccgccagcaucauccuggaguucuuccuaaugguacuucugauccccgaaccggaccggcaacgcacgccccaagacaaccagcucgccuacguggugauaggguuacuuuucaugauccucaccgucgccgccaacgagaugggccugcuggagacgacaaagaaggacuuggggauaggccacgucgccguggggaaccaccaccacgcggccauguuagacguagaccugcaccccgcguccgccuggacccucuacgccguggcaaccacgaucauaaccccgaugaugcgccacaccaucgaaaacaccacggcgaacaucagccugaccgccaucgcaaaucaggccgcgauccugaugggccucgacaaggguuggcccaucuccaagauggacaucggugugccacucuuagcccucggcuguuacagccaggucaacccccucacccuuaccgccgcugugcucaugcuaguggcgcauuacgcuauuaucgggccgggacugcaagccaaggccacgcgggaggcccagaagcgcaccgcggccggcaucaugaaaaaccccaccguugaugggaucguggccaucgaccucgauccgguggucuacgaugcuaaguucgagaagcagcugggccaaaucaugcuacucauccugugcaccucccagauccugcucaugcggacgaccugggcucucugcgagucuaucacucuggcaacugggccccuuacgacauuaugggagggauccccggggaaguucuggaacaccaccaucgccgucagcauggccaacauuuuccgcggcuccuacuuagccggcgccgggcucgcguucagccuaaugaagucccugggcgggggccggcgagggacgggcgcacagggcgaaacccuaggggaaaaguggaagcggcaacugaaccagcuauccaagagcgaguucaacaccuauaagcguaguggcaucauggagguagaucggagcgaagccaaggagggguuaaagcgcggcgagaccacgaagcacgccgucaguagagggaccgcgaagcuucgcugguucgucgagcggaaccuggugaagcccgagggcaaggucaucgaccugggcugcgggcgcggcggguggagcuacuacugcgccggauuaaagaaggugacugaggugaagggguacaccaagggcggccccgggcacgaggagcccaucccgauggccacguacggcuggaaccuggucaaacugcacuccgggaaggacguguucuucaucccccccgagaagugcgacacguuacugugcgacaucggcgagucaucccccaacccgaccaucgaggaggggcggacucuacgcguucucaagauggucgaacccuggcugcguggaaaccaauuuugcaucaagauccugaaccccuacaugcccuccgugguagaaacccucgaacagaugcagcgcaaacacggcggcaugcugguccggaacccucugucccgcaauagcacgcacgagauguacuggguguccuguggaacugggaacaucgugagcgcugucaacaugaccucucgcaugcuccugaaucgguucacgauggcccaucgcaagccuacguaugagagggacguggaccugggagcuggcacccgccacguagccgucgagccugagguggccaaccucgacaucaucgggcagcggaucgagaacaucaagcacgagcacaaaagcaccuggcacuacgacgaggacaacccuuauaagaccugggccuaucaugguuccuacgaggugaagcccagcggguccgcaucaagcauggucaacggcgucguuaagcugcugacaaagcccugggacguaauccccaugguaacccaaaucgcgaugaccgacaccacccccuucgggcagcagaggguguuuaaggagaagguugauacccggaccccgaaggccaaacgcggcacugcccagaucauggaggugacagccaaguggcucuggggcuuccugucgcggaacaagaagccccguaucugcacccgggaggaguucacccgcaagguccggagcaaugccgcgauuggggccguauuuguggacgagaaucaguggaacuccgccaaggaggccgucgaggacgagcgcuucugggaccuggugcaccgagagcgcgaguugcacaagcaggguaagugcgcgaccugcguguacaacaugauggggaagcgggaaaagaagcugggcgaguucgguaaggccaagggcagccgcgccaucugguacauguggcugggcgccagguucuuggaguuugaggcgcugggguuuaugaacgaggaccauugguucucgcgcgagaacagcuuguccggugucgagggggagggccuccacaagcugggguacauucugcgcgauauaagcaagauccccggcggcaacauguacgcggaugacacugcggggugggauaccaggaucaccgaggacgaccuccagaacgaggcccguauuacugacaucauggagccggaacacgcgcucuuagccaaguccaucuucaaguuaacguaccagaacaagguggugcggguccagcggcccgcgaaaaacggcaccgugauggacguaaucucccggcgcgaucagcggggguccggccaggucggcaccuacgggcugaacaccuucacgaauauggaggcucagcugauccgccagauggagagcgaggggaucuucucccccagcgagcuagagacgcccaaccucgccgaacgggugcuggacuggcucgagaaguacggggucgaaaggcugaagcggauggccaucagcggcgacgacugcgugguuaaaccgauugacgacagauucgccaccgcgcugacggcccuaaacgacauggggaagguccggaaggauaucccccaaugggagccgucaaagggcuggaacgacuggcaacagguccccuucugcucccaccacuuucaccagcugauaaugaaggauggucgcgagaucguggugccgugccggaaccaggacgaguuaguagggcgcgcccgggugucucagggcgccggguggagccuccgcgagacggccugcuugggcaaguccuacgcacagauguggcagcugauguacuuccaccggcgcgaucuccggcuggccgccaacgcuaucugcagcgcggugcccguggacuggauccccaccucccgcaccaccuggagcauccacgcccaccaccaguggaugacgacugaggauaugcugucgguguggaaccgcguguggaucgaggagaaucccuggauggaggacaagacccacaucagcuccuggggcgacgugccguaucucgggaagagggaggaccaguggugcgguagccuuauaggguuaaccgccagagccacaugggccacgaauauccagguugcgaucaaccaggugcgacgccucaucggcaacgaaaacuacuuggacuacaugaccuccaugaaacgguucaagaacgaguccgacccugagggggcgcucugguag

SEQ ID NO: 24516 - RNA, 9879 nt, Artificial Sequence
  derived and/or modified CDS sequence (opt11) from DENV-1__JF937619__SS-prME
agugugaccauguugcucaugcugaugccaaccgcccuggccuuccaccucaccacccggggcggugagccccacaugauagugagcaagcaggagcggggcaaaagccuacuguucaagaccagcgccggggugaacaugugcacccucauugcgauggaccugggggagcugugcgaggacaccaugacauacaaaugcccucggaucaccgaggcugagcccgacgauguagacugcuggugcaacgcgaccgacacguggguuaccuacggcaccugcagccagaccggcgagcaccggcgcgaaaagcgguccguggcccucgcgccacacgugggccugggacuggagacgcgaaccgagaccuggaugagcuccgagggcgccuggaagcagauucagcgggucgagaccugggcccuccgccacccuggguuuacggucaucgcccuguuucuggcgcacgccaucggcaccagcaucacccagaagggaaucaucuucauccuccugaugcuggugacccccagcauggccaugcggugcgucggcaucggcucucgcgacuucguggaggggcucuccggcgccacguggguggaugucguguuagaacacgguagcugcguuaccaccauggccaaggacaagcccacccuggacauugagcuccugaagacggaagucacaaaucccgcggugcugcggaagcuaugcaucgaagccaagaucuccaacaccacuacggacagccgcugcccgacccagggcgaggcgacacugguggaggagcaggaugcuaacuucgucugccggcgcacauuuguggaccggggcugggggaacggcugcgggcuguucgggaaggggucacuccugacgugugccaaauucaagugcgugaccaagcuggagggcaagaucguucaauacgagaaucuaaaauacagcgugaucgugaccguccacaccggagaccagcaccaggugggaaacgagucgacggagcacggcaccacagcaacuaucacaccccaggcgcccaccacggagauccaacugacagacuacggggcguugacccucgacugcagcccccgcacgggccuagauuucaacgagauggucuuacucaccaugaaggagaaguccuggcuggugcauaaacagugguuccuggaccucccccugcccuggaccagcggggcgagcaccucccaggagacguggaaccggcaggaccugcucgugaccuucaagaccgcccacgcgaagaagcaggaggucguggugcuaggcagccaggagggcgccaugcacaccgccuuaacgggggccaccgagauccagaccucuggcaccaccaccaucuucgccgggcaccucaagugccgccugaagauggacaagcugacccucaagggcaugagcuacgucaugugcaccgguuccuucaagcuggaaaaagagguggcggagacgcagcacggcaccgugcuaguccagauaaaguacgagggcaccgacgcccccugcaagauccccuucagcacccaggacgaaaaaggggugacccagaacggccggcugaucaccgccaaccccaucgugaccgacaaggagaagccggucaacaucgaggcagagccgcccuucggggaguccuacaucgugaucggcgcgggcgagaaggcacucaagcugaguugguucaaaaagggguccaguaucggcaagauguuugaggccaccgcccgcggggcccggagaauggcgauccugggggacacggccugggauuucggguccaucggcggcguguucaccagcgucgggaagcucguacaccagaucuucggcacagccuauggggugcuguucuccggggucagcuggaccaugaagaucgggaucggagugcugcucacguggcugggucugaacucccgcagcaccucccuuagcaugaccugcaucgccguggggcucgucacccuuuaccucggugugauggugcaagcugacuccgggugcgucaucaacuggaagggccgggagcugaaaugcgggagcggcaucuuuguuacgaacgaggugcacaccuggaccgagcaguacaaguuccaggcggacagcccgaagcgccuguccgccgccaucggcaaggccugggaggagggggucugcggcauccggagcgccacccgucucgagaacaucauguggaagcagaucuccaacgagcugaaccacauucugcucgagaaugacaugaaguucaccguggucgucggugacguggcgggcauucuggugcaggggaagaagaugauccggccccagccuauggaguauaaguauaguuggaaguccuggggcaaagccaagaucaucggcgccgacguccaaaauagcacguucaucaucgaugggcccaacaccccggagugccccgacgaccagcgggccuggaacauuugggagguggaggacuacgguuuuggcaucuuuaccaccaacaucuggcugaagcuccgggacuccuacacccaggugugcgaccaucgccugaugagcgcugcuaucaaggacagcaaggccguccacgccgacaugggcuacuggaucgagagcgagaaaaacgagaccuggaaguuagcgcgggcgucuuucauugaagugaagaccugcaucuggcccaagagccacacucucugguccaacggcgugcuggagagcgagaugaucaucccaaagauccaugggggcccuaucucccagcacaauuaccggcccggguacuucacgcagaccgccggccccuggcaccuggguaagcucgagcuggacuucgaccugugcgagggcaccaccgucgugguggacgagcacugcggcaaccggggaccuagccuccgcacgaccaccgucaccggcaagaucauccacgaguggugcugccgguccugcacgcugccgccccugcgcuuccgcggggaggacgguugcugguacgggauggagauccgccccgugaaggagaaggaggagaaucucguaaaguccauggucucggccggcuccggcgagguggacagcuucuccuuggggcuguuauguauuagcaucaugaucgaggaggugaugcggucccgcuggagccggaagaugcuaaugaccggaacccuggcagucuucuuccuccuaaucauggggcagcugaccuggaacgaccucauuaggcugugcaucauggugggugccaacgcguccgaucgcauggggaugggaacgaccuaccuggcccucauggugaccuucaaaaugcggcccauguucgcagucggccugcuguuccgccggcuaaccagccgcgaggugcugcuacucacgaucggucugucccuggucgccagcguggagcuccccaacucccuggaggagcugggcgacgggcucgcuaugggcaucaugauucuaaagcuccucaccgauuuccagagcuaucaguuaugggcgacccuguuaucucugaccuucaucaagacgacauucagccugcacuacgccuggaagaccauggccauggugcucuccaucgucagccuguucccccuaugccuguccacuacgagccaaaagaccaccuggcugcccgugcugcucggaucccuggggugcaagccgcugaccauguuccucaucgccgagaacaagauauggggccgcaagagcuggccccugaacgaggggaucauggcggugggcauagugagcauccugcucuccagccugcugaagaacgacgugccccucgccgggccccucaucgccggcggcaugcucaucgccugcuacgugauuucagggagcuccgcagaucucagccuggagaaggcggccgaggucuccugggaggaggaggccgagcacagcggcgccucccauaacauacugguggaggugcaggacgaugggacgaugaagaucaaggacgaggagcgcgacgacacccucaccauccugcugaaagccacccucuuagcggucucaggcguguacccgcuguccauccccgccacccuuuucgucuggcacuucuggcagaagaagaaacagagaagcgggguucuuugggacacucccagcccgcccgaaguggaacgcgcagugcuggacgacggcaucuaccggaucaugcagcgcggccugcucggcaggagccaagucgguguggggguguuccaggagaacgucuuucauacaauguggcacgugacccgcggcgccgugcuuauguaccaggggaagaggcuggagccguccugggcgagcgucaagaaggaccuaaucuccuacggcggaggguggcgcuuccagggcagcuggaacaccggggaggaaguccaggucaucgcggucgagcccggcaaaaaccccaagaacgugcagacagcccccggaaccuucaagacucccgagggcgaggugggcgcgaucgcucuggacuucaagcccgggaccuccggaagcccuauugucaaccgggaggguaagaucgugggccuguacggcaaugggguaguaacgacuagcggcaccuacguguccgccaucgcgcaggccaaggccagccaggaggggccgcuccccgaaauagaggacgagguguuccgcaagaggaaccugaccaucauggaccugcacccgggcuccgggaagacucgccgcuaccucccggcaaucguccgcgaggcgaucaagcggaaguugcgcacccugauccucgccccaacccgcgugguagccagcgaaauggccgaggcccugaagggcaugccuauccgcuaucagaccacggcugucaaguccgagcacaccggcaaggagaucguggaccugaugugccaugccacuuucaccaugcgccuccugagccccguacgggucccgaacuacaacaugauuaucauggaugaagcucacuuuacggacccuuccagcaucgccgcccgcggguacauauccacccgggugggcaugggcgaggcggccgccaucuucaugaccgccacgccgcccggcagcauggaggccuucccgcagucaaacgcggugauccaagacgaggagcgcgacauccccgagcggagcuggaacuccggguacgaguggauaacggacuucccgggcaaaaccgucugguucgucccaagcauuaaggccggcaacgacaucgccaacugccugcgcaagaacgggaagcgggugauccagcucucccgcaagacguucgauaccgaauaccagaaaaagaagaacaacgacugggacuaugucgugacgaccgacaucagugaaaugggcgccaacuuccgggcggaucgugugaucgacccgcggcgcugccugaagcccgucauucugaaagacgggcccgaacgggugauccucgccggccccaugccggucacuguggccuccgccgcucaacgccgggggcguaucggccggaaccacaacaaggagggcgaccaguacaucuacauggggcagccccugaauaacgacgaggaccacgcgcacuggaccgaggcaaagaugcuccucgacaacauaaacacgcccgaggguauaaucccggcucuguuugagccggagcgcgagaaguccgccgccaucgauggggaguaccgccugcggggcgaggcgcgcaagaccuucguggagcucaugcggcgcggugaccugcccgucugguuguccuacaaggucgccagcgagggcuuccaguacagcgaccggcgcuggugcuucgacggggagcgaaacaaccaggugcucgaggagaacauggaugucgagaucuggacgaaggagggggagcgcaagaagcugcggccccgcuggcuggacgcccggaccuacuccgauccccuagcccugagagaguucaaagaguucgccgcgggccggcgcucuguguccggggaccucauucucgagaucggaaaguugccgcagcaccugacacagcgggcccagaacgcccucgacaaccuggugaugcugcacaacagcgagcagggcgggcgcgcuuaccggcacgcgauggaggagcuuccugacaccaucgagacccuaaugcugcucgcgcugauagccguccugaccggcggggucacacuguucuuccuguccggcaaggggcugggaaaaaccuccaucgggcuccuaugcgugauggccaguagcguccugcucuggauggcuuccguggagccccacuggaucgccgccagcaucauacuggaguuuuuucugauggugcuccuaaucccggagccggaccggcagcggacgccccaggauaaccaguuagccuacgucguuaucgggcuccuuuucaugaucuuaacaguggccgcgaacgagaugggccuccuggagaccaccaagaaggaucugggaaucgggcacgucgcgguggagaaccaccaccacgccgccaugcucgacguagaccugcaccccgcuuccgccuggaccuuauaugcagucgcgaccacgaucaucaccccgaugaugcgccacaccaucgagaauaccacagcgaacaucucguugacggccaucgccaaccaggcggcgaucuugauggggcuggacaagggcuggcccaucuccaaaauggacaucggagugcccuugcuagcuuuagguugcuauagccaggugaauccccucacgcugacugccgcggugcucaugcucguagcccauuacgcuaucaucgggccggggcugcaggccaaggcuacccgggaggcgcagaagcgcacggccgccggcaucaugaagaaucccaccaucgacgggaucguagccaucgaccuggacccagucauuuacgacgcgaaguucgagaagcagcucggccagaucaugcugcugauccucuguaccucccagauccugcugaugcgcacaacgugggcgcucugcgagagcaucacccuggccaccggaccacugaccacgcucugggagggguccccgggcaaguucuggaacaccaccaucgcugugagcauggccaacaucuuucggggguccuaccuggccggcgcgggccuggccuucagccucaugaagucccucgggggcgggagacgagggaccggggcucagggcgagacguuaggcgaaaaguggaagcgccagcucaaccagcuguccaagagcgaguuuaacaccuacaagcguuccggcaucauggagguagaccgcagcgaggccaaggaaggccugaagcgcggggagaccaccaagcacgcggucucccgaggcacggccaaacuccggugguucguggagcgcaaccuaguuaagcccgaggggaagguaaucgaccugggcugcgggcgcggaggcuggagcuacuacugcgcugggcugaaaaagguaaccgaggugaagggguauaccaagggcggccccggacacgaggagccaaucccgauggccacuuacggguggaaucucgucaagcugcacuccggcaaggacguguucuucaucccacccgaaaaaugugauacgcugcugugcgauaucggggagucuucccccaacccgaccauagaagagggccgcacccugcgggugcugaagauggucgagcccuggcuccgcgggaaccaguucuguauuaagauccugaaccccuacaugcccagcgucguggagacgcuggagcagaugcagcggaagcacggcggcauguuaguccgcaacccccugucucggaacagcacgcacgagauguacuggguguccugcgggaccgggaacaucgugagcgccgucaacaugaccagucgaaugcugcucaaccgcuucaccauggcccauaggaagcccaccuacgagcgcgacguggaccugggggcuggcacucggcacguggccgucgagcccgagguggccaaccuggacauuaucggccagcgcauagagaauaucaagcacgagcauaagucaaccuggcacuacgacgaggacaaccccuacaagaccugggccuaccacgggucuuacgaggugaagccgagcggcuccgcaagcagcauggucaacgggguggucaagcuccugaccaagcccugggacgugauacccauggugacgcagaucgccaugaccgauaccacccccuucggccagcagcggguauucaaggaaaagguggacacgcgcaccccgaaggccaagcggggaaccgcccaaaucauggagguaaccgcccgauggcuguggggcuuccucucucggaacaaaaagcccaggaucugcacgcgggaggaguuuacacgcaagguccgguccaacgcggccauaggcgcugucuucguggacgagaaccaauggaacuccgcgaaggaggcagucgaggacgacagguucugggaucuggugcaccgggagcgcgagcugcacaagcaagggaagugcgcgaccugcguguauaauaugaugggcaagcgugagaagaaacucggggaguucggcaaggccaaggggagccgcgccaucugguacauguggcugggagcccgguuccuggaguucgaggccuuaggcuucaugaacgaggaccacugguucucccgcgagaauucccuguccggggucgagggcgaggggcugcauaaguuaggcuacauccugcgggacaucagcaagauccccgggggcaauauguacgccgacgacacagccggcugggauacgaggaucaccgaggacgaucugcagaacgaggccaagaucaccgacaucauggagcccgagcacgcgcuccuggcgaaguccaucuucaaguuaaccuaccaaaacaagguggugcggguccagcgccccgccaagaaugggacggugauggacgugaucagccgcagagaccagcgcggcuccggacaggucggcaccuacggccucaacaccuuuacaaauauggaggcccaguuaauccggcagauggaaucagagggaaucuuccuaccuaacgagcucgagacgcccaaccuggccggccgcguacuggacuggcucgagaaguacgggguggagcggcugaaacgcauggccauuuccggcgacgacugcgucgugaaaccgauagacgaccgguucgcgaccgcccugaccgcgcucaacgacauggggaaggucagaaaggacaucccccagugggagccaagcaagggcuggaaugacuggcagcagguccccuucugcucccaccacuuccaccagcugaucaugaaggauggccgggagaucguggucccgugccgcaaccaagacgagcuggucgggcgggcccgcgugagccagggcgccggcuggaguuugcgugagaccgcgugccugggaaagucguacgcccagauguggcaacugauguacuuccaccgccgggacuuacgccuggccgccaacgcgaucugcucugccguccccgucgauugggugcccacgucccggaccaccuggagcauccacgcccaccaccaguggaugaccacugaggacaugcuguccguguggaaccgcgucuggauugaagagaacccguggauggaagacaaaacccggauuagcucuugggaggacgugccguaccucgggaagcgcgaggaccaguggugcggcucccugauaggccucaccgcccgcgccaccugggcgacgaacauccagguggccaucaaccagguucgcagacucaucggaaacgagaacuauuccgacuacaugaccagcaugaagcguuucaagaacgaauccgaacccgagggcgcccugugguga

SEQ ID NO: 24517 - RNA, 9879 nt, Artificial Sequence
  derived and/or modified CDS sequence (opt11) from DENV-1__GU131827__SS-prME
ucggugacuaugcuacuaaugcugaugccaacugcacuggcauuucacuugacaacccggggaggggaaccacacaugaucgugucaaaacaagaaaggggaaaaagucugcuguuuaaaacaagcgccgggguaaauaugugcacccuaaucgcgauggaccuaggcgaacuuugcgaagacacgaugaccuacaagugcccucgaaucacagagacggaaccugacgacguagacugcuggugcaacgccaccgacacauggguaacuuacggaaccugcucccagacgggggagcacaggagagacaaaagaagcguagccuuggccccacauguuggccucggacuagagacccgaacagaaacauggaugagcagcgaaggcgcauggaagcaaauccaaaggguggagaccugggcucugagacacccaggauuuacaguuaucgcacucuuucuugcacacgcaaucggcacgagcaucacgcaaaagggaaucauuuucaucuuacucaugcugguaacccccucaauggcgaugcggugcgucgguauuggaucccgggacuucguggaagggcuuagcggcgccaccuggguggaugucguacuggagcacggaagcugugugacgaccauggcgaaggacaaaccaacuuuagacauugagcuccucaaaacugaggugacgaaucccgcugugcuccgcaaacuuugcaucgaagcgaaaaucuccaacacaacgacagacucaagaugcccaacucaaggagaagccacccuagucgaggagcaggacgccaauuucguuuguaggcgaacuuucguugauaggggguggggcaauggaugcggucuauucgggaaaggaucauuaauaaccugcgcaaaauucaaaugcguuacaaaacuugaaggaaagaucguacaguaugagaaccuaaaguauuccgugaucgucaccguucacacgggcgaucaacaccaagucgguaacgaaagcacggagcacggaacuacggcuacgauaacaccucaggcgccaacgacggaaauacaauuaacagacuacggcgcacuaacgcuggacugcuccccacgcaccggccucgacuucaacgaaaugguucucuuaaccaugaaggagaaauccuggcugguucauaaacaaugguucuuggaccuuccacucccauggacuagcggagcgucgacgucucaggaaacauggaacaggcaagaucugcuagugacuuuuaaaacggcccacgcgaagaagcaggaagucgucguccucggaagucaagaaggggcuaugcacacggcacuaacgggugcaaccgaaauacagacgagcggcaccacgacgaucuucgccggccaccuaaaaugccgucugaagauggacaagcuaacuuuaaaagguaugagcuacgugaugugcacaggcagcuucaagcuggaaaaagaggucgcagaaacccagcauggaacggugcuaguccagaucaaauacgaaggcacugaugccccaugcaaaauaccauucucgacgcaagacgagaaaggagugacucaaaaugggcgguuaauuacagcuaaccccaucguaaccgauaaggagaagccuguuaacauagaagcggagccgccauucggugagucguauaucgucauaggggccggcgaaaaagcucugaaacuguccugguuucgaaaggggucgagcauagggaaaauguucgaggcaaccgcacgcggcgcucggcgcauggccauacuaggggacaccgcaugggacuuugggucgaucggaggggucuucaccaguguaggaaaacuuguacaccaaauauucggaacggcauacgguguauuguucucagggguaucuuggaccaugaagauagggaucgguguccugcucacuugguuaggucuaaauucgcggaguacaucucucucgaugacgugcauagcggucggccucgugacguuauaucuaggcgugaugguacaagcagacuccgguugugcuauuaauuggaaaggacgcgaacuaaaaugcgggagugggauauucguaacaaacgaaguacacaccuggacagagcaguauaaguuccaggccgacaguccgaagcgccucagcgccgcaaucgggaaagcaugggaggagggagugugugggauacggucagccaccagacuggaaaacauaauguggaagcagauaagcaacgaacuuaaccacauccuuuuagagaacgacaugaaauuuacagucgucgucggagaugucgcggguauacuggcccaagguaaaaagaugauucggccacagcccauggaauacaaguacucuuggaagucguggggcaaagcgaaaaucaucggugccgauguacagaacacaacguucauaauagacggcccgaauacaccagaaugccccgacgaccagcgggcguggaacaucugggaagucgaagauuacggguuuggaaucuucaccaccaacauuuggcuuaaacuucgagacaguuacacgcaaguuugcgaccaccggcucaugagugcggccauuaaagacuccaaagcaguucaugcggacaugggcuacuggauagaaagugaaaagaacgaaaccuggaaacuagcgcgggccagcuucauagaagucaaaaccuguauuuggccaaaaagccacacccucuggucgaacgggguguuggaaagcgagaugaucauaccaaaaauauacgggggacccauaucccaacacaacuaccguccgggcuacuucacacaaaccgcgggacccuggcaucucggaaaauuagagcuggauuuugaccuaugugaaggcaccaccguggugguagacgaacacugcgggaacaggggaccaucacucagaacaacaacggucacgggcaaaauaauacaugaauggugcugccguaguugcacucuacccccacuacgauucagaggugaagauggauguugguacggaauggaaauccgaccaguaaaggaaaaagaagagaaccucguaaaaagcaugguaucagcugggagcggcgaaguagacagcuucucccucggucuccugugcauaaguauaaugaucgaagagguaaugagaaguagguggagcagaaaaaugcugaugacgggaacacuggccgucuucuuccuacucaucauggggcaacuaaccuggaacgaccuuauacgucucugcauaaugguuggggcaaaugcaagcgauaggaugggaaugggcacgacauaccuagcacuuauggccacauuuaaaaugcggccuauguucgccgugggacuucucuuuagacgccuaaccucacgugagguacuccuacugaccaucggccuaucgcucgucgccucugucgaacuacccaacucccuagaagaauuaggagacggccucgcgaugggcauaaugauacuuaagcuacugacugacuuccaaucccaccagcucugggcuacccuccuaucgcucaccuucauaaagacgacguucaguuuacacuacgccuggaagacaauggccaugguauuguccauugugucauuguuuccguugugucugagcacuacaagccaaaagacgacgugguugccuguucucuuaggcagccucggaugcaaaccguugacaauguuucucauagccgaaaacaagauaugggguagacgcuccuggccacucaaugagggaauuauggcaguuggaauuguaucgauccuccuaucuagccuacucaagaacgacgucccccucgccgguccccucauagcaggcggaauguugaucgcaugcuacgucauauccggaucaucagcagaccucucacuagaaaaggcagcagaagucagcugggaagaagaagccgagcauagcggagcaucccauaacauucugguagaagugcaagacgauggcacaaugaagauaaaagacgaagaacgcgacgacacucugacaauacuccuaaaagccaccuuacuagcagucagcggggucuacccccuaagcauccccgcaacacuuuucguaugguacuucuggcagaagaagaagcagagaucaggagugcucugggauacuccuagcccaccggagguggaacgcgcuguacuagaugacggaaucuacagaauaaugcaacguggccucuugggaagaucgcaagucggcgugggaguauuccaagaaaacgucuuccauaccauguggcaugucacgaggggcgcaguccugauguaccagggcaaacgacuggaacccucgugggcuuccgugaagaaggaccugaucagcuacggagguggcuggcgacuacagggcucguggaacaccggggaagaggugcaggucauugccguagaaccggggaaaaacccgaaaaacguucaaacggcacccgggaccuucaaaaccccagaaggcgaagucggagcaauagcucucgauuucaagccgggaacgagcggcagccccaucgugaaccgagaagggaaaauaguaggccuauacggcaacggggugguaacaacgagcggaacuuacguaagugccauagcccaggccaaggcgagucaagaagggccguugccagagaucgaggacgaggucuuuagaaagcgcaaccugacaauaauggaccugcaccccgggaguggaaagaccaggagguaccuacccgcuaucgugagggaagcgauaaagcgcaaguugagaacccucauccuagcaccuacacggguggucgcauccgaaauggcggaagcacucaaagguaugccuauacgauaccagacaacggcaguaaagucggagcauaccgggaaggaaauagucgacuuaaugugucacgccacuuucacaaugaggcuacucagccccguacggguacccaacuacaacaugauuaucauggacgaggcacacuucacagacccguccagcauagcagcaaggggauacauaucgaccagaguaggaaugggggaagcugccgcuauauucaugacggcaaccccgcccgggagcguugaagcguuuccacagucuaacgcaguaauccaagaugaggagcgagacaucccagaacgguccuggaacuccggauacgaguggaucacagauuucccaggcaaaacaguaugguuugucccaagcauuaaaagcgguaacgacauagccaacuguuuacgcaaaaacgggaaaagaguaauacaacugucgagaaagaccuucgauacggaauaccagaagaccaaaaauaaugacugggacuacguagucacuacagacauuucagagaugggagccaacuuccgagcagaccgugucauagacccaagacgaugccuuaagccgguuauccuaaaagacggacccgaacgcgucauccuggcggggccgaugccagugaccguagccucggcagcccagcgacguggccgcauagggaggaaccacaacaaggagggagaccaauacauauacauggggcaaccguuaaauaaugacgaggaccaugcgcacuggacagaagcaaagaugcuccuggacaacauaaacacucccgaaggaauugucccagcucuauucgagccggagcgcgagaaaagcgcggcaaucgauggagaauaccgccuacgcggcgaagcccgcaagacguucgucgagcucaugcggagaggggaccuaccaguuugguugucauacaaagucgcgucugaaggcuuccaauacagcgauagacggugguguuucgacggugaaaggaacaaccaaguacuggaagaaaauauggacguagagauauggacaaaggaaggagagcgcaagaaacuucggccgagauggcucgacgcccggacauauagcgacccguuagcacuaagagaguucaaggaguucgcagccgggagaagaucagucucaggggaucugauacuggaaaucggcaagcuaccccagcaccugacacagcgggcacagaacgcgcucgacaacuuggucaugcuccacaacucagaacaaggcgguagggcguauagacacgcgauggaagaacugccagauacaauagaaacccucaugcuccuggcucucaucgcggugcugacugguggaguaacgcuauucuuccucuccggacgaggccuagggaagacauccaucggucuacucugugugauggccagcucgguacuccuguggauggcgaguguagaaccccacuggauagcggcguccauaauacucgaguucuuccuuaugguucugcucauaccugaacccgaccggcaacguacaccgcaagacaaccagcuggcauaugugguaauagggcuacuuuucaugauccuaacaguagcagcaaaugagaugggacuacuugagacaacaaagaaagaucuggggauaggacauguggccguagaaaaccaccaccacgcagcaaugcucgacguggaucuacacccggcgagcgccuggacccucuacgcaguugcuacaacaaucauaacgccuaugaugagacacacgauagaaaacacgacggcgaacaucagucugaccgccauagccaaccaagcggcgauccuuaugggccuggacaaaggguggcccauauccaagauggacaucggcgucccguugcucgcauuagggugcuacucgcaagucaacccacuaacgcugacggcagcaguguuaauguuggucgcgcacuacgccauaauaggcccaggcuuacaggcaaaggcaaccagagaggcgcagaaaaggaccgcggcaggaaucaugaaaaacccuacgguagacggcaucguggcgauagaccuugaccccgucguauacgaugcaaaauucgagaaacaauuggggcaaauaaugcuacuaauauuaugcacuagccaaauccuacucaugaggacaaccugggcucucugugaaucaauuacgcuggccacgggcccccuaacgaccuuaugggagggcucacccgguaaauucuggaacaccaccaucgcgguaaguauggccaacauauuccggggcagcuaucucgcgggggcaggacuggcauucagccuaaugaaaaguuuaggggguggaaggaggggaaccggcgcacaaggagagacacugggagaaaaguggaaacgucaacuaaaccaacuaagcaaguccgaguucaacacauacaaaagaucgggcauaauggaaguagacaggucggaggcuaaagaaggcuugaaacgaggggaaacgacgaaacacgcagugucucgcgggacggcgaaacugcgaugguucguagaacgaaaccuuguuaagccggagggaaaagucauugaccuaggcuguggccgaggaggcugguccuauuacugugccggccugaagaaagucacagaaguaaaagguuacacaaaagguggccccgggcacgaggagccaaucccgauggcuaccuacggauggaaucuuguaaaacuacauucaggcaaagauguguucuuuauacccccagaaaagugcgacacccuucuaugcgacaucggugagagcuccccaaacccuaccauagaggaaggcagaacguuaagggucuuaaagauggucgaaccguggcuacguggaaaucaauuuugcaucaaaauacucaaccccuacaugccgagcgugguggaaacacucgaacaaaugcaaaggaaacacggaggaaugcucgugcgcaacccccuaucccgcaacaguacccaugagauguacugggucucauguggcaccggcaacaucguuucggccguaaacaugacgucuagaaugcugcugaacagguuuacaauggcgcaccgcaaaccaaccuacgaacgagauguagaccucggggccggcacacgccacguggcggucgagccggaaguagcuaaccuagacaucauaggccaacggaucgagaauauaaaacacgaacacaagaguaccuggcacuacgaugaagauaacccauacaaaaccugggcuuaccacggaucauaugaaguaaagccauccggaagcgcgucgaguauggugaacggcguggugaaguuacuaaccaaacccugggacgugaucccaauggucacgcagaucgccaugaccgacaccacaccuuuuggacaacagagggucuucaaggaaaaaguggacacgcguacucccaaggccaaaagaggcacggcccaaaucauggaaguaaccgcaaaguggcuuuggggcuucuugaguagaaauaagaagcccagaauaugcacgcgcgaggaauuuacccgcaaagucagaaguaacgccgcaauuggagcaguauuugucgaugaaaaccaauggaacagugccaaagaggcaguugaggacgaaagguucugggaccuaguccacagggaaagagaacuucauaaacaaggcaagugcgcgaccugcguauauaacaugauggguaaacgagaaaagaaacuuggcgaguucggaaaagcaaaagggucgcgcgcaaucugguacauguggcucggcgcucgauuccuagaguucgaagcgcugggcuucaugaacgaagaucacugguucucacgggaaaauucacuaagcgggguagagggagaggggcuacauaaacuuggauacauucuucgcgacauuucaaaaauccccggaggcaacauguacgcugacgacacagcuggcugggauacccggaucaccgaagacgaucuacagaaugaagcaagaauaacugauauaauggaacccgagcaugcgcuacuagccaagagcauuuucaaacuaacauaucagaacaagguagugcgggugcaacggccggcaaagaacgggaccgugauggacgucauaagcagacgagaucaacgcggcuccggacaggugggaacauauggccugaacacuuucaccaacauggaggcacaacucauacgacagauggagagcgagggcaucuucagccccagugaacuagaaacucccaacuuagcagaaaggguccuugacugguuagaaaaauacggaguugaacgacugaaacgcauggccaucucaggugacgacugugucguaaaaccaaucgaugauagauucgccacagcgcugacagcgcucaaugauaugggcaaaguccgcaaagauauuccacaaugggagccgagcaagggguggaacgacuggcagcaggucccauucugcucacaucacuuucaccaacuaauuaugaaagacggccgagaaaucguagugccgugccgcaaccaggacgagcuggucggucgcgccagggugucacaaggggcaggauggucauuaagggagaccgcguguuuaggaaaauccuacgcacagauguggcaacuuauguacuuucaucggagggaccucagacuagccgcaaacgcgaucugcagcgcugucccgguggauuggauacccacgagccgcacgacauggagcauucacgcacaccaccaguggaugaccacagaagacauguugucaguuuggaaccgaguguggauagaggagaacccguggauggaggacaagacacacauaagcaguuggggcgacguacccuaccuaggcaaacgagaggaccaguggugcgguucccuuaucggccucaccgcccgagcuacuugggccacgaacauccagguagcaauuaaccaaguacggcgacuuauagggaacgaaaacuaccucgacuacaugaccucuaugaagcgauuuaaaaaugaaucggaccccgaaggagcguuaugguaa

SEQ ID NO: 24518 - RNA, 9879 nt, Artificial Sequence
  derived and/or modified CDS sequence (opt11) from DENV-1__GU131831__SS-prME
ucggugaccaugcugcugaugcugaugccuaccgcucuggccuuccaccucaccacccgcggcggggaaccccacaugauugugucgaagcaggagcguggcaagagccugcuguucaagaccagcgccggggugaacaugugcacccucaucgccauggaccucggcgaacugugcgaggacacgaugaccuacaagugcccucggaucaccgaaaccgaacccgacgauguagacugcuggugcaacgccacggauaccugggugaccuacgggaccugcagccaaacgggcgagcaccggcgggauaagcggucgguggcccucgcgccccacgugggccugggguuggagacgcgcaccgagaccuggaugucuuccgaaggcgcguggaaacagauccagagagucgagacgugggcccuccggcaucccggguucaccgugaucgcccuguuucucgcccacgcgaucggcacgagcaucacccagaaggggauuaucuucauccuucugaugcuggugacgcccuccauggcgaugcggugugucggcauaggcagccgcgacuucguggaggggcucuccggggcgaccuggguggaugucgugcuggagcacgggucuugcgugaccaccauggcgaaagacaagcccacgcuagacaucgagcuccugaagaccgaggucaccaaucccgccgugcugcggaagcucugcaucgaggccaagauuuccaacaccacgaccgacagccgaugcccgacacagggugaggccacccugguggaggagcaggacgccaacuucgucugccggcgcaccuucguggaccggggcuggggcaacggcugcgggcuguucggcaaagggucccucaucacgugcgcgaaguucaagugcgugaccaagcuagagggaaagaucgugcaguaugagaaucugaaguacagcgugaucgugacuguccacacgggcgaccagcaccaggucggaaacgaguccaccgagcacggcaccacugcaaccauaacaccccaggcgcccaccaccgagauccagcucacggacuacggugcccuaaccuuagacugcaguccccgcaccggccucgacuucaacgagaugguccugcugacgaugaaggagaagucgugguuggugcacaagcagugguuccuggaccuuccccuccccuggaccucuggcgccagcacgagucaagaaacguggaaccggcaggaccuacuggugaccuucaagaccgcccacgccaaaaagcaagaggucguagugcucggaucccaagagggcgcgaugcacacggcccugaccggggccaccgagauccaaaccuccggcacgaccaccaucuuugcugggcaccuuaagugccgccucaagauggacaagcugacccugaagggcaucagcuacgucaugugcacgggguccuucaagcucgaaaaggagcuggccgagacccagcacggcaccgugcuggugcagaucaaguacgaaggcaccgacgcgcccugcaagauccccuucagcacgcaggaugagaagggggucacccagaauggccgucuaaucacugccaauccgauagucaccgacaaggagaagcccgugaacaucgaggccgagccacccuuuggcgagucuuacauugucauaggggccggcgagaaggcacucaagcuaagcugguucaagaagggcuccuccaucggcaagauguucgaggcaacggccagaggggcacggcgcauggccauccugggagacacugcgugggacuucgggucgauuggcggcguguucacaucuguagggaaacuuguccaccagaucuuuggcaccgccuacggggugcuguucuccggggugagcuggacgaugaagaucgggaucggcguccugcuuacauggcugggcuugaacucccgcucuaccucccucagcaugaccugcaucgccguggggcuggugacgcucuacuugggcgugauggugcaagcugacucggggugcgugauuaacuggaagggccgggagcugaagugugggagcggcaucuucgucaccaacgaggugcacaccuggacggagcaguacaaauuccaggccgacagcccgaagcgccuguccgcggccaucggcaaggccugggaggagggggugugugggauccggagcgccacucgccuugagaacaucauguggaagcagaucuccaacgaacugaaccacauccugcucgagaacgacaugaaguucacgguaguggugggggacgucgccggcaucuuggcgcagggaaagaagaugaucagaccacaaccaauggaauacaaguacucauggaagucauggggaaaagcuaagaucaucggcgccgacgugcagaacaccaccuucauuaucgacggaccaaacaccccagagugcccggacgaccaacgcgccuggaauaucugggagguggaagacuacgguuucggcaucuucacgaccaacaucuggcugaaacuccgggacucguacacccaagucugcgaccaucgccugauguccgccgccaucaaggacagcaaggccgugcaugcagacaugggauacuggaucgaguccgagaagaaugagaccuggaagcuggcccgggcgagcuucaucgaggugaagacguguaucuggcccaagucccacacacucuggucuaacggcguccuggaguccgagaugaucaucccgaaaaucuacggagggccgaucucacagcacaacuaccgccccggauacuucacccagaccgccggacccuggcaccuagggaagcucgagcuggacuucgaccugugcgagggcacgacagugguggucgacgagcacugcggcaaucgcgggccgucccuccgcacuaccacggugaccggcaagaucauccacgagugguguugucggagcugcacccugccgccccugcgguuucgcggggaggacggcugcugguaugggauggagauucgccccgugaaggagaaggaggagaaccucgucaaguccauggugagcgcuggcagcggcgaggucgacuccuucagccuggggcugcucugcaucuccaucaugaucgaggaggucaugcggagccgcugguccaggaaaaugcuuaugaccggcacgcuggccguguucuuucuccugaucauggggcagcugaccuggaacgauuugauucgccugugcaucauggugggggccaacgcuagcgaccgcauggggaugggcaccaccuaccuugcccucauggccaccuucaagaugaggcccauguucgccguggggcugcuguuccgucggcucaccucccgcgaggugcuauuauugaccauuggguuaagccugguggccagcgucgagcuccccaacagccuggaggagcugggggacgggcuugcgaugggcaucaugauccugaaacugcucacugacuuccagucccaucagcugugggccacgcugcugagccugaccuucaucaagacgacguuuucccuucacuacgccuggaagacaauggccaugauccuuagcaucgugucccuguuccccuugugucucucgaccacuucccagaagaccaccuggcugcccguccugcucggguccuuggggugcaagccucucaccauguucuuaaucgcugaaaacaagaucuggggccggcgcuccuggccccugaaugagggaaucauggccguggguaucgugucuauccugcucagcucacugcugaagaacgauguuccccuggccgggccccugaucgccggcggcaugcugauugccugcuaugugaucuccggguccagcgcggaccuauccuuagagaaggcugccgaagugagcugggaggaggaggccgaacacuccggcgcaagccacaacauccuggucgaggugcaggaugacgggaccaugaagaucaaggacgaggagcgggacgacacccugacaauccugcugaaggcgacgcuccuggcugucuccggagucuacccgcucagcaucccagccacccuguucguaugguauuucuggcagaaaaagaagcagagguccggcguguugugggacacccccagcccgccugaggucgagagagccguucuggacgacggcaucuacagaaucaugcagcggggguugcuggggcggagccaggugggcgucgggguguuccaggagaacguguuucacaccauguggcacgucacgcggggagcuguccugauguaucaagggaagcgucuggaacccagcugggccuccgugaagaaggaccugaucaguuacggcggcggguggcgucuucagggcuccuggaauaccggggaggagguccagguaaucgccguggagccuggcaagaaucccaagaacguccagaccgcccccgggaccuucaagaccccagagggcgaggugggcgccaucgcccuggauuucaagcccgggacguccggcucccccauugugaacagggagggcaagaucgucggauuauacgguaacgggguggugacaaccagcggcacuuacgucagcgcgaucgcccaggccaaggcaucccaggaggguccacugcccgagaucgaggacgagguguucagaaagcgcaaucugacuaucauggaucuccacccuggcagcgggaagacccggcgguaccuuccggcgaucgugcgggaggccaucaagagaaagcugcgaacccucaucuuagcccccacgcgggugguagccagcgagauggccgaggcccugaagggcaugcccauccgcuaccagaccaccgccguaaagagcgaacacaccggcaaggaaaucgucgaccucaugugccacgccacguucacaaugcggcugcugucccccguucgugugccgaacuacaacaugaucaucauggacgaagcacacuuuaccgauccgagcagcaucgccgcgcggggguacaucagcacccgcgucggcaugggggaagccgccgccauuuucaugacggccacgccacccggauccguggaggcuuucccacaguccaacgccgugauccaggacgaggagcgggacaucccugagcgcuccuggaacagcggguacgaguggaucaccgacuucccgggcaagaccgucugguuugugccguccauuaagaguggcaacgacaucgcuaacugccuccggaaaaacgggaagcgcguaauccagcugucgaggaaaacguucgacaccgaguaccagaagacgaagaauaaugacugggauuacgucgugacaaccgacaucagcgagaugggcgccaacuucagggcggaccgggugaucgacccacgccggugccugaagcccgucauucuuaaggacggccccgagcgcgugauacuggccggccccaugccggugacaguagcuuccgcggcucaacggcgcggucggaucggccgcaaccacaauaaggagggcgaccaguacaucuacauggggcagccccugaacaacgaugaggaccacgcgcacuggaccgaagccaagaugcuccuggacaacaucaacacacccgagggcaucauaccagcacuguucgagccggagagagagaagagugccgccaucgacggcgaguaccgucugcgaggagaggcgcggaagacguucguggagcugaugcgccguggggaccugcccgucuggcuuuccuacaagguggccagcgagggcuuccaauacagcgaccgccguuggugcuucgacggcgaacgcaacaaucaggugcuagaggagaauauggacgucgagauuuggaccaaggagggggagaggaagaaacuucggccccgauggcuagacgcccgcacguacuccgacccccuggcccugcgcgaguucaaagaguucgcagcgggcaggcggagcguguccggugaucucauucuggaaaucgguaaacugccgcagcaccucacccaacgcgcccaaaacgcccuggacaaucuagugaugcuccacaauuccgagcagggagggcgggccuaccgccacgcgauggaggagcugcccgacacgaucgagacccugaugcuccuggcgcugaucgccguccuaaccggcggcgugacccuauucuuccucuccggccgggggcuaggcaagacuagcaucggccuccugugcgucauggccucuagcguccuccuguggauggcauccguugagccccacuggauagcggcuagcaucauccuggaguucuuuuuaaugguucugcugauacccgagccggaccgccagcggacgccccaggacaaucagcucgcguacguagugauuggacugcuguuuaugauacuaacgguagcggcaaacgagaugggccugcuggagacuaccaagaaggaccuuggcaucggccacgucgcuguggaaaaccaccaccacgccgcaauguuagauguagaccugcaccccgccuccgccuggacgcucuacgcggucgccaccacuaucaucaccccgaugaugcggcacacgaucgagaacacaaccgcaaacaucagccugaccgccaucgcgaaccaggcggccauccuaauggggcucgacaagggcuggcccaucuccaagauggacauuggcgugccccuacuggcccucgggugcuacagccaggugaacccccugacccugaccgccgcugucuuaaugcugguugcccacuacgccaucaucggcccugggcugcaggcuaaggcaacccgugaggcgcaaaagcggaccgccgccggcaucaugaaaaacccgacgguugacgggaucgucgccauugaucucgaccccguuguguacgacgccaaguuugagaagcagcugggccagauaauguugcucauucugugcaccucccagauccuucucaugcgcacaaccugggcgcucugcgagagcaucacacuggccaccggcccgcucaccacccugugggagggaucaccgggcaaauuuuggaauacgacaauagccgucagcauggccaauaucuuccgggggucguaucuagccggcgcgggacucgccuucucucugaugaagucccuagguggagggcgcagggggaccggagcucagggcgagacucuaggcgagaaguggaagcgccagcugaaccagcugucuaaaagcgaguucaacacguacaagcgguccgggaucauggagguugacaggagcgaggccaaggagggccucaagcgcggggagaccaccaagcacgcgguguccagaggcaccgccaaguuacguugguucguagagcgcaaccugguaaaacccgagggcaaggugaucgacuugggcugcggacgcgggggcuggucguacuacugugccgggcucaagaaggucacggaggugaagggcuacaccaagggcggcccgggucacgaggagcccauccccauggccaccuacggauggaaucuuguaaagcugcacucuggaaaggacgucuuuuucauuccucccgagaagugcgacacccuccuaugcgacauaggggagagcagccccaacccgaccauugaggaaggccgcacccugcgggugcucaagaugguggagcccugguuacgcgggaaucaguucugcaucaagaucuuaaaccccuacaugcccagugucguggaaacccucgagcagaugcagcggaagcacggcgggaugcuggugcgcaacccgcugucgcggaacagcacgcaugagauguacugggucuccugcgggaccggcaacaucgugucugccgugaacaugacgucccgcaugcuccuuaaccgauucaccauggcgcaccggaagcccacguacgagcgugacgucgaccugggggccggcacccggcacguggccguggagcccgagguggcaaaccucgauaucaucggccagcggaucgagaacaucaagcacgagcauaagagcacguggcacuacgacgaagacaacccauacaagaccugggccuaccacgggucuuacgaggugaaaccgucuggcuccgcuagcagcauggugaacgggguggugaaguuacugaccaagccuugggacguaauccccaugguuacccagauagcaaugacugauaccaccccuuucggccagcagagaguguucaaggagaaggucgacacccgcaccccgaaggccaagcgugguaccgcccagaucauggaagugaccgcgaaguggcucuggggcuuccugucgcgcaacaagaagccccggaucugcacccgcgaggaguuuacgcggaaggugcgcagcaacgcggcuaucggagccgucuuuguggacgagaaccaguggaacagugcuaaggaagcgguggaggacgagcgguucugggaucugguccacagagaaagggagcuccacaagcaggggaagugcgcgacuugcguguacaacaugaugggcaagcgcgagaagaaguugggggaguucggcaaggccaaggggagccgggcuauaugguacauguggcugggugcccgcuuucucgaguucgaagcguugggguucaugaacgaggaccacugguucucccgggagaacagccugucgggaguggagggcgaggggcuccacaagcuaggcuacauccugcgcgacaucagcaagauaccuggagggaacauguacgccgaugacaccgccggcugggacacgagaaucacggaggacgaccuccagaacgaggcccgcaucaccgacauaauggagccggagcacgcccugcuugcgaaguccaucuuuaagcucaccuaccagaauaaggucgugcgggugcaacggcccgccaaaaacgggaccguaauggacgugaucagcaggcgggaccaacgcggcuccggccagguggggacauacggccugaacaccuuuaccaacauggaggcccagcucaucagacaaauggagagcgaagggaucuuuucccccagcgagcucgagacacccaaccuggccgagagggucuuggacuggcuggagaaguacggcguggagcggcuaaaacgcauggcgaucuccggagacgacugcguggucaagccgaucgacgaccgguucgcgacggcccugacggcccucaacgacaugggcaaggugcgcaaagacaucccccagugggagcccagcaagggguggaacgacuggcagcaggucccguucugcucccaccacuuccaccagcugaucaugaaagacggccgcgagaucgucgucccgugccgcaaccaggaugaguuagugggccgggcccgcguaagccagggggcuggcuggagccucagggagacugcaugccuggguaagucauacgcgcagauguggcaacugauguacuuucauaggcgggaccuccgccuggccgccaacgcgaucugcagcgcaguacccguggacuggauccccacaucccgcacuaccuggagcauccacgcccaccaccaguggaugaccaccgaggacaugcugucgguuuggaaccgcguguggaucgaggagaaccccuggauggaggacaagacucacaucagcuccuggggcgacgugccauaccuugggaagcgcgaggaccaaugguguggcucccugaucgggcugaccgccagagccacuugggcgaccaacauccaggucgccauuaaccaggugcgccggcucaucgggaacgagaauuaucuggacuacaugaccucuaugaagagguucaagaacgagucagaccccgagggcgcgcugugguga

SEQ ID NO: 24519 - RNA, 9879 nt, Artificial Sequence
  derived and/or modified CDS sequence (opt11) from DENV-1__EU482789__SS-prME
uccgugaccaugcugcucaugcuaaugcccacagcccuggccuuccaucuaaccaccagaggaggggaaccccacaugauagugacuaaacaggagcgggguaagucgcuccuguucaagaccucugcggggguaaauaugugcacccucauugcuauggacuugggugaacugugugaggacaccaugaccuauaagugcccuagaaucaccgaagcggagcccgaugacgucgacugcugguguaaugcgacggacacuugggucacguacggcacauguagccagacgggcgagcaccggcgcgauaaacggagcguggcccucgcaccccaugugggcuuagggcuggagacccgaaccgagaccuggaugaguucggagggcgccuggaagcagauccagcggguagagaccugggcccuccgccaccccggcuucacaguuaucgcccuauuccuggcacacgcaaucgggaccuccaucacccagaagggaaucaucuucauauuacugaugcugguuacgccaaguauggcaaugcggugcgucgguauaggcucacgagacuucgucgaggggcugucgggcgccaccuggguggaugucgugcuggaacauggcuccugcgugacaaccauggccaaagacaagccgacguuggacaucgagcuccugaagaccgaggucaccaaccccgccgugcuacggaaacucuguaucgaggcuaagauauccaacacuacgaccgacucacgcugcccuacucagggggaggccacccugauggaggagcaagacgcgaacuuugugugucggaggacguucgucgaccggggcugggggaauggcugcgggcuguuugguaaggggagccucauaacgugcgccaaguucaaaugcgucaccaagauggagggcaaaaucgugcaguacgagaaccucaaguacagugucaucguuacugugcacacgggagaccagcaccagguggggaacgaaucuaccgagcacggcaccacggcuacuaucacgccgcaggccccuaccuccgaaauccagcugaccgacuacggagcccuaacucuggacuguagcccacgaacuggccuggacuucaacgagaugguguuacuaacgaugaaggaaaagagcuggcugguccacaagcagugguuccucgaccuuccucuacccuggacaagcggagcaucuaccagucaggagacauggaaccgacaggacuugcuggugaccuucaagaccgcccacgcaaagaagcaggagguugucgugcucggcagccaagagggcgcuaugcauaccgcccuaacgggagccaccgaaauccaaaccuccggcaccacuacaaucuucgcggggcaccugaagugcagacugaagauggacaaacucacccucaagggcaugagcuacgugaugugcacaggguccuucaagcuagagaaggaagucgcggagacgcaacacgggacuguccucgugcagauaaaauacgagggcaccgacgcccccugcaagauucccuuuagcacacaggaugaaaagggggugacccagaacgggcgguugaucaccgcgaauccgaucgugaccgacaaagagaaacccguaaacauagaggccgagccacccuucggggagaguuacaucguaaucggcgcaggcgagaaggcccucaagcugagcugguucaagaaggguuccagcaucggcaagauguucgaggccaccgcccgcggugcccgccgcauggcgauacucggugacacggcaugggacuucggaucaaucggcgggguuuucaccagcguggggaagcugguccaucagaucuucggcacugcuuaugggguccuguucucaggcguaaguuggaccaugaagauaggcauaggcguccuccuuaccuggcuaggccugaacucgcgcucaaccuccuuaagcaugacuugcaucgcuguagggcuggugacccucuaucuuggcgucauggugcaagccgacuccgggugcgugaucaacuggaagggccgggagcuuaaaugcggaagcggaauuuucgucaccaacgaggugcacacuuggaccgagcaguacaaguuccaggcggacucaccgaaacgccucucagcugccaucggcaaggccugggaggagggugucugcggcauucggagcgccacacgccuggaaaacaucauguggaagcagaucuccaacgagcugaaccauauccucuuagagaaugacaugaaguucacugucgugguaggggacgugguggggauccuggcgcaggggaagaagaugauccggccccaaccuauggagcacaaguauagcuggaaaagcuggggcaaggccaagaucauuggcgccgacgugcagaacacuaccuucaucauagaugggcccaacacccccgagugcccagacgaccagcgcgcguggaacaucugggagguagaggacuacgguuucgggaucuucaccacaaacaucuggcucaagcugcgugacuccuacacgcaaguaugugaccaucgccugaugucugccgccaucaaggacagcaaggcggugcacgccgauaugggauacuggauugaguccgaaaagaaugagaccuggaagcucgcucgggcgagcuucaucgaggucaagaccugcauuuggcccaagucccauacacuguggucgaaugggguacuggagucggagaugaucauccccaagaucuacggcggccccaucagccaacauaauuaucgccccggauacuucacccaaacagccggcccguggcaccucgggaagcuggagcuggacuuugacuuaugugagggcacuacgguugucguggaugaacacugcggcaaccgggggcccagcuugcgaaccaccaccgugacagggaagaucauucacgaguggugcugccguagcugcacccugccgccauugcgcuucaagggggaggacggcugcugguacggcauggagauccgucccgugaaagagaaggaggagaaccugguuaaguccauggugagcgccgguagcggagagguugauagcuucagccuggggcuccugugcauaucgaucaugaucgaggaggugaugcgcagccgguggucccgcaagaugcugaugaccggaacccuagcagucuuccugcuccugaucauggggcagcucacguggaaugacuugauccggcucugcauaaugguaggcgccaacgcgagcgaccgcaugggcaugggcacgacauauuuggcguugauggccaccuucaagaugcgcccuauguucgccguggggcuccuguuccgaagacugacgucacgggaggugcuccugcugacuaucgggcuuucccuuguugcuucaguggaauuacccaacucacucgaagaacucggagacggucuggcaaugggcauaaugauccuaaagcugcuuaccgacuuccaaucccaucagcucugggcaacccugcuuagcuuaacguucaucaagacaacccucuccuugcauuaugcauggaaaaccauggcuaugguccucagcauuguaucccuguuuccccugugucucucgacaacgucccagaagaccacaugguuaccaguguugcuagguagccuggggugcaaaccgcugacaauguuucucaucgcggagaacaagauauggggucgcaaguccuggccccugaacgaggggaucauggcuguugggguugucagcauucugcucuccucccugcuuaaaaacgaugucccccucgcagggccgcuuaucgccggcggcaugcuaaucgcaugcuaugugaucucggguuccucagccgaccuauccuuagagaaggccgccgagguuagcugggaggaggaggccgagcauaguggcgccagccacaacauucuggucgagguacaggaugacggaacgaugaagaucaaggaugaagaacgggaugacacacucaccauccugcuaaaggcuacccuccuggccguguccggcgucuacccguugagcauccccgccacccucuucgucugguacuuuuggcagaagaagaagcagcgcucugggguacugugggacaccccuagcccacccgaagucgagcgggccguacuggaugauggcaucuaucguauuaugcagcgcggccugcucgggcgcucccagguuggugucgggguguuccaagagaacguguuccauaccauguggcacgucacccggggagcgguacugauguaucagggcaagcggcuagagcccagcugggcguccgugaagaaagaccuaauaagcuauggcgguggcuggcgguuacaggguaguuggaacacgggggaagagguccaaguaaucgccgucgagccaggcaagaaccccaagaauguccagaccgcccccggcaccuucaagacgccggagggcgaagucggcgcuaucgcccucgacuucaagccuggcacgagcggcucccccauaguaaaccgcgaggggaagaucgucgggcuuuacggaaacgggguuguaaccaccucuggcacauacgugucggccauugcccaggcaaaggcaucccaggagggaccgcugccggagaucgaggacgaggucuuuagaaagcguaaccugacgauaauggaccuucaccccggcagcgguaagacucggagguaccuaccggccaucgugcgggaggccaucaagcgcaaacuuagaacccucauacuagcccccacgcgaguagucgcuucggagauggccgaagcgcugaagggcaugcccaucagguaccagacaaccgccgucaagagugaacacacggguaaggagaucgucgauuugaugugccaugccaccuucacgaugcggcugcugucccccgugcgugugccgaacuacaacaugaucauuauggacgaggcccauuucacagaccccagcucuaucgcagcgagaggguacauuucuacccgcguugggaugggagaggccgccgccaucuuuaugaccgcuaccccgccaggaagcguggaggcuuucccgcaaucaaacgccguaauacaagacgaggaacgggauauacccgagcgauccuggaacagcggguaugaguggauuacagauuuccccggcaaaacaguuugguucgugccuucuaucaagucagguaaugauaucgcaaacugucucagaaagaacggaaagcgcgugauccagcuguccagaaagaccuucgacacggaauaccagaaaacaaagaacaacgacugggacuacgucgucaccacugacauuuccgaaaugggggcuaauuuccgugccgacagagugaucgauccccgccggugccugaagccagucauacucaaagaugggccagaacgcgucauccuggccggcccgaugccggucacggucgcguccgcggcccagaggaggggccggaucggccgcaaccacaacaaagagggcgaccaguacauuuacaugggccagccccugaacaacgacgaagaccaugcgcacuggaccgaggcaaagaugcuccuggacaacaucaacacgccugagggcaucaucccugcccucuucgagccugaacgagagaaguccgcagccauugacggggaauaucgcuugagaggcgaggccagaaagacauucguugaacugaugcgccgcggggaccugccagucugguuaucguacaagguagccagcgagggcuuucaguacuccgaccgccgguggugcuucgacggugagcggaacaaccagguucuagaggagaacauggacgucgaaaucuggacaaaggagggugagcggaagaaguugcgcccacgguggcucgacgcccgaaccuacucggacccccuggccuugcgggaguucaaggaauuugccgcgggcagaaggagcguguccggggaucucauacuagagaucggcaaguugccacagcaccucacacagcgggcucagaacgcucuggacaacuuggucaugcuucacaacuccgagcagggcggacgggccuaccggcacgcgauggaggaacugcccgacacaauagagacgcugaugcuacuugcacugaucgcugugcuuacagguggagugacccuauucuuucucuccggccgcgggcucgggaagacgagcaucggacugcugugcgugauggcuuccagcgucuuguuguggauggccaguguggagccccacuggaucgcagccagcaucauccuggaguucuuccucauggugcuucugaucccggagccugaccgccagcggacgccccaagauaaccagcucgccuacgucgugauuggccugcuguuuaugauccucacaguagccgccaaugaaaugggacugcuggaaaccaccaagaaggaccucgggauugggcauguagccguugagaaccaccaccaugccacgaugcuagacgucgaccugcacccugccuccgcuuggacacucuaugccguugcgaccaccaucaucaccccgaugaugaggcacaccauugagaacacaaccgccaauaucagccugaccgccaucgcaaaucaggccgcgauacucauggggcucgacaaggguuggcccaucuccaagauggacaucggcgugcccuugcuggcacucggcugcuacagccagguaaacccccugacgcugaccgccgcgguccucaugcugguggcgcauuaugcaaucaucgggccagggcugcaagcuaaggccacccgggaggcucagaaacgcacagcugcgggaaucaugaagaaucccacuguggacgggaucgucgccauugacuuggaccccgugguguacgacgccaaguucgagaaacaacugggacagauuaugcuucucauccugugcaccucccagauccugcucaugcgcaccacaugggcuuuaugugagagcauuacgcuggcaacuggcccccuuaccacucugugggaggggagcccgggcaaguuuuggaacacgacgaucgcugucagcauggcgaauauauuccguggguccuaccuggcaggggccggccuagcauuuagccugaugaaguccuugggucgcggcaggcgcggcaccggcgcccagggggagacccucggagagaaauggaagagacagcugaaccagcuguccaagagcgaguucaacaucuacaagcgcucuggcauuauggagguggaccgaagcgaggcaaaagagggucucaagcgaggcgagacuacacggcacgccgugucacgggggaccgcaaagcugcggugguucguggagcgcaaccuugugaaacccgagggcaagguuaucgaccuggggugcggccggggcggauggagcuacuacugugccggcuugaagaaagucaccgaggucaaaggguacaccaaaggcgguccaggccacgaggagccuaucccaauggccaccuacggauggaaucuggugaagcugcacuccgggaaggacgucuucuuuacgccgcccgaaaagugugacaccuuacugugcgacaucggggagagcucgccgaacccuacgauugaagaggggaggacccuucgggugcugaagaugguagagccauggcuccgcggcaaucaguucuguaucaagauacugaacccguacaugccuagcgugguagagacacucgaacagaugcagcgcaaacacggaggcaugcuggugagaaacccacugagucggaauaguacccacgaaauguacuggguguccugcggcaccggaaauauuguuagcgccgugaacaugacgucccgcaugcuccugaaccgguuuaccauggcccaccggaagccuacauacgagcgcgauguugacuuaggcgcggggacacggcauguggccguggagcccgaggucgccaaucucgacaucauaggacagcgaauugagaauaucaagcaugaacacaagucgacguggcauuacgaugaggacaacccauauaaaaccugggcauaucacggcaguuaugaggugaagccgaguggguccgcgagcuccauggucaacggcguagugaagcugcuaaccaagcccugggaugucauccccauggugacacagauugcaaugacggacaccacccccuucgggcaacagcguguauucaaggaaaaagucgacacacgcacgccgaaggcaaagcggggcacugcgcaaaucauggaaguuacagcccgcuggcucuggggguuccugucccggaacaaaaagccccguaucugcacgagagaggaguucacgcguaaggugcggaguaacgccgcgaucggcgccgucuuuguggacgagaaccaguggaacucugccaaggaagcgguggaggaugagcgcuucugggaucuggugcagaaagagcgggagcuccacaagcaaggcaagugcgcgaccugcguguauaauaugaugggcaagcgcgagaagaagcugggcgaauuuggaaaggcaaagggcagccgggcuaucugguauauguggcuaggggcgagauuccucgaguucgaggcucugggguuuaugaacgaagaucacugguuuucucgggagaacagccuguccgguguugagggggagggccuccacaaacuuggguacauccugcgagacaucucuaagauucccggcgggaauauguaugcugacgacaccgccggcugggacacucggauaacggaggacgaccuccaaaaugaggcgaaaaucaccgacaucauggagccggagcacgcccugcuggcuaccuccaucuuuaagcucacauaccagaacaaagucgugcgggugcagaggcccgccaagucaggcacgguaauggacgugaucucccgacgcgaccagcgcgggucaggccagguggggacguauggccugaauacuuuuaccaacauggaggcgcagcuaauccggcagauggaaucggagggaaucuuccuacccagugagcuggaaacgcccaaccucgccgagcggguacucgacuggcuggagaaguacgggguggagcgccugaagcggauggccaucuccggagaugacuguguggucaagcccaucgacgaucgcuuugccaccgcgcuaaccgcgcuaaacgacauggggaaggugcggaaggacaucccacagugggaacccagcaaggguuggaacgacuggcaacaagugcccuucugcucccaccacuuucaccagcuuaucaugaaggauggucgcgagaucgucgugccgugccguaaccaggacgaacuugugggccgggccagggucucacaaggcgccggauggagcuugcgcgaaacggccugcuuggguaagucauacgcgcagauguggcagcucauguauuuucaccggagggauuuaagacuggccgcuaacgccaucuguagcgcagugcccguggacuggguccccaccucccgcaccaccuggaguauacacgcccaccaccaguggaugacuacggaggacaugcuguccguuuggaacagaguuuggauagaggagaaucccuggauggaagauaagacccaugucagcuccuggggugacgugccguacuugggcaagcgugaggaucaguggugcgggagccugaucggacucacggcccgcgccaccugggcaucuaacauacagguggcgaucaaucagguccggcgccugauuggcaaugaaaacuaccuggauuacaugaccagcaugaagcguuucaagaacgaaggggacccagagggcgcccugugguga

SEQ ID NO: 24520 - RNA, 9879 nt, Artificial Sequence
  derived and/or modified CDS sequence (opt11) from DENV-1__EU482790__SS-prME
agcgugaccaugcugcugaugcugaugcccaccgcccuggccuuccaccucacgacccggggaggcgagccccacaugaucgugagcaagcaagagcggggcaagucucuccuuuuuaagacguccgcgggaguaaacaugugcacuuugauugcaauggaccugggcgaguucugcgaggauacgaugaccuauaagugcccuagaaucaccgaggccgagccugacgacguggacugcuggugcaacgccacagacacaugggugaccuacgggaccugcagccagacaggcgaacauaggcgggauaagcgcuccguagcccucgcgccccacguggggcucggccuggagacgcgcaccgagaccuggaugagcagugagggcgcauggaaacagauccagcgggucgagacgugggccuugcgccacccuggguucacggugauugcccucuuccuggcccacgcgaucgggaccagcaucacccagaaggggauuaucuuuauccugcucaugcuggugacccccuccauggcgaugcggugcguuggcaucgguucucgugacuucguggagggucugucgggggcaacuuggguggacgucgugcucgaacacgggaguugcgugacgaccauggccaaggacaagcccacccuggacaucgagcugcuuaaaacggaggucaccaaucccgcggugcuucggaagcugugcaucgaggccaagaucucuaacaccaccacggacagccgcugcccaacccaaggggaggccaccuuaguggaggagcaggacgccaacuucgucugccggcggacauucguggaccgggguugggggaacggcugcgggcuguucggcaaggggagccugaucacgugcgcuaaguucaagugcgugacaaagcucgaggguaaaaucguccaguaugagaacuuaaaguacagcgugaucgugacgguccauacaggcgaccaacaucaggugggaaaugagagcacggagcacggaaccaccgcgaccauuacaccccaggcuccuuccacagagauacagcuuacagauuauggggcacugacccuggacugcagcccccggaccgggcuggacuucaacgagaugguccuacugacgaugaaagagaaaaguuggcuggugcacaagcagugguucuuggaccuuccgcugcccuggaccagcgguucaagcaccucccaggagaccuggaaccggcaggaccuccuggugaccuuuaaaaccgcccaugccaagaagcaggaagucguggugcuaggcucccaggagggcgcgaugcacaccgcccucaccggggccacagagauccaaaccuccgguaccacuacgaucuucgccggccaucugaagugcaggcugaaaauggauaaacuuacuuugaagggcaugagcuacgucaugugcaccggauccuuuaagcuggaaaaggagguagccgagacccagcacggcacggugcuuguccagaucaaguaugaggguaccgacgugcccugcaagaucccauucagcacccaggacgagaagggggugacccagaacggccggcugauuacggcgaacccaaucgucaccgacaaggagaagccggugaacaucgaggccgagccacccuuuggagagaguuacaucgugaucggcgccggcgaaaaggcccugaaacugucuugguucaagaaggguuccagcaucgggaagauguucgaggcgaccgcccgcggagcuagacgcauggccauacucggcgacacggccugggacuucggguccauagguggcgucuucacgucgguggggaagcucguccaccagauauucggcacugcguacgggguacuauuuuccggcgucagcuggaccaugaagauugggaucggggugcuccugaccuggcugggccucaacucccgcagcacgagccucucgaugaccugcauagccgucggguuaguuaccuuguaccugggcgugauggugcaggccgauagcgggugcgugaucaacuggaagggacgcgagcugaagugcgggucaggaauauuuguaaccaacgagguccacacguggacagagcaauacaaauuccaggccgacucaccgaagaggcuguccgccgcgaucggcaaggcuugggaggaggggguaugcggcaucaggucggccaccagacuggagaacaucauguggaagcaaaucuccaacgagcugaaccacauccuccuggaaaacgacaugaaauuaacagucguggugggggacguggccgggaucuuggcccagggcaagaaaaugauacgcccacagccgauggaguacaaauacagcuggaaaucuuggggaaaggcaaagaucaucggugcagacguccagaacacuaccuucauuaucgaugggcccaacaccccggaaugucccgaugaccagcgcgccuggaacaucugggagguugaggacuacggcuucgggauuuucacaaccaauaucuggcugaagcugcgggacagcuacacccaggugugugaccaccgacucauguccgcggcgaucaaggacagcaaggcuguccacgcagacaugggguacuggaucgaguccgagaagaacgagaccuggaaacuggcgcgggccucguucauugaggugaagacaugcauauggcccaagucccacacucuguggagcaauggcguccucgaguccgagaugauuauccccaagaucuaugggggacccaucagccagcacaacuaccgccccggguacuucacgcagaccgcggggcccuggcaccuugguaaacuggaauuggacuucgaccuaugugagggcacgacggucgugguugacgaacacugcggcaacagagggccgucccugagaacgaccaccgugaccggcaagaucauccacgaaugguguugccgcagcugcacgcugccgccccuccgcuuuaaaggggaggauggcuguugguacgggauggagauccggcccgugaaggagaaggaggaaaaccuggucaagucaauggucuccgcaggcucaggcgagguggacucuuucagccuaggucugcucugcauauccaucaugaucgaggaagugaugcgcucccgguggucccgcaagaugcuaaugaccggcacucuggccguauucuuccugcucauaauggggcagcugacuuggaaugaccuaaucagacucugcaucauggugggagccaacgcgagcgaccgcaugggcaugggaacgacauaucuggcgcugauggccaccuuuaaaaugaggccgauguucgcgguggggcugcuguuucggaggcugaccucccgggagguccuccugcuaacaauagggcuaagccugguggccuccgucgagcugcccaacucucuugaggagcugggugacgggcuggccauggggauaaugauccucaagcugcugaccgacuuccagucucaccagcucugggcuacucugcuuucccucaccuuuaucaagacgaccuucagucuucacuacgcuuggaagaccauggccauggugcugagcaucguaucccucuucccauuaugccugagcaccacgagccagaagaccaccuggcuccccguccugcucggcagccuggguugcaagccguugaccauguuccugaucgccgagaacaagaucuggggccgaaagagcuggccucucaacgaggggaucauggcagugggcaucguguccauucugcucagcucucuacugaagaacgauguaccacuggcagggccccucaucgcgggcggcaugcugaucgccuguuauguaaucucuggguccagcgccgaccugucccucgaaaaggcggcagaagugaguugggaggaggaggccgagcauuccggcgccagccacaacauccuggucgaggugcaggacgacggcacgaugaagaucaaggacgaggagcgggacgacacccugaccauccuccugaaggccacucugcucgcgguguccggcgucuauccacuaaguauccccgccacccuguucgucugguauuucuggcagaagaagaagcagcgguccgguguucucugggacacuccgagcccucccgaggucgagcgggccgugcuggacgacggcaucuaucgcaucaugcagaggggccugcuggggaggucccaggugggcgucggcguguuccaggagaacguguuccacaccauguggcacgucacgcggggcgcugugcucauguaucaaggcaagcgccuggaacccucgugggccucggugaagaaggaccugauuagcuacggaggcggguggaggcuccagggcuccuggaacaccggggaggaaguccaggugauagccguggagccaggcaagaaccccaaaaacguccaaacggccccggguaccuucaaaaccagugagggcgaggugggcgcuauagcucucgauuucaagcccgggaccagcggcucccccaucguaaaccgugaggggaagauugugggccuguacggcaacgggguggugacgaccagcggcaccuacguaucggccaucgcccaggccaaggccagccaggaagggccucugccggagaucgaggacgaaguauuccgcaagcgcaaccugaccaucauggaccugcaucccggcucagggaagacucggcgcuaucuccccgccaucgugcgcgaggcgaucaagcgcaagcuccggaccuugauccucgccccgacucgcgucguggcaucagaaauggcagaggcgcuaaaaggcaugcccauccgcuaucagacgacugcggucaaguccgagcacacuggcaaggagaucgucgaccugaugugccacgccacauucaccaugcggcuccugagcccugugcgcgugcccaacuacaauaugaucaucauggacgaggcacauuucacagacccguccagcaucgcugcccggggcuacauaucuacccgcgucggcaugggcgaggcugccgcuaucuucaugaccgccaccccgcccggcucgguggaagccuucccccaguccaacgcggugauacaggacgaggagcgggauauuccagagcgaagcuggaauaguggguaugaguggaucacggacuuccccggcaagaccgucugguucgugccuagcaucaaguccggcaaugacaucgccaauugucugaggaaaaacgggaagcgcgugauucaguuaagccggaagacguucgacaccgaguaccaaaagacgaagaauaacgacugggacuacgucgugaccaccgacauuagcgagaugggcgccaauuuccgcgcagaccgggugaucgaccccaggcggugucuaaagccugucauucugaaggacgggcccgagcgggugauccucgcgggccccaugcccgucaccguggcgucagccgcccaacggcgcgggcggaucggucguaaccacaacaaggagggggaucaauacauauacaugggccaaccgcugaacaaugaugaggaccacgcccauuggacggaggcgaagaugcuacucgacaacaucaacaccccagaggggaucauccccgcccuuuucgagcccgagcgagaaaaguccgcugccaucgauggggaauaccgccuccguggugaggcccguaaaaccuucguagaacucaugcgccgcggggaucugccugucuggcuguccuacaagguagcgagcgaggguuuccaguacuccgaccgccgguggugcuucgacggcgagcgcaacaaccaggugcuagaagagaacauggacguggagaucuggaccaaggagggggagagaaagaagcugcgccccagguggcuugaugccaggacguauagcgacccccucgcccugcgggaguucaaggaguucgccgcgggccgccguucugucagcggggaccuuauccucgagauaggcaagcugccucagcaccugacgcaacgcgcgcagaacgcccuggacaaccuggugaugcugcacaauuccgagcagggugggcgggcauacagacacgcaauggaggagcuccccgauacgauugagaccuuaaugcugcucgcucuaaucgcuguccugacgggcggggugacccucuucuucuuaagcggucggggucuuggcaagaccuccaucggauugcugugcgugauggccagcaguguucugcucuggauggccucgguggagccacacuggaucgccgccuccaucauccuggaguucuucuuaaugguguuacugaucccugagccugaucgccagcgaacgccgcaagacaaucaacuggccuacguggugaucgggcuccuguucaugauccugaccguggcagccaacgagaugggccuacucgagacaaccaagaaggaccucgggaucggccacguugcaguggagaaccaccaucacgcagccauguuggacguggaccugcaccccgccagcgccuggacccuguaugcagucgcgaccacgaucaucacccccaugaugcggcacacuaucgagaauaccacagcuaacaucucccucaccgccaucgccaaccaggccgcaauacugauggggcuggacaagggcuggccgaucagcaagauggacaucggcgugccccuccuggccuuggggugcuacucccaggugaacccacuuacccugaccgccgccguccugaugcucguggcgcacuacgccaucaucggccccgggcugcaggccaaagccacgcgugaggcccagaagcgcacagcagccggaaucaugaaaaacccuacuguggacgguaucgucgccauagaccuggacccgguagucuacgacgccaaguucgagaagcaacucggacagaucaugcugcugauucucugcaccucgcagauccugcugaugcgcacgaccugggcccucugcgagucuauaacccuggcgaccggcccccugacgacccucugggagggaucacccggcaaguucuggaacaccaccaucgcaguaagcauggccaacaucuucagggguuccuaccuggccggcgccggccuggcguucagccuuaugaagucccuagggggcgggcgcagggggacgggggcccaaggagagacccugggcgaaaaguggaagcggcagcucaaccagcucucuaaguccgaguucaacaccuacaagcggagcgggaucauggagguggaccgcucugaagccaaggaaggccugaagcgcggggagaccacgaagcacgcugugucgcgcggcaccgcgaagcuccggugguucgucgagcgcaaccuggugaagccggaggggaagguaaucgaccucgguugcgggagaggugguugguccuacuacugcgcggggcuuaagaaggucacggaggugaagggguacaccaagggcggccccggccacgaggagcccauccccauggccaccuacggguggaaccucgugaagcuguacagcggcaaggacgucuucuuuaucccacccgagaagugcgacacccuucuuugcgacaucggggaguccucccccaaccccacuaucgaggagggccgcacucuacguguccugaagaugguggaaccaugguuacgcgggaaccaguucuguaucaaaauccugaaccccuacaugcccuccgucguggagacacucgagcagaugcagcggaagcacggcggcauguuagugcguaauccccuaagccggaacucgacccacgaaauguacuggguuagcugcggaaccggcaauaucguguccgccgugaacaugaccucacgcaugcugcucaaccgguucacgauggcccaccgaaaaccgacguacgagcgcgacgucgacuuaggggcgggcaccagacacguggccguggagcccgagguccccaaccuugacaucaucggccagcguaucgaaaacauaaagcacgagcacaaguccaccuggcacuacgacgaggacaaccccuauaagacaugggcguaccacgggagcuacgaggugaagccgagcggcuccgccagcagcauggugaacggcguagugaagcucuugacgaaacccugggacgucaucccgauggugacccagaucgccaugacugacacgacgcccuucggccagcagaggguguucaaagagaagguggacaccagaacucccaaggcgaaacgcgggaccgcucagaucauggaaguuacggccaagugguuauggggcuucuuaagccgcaacaaaaagccacgaaucuguacccgcgaggaguucacccgaaaggugcgguccaacgccgccaucggcgcggucuucguggacgagaaccaauggaacuccgccaaggaagccguggaggacgagcgauucugggaccugguccaccgcgagcgggagcugcacaagcaggggaaaugcgccacaugcguguacaacaugauggggaagcgagaaaagaagcucggagaguucggcaaggcgaaggggagucgcgccaucugguacauguggcugggcgcccgguuucuggaguucgaggcccucggcuucaugaacgaggaccacugguucagccgagagaacucccugagcgggguggagggcgagggacugcacaagcugggcuacauucugcgcgauaucuccaagauccccgggggcaauauguaugccgacgacaccgcgggcugggacacacggaucacggaggaugacuugcagaaugaggccaagaucaccgacaucauggagccggagcaugcccuccuggccaagaguaucuucaagcugaccuaccagaacaaggucgugcgcgugcagcggccugcaaagaacgggaccguuauggacgugauaucccgccgagaucagcggggcagcggccaagugggcaccuacggccucaacaccuuuacgaacauggaggcucaguuaauccgccagauggagucugaggggaucuucagccccuccgaguuggaaaccccaaaccucgccggccggguguuagacuggcuugaaaagcaugggguggaacgccuaaagaggauggccauaucaggagacgauugcguggucaaaccgaucgacgaccgcuuugccacggcccugacggcgcugaacgacauggggaaggugcguaaggacauaccccagugggagcccagcaagggcuggaacgauuggcagcagguccccuucugcucccaccacuuucaucagcucauaaugaaagacggccgugaaaucgucgugccuugccggaaccaggacgagcugguggggcgcgcccgggucucucagggagcgggguggucccuucgggagacggccugccucggaaagagcuaugcccagauguggcagcugauguacuuccacaggcgcgaccuucggcucgcggcuaacgccaucugcuccgccgugcccguggacuggguccccacaagccgcacuaccugguccauccacgcgcaccaccaguggaugaccaccgaggacaugcugucuguguggaaccgggucuggauugaggagaaccccuggauggaggacaagacgcacaucuccagcuggggcgaugucccguaccuuggcaagcgcgaggaccaguggugcggcucccucaucgggcuuaccgcucgggccacgugggcuaccaauauccagguggccauuaaucaggugcgcagacuuaucggcaaugaaaacuaucucgacuacaugaccagcaugaagcgauucaagaaugaauccgacccggagggcgcgcugugguaa

SEQ ID NO: 24521 - RNA, 9879 nt, Artificial Sequence
  derived and/or modified CDS sequence (opt11) from DENV-1__EU482791__SS-prME
ucagugaccauguugcuaaugcugaugcccacggcccuggcuuuccaucucaccacucgcggcggggagccccacaugaucgugacuaaacaggagagaggcaaaagccugcuuuucaagacaagcgcuggggugaauaugugcacacucaucgcuauggaccugggagagcugugcgaggacaccaugaccuacaaguguccacguaucacagaggccgagcccgaugacgucgacugcugguguaaugcuaccgauacgugggucacguacgggacgugcagccaaacgggggagcaccggagggacaagcggagcguggcccucgcgccccacgugggccuggggcuggagacccgcaccgagaccuggaugucuagcgagggcgccuggaagcagauccagagaguggagacgugggcccuccgccacccuggguucaccgugauagcccuguuccuggcgcaugccaucggcacuuccaucacccagaaagggauuauauuuauccuccugaugcuggugacgcccuccauggccaugcggugugucgguaucggcagcagagacuuuguagaggggcucagcggcgccacauggguagacguggugcuggagcacggguccugcgugaccacuauggcgaaggauaagccuacgcuggauauagagcuacugaaaaccgaggucacuaaccccgcgguauugaggaagcugugcaucgaggccaagaucuccaacaccacgacagacucccggugccccacccagggcgaggccacccugauggaggagcaggaugcuaacuucgugugccggcggacauucgucgaccgggguugggggaauggcugcggacuguucggcaaagguucauugaucaccugugccaaguucaaaugcguuacaaaguuagagggcaagaucgugcaguacgagaaccuuaaguacucagucaucgugacagugcacacuggcgaccagcaccaggucgguaacgagucaacggagcacggcaccaccgcuacaauuacaccucaagcccccaccuccgagauacagcuuacggacuauggggcccugacccuggacugcucaccccggacggggcucgauuuuaacgagauggugcuccugaccaugaaagaaaaguccuggcuaguccacaaacagugguuccuggaccugccucucccauggacuagcggugcgagcaccagccaggaaacauggaaucggcaggaccuacugguuaccuucaagaccgcccacgcgaagaagcaggaaguggucgugcucggcagucaggaaggugccaugcacaccgcgcuaacaggcgccaccgagauacagaccucgggcaccacgaccaucuucgcggggcaccugaaaugccgucucaaaauggacaagcugacccugaaaggcaugagcuacguuaugugcacugggaguuucaagcucgagaaagaaguagcggagacgcagcaugguaccgugcuggugcaaauaaaguacgagggcaccgacgcccccugcaagauacccuucuccacccaggacgagaaaggcguaacucagaacggccgcuugaucaccgcaaauccgaucgugaccgacaaagagaagcccgugaacauagaggccgagccgcccuucggggagagcuacauugucaucggcgcgggcgaaaaggcacugaaacuaagcugguucaagaagggcucaagcaucggcaaaauguucgaggccaccgccagaggggcucggagaauggcgauccuuggcgauaccgcgugggacuuuggguccauuggcggcguguuuacuagcguggggaaguuaguccaccagaucuucggcaccgccuacgggguucucuucuccggagugagcuggaccaugaagaucgggaucggcguacugcugacaugguuaggccugaacagcagaagcaccucucuuagcaugacaugcauugccgugggguuggugacacuauaccugggcgugauggugcaggccgacucggggugcguuaucaacuggaaaggcagggagcucaagugugggagcggcauauucgucacgaacgaggugcacaccuggaccgagcaguauaaguuucaggcggauagcccaaagcgccuguccgcagcgauaggcaaggccugggaagaggggguaugcggcauacggucggccacccggcuggagaauauaauguggaagcaaauaucaaacgagcucaaucacauccugcuggagaacgggaugaaguucacagucgucguuggcgaugucgucgggauccuggcgcagggaaagaaaaugaucagaccccagcccauggagcacaaguacucguggaaguccuggggcaaggccaaaaucauaggagcggacgugcagaacacuacguuuaucaucgacggaccaaacaccccggagugcccggacgaccagcgcgcuuggaauauaugggaagucgaggacuacggguuuggcaucuucaccacuaacaucuggcugaagcugagagacaguuacacccaggugugcgaucacaggcucaugucugcggccaucaaggacagcaaggccguacacgccgacaugggcuacuggauugaauccgagaagaaugaaacauggaagcuggcccgggcgagcuucauagaggugaaaaccugcaucuggcccaaaucccacacucuguggagcaacggggugcuggaguccgagaugaucauuccaaaaaucuacggcgggccgaucagccagcacaacuaucgccccggcuacuucacucagacggccgggcccuggcaccuaggaaaacuggagcucgacuuugaucugugugaaggaacuacugugguuguugacgagcacugcgggaaccguggacccucccugcgcaccaccaccgugaccgggaagauaauccacgaguggugcugucgguccugcacccugccuccccuccgcuucaagggcgaggacgggugcugguacggcauggagauuaggcccgucaaggaaaaggaggagaaucuggugaaguccauggugagcgcggguagcggcgaggucgauucuuucagccucggccugcugugcacaucgaucaugauagaggaggugaugcgcucgcgguggucacgcaagaugcucaugaccgggacgcuggcuguuuuccugcuccuuauaaugggacaguugaccuggaacgaccucauccggcugugcauaaugguaggugccaaugcgagugaucgcaugggcaugggcaccaccuaucuagcgcucauggcuacuuucaagaugcggccaauguucgccguggggcugcuauuccggcgccucaccucccgggaagugcugcuccugaccaucgggcugagccugguugccagcguggagcuuccaaacagccuggaggagcugggggacggccucgcgaugggcaucaugaucuugaaacugcucaccgacuuccagucccaccagcugugggccacguuacucagccuaaccuucauuaagacuacauugucucuccacuacgccuggaaaacuauggcgaugguccugucgaucguuucccuguucccccucugccugagcacaaccagccagaaaaccacguggcugcccgucuuacuggggagccuugggugcaaaccacucaccauguucuugaucgcggaaaacaagauauggggucgcaaauccuggccccugaaugagggcaucauggccgucgggguggucagcauccuccugagcagccuguugaagaacgacgucccccuggccgggccguugauugccggcggaaugcucaucgccugcuacguaauuucagguuccagcgcggaccugagucuagagaaggccgccgaggucagcugggaggaggaggccgagcacuccggggccagccacaacauucucguagaaguacaggaugacggcacuaugaagauaaaagacgaggagcgcgaugacacccugaccauccugcucaaggcgacgcugcuggccgucuccggugucuauccguugagcauccccgccacgcuguucgugugguacuucuggcaaaagaaaaaacaacgcuccgggguucugugggacaccccuagcccucccgaggucgagcgggccguguuagacgacgggaucuaccgaauaaugcagcggggucuauuggggcgcucccaaguuggcgugggcguguuccaggagaacguguuucacaccauguggcauguaacucgcggggccgugcucauguaccagggcaagcgccucgagcccucgugggcguccgugaagaaagaccuuauuagcuauggagggggcuggaggcuacagggauccuggaauaccggcgaggagguccaggugaucgccguggaaccgggaaaaaaccccaaaaauguacagacagcacccggcaccuuuaagacgccagagggcgaggugggggccaucgccuuagacuucaagcccgggaccuccgggagccccaucgugaaucgggagggcaagaucgucggccuauacggaaaugggguggucaccaccucagggacguacguaagcgcuaucgcacaggccaaggcgucucaggagggcccgcugcccgagaucgaggaugagguguucaggaagaggaaccucaccaucauggauuugcaccccggcagcggcaaaacucgucgguaccucccugccaucgugcgggaggccaucaagcgcaaacucagaacccugauccuggcgcccacgagaguuguugccagcgagauggcagaggcucucaagggaaugcccauccgcuaccagaccacagcugucaagagcgagcacaccgggaaggaaaucgucgaccugaugugucacgccacguuuaccaugcgguuacucuccccagugaggguucccaacuacaacaugaucaucauggaugaggcccauuucaccgaccccagcuccaucgccgccagaggguacauaagcacccgcguagguaugggagaggcagcggccauuuucaugacggcaacaccgcccggguccguggaggcguucccgcagagcaaugccgugauucaggaugaggagcgggauauacccgagcgcuccuggaauucuggauacgaauggaucaccgacuuccccggcaaaaccgucugguuuguacccucgaucaagagcgggaacgacauagcgaacugccugcggaagaacggaaagcgugugauccagcuguccagaaagacguuugauaccgaguaccagaaaaccaaaaauaaugacugggacuaugucgugacuacggacaucagcgagaugggcgccaacuuccgcgcagauagggugaucgauccgcgccggugccuaaaaccagucauacugaaagacggcccugaacguguaauccuggccgggccuaugccggucaccguggccuccgcagcccagaggaggggccggaucggaaggaaccacaauaaggaaggagaucaguacaucuacaugggccaacccuugaauaacgacgaggaccacgcgcacuggaccgaagcuaagaugcugcuggauaauaucaacacucccgaggggaucaucccagcauuauucgagccagagcgggagaagucagccgccauagacggagaauaucgguugcgcggggaggcgcggaagacguucguggagcugaugagacggggagaccucccggucugguuguccuacaagguggcuagugaaggcuuccaguacagcgaccgccgguggugcuucgacggagagcgcaacaaucaggugcuggaggagaacauggacguugagaucuggaccaaggagggggagcguaaaaaguuacgcccgcgguggcuggacgcccgcaccuacuccgacccccuggcccuccgggaguucaaagaguucgccgcggggcgacggagugugucaggcgaccugauccuggagaucggcaagcucccgcagcaccugacgcagcgcgcccagaaugccuuggacaaccucgucaugcugcacaauagcgagcagggcgggagagccuaccgccaugccauggaggagcuccccgacacgauugagaccuugaugcugcuggcucucaucgccguacucaccgggggggugacgcuguucuuucucuccgggcggggccugggcaaaaccagcauagggcuacucugcgugauggcauccagcguacuccuguggauggccuccguggagccccacuggaucgccgcaaguaucauccucgaguucuuccugaugguucugcucauccccgagccugaucgccaaaggacgccccaggacaaucaguuggccuacgugguuaucggacuucucuucaugauucucaccguagcggccaaugagauggggcugcuagagaccaccaagaaggaccuagggauagggcacgucgcugucgaaaaccaucaccacgcaacgaugcuggacguugaccuccaucccgccuccgccuggacccuguacgccguagcgaccacaaucaucacaccgaugaugcgccauaccauagaaaauacuacagccaacaucagccugacggcgaucgcuaaccaggccgcgauacuuaugggccuggauaagggauggccuaucuccaagauggacaucggugugccacuguuagccuuggguugcuacagccaggugaacccacuuacucuuacagcugccgucuugaugcuggucgcgcauuacgcuaucaucggcccgggccuccaagccaaagccaccagggaggcccagaagcguacugcagcagggaucaugaagaaucccaccguggacggcaucgucgccauagaucuggacccugugguguaugacgccaaguucgagaagcagcuggggcagauuaugcuccugauccugugcaccucccagauccuccugaugcgcaccacgugggcucugugcgagagcauuacccucgccaccggaccccugaccacucugugggagggaagcccggggaaauucuggaacacuaccaucgccguaaguauggcuaauaucuuccgcggguccuacuuggcuggcgccgggcuggcauucagcuugaugaaauccuugggggguggacgucgggggacaggagcccaaggcgagacgcugggggagaaguggaaacgccagcugaaccagcucuccaagagcgaguucaacauuuacaaacgcuccgggaucauggagguggaucgcagcgaggcuaaggaagggcugaagcgaggcgagaccacgcgccacgcugugucccggggaacagccaagcugcguugguuugucgagcggaaccuugucaagccugagggcaaggugaucgaccuaggcugcgggcgcggcggauggagcuacuacugcgcaggccucaagaagguaaccgaggugaagggguacacuaaaggaggcccagggcacgaggagccaauucccauggccaccuacggcuggaaucuggugaaacuccacuccgggaaggacguguuuuucacuccgcccgagaagugcgacacacugcuaugcgacaucggcgaaagcuccccaaacccgaccaucgaggaagggaggacguugcgcgugcugaaaauggucgagcccuggcuacgcggcaaccaguucugcaucaagauccucaaucccuacaugcccagcgugguggagacuuuagagcagaugcagcguaagcacgguggaaugcucguucggaacccgcucagucgcaacagcacccacgagauguauugggucuccuguggcacugggaacaucgugagcgcagugaacaugacgucucguauguuguuaaaccgcuucaccauggcacaucgcaaaccgaccuaugagcgggacgucgaccugggggcuggcacccgacacguggcaguggaaccggaggucgccaaucucgacaucaucggacaacggaucgagaacauuaagcacgaacacaagagcaccuggcacuacgacgaagacaaucccuauaagaccugggccuaccacggcucguacgaggugaaaccgucuggguccgcuagcagcauggucaacggcgugguaaagcugcucaccaagcccugggacgucauccccauggugacgcagaucgcgaugaccgacacgacccccuucgggcagcaacgcguauuuaaggagaaagucgacacgcggaccccgaaagccaaacgcggcacggcccagaucauggaagucaccgcgcggugguuauggggcuuccucucccgcaacaagaagcccagaaucuguacgcgcgaggaauuuacccgaaaggucaggagcaaugccgcgaucggggcugucuucguggacgagaaccaguggaauucggcgaaggaggccguggaagacgagcgguuuugggaccucguccagaaggagcgugagcugcacaagcagggcaagugcgcgaccugcguguacaacaugauggggaagagagagaaaaagcugggcgaauuugggaaagccaagggcagccgcgccaucugguacauguggcucggggcgcgguucuuagaauucgaagcgcucggguucaugaacgaggaccauugguucucccgcgagaauagccucagcggggucgagggggaaggcuugcauaaauugggguacauccuacgggacaucucgaaaauacccggcggcaacauguacgcggacgacacugcugggugggacacgcgaauaaccgaggacgaccugcagaaugaggcaaaaaucacagauauuauggagccggagcacgcacuucucgccacaucaaucuucaaguuaacauaccaaaacaaggucgugcgggugcagcgcccggcaaaaaacggcacagucauggacgugaucagccgcagagaccagcgcggcagcggccaggugggcaccuacgggcuaaacaccuuuacgaacauggaagcccagcucaucagacagauggagagugaggguauuuuccugcccagcgaguuggagacccccaaccucgccgagcgcguacuggacuggcuagagaaguaugggguagaacgguuaaagcgcauggccaucagcggggacgauugcguuguuaagccgauugacgaccgcuucgccaccgcgcuuaccgccuugaacgacauggggaaggugcgcaaggacaucccgcagugggaaccauccaagggcuggaaugacuggcagcaggugcccuucuguucccaccauuuccaccaauugaucaugaaggacggaagagagaucgucgugccgugcagaaaccaggaugagcuggucgggcgggcgcgcgucucccaaggagcaggguggucucuccgggagaccgcgugucucggcaaaagcuacgcccaaauguggcagcugauguacuuccaccgccgggaucugcgcuuagccgcaaacgccauaugcuccgcggugcccguggacuggguccccaccagccgcaccaccugguccauccaugcgcaucaccaauggaugacgaccgaggacaugcugagcguuuggaacagaguguggauugaagagaaccccuggauggaggacaagacccacgucuccagcuggggcgacgugccguaccuaggcaagcgggaggaccaaugguguggcucacuuaucgggcuaaccgcccgagccaccugggccuccaacauccagguggcgauuaaccagguccgccggcuaauaggcaaugagaacuaccucgauuacaugacauccaugaagcgcuucaaaaaugagggcgacccggagggugcacugugguga

SEQ ID NO: 24522 - RNA, 9879 nt, Artificial Sequence
  derived and/or modified CDS sequence (opt11) from DENV-1__EU482792__SS-prME
agcgugaccauguuacucaugcugaugcccacggcccuagccuuucaccucaccacccggggcggggagccccacaugaucgugaccaagcaggagcgggggaagucacuguuguucaagaccucagccggggugaacaugugcacacucaucgccauggaucugggcgagcugugcgaagacaccaugaccuacaagugcccucggaucacggagaccgagcccgacgacguggacugcugguguaacgccaccgacaccugggugaccuaugggacgugcucgcagaccggggaacaucggcgcgacaagcggagcguggcccucgcgccccacgucggccuggggcuugaaacccgcacggagacguggauguccagcgaaggcgccuggaagcagauccagagaguggaaaccugggcccuccgccacccaggguucaccguaaucgcccuuuuccuagcccacgcgaucgguaccucuaucacacagaaaggaaucaucuucauacuccugaugcugguuacccccagcauggccaugcggugcgucggcauaggcagccgcgauuucguagagggucucagcggagcaacuuggguggacguggugcuggagcacggguccugcgugaccacaauggccaaggauaagccuacucuggacaucgagcuccugaagaccgaggucacuaaucccgcuguccugcggaaguuaugcaucgaggcgaaaauaagcaacacgacgaccgacucucgcugcccuacccagggugaggcuacgcugauggaggagcaagacgccaauuucgugugccgaaggaccuuugucgaucggggcugggggaacgggugcggucuauucggcaaagggagccucauaacgugcgccaaguucaagugcgugacgaagcuggagggcaagaucgugcaguaugagaacuugaaguacucagucauugugacgguccacaccggcgaccagcaccaggucgguaacgaaagcaccgagcacggcaccaccgccacaaucacgccccaggcacccaccucggagauacagcucaccgacuacggagcacugacucucgacugcagcccacgcacaggacuggauuuuaacgagaugguguugcuaaccaugaaggagaaguccuggcucguccauaagcagugguuucuggaccuaccgcuccccuggaccucgggggccagcacgucccaagaaaccuggaaccgacaggaccugcuggugaccuucaagaccgcccaugccaaaaagcaggaagugguugugcugggaagccaagagggagcgaugcacacugcacugacgggggccaccgagauccagaccucggggacgaccaccaucuucgccggucaccugaagugcagacucaagauggacaagcugacccuuaagggcaugagcuacgugaugugcacgggguccuuuaagcuugagaaggaggucgcggagacccagcacgguaccguacuggugcaaaucaaguaugaaggcaccgacgcgccuugcaagauccccuucaguacgcaagacgagaagggggugacccaaaacggcaggcugaucaccgccaacccgaucgugaccgacaaggagaaacccgucaacaucgaggccgagccucccuucggugaguccuacaucgucauaggcgccggugagaaggcgcugaagcucagcugguucaagaaaggguccagcaucggcaagauguucgaggccacggcccgcggggcucgucgcauggccauccugggcgauaccgcgugggacuucggcaguaucggcgggguguucaccagcguggggaagcuaguccaccagaucuucggcaccgccuauggggucuuauucuccggggugucauggacaaugaagaucgggaucggcgugcugcuuaccugguuaggccugaacucccgcaguacgucccugucgaugaccuguauugccguagggcucguaacccuauaccugggcgucauggugcaggccgacuccgggugugugaucaacuggaaaggucgggagcuuaagugcggguccgggaucuucgucacuaacgaagugcauaccuggacugagcaauauaaguuccaagcugacagcccgaagcgacuguccgcggccauagggaaggccugggaagagggggucugcggcauccggagcgcaacacgucucgagaacaucauguggaagcagaucucaaaugaacucaaccacauccuccuggaaaacgauaugaaauucacgguugucgugggagacgucgugggcauauuagcccaggguaaaaagaugauccggccacagccaauggagcacaaguacucauggaaguccugggggaaggcgaagaucaucggagcugaugugcaaaacaccacuuucauuaucgaugggcccaauaccccggagugcccagacgaccagcgcgccuggaacaucugggaggucgaggacuauggcuucgggauauuuacgaccaacaucuggcugaaguuacgggacagcuacacccaggugugcgaccaccggcucauguccgccgcgaucaaggauagcaaggcggugcaugccgauaugggcuauuggauugaguccgagaagaacgagacguggaagcuggcccgagccaguuucaucgagguuaagacguguauauggccuaagucccacacccuuuggagcaacggcgugcucgaaucugagaugauaaucccgaagaucuaugggggcccgauuagccaacacaacuacagacccggcuacuuuacccagaccgcggggcccuggcaccucggaaaacuggagcucgacuuugacuugugcgaggggaccacuguggucguggacgagcacuguggcaaccgggggccgucccuacgcaccaccaccguuacgggcaagaucauccacgagugguguugccggagcugcacccugccgccccuccgcuucaagggcgaagacggguguugguacgguauggaaauccgucccgucaaggagaaggaggagaaccuggugaaguccauggugagcgcaggaucuggagagguagauaguuucagccucggucugcuuugcaucucaaucaugaucgaggaggugaugcgcagccgcuggucccgcaagaugcucaugacaggcacccuggccguauuccugcuacugaucauggggcagcugacuuggaacgaccugauccgauugugcaucaugguuggcgccaaugccagcgacaggauggggaugggcacaacuuaccuggcgcucauggccacguucaagaugcgcccgauguucgcaguaggccugcuguuucgucgauuaaccucaagagagguacugcugcucaccaucggucuuagccugguugccuccguggagcuaccaaauucgcuagaggagcugggcgauggccuagccaugggcaucaugauccugaagcugcucacggauuuccagucacaccagcugugggcgacgcugcucagccugaccuucauaaagacaacucugagcuugcacuaugcuuggaagacuauggccaugguucugucaaucgugucccuguuccccuugugucuauccacuaccucccagaagaccacguggcugcccgugcuccugggcagcuugggaugcaaaccccucaccauguuucugaucgcggagaauaagauuuggggccgcaaaucguggccccugaacgaggggauuauggcagucgggguaguguccauauuauugagcucccuacucaagaacgacgugccacuggccgggccccuaaucgcgggcggaaugcucauugcauguuacguaaucagcggguccagcgccgaucuaucacucgagaaggcggccgaggugagcugggaagaggaagccgagcacuccggcgccagccacaauauccucgucgaggugcaggacgacggcacuaugaaaauuaaggaugaggagcgggaugacacccugacuauccuguuaaaggcgacgcugcuggcgguguccggcgucuacccgcucagcauccccgccacccuuuucguaugguauuucuggcagaagaagaaacaacgguccggggugcugugggacacucccagcccccccgaggucgagcgggccgugcuggaugacggcauuuaccgcauuaugcagcgggguuuguuagggcgcucccaagugggcgucgguguguuccaagagaacguguuucacaccauguggcacgucaccaggggcgcggugcugauguaccaggggaagcgccucgaacccagcugggcuuccguuaaaaaggaccugaucagcuacggaggcggguggcgguugcagggcuccuggaacacaggugaagaaguccaggugaucgcgguggagccaggaaagaaccccaagaacguacaaaccgcucccgggaccuucaagacacccgagggcgaagugggagcuaucgcccucgacuucaagcccgggaccagcgggucccccaucgucaaucgcgaggggaagaucguaggccuguacgggaacgggguggugacuacgagcggcacuuacgucagcgccauagcccaggccaaggcaucucaggaggggccgcuacccgaaauagaggacgagguguuccggaaaagaaauuugaccauaauggaccugcaucccggcagcgggaagacccgacgcuaccugccggccaucgugcgugaggcgauuaagcgcaagcucaggacauuaauacuggccccgacgcgcgucguggccuccgagauggccgaggcucuaaagggaaugcccauccgcuaccagacgacggcagucaagagcgagcacacugguaaggagaucgucgacuuaaugugucaugccacguucaccaugcgguugcucucgcccguacgcgugccgaacuauaacaugauaauaauggacgaggcccacuucacagaucccucgucgauagccgcccggggguacaucagcacucgaguggguaugggggaagcggccgcuaucuucaugacggccacgccgcccggcuccguggaggcuuucccgcagagcaacgcugugauccaggacgaggagcgggacauccccgagaggucauggaacagcggguaugaguggaucaccgacuuucccgggaagacggucugguucgugcccuccaucaagagugggaaugacauagccaacugccugcgcaagaacgggaagcgcgugauccagcugucccggaagacguucgacacugaguaccagaagaccaagaacaacgacugggacuacgucgugaccacggacauaagcgagaugggcgccaacuuccgcgccgaccggguaaucgacccgcgcagaugccuuaagcccgugauccuaaaggaugggcccgaacgcgugauccuugcggggccuaugccggugaccguggcuagugccgcacagcggcgcggaagaaucggucgcaaccacaacaaggagggcgaucaguacauauauaugggacaaccucucaacaacgacgaggaucacgcccacuggaccgaggcgaagaugcugcuggauaauaucaacacaccagagggcaucauucccgcgcucuucgagccggagcgggagaaauccgccgccaucgacggggaguaucgcuuacgaggagaggcccguaagacguucguggagcuaaugcgccggggagaccuccccguguggcuguccuacaagguugcaagcgagggauuccaguacagcgaccgccguuggugcuucgacggugagcgcaacaaucaagugcuugaggagaacauggacgucgagaucuggaccaaggagggggagcggaaaaagcuccggcccagauggcuggacgcccgcacuuacuccgacccccuugcccugcgggaguucaaggaguucgcugccggccgccgguccgucagcggggacuugauucuagagaucggcaaguugccacagcaucuuacacagcgugcgcaaaacgcgcuugacaaucucgugaugcugcacaacagcgagcagggcgggcgggccuaccgccacgccauggaagagcugccggauacgaucgaaacguugaugcugcuagcccuaaucgccguccugaccggcggugugacccuguuuuuccuuuccggcagaggguugggaaagacuagcauuggccuucucugugucauggcuucgagcguccugcuguggauggcguccguggaaccccacuggaucgcggcgagcaucauccucgaguucuuccuaauggugcuccucauccccgagccggaccgccagcggacuccccaggacaaucagcuagccuacgucgugaucgggcuccuuuucaugauccugacgguggcagcgaacgagaugggcuugcucgagaccacaaagaaggaccuggggauaggccacguugccguggaaaaucaccaucacgcaacgaugcuggacguugaccuccaccccgccuccgccuggacauuguacgccguagccaccaccaucaucacgccgaugaugcgccauaccaucgaaaauaccaccgcgaacaucagccucaccgccaucgcgaaccaagccgccauccucaugggguuagacaaaggguggccgaucucuaagauggacaucggcgugccccugcucgcgcugggauguuacucucaagugaaccccuuaacccucaccgccgccguccuaaugcugguggcccacuaugcuaucauaggcccuggccuccaggcgaaggccacucgggaggcccaaaagcgcacggcggcggggaucaugaagaaccccacgguggacgggaucgucgccauagaucuggacccagugguguacgaugccaaauucgagaagcagcugggccagaucaugcuccugauccuauguacaucacagauacuccugaugcgcaccacgugggcucugugcgaguccaucaccuuggccacgggcccccugaccacgcugugggaggggagcccgggcaaguucuggaacaccaccaucgccgugucuauggccaacaucuuccgggggaguuaucucgccggcgcuggccuugcguucagccugaugaaaucgcuugggggcgggcgccgcggcacaggggcgcagggcgaaacacugggggagaaguggaagcgccaguugaaccaacucuccaagagcgaguucaacaucuauaagcggucggggaucauggagguggaucguucugaggccaaggagggccugaaaaggggugagaccacccgccacgccgugucgcgaggcaccgccaaacuacgaugguucguugagcgcaauuuagugaagccggaaggcaaggugaucgaucucggauguggccgcgggggcuggagcuacuauugcgcggggcugaagaaagucacggaggucaagggcuacaccaaaggcgggcccggccacgaggagcccaucccgauggccaccuacggguggaaucuggugaaacuccacuccgggaaggacgucuucuuuacaccacccgagaagugcgacacccugcugugcgacaucggggaauccucucccaacccgacaaucgaagagggccgcacacugagagugcugaagaugguggagcccuggcugcggggaaaucaguuuuguauuaagauacucaaccccuacaugcccagugucguggagacucuugagcagaugcagcgcaaguacggcggcaugcuuguucggaacccccucucccgcaacucuacccacgagauguacugggucagcugcgggacgggaaauaucgugagcgccgugaacaugaccucccggaugcugcugaacagauucaccauggcccaccgcaagccgaccuacgaaagagauguugaccucggggccggcacgagacacguggccguggagccagaggucgccaaccuggacauuauuggucaacggaucgagaacaucaagcacgagcacaagucgacuuggcacuacgaugaagacaauccuuacaagaccugggccuaccacggauccuacgaagugaaaccuagcggcuccgccucgagcauggucaauggagucgugaagcugcucacuaaaccuugggacgucauucccaugguuacccagaucgcaaugaccgauacaacgcccuucgggcagcaacgcguuuuuaaggagaaagucgacacgcggacccccaaggcgaaacgugggaccgcacagaucauggaaguaaccgccagauggcuguggggauuucuguccagaaauaagaaaccgcggauaugcacgcgcgaggaguuuacccguaagguucgcagcaacgccgcaaucggcgcugucuucguggacgagaaccaguggaacuccgccaaggaagccguggaggacgaaagauucugggauuuaguccagaaggagcgcgagcugcacaagcagggaaagugcgccaccugcguguacaacaugauggguaagcgggagaagaaacucggggaauucggaaaggcaaaaggcagccgagccaucugguacauguggcucggagccagauuucuggaguucgaggcauugggcuucaugaacgaggaccauugguucuccagagaaaacagccucuccggaguugagggcgagggguugcacaagcugggcuacauacucagggacauauccaaaauccccggaggcaacauguaugccgacgacaccgcgggcugggacacccgcaucaccgaagaugaccugcagaacgaagccaagaucacagacauuauggagccggagcacgcccugcucgccaccucgaucuuuaagcucacguaccagaacaagguugugcgcguucagcgccccgccaagaacggaaccguaauggacgugaucucacgccgggaucagcgaggcuccggccaggugggcacauacggccugaauaccuucacgaauauggaggcgcaacucauccggcagauggagagugaggguauauuccuccccuccgagcuagagacccccaaccucgcugagcgaguccuggacuggcuggaaaaguauggcguggaacgacuuaagcgcauggccauaucuggggaugacuguguugucaagccgauagacgaucgguucgcuaccgcccugaccgcgcucaacgacauggguaaagugcgcaaggauaucccacagugggagccguccaagggguggaacgauuggcaacagguucccuucugcagccaccauuuucaccagcucaucaugaaggacggucgugaaaucguggugccgugccgcaaccaagacgaacuggugggccgagcacggguuucccagggggccggcuggucgcuacgggagacggccugccucggcaagaguuaugcccagauguggcagcugauguacuuccaucgcagggacuugcgccuggcggccaacgcaaucugcucugccgugcccguggacuggguccccaccagucgcaccaccugguccauccacgcgcaccaccaguggaugacgaccgaggauaugcugagcgucuggaaccgcguguggaucgaagaaaaccccuggauggaagacaagacccacgucuccagcuggggggacgugccuuaccuggggaagcgggaggaccaguggugcggcucgcugauuggccuaacagcccgcgcaacuugggccagcaacauccagguggcgaucaaccagguccgucgguugauugggaacgagaauuaccuagacuacaugacuuccaugaagagauucaagaacgagggcgacccagagggggcgcugugguga

SEQ ID NO: 24523 - RNA, 9879 nt, Artificial Sequence
  derived and/or modified CDS sequence (opt11) from DENV-1__EU482707__SS-prME
agcgugaccaugcugcugauguuaaugcccaccgcccuggcuuuccaucucaccacacgcggcggggagccccacaugaucguguccaaacaggagcgggggaagagccuucuguucaaaacgagcgcgggggugaacaugugcaccuugauugcaauggaccugggcgagcugugcgaggacacgaugaccuauaagugcccccggauuacagaggccgagcccgacgauguggacugcuggugcaacgcuaccgacaccuggguuacuuacgggaccugcagccagaccggcgagcaccggcgggacaagcgguccguggcccucgcgccccaugugggcuugggguuagagacgagaaccgagaccuggaugagcuccgagggcgccuggaaacagauucaacgagucgagaccugggcccugcgccacccaggguucacggugaucgccuuauuccuggcgcacgcuauuggcaccagcaucacccaaaagggcaucaucuucauccuucugaugcugguuaccccuuccauggccaugaggugcgucggcaucggcagccgcgauuucguggagggacuuuccggcgccacguggguggacgucguguuagagcacggcaguugcgugaccaccauggcuaaggacaagcccacccuggacaucgagcuacugaagaccgaagucaccaaccccgcagugcugcggaaacucugcaucgaggccaagaucucgaacacaacgacggacucccgcugcccgacccagggggaggccacauuggucgaggagcaggacgccaacuucgucugcaggcggaccuucguggaccggggcugggggaacgggugcgggcuguuuggcaaggguagcuugauuaccugcgccaaguucaagugcgugaccaagcuggagggcaagaucguacaguacgagaacuugaaguacagcgugaucgugaccguccauaccggggaccagcaucagguggggaacgagucuacggagcacgggacaaccgcgaccauaacgccccaggcacccacgacagagauccagcuuacagacuacggugcccugacacuggauugcagcccgcgcacgggcuuagacuucaacgagaugguccuuuuaaccaugaaagagaaguccuggcucgugcacaagcaaugguuccuggaccugccccuccccuggaccucuggugcauccaccucccaggagacguggaaccggcaggaccuccuggugaccuuuaagaccgcccacgcgaaaaagcaggagguggugguguuaggcagccaggagggugccaugcacaccgcccugacuggagccacagagauccagaccucgggaaccacgaccaucuucgccgggcacuugaaaugccgcuugaagauggacaagcugacccugaaggguaugagcuaugucauguguacugguuccuucaaacucgagaaggagguggcggagacucagcacggaacggugcugguccagaucaaauacgagggcaccgacgccccgugcaagaucccauucagcacccaggacgagaagggggugacgcagaacggccggcuaauaacagccaacccgaucgucaccgacaaggagaagcccgucaacaucgaggccgagccucccuucggggaguccuauauagugaucggcgcgggcgaaaaggcccugaagcucagcugguucaagaagggguccagcaucggcaagauguucgaggccacagcccgcggugcccggaggauggcgauccugggggauacggcgugggacuucggguccaucggcggcguguucaccagcguagggaagcugguucaucagaucuucggcacagccuacgggguccuauuuuccggggucucauggaccaugaagaucgguaucggcgugcugcugacuuggcucggccugaacucccgcucaacaucccuguccaugacaugcaucgcugucggacucgucacccuguaccugggcgugaugguccaggccgacuccgggugcgucaucaacuggaaggggagggagcucaagugcggaagcggcaucuucgugacgaacgaggugcacaccuggaccgagcaguacaaguuccaggcggacaguccuaagcgccuuuccgccgccaucgguaaggccugggaggagggggucuguggcauacggagcgcgacacgccuggagaacaucauguggaagcagaucucuaacgaacuaaaccauauccugcuggagaacgauaugaagcucaccgugguggucggggacguggcgggcauucuggggcagggcaagaagaugauccggccacagccuauggaguacaaguacuccuggaagagcuggggcaaggccaagaucaucggggccgacgcgcagaacacgaccuucaucaucgacggacccaacaccccggagugucccgaugaccagcgcgcguggaacaucugggaaguugaggauuacggguucggaaucuuuaccacaaauaucuggcugaagcuccgggacagcuacacacaggucugcgaccaccgcuugauguccgccgcuaucaaggauagcaaggccguacacgccgacaugggcuacuggaucgaaagugagaagaacgagaccuggaagcuggcgcgggccagcuucauagaggugaaaaccuguaucuggcccaaaagucacacacuauggagcaacgggguccuggagucagagaugaucauccccaaaaucuacggugggccgauuucucagcacaacuaccgcccagguuauuucacacagaccgcaggccccuggcacuuggggaagcucgagcuggacuucgaccugugcgaggguaccacggugguggucgaugagcacugcgguaaccgaggcccaucccuccgaaccaccaccgugacagggaagauaauccacgaguggugcugccggagcugcacccugccgccccugcgcuuccggggcgaagacgggugcugguacggcauggagauaaggcccgugaaagaaaaggaggaaaaccucguuaaguccauggugagcgccgggagcggggagguagacuccuucucgcugggccugcugugcauauccauuaugaucgaggaggucaugcggagccgcuggucccggaagaugcugaugaccgggacucuggccguguucuuccuccugaucaugggccagcugacguggaaugaccuaauccgacugugcaucauggugggggcgaacgccagcgaccgcaugggcaugggaaccaccuaucuggcccucauggccaccuucaagaugcggccgauguucgcgguggggcugcucuuccgccggcucacgucccgagaggugcugcugcucacgauaggucugucauugguggcuucggucgagcuccccaacagccuggaagagcugggggacggccucgccaugggcauaaugauacuaaagcugcugacugacuuccagucacaccagcugugggcgacccugcucagccugacauucaucaagaccaccuuuagucugcacuacgcguggaagaccauggcgaugguuuugagcaucgucucccuguucccccugugccuaagcacgacgagucagaagaccacguggcugcccgugcugcucgggagccugggcugcaagccgcugacuauguuccucaucgccgagaacaaaauaugggggcggaaguccuggccccucaacgagggcaucauggccguggggaucgucagcaucuuacucaguucccugcucaaaaacgacgugccccucgcggguccccugaucgccggugggauguuaaucgcgugcuacgugauuagcggaucuagcgcugaucucucuuuggaaaaggccgccgaggucagcugggaggaggaggcugagcacuccggggcgucucacaacauccuggucgaggugcaggacgacggcaccaugaagaucaaggacgaagagcgcgaugacacccucaccauccugcugaaggcuacacucuuagccgucuccgggguguacccacugagcauacccgccacccucuucguuugguacuucuggcagaagaagaaacagcgguccggcguccugugggacacccccagcccgccugagguggagcgagccgugcuggacgacggaaucuauaggauaaugcaacggggguugcucggucggucccaggucgggguggggguguuccaggagaacgucuuccauaccauguggcacguuacccgcggggcagugcugauguaccagggcaagcggcuggagccuagcugggccucagucaagaaggaccucauaagcuacggcggggguuggcgccugcgcgggucguggaacacgggcgaggagguccagguaaucgccgucgagcccgggaagaauccgaagaacgugcaaaccgcccccggcaccuuuaaaacccccgagggcgaggugggggccaucgcgcuggacuucaagcccggcacaagcgggucacccaucgucaacagagagggcaagauagugggccucuacgguaacggagugguaaccaccagcggcaccuacgucagcgccaucgcucaggccaaggcgucccaggaagggccgcugcccgagaucgaggacgaggucuuucgaaagcgaaaccugacgauuauggaccugcaccccggguccggcaagacccgacgcuaccuaccugcaaucguccgggaggccaucaagcgcaagcugcgcacucucauccuggccccgaccagggugguggccuccgagauggccgaagcccugaaagggaugcccauccgcuaccagacgaccgccgucaagagugagcacaccgggaaggagaucguggaccucaugugccacgcaaccuucacgaugcggcugcugucccccgugcgcgucccgaacuacaauaugaucaucauggaugaagcgcacuucaccgaucccucuucgauagcggcccggggauacaucagcacccgcguggggaugggcgaggccgcggccaucuucaugaccgcgacgccgcccgguuccguggaggcuuuuccucagagcaacgccguuauccaggacgaggagcgggacauccccgagagaucuuggaacagcggcuacgaguggauuaccgacuuucccggcaaaaccgugugguucgugcccagcauuaagagcgggaacgacaucgccaacugucuccggaagaacgggaagcgcgucauccagcugucccggaagaccuucgacacggaguaucagaagaccaagaacaacgacugggacuacguggugaccaccgacaucagcgagaugggggccaacuuccgcgccgaccgggucaucgacccgcggcggugucugaagcccgucauccucaaggacggccccgagcgcgugauuuuggcugggcccaugccggugacgguugccuccgccgcgcagcggcguggccggaucgggcgaaaccacaacaaggagggggaccaguacauuuauaugggccagccccugaacaacgacgaagaucacgcccacuggacagaggccaagaugcuccuggacaacaucaacacccccgaggggaucauccccgcccuguucgagcccgagcgcgagaaguccgcggcgguagacggcgaguaccggcuccgcggagaggcccggaagaccuucguggaacugaugagacggggcgaccugcccguguggcucuccuacaaaguagccagcgaggguuuucaguacagugaucgucgguggugcuucgacggggagcgcaacaaccaggugcuugaggagaauauggacguggagaucuggacgaaagagggcgagcggaagaagcugagaccccggugguuagacgcacgcacuuacuccgacccccuggcccuccgggaguucaaagaguucgcugccgggcgcagaucagucuccggcgacuuaauccuggagaucggcaagcugccgcagcaccucacgcagagggcucagaacgcccuggacaaccugguaaugcuccacaauucugaacagggcgggcgggcguaccgccacgccauggaggagcugcccgacaccauagagacgcugaugcuccuggcccugaucgccgugcuuacggggggcgucaccuuauucuuccuguccgggcggggcuugggaaagacuagcaucgggcugcugugcgugauggccuccagcguguuacuguggauggcguccgucgagccccauuggaucgccgccagcaucauccuggaguucuuccucaugguucugcugauccccgagccggaccgccagcggacgccccaggacaaccagcucgcuuacguggugauaggccuacuguuuaugauucucacgguggccgcgaacgaaaugggucuacuggaaacuaccaagaaggaccuaggcaucgggcacguggccguggagaaccaccaccacgcagcgaugcuggacguggaccugcaucccgccagcgcguggacccuuuacgcuguggcaacgaccaucaucaccccgaugaugcgccacaccauugagaacacaaccgcuaacaucucguugaccgccauugcaaaucaagcagccauccugauggggcucgacaaaggguggcccaucuccaagauggacaucggggucccacuacuggcucugggcugcuacagccaggugaacccccugacucugaccgcggccgugcucaugcuggucgcccauuaugccaucaucgggccgggccugcaggccaaggcgacccgcgaggcccagaagcggaccgccgccgggauaaugaagaaucccaccguggacggcaucguggccauagaccucgaccccguagucuacgaugcgaaguucgagaagcaacugggacaaaucaugcugcucauccuuugcacgucccagauccuucugaugagaaccaccugggcccugugcgaaagcaucacccuggccacggggccuuugaccacgcugugggagggcaguccggggaaguucuggaacaccacaaucgccgugagcauggccaauaucuucagaggcuccuaccuggcgggcgccgggcucgcauucagcuuaaugaagucucugggugggggucgccgggguaccggcgcccagggcgaaacacucggggagaaguggaaacgccagcugaaccagcuguccaaaucggaguucaacacguacaaacggucuggcauuauggaggucgaccgcagcgaggcgaaggaagggcucaagcggggcgagacgaccaagcaugccgugucccgcgguaccgccaagcucaggugguuuguagaacgcaaucuggucaagcccgaagggaaggugaucgaccuggguuguggucggggagguuggucguacuauugugccgggcucaaaaaggugaccgaagucaagggguacacgaagggcggccccggucacgaggagccaauccccauggccaccuacggcuggaacuuagugaagcugcacuccgggaaggacguguucuucaucccgcccgagaagugugacacacuccugugcgacaucggcgaaagcagucccaauccaaccaucgaggaagggcgaacgcuccggguucucaagaugguggagcccuggcugcgcggcaaccaguucugcauuaagauucugaaccccuauaugcccagcguggucgaagcgcucgagcagaugcagcggaagcacggcggcaugcugguucgcaacccgcuguccaggaacagcacccacgagauguacuggguguccugcgguaccgggaacauugucagcgcuguaaacaugaccagccgcaugcucuuaaaccgcuucaccauggcccaccggaagcccaccuacgagcgcgacguggaccugggcaccggcacacgacacgucgccguggaacccgagguggcaaaccucgacaucaucggccagcgaaucgaaaacaucaaacacgagcacaaaagcaccuggcacuaugacgaggacaaccccuacaaaacgugggcguaccacggcuccuaugagguaaagccgagcgguuccgccagcaguauggucaauggcguggugaagcugcucacgaagccgugggacgugauccccauggucacccagaucgccaugaccgacacgacccccuucgggcagcagagaguguuuaaggagaaaguggacacccgcaccccgaaggccaagcgggguacggcccaaaucauggaggucaccgcucgcugguuguggggcuuucugucgcggaacaagaagccccgcaucugcacccgggaggaauucacccgcaaaguccguagcaacgccgccaucggggcaguguucgucgacgagaaccaguggaacucugcgaaagaggccguggaggacgagcgcuucugggaccugguccaccgggagcgcgaguugcacaagcagggcaagugcgccacgugcgucuauaauaugauggggaagagggagaagaaguuaggggaguucgggaaagccaagggcagcagagccaucugguacauguggcugggcgcgcgguuccucgaguucgaggcccugggauuuaugaacgaagaccauugguucucaagagaaaacagucuguccggcguggagggggaaggucuccacaaacugggguacauccugcgggauaucucuaagauucccggcggcaacauguacgccgacgacaccgccgggugggacacccgcaucaccgaggacgaccuccaaaaugaggcgaagaucacagacaucauggagccggagcacgcgcugcuggccaaagccaucuucaagcucaccuaucagaacaaggugguccgcgugcagcggcccgccaagaacggcaccgugauggacgucaucagccgccgggaccaacgcgggagcggccaggugggcaccuacgggcugaacacguucaccaacauggaggcacaguuaauccgucagauggaguccgagggcaucuuuagccccuccgagcucgagacccccaaccuggcggagcgugcccuggacuggcucgagaaguacgggguggagcggcugaagcgcauggcaaucucgggcgacgacugcgucgugaaaccgaucgacgaccgguucgcgaccgcccuuacggcacucaacgacauggggaaaguccgcaaggacaucccucagugggagcccuccaagggauggaaugauuggcagcagguccccuucugcagccaccacuuccaccagcugaucaugaaggacggccgggagaucguggugccgugccgcaaccaggacgagcugguuggacgggcccgcgugucccagggagccggguggagccucagggagaccgcaugccugggcaagagcuacgcgcagauguggcagcugauguacuuccaccgccgggaccuccggcuggccgccaacgccaucugcuccgccguccccguagacugggugcccacgucacggacuacaugguccauccacgcgcaccaccaguggaugaccaccgaagacaugcuuagcguguggaaccgcgucuggaucgaggagaaccccuggauggaggacaagacccacaucuccagcugggaggacgugccguaccuggggaagcgcgaggaccagugguguggcucccugaucggccugacggcccgggccaccugggccaccaauauccagguggcuaucaaccagguccgccggcucauugggaacgagaacuaccuggauuauaugaccagcaugaagcgcuucaagaacgaguccgaccccgagggagcauugugguga

SEQ ID NO: 24524 - RNA, 9879 nt, Artificial Sequence
  derived and/or modified CDS sequence (opt11) from DENV-1__EU482708__SS-prME
agcgugacuaugcugcucauguuaaugcccacugcccuggcguuccacuuaaccaccagagguggggagccacacaugaucgugaguaagcaagagcggggcaagagccuccuguucaagaccuccgcuggggugaacaugugcacucucauagccauggaccugggcgaguugugcgaagauacuaugacuuacaagugcccgcggaucaccgagaccgagcccgacgacgucgacuguuggugcaacgccacggacaccugggugaccuacgggaccugcagccagacgggagagcaccggcgugacaaacgguccgucgcccucgcgccccacgugggccugggacucgagacccgcaccgagaccuggaugagcuccgagggggccuggaaacagauccaacggguggagacgugggcccuccggcaccccggguucacagugaucgcccuguucuuggcccacgcgaucggcaccucuauaacucagaaggggaucaucuuuauccucuuaaugcuggucacacccuccauggccaugcggugcgucggcaucgguagccgcgacuuuguggaggggcucuccggcgccaccuggguggacgucgugcuggagcacgggagcugcgugaccaccauggccaaggacaagcccacgcuggauaucgagcugcugaagacugaggucaccaauccggccguucugcggaagcucugcauugaagcgaagaucuccaacacaacgaccgacagccgcuguccgacccaaggugaggccacccugguggaggagcaagacgccaacuucgucugcaggagaacguucguugaccggggcugggggaauggcugugggcuguucggcaagggaucucucaucacuugcgcgaaguucaagugcgucaccaaacuggagggcaagaucguccaauacgagaaucugaaauacagcgugaucguaaccguccacacuggcgaucagcaccagguggggaacgaguccaccgaacauggcacgacugccacgaucacgccccaggcgcccaccacagagauacagcucacagacuacggggcccuaacucuggacugcagcccccgcaccggacucgacuucaacgagaugguucugcugaccaugaaggagaaauccuggcuggugcauaagcagugguuucuggaccugccacuccccuggaccuccggggccagcacgucccaggagaccuggaacagacaggacuuacuggugaccuucaagaccgcccacgcaaagaagcaggagguggucguucucggcagccaggaaggcgcgaugcacacggcccucaccggggccaccgagauccagacauccgguacaaccaccauauucgcugggcaccugaagugccgccucaagauggacaagcucacccugaagggcaugucguacgucaugugcacggggaguuucaagcuggagaaagagguggccgaaacccagcacggcaccgugcugguccaaaucaaguacgaaggcacugacgcgcccugcaaaaucccguucagcacgcaggaugagaagggggugacccagaacggccggcugaucacggcaaauccaaucgugacggacaaggaaaagcccgucaacaucgaagccgagccgcccuucggggaguccuacauugugauaggggccggcgagaaagcgcugaagcuaagcugguuuaagaagggguccucgaucggcaagauguucgaggccacugcucgcggagcccggcgcauggccauccuaggcgacacagcgugggacuucgggucaauaggcgggguguucaccagcguagggaagcuggugcaccagaucuucggcacagccuaugggguccuguucuccggcguaagcuggacgaugaagaucggcaucggugugcugcugaccugguuaggccugaacucccgcagcaccuccuugagcaugaccugcaucgccgugggccuugucacccuguaccugggcgugauggugcaggccgacucugggugugucaucaacuggaagggccgggagcucaagugcgggucuggcaucuucgugacgaaugaggugcacaccuggacagagcaguacaaauuccaggccgacagcccgaagcgccuuuccgcggcgauagguaaggccugggaggagggggucuguggaauccggagcgccaccaggcuggagaacaucauguggaagcagauauccaacgaauuaaaccacauacuccuggagaaugacaugaaguuuacgguaguugucggggaugucgccggcauccucgcccaggggaagaagaugauucggccccagccaauggaguacaaguauaguuggaagagcuggggcaaggccaagauuaucggcgccgaugugcagaauaccaccuuuaucaucgacggccccaacaccccggagugccccgacgaccagcgcgcuuggaauaucugggaggucgaggacuacggcuucgggaucuucacgaccaacauuuggcugaagcugcgcgacucauacacacagguuugcgaucaccgccucauguccgcggcaaucaaggacuccaaggccgugcacgccgacaugggcuacuggaucgaguccgagaaaaaugagacauggaaguuagcgcgggcuagcuucauugaggucaagacguguaucuggcccaaaucccacacccugugguccaacggcgugcucgaguccgagaugaucauccccaagaucuacggaggaccgaucagccagcacaacuaccgccccggauacuuuacgcaaaccgcuggccccuggcaccuggggaagcuggagcuugacuucgacuugugugagggcacgaccguggucguggacgagcacugcggcaaccguggucccucccugagaaccaccacggugaccggcaagauuauccacgaauggugcugccggaguuguacucugccgccccuccgcuuccgaggggaagacggcuguugguacgggauggagauccgccccgucaaggagaaagaggagaaucuggugaaguccauggugucugccggcucgggcgaggucgauucauucucacucgggcugcugugcaucuccauaaugauugaggaagucaugcggagccgcuggucccggaagaugcucaugacgggaacucuugcgguguucuuccuguugaucauggggcagcugaccuggaacgaccugauccggcucugcaucauggucggcgccaacgccagcgacagaauggggaugggaaccaccuaccuggcccugauggccacguucaagaugaggccgauguuugccgucggcuuacuguuccgccggcugaccuccagggagguacuccugcugaccaucgggcucagcuugguggccuccgucgaacuacccaacagccucgaggagcugggggacgggcuggcgaugggcauaaugauccucaaacuguuaaccgacuuccaaucccaucagcuuugggcgacgcucuugagccucaccuucaucaagaccacuuucagccugcacuacgccuggaaaacgauggccaugguccugagcaucguaucacucuucccccugugucugagcacgaccucccaaaagaccacguggcuccccgugcugcuggguucacucggaugcaagccgcugaccauguuccugaucgcggagaacaagauauggggccggcgcaguuggccccugaacgaggggaucauggccgucggcaucgucagcauacugcuuagcucccuccugaaaaacgacgugccgcuggccgggccgcucaucgccggcggcauguuaaucgccugcuacgucaucagcgggagcuccgcagaccugucguuagagaaggccgccgaggugagcugggaggaggaagccgagcacuccggcgccagccauaacauccugguggagguccaggacgaugggaccaugaagaucaaggacgaggagcgggacgacacccugaccauauugcuaaaagcaacgcugcucgcggucucuggcguguacccucuuagcauccccgccacccuguucgucugguacuucuggcagaaaaagaagcaacgcuccggggugcucugggauacccccagcccgccggagguggagcgugcuguacuggacgacggcaucuaccguaucaugcagcggggccucuuggggcgcucccagguuggcgugggggucuuccaggagaacguuuuucacacgauguggcacgugacaaggggggccguucucauguaccaagggaaacgccuggagcccucgugggcguccgugaagaaggaccugaucucguacggcggcggcuggcggcuccaggguuccuggaacaccggggaggaagugcaggucaucgcgguggagcccggaaagaaccccaagaacguccagaccgcccccgggacauucaagacgcccgagggggaggucggcgccauagcccuggacuucaaaccagguaccagcgggucccccauuguaaaccgagaggggaaaaucgugggccucuacggcaauggggucgugaccacaagcggcacguacguguccgcgauugcccaggccaaagcaucccaggaagggccgcucccagaaauagaggacgaggucuuccggaagcgcaaucugaccauaauggaccugcaccccgggagcggaaagaccagacgcuaccucccugcgaucgugcgggaggcaaucaagcggaagcugcgcacccugauccucgcucccacgcggguggucgccuccgagauggccgaagcgcugaagggcaugcccauccgcuaccagaccaccgcugucaagagcgagcacaccggaaaggagaucguggaccugaugugucacgccacguucaccaugcggcuccuguccccaguacgcgugccaaacuacaacaugaucaucauggacgaggcgcacuucaccgacccgagcuccaucgccgcgcgaggguacaucagcacgcgcgucggcaugggggaggccgccgcuauuuucaugacggccacgccgccuggcuccgucgaggccuucccgcaaagcaaugccgugauccaggacgaggagcgggacauccccgagcgguccuggaacagcggguacgaguggaucacagacuuccccggcaagaccgugugguucguacccaguauaaagagcggcaacgacaucgccaacugucugcggaagaacgggaagagggugauccagcucucccgcaagacguucgacaccgaguaccagaagaccaaaaacaaugacugggacuacguggucacgacggacaucagcgagaugggcgcgaacuuccgcgccgaccgagugaucgacccccgccggugccugaagcccgugauccuuaaggacgggcccgagcgcguuauccucgccggccccaugcccgugacgguagccuccgccgcccagcggcgugggcggaucggccgcaaccacaacaaggaaggugaccaguauaucuacauggggcagccgcugaacaaugaugaggaccacgcgcacuggaccgaggccaagaugcugcucgacaacaucaauacacccgaggguaucauccccgcucuguucgagccggagcgagagaaguccgccgccaucgacggggaguaccggcugcgcggggaggcucguaagacguucguugagcucaugcgccgcggggaccugcccguuugguuauccuacaaggucgcuagcgaaggcuuccaguauagcgaccgccgguggugcuucgacggcgagcgcaacaaccagguucucgaggagaacauggauguugagaucuggaccaaggaaggcgagcgaaaaaaacugagaccccgguggcuggacgcccgcaccuacagcgacccucuggcccugcgggaguucaaggaauucgcggcgggcaggcggagcguuuccggggaccugaucagcgagauaggcaagcucccacagcaccucacucagcgcgcccagaacgcccuggacaaccucgugaugcugcacaacuccgagcagggcgggcgggccuaccgacaugcgauggaggagcuaccugacacgauugaaacccucaugcugcucgcccucaucgccgugcugacgggcggggucacccuguucuuccucagcggccgggggcugggcaaaaccuccaucggccugcucugcgugauggccagcuccgugcuccuauggauggccagcgucgagccacacuggaucgcggcaucuaucaucuuggaauucuuccugauggugcugcucauccccgagccggaccgccagcggacgccccaggacaaccagcuggccuacgugguaaucggacuccucuucaugauccucacgguggccgccaacgaaauggggcugcucgagacuacuaaaaaggaccuggggaucggccauguggcggucgagaaccaccaccacgccgccaugcucgacguugaccuccaccccgccagcgcuuggacgcuguacgcgguggccaccacaaucaucaccccgaugaugcgccacacaaucgagaauaccacagcgaauauuucccugaccgccaucgccaaccaagcggccauccucauggggcuggacaagggcuggcccaucagcaagauggacaucggcguuccccugcuugcgcuggggugcuauucccaggugaauccgcucacguuaaccgccgcgguguugaugcuggucgcacacuaugccaucaucggcccggggcuccaggccaaggccacccgcgaggcgcagaagcggacggccgcgggcauaaugaagaaccccacgguggauggcaucguggccauagauuuagacccaguagucuacgaugccaaguucgagaagcagcugggccaaaucaugcuauuaauccugugcaccagccagauccuccugaugcgcaccaccugggcgcugugcgaguccaucacgcucgccacaggcccccugaccacccuaugggaggggagcccuggaaaguucuggaacaccaccaucgccguguccauggcgaacauuuuucgggggagcuaccucgccggggccggccuggcauucagccugaugaagucccucgggggcgggagacggggcacaggggcccagggcgagacucugggcgagaaguggaagcgccagcugaaccagcucucuaaguccgaauucaacacguacaagagaagcgggauaauggaggucgaccgcucggaggccaaggagggcuugaagcgcggggagacuaccaagcacgcggugagccguggcaccgccaaguuacggugguucgucgagcgcaaccucgucaagcccgagggcaaggugauugaccuggggugcggccguggcgggugguccuacuacugugccgggcugaagaaggugacagaggucaagggguacacgaagggcgggcccggccacgaagagcccaucccgauggcaaccuacgguuggaaccuggugaagcuacacagcggcaaggacguguucuucaucccgccggagaagugcgacacucuacugugcgacaucggggaauccagccccaacccgacgaucgaggagggccggacccuccgaguacugaagaugguggaaccuuggcugcgggggaaccaguucugcauuaaaauccucaaccccuacaugcccuccguggucgaaacccuggagcagaugcagaggaagcacggcggcaugcuggugcgcaacccucucagccggaacuccacccacgagauguacugggugucuugcgggacuggaaacaucgucagcgcagugaacaugacaagccgcaugcuacucaaccgcuucacuauggcgcaccggaagcccaccuaugagcgcgacguggaccucggggcggguacccggcacguugccguggagcccgagguggccaacuuagacaucaucggccagaggaucgagaauaucaagcacgagcacaaguccacuuggcauuaugacgaggauaauccuuacaagacuugggccuaucaugggagcuacgaggucaagccguccggcagcgcgagcuccauggugaacgggguuguuaagcugcucacuaagcccugggacguaauccccauggucacccagauugccaugacugacaccacccccuucggccagcaacggguguucaaggagaaaguggacacccgcaccccuaaggccaagcgugggaccgcccagaucauggagguaaccgccaaguggcuguggggcuuccugagccggaacaagaagccccggauuugcacucgggaggaauucacacggaaggugcgcuccaacgcggccaucggcgccguguucgucgacgagaaccaguggaacagugccaaagaggcggucgaagaugagcgguucugggaccucgugcaccgggaacgggaacuccacaagcaggggaaaugcgcgacgugcguauacaauaugaugggcaagagagagaagaagcugggggaguucggcaaggccaagggcuccagggccaucugguacaugugguuaggcgcccgcuuccuggaguucgaggcgcugggcuucaugaacgaggaccauugguucagccgggaaaacucccucagcgggguggagggggaagggcugcacaagcugggcuacauccuccgcgacaucuccaagauaccugggggcaacauguacgccgaugacaccgcaggcugggacacccggaucacggaggacgaccugcagaacgaggcacgcaucaccgacaucauggagccggagcacgcucugcuggcccguagcaucuucaagcuuaccuaccagaacaaggugguccgggugcagagacccgccaagaacgggaccgucauggacgucaucucccggcgcgaccagcggggcuccgggcaggugggcacguacggccugaacaccuuuacaaacauggaggcgcagcucauccgccagauggaguccgaagggaucuucagccccuccgaacuggagacccccaaucuggccgaacgggugcuugacugguuagagaaguacggugucgagcgccugaagcggauggcaaucagcggggaugacugcguggucaagccgaucgacgaucgcuuugcgacggcccucaccgccuuaaaugacaugggcaaggugcggaaggacauaccccaaugggagcccuccaagggguggaaugacuggcaacaggugcccuucugcagccaccauuuccaccagcuaaucaugaaggaugggcgcgagaucgucguaccaugucggaaccaggacgagcucgugggccgcgcucgggugagccagggggccggcugguccuuaagggagaccgcgugccugggcaagagcuacgcucagauguggcagcucauguacuuccaccggagagaccugaggcuggccgccaaugcgaucuguuccgccguccccguggacuggauacccacaagccgcacaaccuggucaauccacgcucaccaucaguggaugacgaccgaggacaugcucagcguguggaaccgcgucuggaucgaggagaaucccuggauggaggacaaaacgcacauauccucguggggcgacgugccuuaccuggggaagagagaggaccaguggugcggcuccuugaucggccucaccgcccgcgccacuugggcgacuaacauccagguggccaucaaccaaguacggcgccugaucgggaacgaaaacuaccuggacuacaugaccagcaugaaacgguuuaagaacgaguccgaccccgaaggcgcccucugguga

SEQ ID NO: 24525 - RNA, 9879 nt, Artificial Sequence
  derived and/or modified CDS sequence (opt11) from DENV-1__EU482709__SS-prME
agcgugaccaugcugcugaugcucguccccaccgcauuggcuuuccaccucaccacccgagguggggagccccacaugaucgugaguaagcaagagcggggcaagagccugcuguucaagacgagugccggggugaauaugugcacccugaucgccauggacuuaggcgagcucugcgaggacacuaugaccuacaagugcccccggauuaccgagaccgagcccgaugacguggacugcuggugcaacgccacggacaccugggugacuuaugggaccugcagccaaaccggcgagcaccggcgggacaagcgguccguggcccucgcgccccacgucggucuggggcuggagacccgcaccgagacuuggaugagcuccgaaggagccuggaagcagauccaacgggucgagacgugggcccuccggcaccccggguuuaccgugaucgcccuguuccuggcccacgcgaucggcacaagcauuacgcagaaggguaucauuuucaucuuacugaugcuggucacgcccuccauggccaugcggugugugggcaucggaagccgagacuucguggaggggcucuccggagccaccuggguggacguagugcuggaacacgguucaugcguaaccacaauggccaaggauaagcccacgcuggacauugagcuacugaagacggaggugacuaaccccgccgugcugcgcaaacucugcaucgaggcgaaaaucuccaacacaacgaccgacagccgcugucccacccagggggaagccaccuuagucgaggagcaagacgccaacuucgugugccggcgcacguucguggaccggggcuggggcaacggcugcggacuguucggcaaggggagucuaaucacgugcgcgaaguucaaaugcgugacgaaacuugagggcaagauuguccaguacgagaaccugaaguacucugugaucgucaccgugcacacgggggaccagcaccaggucgggaacgaguccacagagcacgggaccaccgcuaccauaacgccccaggcccccaccaccgagauccaacucaccgacuacggggcacugacccuggacugcagcccccgcaccggccucgacuuuaacgagauggugcugcugaccaugaaggaaaaguccuggcucgugcacaagcagugguuucuggaucugccccuccccuggaccagcggggcgucaacaagucaggagaccuggaaccggcaagaccuauuagugacguucaagaccgcccaugccaaaaagcaagaagugguugucuugggaucucaggaaggcgcgaugcacacggcucugaccggggcaaccgagauccagaccuccgguacaaccacaaucuucgccgggcaccugaagugccgccucaaaauggauaaguuaacucugaaaggcaugagcuacguaaugugcacuggguccuucaaacucgagaaggagguggcagagacccagcacggcacuguucuggugcagauaaaguacgagggcaccgacgcgcccugcaagauacccuucagcacccaggacgagaagggggucacccagaacggccggcugaucaccgccaacccgaucgucaccgauaaggagaagcccguuaacauagaggccgaaccgcccuucggagaguccuacaucgugaucggcgccggcgagaaggcguuaaagcucagcugguucaaaaaggguuccagcaucggaaagauguuugaggcgacggcccgcggggcccggcgcauggccauauugggcgacaccgcgugggacuucgggaguaucggcggcgucuucaccagcguggggaagcuggugcaccagaucuucggcaccgccuacgggguauuguucuccggcgugagcuggacaaugaagaucgggaucggcgugcugcugacauggcucggccugaacucccgcagcaccagccugagcaugaccugcaucgccgucggucuggugacgcuguaccugggcgucaugguacaagcagacuccggaugugugaucaacuggaagggccgggagcucaaaugcgggagcggaaucuucgugaccaacgagguccacaccuggaccgagcaguauaaguuccaggcugacagcccgaagcggcuguccgcggccaucggcaaggcuugggaggagggggucuguggaauccggagcgcuacacgccuggaaaacaucauguggaagcagaucuccaacgagcucaaccacauccugcuggagaacgauaugaaguucacuguggucgugggggacguggcugguauacucgcgcaggggaagaagaugauccggccucaacccauggaguacaaguacagcuggaaguccuggggcaaagccaagaucaucggcgccgacguccaaaacacgaccuucauaaucgaugggccgaacaccccggagugcccugacgaccagcgggccuggaacaucugggagguggaggacuacggguucggaaucuucacgacaaacaucuggcugaagcugagggauagcuacacccaggugugcgaucacagacucauguccgccgccaucaaggacagcaaggccguccacgccgacaugggguauuggaucgaguccgaaaagaacgaaaccuggaagcuggcccgggcgagcuucauagaggugaagacgugcauuuggcccaagucccauacccuuuggagcaacggcgugcucgaguccgaaaugaucauccccaagaucuacgggggcccuaucagccagcauaacuacagacccggguacuuuacccagacugccggccccuggcaucuggguaaacuggaacucgacuucgaccugugcgagggcacgaccguugucgucgaugagcacugcggcaacagagggccgucccugagaaccaccacgguaaccggcaagauuauacacgaaugguguugcagaagcugcacccuuccaccccuccguuuccggggcgaagacggauguugguacgggauggagaucagacccgugaaggagaaggaggagaaccuggucaaguccaugguaagcgccggcagcggcgagguggacucuuucagucucgggcuacugugcaucuccaucaugaucgaagaggugaugcggagccgcuggucccggaaaaugcuuaugaccgguacacuagcggucuucuuucugcucaucauggggcagcugacuuggaacgaucugauccgccucugcaucauggugggcgccaacgcaagcgaccggauggggaugggcaccacuuaccuggcucugauggcgacuuucaagaugcggccgauguucgccgucggccuccuguuccgccguuuaaccucccgcgaaguccuccuacuuaccaucgggcucagcuuaguggccuccgucgagcugcccaacucccucgaggaacugggcgacggucuggcuauggggauaaugauccugaagcuguuaaccgacuuccagucccaucagcucugggccacgcugcugucauuaaccuucaucaagacgaccuuuuccuugcacuacgccuggaagacgauggccauggugcugagcaucgugucccucuucccccugugccuguccaccacuucccagaagacuacguggcuccccgugcuguuaggcagccucgggugcaagccacuuaccauguucuugaucgcggagaacaagaucuggggccgacgcucguggccgcucaacgaggguaucauggccgugggcaucgugagcauccugcucagcagccuccuaaagaacgacgucccucuagcugggccccucauugccggagggaugcugauagccuguuacgugaucagcggauccagugcggaccugucccucgaaaaggccgccgaggugagcugggaggaagaggcagagcacuccggcgccagccacaacauccugguugagguccaagaugacgggaccaugaagaucaaggacgaggagcgggacgacacucugaccauuuuacugaaggcgacgcugcucgccguguccggcguuuacccguugagcauccccgccacgcuguucgucugguauuucuggcagaagaagaagcagagguccggggugcucugggacacccccagcccgccagaagucgagcgggccgugcuggacgacgggaucuaccguaucaugcagcgugggcugcuggggcgcucccaagugggugucgguguauuccaggagaacguguuccacaccauguggcacgucacacggggcgccgugcucauguaccaggggaaacgccuagagcccagcugggcguccgugaagaaggaccugauaucguacggcggcggguggcggcuccagggcuccuggaacacuggggaggaaguacaggugaucgccguagagcccggcaagaaccccaagaacguccagaccgcccccgggaccuucaagacucccgagggcgaggugggcgccauugcucuggacuucaagcccgggaccagcggcuccccaauugugaaccgcgaggggaaaaucguaggccuguacgguaacggcguggugaccaccagcggcacuuacgucagcgcgaucgcgcaagccaaggccucccaggaggggccgcugcccgaaauugaggaugagguguuucggaagcgcaaccugaccaucauggaccugcaccccggcagcgggaagacccggcgcuaccucccagcgauagugcgagaggccauaaagcggaaacugcgcacccugauacuugcccccacgcgggucguggccuccgagauggccgaggcgcugaagggcaugcccauccgauaccagaccaccgccgucaagagcgagcacaccggcaaggagauagucgaccugaugugccacgccacguucacuaugcgguugcucucccccgugcgcgugccgaacuacaacaugaucaucauggacgaggcccauuucaccgaccccaguuccauugcugcgcgcggguacaucuccacccguguaggcaugggggaggccgccgccauauuuaugacggcaacgccgcccggcuccguggaggcguucccgcagagcaacgcggugauucaggacgaggagcgggacauccccgagcguuccuggaauagcggcuacgaguggaucaccgauuuucccggcaagaccgucugguucguccccucaaucaagucgggcaacgacaucgccaacugccugcggaagaacgggaagagaguuauccaacucucccggaagacguucgacacugaguaccagaagaccaagaacaaugauugggacuacgucgucaccacggacaucuccgaaaugggagcuaacuuccgcgcggaccgggugaucgacccgcgucggugcuugaaacccgucauccugaaagacgggccggagcgcguaauccucgcugggcccaugccggucaccguugccuccgcggcccagcggcgugggcggaucggcaggaaucacaacaaggaaggcgaccaguacaucuauaugggacagccucugaacaacgacgaggaccacgcgcacuggaccgaagccaagaugcugcucgacaacaucaacacccccgagggcaucauccccgcccuuuucgagccggagcgcgagaagagugccgcuauagacggagaguaccggcugcgcggggaggcgcggaagacguucguggaacucaugcgcagaggggaucugcccgucuggcuguccuacaaaguggccucugaaggcuuccaguacuccgaccgccgguggugcuucgauggcgagcgaaauaaccaggugcucgaagagaauauggacgucgagauuuggacaaaggagggggagcggaagaagcugcgcccccgguggcuggacgcccgcaccuacuccgacccacucgcccugcgggaguucaaggaguucgcagcgggccgccggagcguguccggggaucugaucuuggagaucgggaagcugccgcagcaccugacccaacgcgcccagaacgcguuggacaaucuggugaugcuucacaacucugaacaaggcgggcgggccuaccgccacgcgauggaggagcucccagacacgaucgagacccugaugcugcuugccuuaaucgcuguccugacuggcggggugacccucuuuuuccucuccggccgggggcugggcaagacuagcaucggucuccugugcgugauggccuccagcgucuugcucuggauggcauccguggagccccacuggaucgcggccagcauaauccuggaguucuuccugauggugcuacucauccccgagccggaucgccagcgaacgccccaggacaaccagcuggccuacgucgugaucgggcuccuguucaugaucuugaccguggccgccaaugagaugggcuugcuggagaccaccaagaaggaccuggguaucgggcacgucgcuguggagaaccaccaucacgccgccaugcucgacguggaccugcaccccgcguccgccuggacucuguaugccgucgccacaaccauuaucacgccaaugaugagacacacgaucgagaacaccacagcuaacaucagccucaccgccaucgccaaccaagcggccauccuuauggggcucgacaaggguuggcccauauccaagauggacaucggcgugccucuccuggcccuggggugcuacagccaggugaacccccucacgcugaccgccgccguccugaugcucguagcccacuacgcgaucaucggcccggggcuucaggccaaggccacucgcgaggcgcagaagcggaccgccgcaggcaucaugaaaaacccaacgguugaugggaucgucgccaucgaccuggaccccgugguguaugacgccaaguuugagaaacagcucggccagaucaugcugcugauccucuguaccucccaaauccugcugaugcgcaccaccugggcucucugcgagagcaucacgcuggcuaccggcccccugaccacccucugggagggguccccgggcaaguuuuggaacacgacuauagccgugagcauggcgaauaucuuccggggguccuaccuggccggcgcuggccuggccuuuagccucaugaagucccucgggggaggucgcagagggaccggggcccagggcgagacacugggcgagaaguggaagcgccaacucaaccagcuguccaagagcgaguucaauacguacaagcgguccgggauuauggaaguggaccgcagcgaagcgaaggagggccugaagagaggggaaacaaccaagcacgcggugucccgcggcacagccaaguugcggugguucgucgagcguaaccuggucaagccagaggggaaggugaucgaccugggcugcggccgcgggggcuggagcuacuacugcgccgggcugaagaaggucacggaggugaaaggcuacacuaagggcggucccggucacgaggagcccaucccuauggccaccuacggguggaaccucguuaaguuacacuccggcaaggacgucuuuuucauaccacccgagaaaugcgacacccugcucugcgacauuggcgagagcucccccaacccgacaaucgaggagggcagaacccugcgggugcuaaagaugguggagccuuggcuccgcgggaaccaguucugcaucaagauccugaaucccuacaugcccucggugguggagacccuggagcagaugcagcggaagcacggcgggaugcucgugagaaacccguuaucccgcaacagcacacacgagauguacugggucuccugcgggacaggcaacaucguauccgccgucaacaugacgucccgcaugcugcucaaccgcuucaccauggcgcauaggaagcccaccuacgagcgcgacguagacuuaggggcuggcacccgucacguggccguggagcccgaggucgcgaaccuggacauuaucggucagcgcaucgagaacaucaagcacgagcauaagagcaccuggcauuacgacgaggacaaccccuacaagaccugggccuaccacggguccuacgaagugaagccaucuggcucugcgucgagcauggucaacgggguggugaaacuccugaccaagccgugggacguuauccccauggugacccagaucgcgaugacggacacgacgcccuucggccaacagcggguguucaaagaaaaggucgauacccgcacgccgaaggccaagcgggguacggcacaaaucauggagguuacagcgaaguggcuguggggauuucuuucccgcaacaagaagccgcggaucugcacccgcgaggaauuuacgcggaaggugagaagcaacgcggccaucggcgcggucuucguggacgaaaaccaguggaacuccgccaaggaggcgguggaggacgagcgguucugggaccugguccaccgcgagcgggagcuacacaagcaggggaagugcgcgaccugcguguauaacaugaugggaaagcgagagaagaagcucggugaguuuggcaaggccaaaggcagccgggccaucugguacauguggcugggggcccgcuuucuggaguucgaggcgcucggguucaugaacgaggaccacugguuuuccagagagaacucccuguccggcgucgagggcgagggucugcacaagcucggcuauauccugcgugacaucagcaaaauccccggagggaacauguacgccgacgauaccgccgguugggacacccggaucacggaggacgacuugcagaacgaggcccgcaucaccgacaucauggagccggagcacgcgcuccuggcaaaguccaucuuuaaacuuaccuaucagaacaaagucguccgcgugcagcggcccgccaaaaacgggaccgucauggacgugaucagccgccgggaccagcgcggcuccggccaaguggggacguacggccuuaacaccuucaccaacauggaggcccagcugauccggcagauggagagcgaggggaucuuuuccccgagcgagcuggagacccccaaccucgcugagcgcguccuggacuggcucgagaaguacggcguggagcgucucaagcgcauggccaucuccggggacgacugcguggucaagccuauugacgaccgguucgcgacggcccugaccgcacuaaacgacaugggcaaggugagaaaggauaucccccagugggagccuagcaagggguggaaugacuggcagcaagugcccuuuugcucacaccacuuucaccagcucaucaugaaggacggccgggagaucgucgugccuugcagaaaccaggaugagcuggugggacgggcccgcgucucucagggggccggcuggucucugcgggagaccgcgugccuugggaagucuuaugcccagauguggcaacugauguacuuccaccgccgggaccugcgccucgccgcaaacgcgaucugcucagccgugcccguggacuggauccccaccucccggacgaccuggagcauccacgcccaccaccaauggaugaccaccgaggacaugcuguccgucuggaacaggguguggauugaggaaaauccuuggauggaggacaaaacgcacaucagcuccuggggcgacgucccuuaccuggguaaacgagaggaccaguggugcggaagccucaucggccucaccgcccgggcgaccugggcgaccaauauccaggucgccaucaaccaggugcgccggcugauuggcaacgagaacuaucucgacuacaugaccaguaugaagcgcuucaaaaacgaguccgaucccgagggagcgcugugguag

SEQ ID NO: 24526 - RNA, 9879 nt, Artificial Sequence
  derived and/or modified CDS sequence (opt11) from DENV-1__EU482710__SS-prME
uccgugaccaugcugcucaugcugaugcccaccgcccucgccuuccaccucacuacccggggcggggagccccauaugaucgucaccaagcaggaacgggguaaaagccugcuguuuaaaacuucagccggggucaacaugugcacucuaaucgccauggaccuuggcgagcugugugaggacaccaugaccuacaagugcccucggaucaccgaggccgaacccgaugacguugacugcuggugcaacgccaccgacaccugggugaccuacgggaccugcucgcagacgggcgagcaucggcgcgacaagcgguccgucgcccucgcaccccacguaggccuggggcuggagacccgcaccgagaccuggaugaguagcgagggcgccuggaagcagauccagcgggucgaaacgugggcccuccgacaccccggguucacagugaucgcacuguuccuggcacaugccauaggcacauccaucacccagaagggcaucaucuucauacucuugaugcuggugacgcccagcauggccaugcggugcgucggcaucggcucccgcgacuucgucgaaggacucagcggcgccaccuggguggacgucguccuggagcacggguccugcgugacuaccauggccaaagacaagcccacgcucgacaucgagcucuugaagaccgagguuaccaaccccgcggugcugcggaagcucugcaucgaggcgaagaucucgaauaccacaaccgacucccgcugcccgacccagggcgaggccacccugauggaggagcaggacgcaaauuucguuugcaggcgcacguucgucgaccggggcugggggaacggcugcgggcucuucggcaagggaagcuuaaucacgugcgccaaguucaagugcgugaccaagcuggaaggcaagaucguacaguacgagaaccugaaguacucgguaauagugaccgugcacacgggagaucagcaccagguagggaacgagagcaccgagcacggcaccaccgcgaccaucacgccccaggcccccacguccgagauccagcugaccgacuacggggcccugacauuagauugcaguccgcgcacgggccucgacuucaacgagauggugcuguuaaccaugaaggagaaguccuggcuaguccacaagcagugguuccuggaccugccgcucccguggacuagcggggccagcaccucgcaggagacguggaaccggcaagaccugcuagugaccuuuaagacggcccacgcgaagaaacaggagguugucgugcuuggcagucaggagggcgccaugcacaccgcucugacaggugccaccgagauccagaccuccggcaccacgaccaucuucgccgggcaucugaagugccgccucaagauggauaagcugacccugaagggcaugagcuacgugaugugcaccggguccuucaagcuagagaaggaggucgcggagacacagcacggcaccgugcuggugcagauuaaguacgagggaaccgacgcccccugcaagauccccuucagcacccaggacgagaagggggucacgcaaaacggccggcugaucaccgccaacccgaucguaaccgacaaggagaaacccguuaacaucgaggcugagccgcccuucggggaguccuacaucgugauuggcgcgggcgaaaaggcccuuaaacucagcugguuuaagaagggguccagcauuggcaagauguucgaagcgaccgcgcguggugcccggcgcauggcgauccugggugacacugcuugggacuucgggagugugggcggcguguucacaagcgucgggaagcuggugcaccagaucuuugguaccgccuauggggugcuguucuccggcgucagcuggaccaugaagaucgggaucggcguucugcugacguggcuuggccuuaacucccgcagcaccucccucagcaugaccugcaucgccgugggacucgucacccuauaccucggcgugaugguacaggcggacuccggguguguuauaaacuggaagggacgggagcucaagugcgggucgggcauauuugugaccaaugaggugcacaccuggaccgagcaguauaaguuccaggcggacagcccgaagcgccuguccgcagccauaggcaaggccugggaggagggggucuguggcauccggagcgccacccgccuggagaacauaauguggaagcagaucucaaacgaacucaaccacauccugcuggagaacgacaugaaguuuaccgugguggugggggacgugguaggcauccuggcgcaggggaagaagaugauccggccccagccgauggagcacaagcacagcuggaagagcugggggaaagccaagaucaucggcgccgacguccagaauacgaccuucaucaucgacggacccaacaccccggagugccccgacgaccaacgcgccuggaacaucugggagguggaggacuacgguuuugggaucuucaccacgaacauauggcugaagcugcgggacagcuacacccaggugugcgaccaccgccuuaugucggcggcaaucaaggacuccaaggccgugcacgccgauaugggcuacuggaucgaguccgaaaagaacgagaccuggaagcuagcccgggcgagcuuuauugaggugaagacguguauuuggcccaagucgcacacgcucuggagcaacggggugcuugaguccgagaugauuauccccaagauuuacgggggcccgaucagccagcacaaccaccgcccuggauacuucacacagaccgccggccccuggcacuuaggcaagcucgaguuagacuucgaccugugcgaggggaccacggucgugguggacgagcacuguggaaacagggggccguccuugcgcaccaccaccgucacgggcaagaucauccacgaguggugcugccggucaugcacccugccgccccuccgcuucaagggggaggacggcugcugguacgggauggaaauccgucccgugaaggagaaggaggagaaccuggugaaguccauggucagcgccggcucgggcgaaguggacuccuucagccucggguugcugugcaucuccauuaugauagaggagguaaugcgcagccgguggagccggaaaaugcucaugacuggcacccuggccgucuuccuccugcugauaauggggcagcuaacguggaacgaccucauccggcugugcaucauggugggcgcuaacgcguccgaccgcaugggcaugggcaccacauaccuggcccucauggccaccuucaagaugcgcccgauguucgccguaggccugcuguuucggcgccucacaucccgcgagguccuucugcuuacgaucggacuuucacugguggccuccguugagcuccccaacagccuggaagagcugggcgacgggcucgcgaugggcauuaugauccugaaguugcucacugacuuccagucccaccaacugugggccacccugcucucacuaacauucaucaaaacaacccugucccuccauuacgcguggaagaccauggccaugguguuaagcaucgugucccuguucccucucugccugagcacgaccucccagaagaccacauggcugccaguuuuacuuggcagccugggcuguaaaccacucacuauguuccuuaucaccgagaauaagaucuggggacgcaagucuuggccccugaacgaggggaucauggcggugggcguggucagcauccuccugagcuccuuacucaagaacgacgugcccuuggccgggccccuaauugccggcggcaugcucaucgccugcuaugugaucagcggguccagcgcagaccucucccuggaaaaagcggcugaggucagcugggaagaggaggccgagcacuccggcgccagccacaauauccuuguggaaguucaagacgaugggaccaugaagauaaaagacgaagagagggacgauacacugacaauccugcucaaggccacgcuccuggcagucaguggcguguacccgcucucuauccccgccacccucuuugugugguacuucuggcagaagaagaaacagcgcuccggggugcuuugggacaccccaucaccgccagaagucgagcgggcaguguuggacgacggcaucuacaggaucaugcagaggggccuccuggggcgcucacaggucggcgugggagucuuccaggagaaugucuuucacacaauguggcacguuacgcggggggccgugcugauguaccaagggaaacgccucgaaccaagcugggcguccgucaagaaggaucugaucuccuacggcggcggguggcggcuccagggcuccuggaauaccggggaggagguccaggugaucgcggucgagcccggcaaaaaccccaagaacgugcagaccgccccugggaccuucaagacgcccgaaggcgaggugggggccaucgcgcucgacuucaagcccggcaccagcggcagcccgauagucaaccgggaagggaagaucguaggccuguacggcaacggggugguuaccaccucuggcacguacgugagcgccaucgcgcaagccaaggcaucccaggagggcccccuuccugagaucgaggacgagguuuuccggaagaggaaccuuaccaucauggaccugcaccccggcagcgggaaaacccggcgcuaccuucccgccauaguccgcgaggcuaucaagcguaagcuccggacccugauccuggcccccacgcgcgugguggccuccgagauggccgaagcccucaagggcaugcccauccgcuaccagacgaccgcggucaagagcgaacacaccggcaaggagauaguggaccugaugugccacgcuacguucaccaugcggcugcuuucccccguuagggucccuaacuauaacaugaucaucauggacgaggcccacuuuaccgaccccucuuccaucgccgccaggggguacaucucgaccagagugggcaugggagaggcggcagcuauuuucaugacggcaacgccgcccggcuccguggaggccuucccgcagagcaacgccgucauccaggaugaggagcgagacauccccgagcgcuccuggaacagcggguacgaauggaucacggacuuccccggcaagaccgugugguucgugcccuccaucaagagcggcaacgacaucgcgaacugcuuacggaagaacgggaagcgggucauccagcugucccggaagacguucgacacggaguaccagaagaccaagaacaacgacugggauuacguugugaccacggauaucagugagaugggcgccaacuuccgcgccgaccgggucaucgacccucgccgaugccuaaagcccgugauccugaaggacgggcccgagcgcgucauccuggcggggcccaugccggucaccguggccuccgccgcacagcggcgcgggcggaucggccgcaaccacaacaaggaaggugaccaauacauuuacauggggcaaccccucaacaacgacgaggaccaugcccacuggaccgaggcgaagaugcugcuggacaacaucaauaccccugagggcauaauccccgcccucuucgagccggagcgggagaaguccgcagccaucgacggggaauaccgccugcgcggcgaggcccggaagacguucgucgagcucaugcgccguggggaccuccccguguggcuguccuacaagguggcgagcgagggcuuccaguacagcgaccgccgcuggugcuucgacggcgagcgcaacaaccaggucuuggaagagaacauggacguggagauuuggacaaaggagggggaacggaagaagcuccgcccgcgguggcuggacgcccgcaccuacuccgacccccuggcgcuccgggaguucaaggaguucgcugcgggccgccggagcgugagcggcgaccugaucuccgaaauugggaaacugccgcagcaccucacccagcgagcccagaacgcccuggacaaccuggucaugcuccacaacuccgagcagggcgggcgggccuaucgccacgccauggaggagcuuccagacacaaucgagacccugaugcuccuggcgcugaucgcggugcucaccggcggggugacccuuuucuuucugucuggccgggggcucggcaagaccuccaucggucugcugugcgucauggccagcuccgugcuccuguggauggcgagcguggagccccacuggaucgccgccuccaucauccuggaauucuuccucaugguccucuugauccccgagccggaccgccagcggacgccccaggacaaccagcucgccuacguggugaucggccugcuauucaugauccucacaguagccgccaacgagaugggccuguuggagacaaccaagaaagaccucggcaucggucacgucgccguggagaaccaccaccacgcaacgauguuagacgucgaccuacaccccgcuucagccuggacccucuacgccguggccaccaccaucaucacgccgaugaugcgccauaccaucgagaacaccaccgcgaacaucucccugacagccaucgcuaaucaggcggcuauucugaugggacucgauaagggcuggcccaucagcaagauggauaucggcgugccccugcuagcgcucgggugcuauucccaggucaauccucucacccugacugccgccguacugaugcucguggcccacuacgcgauaaucggcccggggcugcaggccaaggccacucgggaggcccaaaagagaacggcagcgggcaucaugaagaaccccaccgucgacgggaucaucgcaauagaccucgaucccgugguguacgacgccaaauucgagaagcaacugggucagaucaugcugcucaucuuaugcaccagccagauucuguugaugcgcaccacgugggcccugugcgaguccaucacccuggccaccggcccacucaccacgcugugggaggggagcccgggcaaguucuggaacacuaccauagcggucuccauggccaacaucuuucgggggagcuaccuggcuggggccggccucgccuucagccugaugaagagucucgggggcgggcggcgugggaccggggcgcagggcgagacgcucggcgagaaguggaaacggcagcugaaccagcuaagcaaguccgaauucaacaucuauaagcggagcgggaucauggagguggacagauccgaggccaaggagggcuugaagcgcggggagaccacccgccacgcggugagccgggguaccgcgaaacugcgcugguucgucgagcgcaaccuggugaaaccugaggggaaggugauagacuuaggcugcggaagagggggcugguccuacuauugcgcggggcucaagaaggucacggagguaaaggguuauaccaaagggggccccggccacgaggagcccauucccauggccacuuacggguggaaucugguaaagcuacacagcggcaaggacgucuucuuuacaccgccugagaagugcgacacgcuccugugcgacauaggggagucaucuccaaauccgacuauugaagagggccguaccuuacgaguacucaagaugguggaaccguggcuccgggggaaccaguucuguauaaagauccugaaccccuauaugcccucaguuguggagacacucgagcagaugcagcgcaagcacggcggcaugcuggugcggaacccccugagucgcaauuccacccacgagauguacuggguuagcugcgguacgggcaacaucguuucagccgugaacaugaccagccggaugcuccugaacagauucaccauggcccaccgcaagccaaccuacgagagggaugucgaccugggggcgggcacgcgccacgucgcgguggagccagaagucgccaauuuggauaucaucgggcagaggauagagaacaucaagcacgagcauaaguccaccuggcacuacgaugaggauaaucccuauaagaccugggccuaccacgggagcuacgaggugaagccauccggcagcgcaagcuccauggucaacgggguggugaagcuacugaccaagcccugggacgucauccccauggugacgcagauugcaaugacggacaccacccccuucggccaacagcgaguauucaaggagaagguggacacgcggaccccgaaggcgaagcguggaaccgcccagauuauggaggugaccgcccgguggcuauggggcuuucugagccgcaacaagaagccccggauaugcacgagggaagaguucacucggaagguccgcuccaacgcagccauaggcgcggucuuuguggacgagaaccaguggaacagcgccaaggaggccguggaggacgagcgguuuugggaucugguccagaaggagcgcgagcuccacaaacaagggaagugcgcaaccugcguguacaacaugaugggcaaacgggagaagaaacugggugaguucggcaaggcgaaggggucccgcgccauaugguauauguggcugggcgcccgguuccucgaauuugaggcccugggcuucaugaaugaagaccacugguuuagccgagagaacucccugagcgggguagagggcgaggggcuucacaagcugggcuauauucugcgggacaucuccaagauccccgggggcaacauguaugccgacgacacugcaggcugggacacucgcaucaccgaggacgacuuacagaacgaggccaagaucaccgacaucauggagcccgagcacgcgcugcuagccaccagcauuuucaagcucaccuaccagaauaaggucguucgggugcagcgccccgccaagaacgggaccguaauggacgugaucucucgccgagaccagcgcggcagcggucaggucggcaccuacggccuaaauaccuucacgaauauggaggcgcaauuaauccgccagauggagagcgagggaauuuuccuccccucugaguuggagaccccgaaucucgcggagcgcguacucgacuggcuggagaaguacggcguggagaggcucaaacgcauggccaucucaggggacgacugcguagucaagccgaucgacgaccgguucgcuaccgcccucaccgcgcucaacgacaugggcaaggugcggaaggacaucccccagugggaacccagcaagggguggaacgauuggcagcagguccccuucugcucccaccacuuccaccagcugauuaugaaagacggccgggagaucgucgugccgugccgcaaccaggacgagcucgugggccgggcacgcgucucucagggagccggguggagccuucgggagacggcuugccuuggcaaguccuacgcccagauguggcaguugauguauuuucaccgccgggaccugcgauuagcggccaacgcgaucuguagcgccgugcccguggauuggguccccaccucccggacgaccuggagcauccaugcucaccaccaauggaugacgaccgaggacaugcucuccguuuggaacagaguguggaucgaggagaaccccuggauggaagauaaaacgcacgucuccuccuggggcgaugugccuuaccugggaaagcgggaggaccaguggugcggcagccugaucggccucacggcccgcgccacaugggccuccaacauccagguggccaucaaucaggucagacggcucaucgguaacgagaacuacuuggacuacaugacgagcaugaagcgcuucaagaacgagggagaccccgagggagcgcucugguga

SEQ ID NO: 24527 - RNA, 9879 nt, Artificial Sequence
  derived and/or modified CDS sequence (opt11) from DENV-1__EU482712__SS-prME
agcgugacuaugcugcucauguugaugcccaccgcgcuugccuuccaccucacgacucggggcggcgagccucacaugaucguguccaagcaggaacgggggaagucucugcuguuuaagaccagcgcgggagugaacaugugcacccucaucgcgauggaccugggagaguucugcgaggacacgaugaccuauaaaugcccgagaauuaccgaggcugagccggacgacguggacugcuggugcaacgcgaccgacacgugggugacguacgguacauguagccaaaccggcgagcacagacgugacaaacggucuguagcccuggcaccucacgugggccucggacuggagacgcgcaccgagaccuggaugagcuccgagggcgcuuggaagcagauccagcggguagagaccugggcccugcgccacccaggguuuacggugauugcccucuuucuugcgcacgccauuggcacgagcaucacgcagaagggaaucaucuuuauauuacucaugcuugucacccccuccauggccaugcguugcgucggcauaggaagccgcgacuuuguggaggggcuguccggcgccacguggguggacgucgugcucgagcacggcagcugugugaccaccauggcgaaggacaagcccacccuggacaucgaguuacucaagacggaagucaccaaccccgcagugcugcggaaguuaugcauugaggccaagauauccaacacuaccaccgacucuagaugcccgacucaaggggaggccacucucgucgaggagcaagaugccaacuucgugugccggcgcaccuucguggaccggggcugggggaauggcugcgggcuguucggaaaagggucccugaucacgugugccaaguucaagugcguuaccaaacucgagggcaagaccguccaguacgagaacuuaaaauacagcgugaucgugaccguccacaccggcgaccagcaucaggucgggaacgagucuaccgagcacggcacgaccgcaaccaucacaccgcaggcccccagcaccgagauccaacugaccgacuauggggccuugacccuggacugcagcccccggaccggccuggacuucaaugagaugguucuccugaccaugaaggagaaauccuggcuugugcauaagcagugguuccucgaucugccgcugcccuggaccaguggggccagcacaagccaggaaacguggaaucggaaggaccucuugguuaccuucaagaccgcacacgcgaagaagcaggaggucgugguccugggcucccaggagggggccaugcacaccgcguugacgggggccacagagauccagaccagcggcaccacuaccaucuucgccgggcaccugaagugcagacugaaaauggacaaacugacccugaagggcauguccuacgucaugugcacaggguccuucaaacuggagaaggagguggcggaaacgcagcacggcaccgugcucguccagauuaaguacgagggcacagacgcccccugcaagauccccuucuccacacaggacgaaaagggggugacucagaauggccggcugaucaccgccaaccccaucguuaccgacaaggagaagccugucaauauugaggcugaaccgccuuucggggagagcuacaucgugaucggagcgggcgagaaggcccugaagcugaguugguucaagaaggggaguuccauugguaagauguucgaggcaaccgcucgcggggcccggcgcauggcuauccuuggcgacacggcuugggacuucggaagcaucggcggcguguucaccuccguugggaagcuggugcaccaaaucuuuggcacggcuuaugguguguuguucucaggcguaucuuggaccaugaaaaucgggaucggcguccugcugacguggcugggacucaacagccguuccaccagccuguccaugaccuguaucgccgugggacuggucacacucuaccugggcgugauggugcaggccgacucagggugugucauaaacuggaagggccgcgagcugaaaugcggaagcggaaucuucgugacaaacgaggugcacaccuggaccgagcaguacaaauuucaggcggacuccccgaagcgccucagcgcagccaucggcaaggccugggaggaagggguaugcggcauccgguccgcaacgcgccuggagaacaucauguggaagcagauaagcaacgagcugaaccacauccuccucgagaacgacaugaaguucaccgugguugugggggacguggcgggcauucuggcccaggggaaaaagaugauccggccucagcccauggaguacaaguacucauggaagucauggggcaaggccaagaucaucggcgcggacgugcagaacacgacauuuaucaucgacgggcccaacacgccggagugucccgacgaccagcgcgcauggaacauaugggaggucgaggacuacgguuucgggauauucaccacgaauaucuggcucaagcugcgggacuccuacacccaggucugcgaccaccgcuuaaugagcgcagccaucaaggacucgaaggccguacacgccgacaugggcuauuggauagaauccgagaaaaaugagaccuggaagcucgcgcgggccucguuuaucgaagugaaaaccugcaucuggcccaagucgcacacgcucugguccaacggggugcuggagagcgagaugaucaucccuaagaacuauggggguccgaucucccagcacaacuaccgcccaggguauuucacgcagaccgcugggccguggcaccucgggaagcuggagcucgacuucgaccucugugaaggcaccacggucgucguggaugagcauugcggcaaccgggguccgucucuccgcaccacuaccgugacgggcaagaucauucacgagugguguugcagauccuguacccuaccgccccugcgcuucaaaggagaggacggaugcugguacgggauggagauccgacccgucaaagagaaggaggagaaccuggucaagagcauggucagcgcaggcuccggagagguggacucauucagccuggggcugcuaugcaucuccauaaugauugaggaggugaugcgcucccgcuggagccgcaagaugcugaugaccggcacccuagccgugcuguuucugcucaucauggggcagcuaacguggaaugaucugauacgccucuguaucauggucggcgccaacgccuccgaucgcauggggaugggcaccaccuauuuggcccugauggccaccuucaaaaugcgcccgauguucgcggugggccuccuguuccggcgccugacgucucgagaaguccuccugcuaacuaucgggcucucucuggucgcgucaguggagcugcccaacucccuggaagagcugggcgauggccuggccauggguaucaugaucuugaagcugcugaccgauuuccagagccaccagcucugggccacccugcugucccucacguucaucaagaccaccuucucacugcacuacgccuggaagaccauggcgauggucuuaagcauagugagucuuuucccccugugccuguccacgaccagccagaagaccaccuggcucccgguccugcugggaucccuaggguguaagccgcugacuauguuccugaucgccgagaacaaaaucuggggccggaagagcuggcccuugaacgaggggaucauggccgucgguaucgugagcaucuuacuguccucacuccugaagaacgacgugccccuggccgggccacugaucgcgggcggcaugcugaucgcgugcuacgucaucuccgggucaagugcugaccugagccucgagaaggccgccgaagugucaugggaggaggaagccgagcauagcggcgcgucccauaacauccugguggagguccaggacgacgggacuaugaagauaaaggacgaggaacgggacgacacuuugacaauccugcuaaaggccacccugcucgcugugagcggaguguacccccuauccaucccagccacucuguucgucugguacuuuuggcagaaaaagaaacagagaagcggggugcucugggacacccccagcccgcccgagguggaacgggcggucuuagacgacggaaucuaccgcauuaugcagcggggccuucuggggcgcagccaagugggcguaggcgucuuccaggaaaacguguuccacaccauguggcacgugacccggggagcuguccucauguaccaggggaagcgccuggagccuuccugggcuagcguaaaaaaggaccuaaucuccuacggcggcggauggagacuccagggcagcuggaacacuggggaggaggugcaggucaucgccguggaacccggcaaaaauccgaagaacgugcagacggcgcccgggaccuucaagacauccgagggcgaaguaggcgccauagcgcuggacuucaagcccgggacgucagggagccccaucgucaaccgcgaagggaagaucgugggccuguacggcaacggggucgugaccacgaguggcaccuacgugagugcuaucgcccaggccaaggcgucccaagagggcccccucccugagaucgaggacgaggucuuccggaagcgcaacuugacgaucauggaucuacaccccggcagcggcaagacccggcgcuaccuccccgccaucgugcgggaagcgauuaagcgcaagcugcggacacuaauccucgccccaacccgcguggucgccuccgagauggcggaggccuuaaagggcaugccgauccgauaccaaacuaccgcagucaagagcgaacacaccggcaaggagaucguggaccugaugugccacgccacguucacuaugcggcuccucucacccguccgcgugccaaacuacaacaugaucaucauggacgaagcacacuucacggacccgagcuccauugcggcgcggggguacaucuccacccgcgugggcaugggagaagccgccgccaucuucaugaccgcgacgccgcccggauccgucgaagcguucccacaaucuaacgccgugauacaggaugaagagcgagacauccccgaacgcucauggaacucuggauacgaguggaucacggacuuccccggcaagacagugugguucguccccuccaucaagucuggcaacgacaucgccaacugccuacggaaaaacgggaagcgcgugauccagcucucccggaaaaccuucgauacagaguaccagaagaccaagaacaacgacugggacuauguggucacgaccgauaucagcgagaugggcgcuaauuucagggcagacagggugaucgauccccgcagaugccugaagccggugauccucaaggacgggcccgaacgcgucauccucgcgggccccaugcccgugacggucgccucagccgcccagcggaggggccggaucggccgcaaccacaacaaggagggcgaccaguacauuuacauggggcagccucugaacaaugaugaggaccacgcucacuggaccgaggccaagaugcugcucgacaacaucaauacccccgagggcaucauacccgcccucuucgagcccgagagggagaaguccgccgcaaucgacggggaguaucgucugcgcggagaggcccggaagaccuucguggagcucaugcgccgcggggaccuacccguguggcucagcuacaaggucgccucagagggcuuccaguacagcgaccgucgguggugcuucgacggcgagcgcaacaaccagguacuugaagagaacauggacguggagaucuggacgaaggagggggagcggaaaaagcugcgcccccgguggcuugacgcacgcaccuacuccgacccccuggcccuacgggaguucaaggaguuugcggccggcagacggagugucuccggugaccugauucucgagauagguaagcugccccagcaccucacccagagggcucagaacgccuuggauaaccuggugaugcugcacaacagcgaacagggcggacgggcuuaucgacacgcaauggaggagcuccccgacacuauugagacccuaaugcuguuagcccugaucgccgucuuaacaggggguguaacacucuucuuccuguccggccgggggcugggaaagacuagcaucggccuucugugcgugauggcuagcagcguacugcucuggauggcuuccgucgagccccacuggauugccgccuccaucauucuggaguucuuucucauggugcuccugauucccgagcccgaccgccagcggaccccgcaggacaaccaguuagccuaugugguaauugggcugcuguucaugauccugaccguggccgccaacgagaugggacuccuagagacaacuaaaaaggacuuagggauuggucauguggcagucgagaaccaccaccacgccgcaauguuagacguggaccugcacccagccuccgcguggaccuuguacgcgguagcaacgaccaucaucaccccgaugaugagacacaccaucgagaacaccacugccaauaucagccucaccgccaucgccaaccaggccgccauauuaaugggccuggacaagggcuggccuaucuccaagauggacaucggcgucccccucuuggcccuggggugcuacagccagguuaacccccucacccugacggcugcagugcuuaugcucgucgcccauuacgcgaucauaggccccgggcugcaggcaaaagcgacucgggaggcccagaagcgcaccgccgcugggaucaugaagaacccgaccguagacgggaucguagccauagaccuggacccuguuguuuacgacgcgaaauucgagaaacagcucggccaaaucaugcugcugauccucugcaccucccagauccuacugaugcguaccaccugggcccucugcgagucaaucacccuagccacaggcccccugaccacccucugggaggggagccccggcaaauucuggaacaccacgaucgccguuagcauggccaacaucuucagagggagcuaccuggcgggcgcuggccuagccuucucccucaugaagucccucgggggcggccgccgggggaccggggcccagggcgaaacguuaggcgagaaguggaagcgucaacucaaccaacucuccaagagcgaguucaacaccuacaagcggucugggaucauggagguggaccgaagcgaggcgaaagaaggccugaagcgcggggagacgaccaagcaugcgguauccagagguaccgccaagcuccggugguucguugagcgcaaccuggucaagccggaagggaaggugaucgaccugggguguggacgaggaggguggagcuauuauugcgcagggcugaaaaaggugaccgaggugaagggguauacgaagggcgggcccggccacgaggagccgaucccuauggccaccuacggguggaaccucguaaagcugcacuccggcaaggauguguuuuucaucccgccagagaagugcgacacccugcucugcgacaucggggaguccagccccaacccgaccaucgaggaggggcgcacgcugcggguccugaaaaugguugagccguggcuccgcggaaaccaguucugcauaaagaucuuaaaccccuacaugcccucaguggucgagacgcuggagcaaaugcagagaaagcacggaggcaugcucgugcgcaacccauugucucguaacagcacccacgagauguacuggguguccugcgguaccggcaacauugucagcgcgguuaacaugaccuccaggaugcugcucaaccgguucacgauggcgcaccgcaagccgacguacgagcgagauguggaccuuggggcaggcacccgucacgucgcgguggaaccggagguggccaaucuggacaucaucggccagcgcaucgaaaauaucaagcacgagcacaagucaaccuggcauuaugacgaggacaaccccuauaagacgugggcguaccacgggucauacgagguuaagcccagcggcucagccucgucgauggugaacggggucgucaaacucuuaaccaagcccugggacgugaucccuauggucacucagaucgcuaugaccgacacgacucccuucgggcaacagcguguguucaaggagaagguggacacccggacccccaaggccaagcgggggacggcucagaucauggaggucaccgcgaagugguuguggggcuuucucucgcgcaacaaaaagccacggauaugcacucgcgaggaguuuacccgcaagguccgcucuaacgccgccauuggcgcugucuucgucgaugagaaccaguggaacagugcgaaagaggccguggaagacgaacgauucugggaccuggugcaccgcgagcgagaacuacacaagcaggguaagugcgccacuuguguauacaauaugauggguaagcgcgagaagaagcucggggaguucggcaaggccaaggggagccgggcaaucugguacauguggcugggcgcgcgcuuccucgaauucgaggcgcuuggcuucaugaacgaggaccacugguucucccgagagaauucucuguccgggguggagggggagggucuucacaaauugggauauauucuccgggacauaagcaagauaccagggggcaauauguacgcagacgauaccgccggcugggacacccguaucaccgaggaugaccugcagaacgaggccaagauuacggacauuauggagcccgagcacgcacucuuagccaaaaguaucuucaagcugaccuaccagaauaaggugguucgcgugcagcgcccggcuaagaacggcaccgugauggacgucaucagccgucgcgaccaacggggcagcggccagguaggcaccuauggccucaacaccuucaccaacauggaggcucagcugauccgccaaauggagucagaagggaucuucucccccagcgaguuagaaaccccaaaccucgccgggcgggugcuggauuggcuggagaagcacggggucgagcgccucaagcguauggcgaucuccggcgacgauugcguugucaagcccaucgacgaccgcuucgccacugccuugacugcacugaacgacaugggcaaggucaggaaggacaucccgcagugggagccaagcaaaggcuggaacgauuggcagcaggugcccuucugcucccaccauuuucaucagcucauuaugaaggacggccgcgagaucgugguccccugccggaaccaggacgagcugguagggcgcgcccgggucucccaaggcgcuggguggaguuugcgcgagaccgccugccugggcaaguccuaugcgcagauguggcagcuuauguacuuccaccggcgugaucuccgguuggccgccaacgccauuuguagcgccgugccugucgauugggugcccaccagccgcaccacauggucaauccacgcccaccaccaauggaugacaaccgaggacaugcugagugucuggaaucguguguggaucgaggagaacccguggauggaggacaagacgcacauaagcucauggggcgacgugcccuaccugggcaagcgagaggaccaguggugcggcagucucaucgggcugacggcccgggcgaccugggccacgaauauccaggucgccauuaaucaggugcgacgccugaucggcaaugagaacuaccuugacuacaugacauccaugaagcgguucaaaaacgagagcgacccggaaggagcccugugguga

SEQ ID NO: 24528 - RNA, 9879 nt, Artificial Sequence
  derived and/or modified CDS sequence (opt11) from DENV-1__EU249490__SS-prME
agcgugaccaugcugcucaugcugaugccuaccgccuuggcuuuccaccugacgacccgcggcggggagccucacaugauugugucaaagcaggagaggggcaagucgcugcuguucaagaccuccgcgggggugaauaugugcacgcucaucgccauggaccugggagaguucugcgaggacacgaugaccuacaagugcccgcgcaucaccgaggcggagcccgacgacguggacugcuggugcaacgccacugauacaugggugaccuaugggaccuguagccagaccggcgagcaccgccgcgacaagcguuccguggcccuggcgccccacguuggacucgggcuggagacgcgcacggagacuuggaugagcuccgagggcgccuggaaacagauacaacgggucgagaccugggcccuacgccaccccgguuucacugugauagcauuauuccuggcgcacgccauaggcaccagcaucacccaaaaggggaucauuuuuauccugcucaugcuggugacccccuccauggccaugcgcugcgucggcaucggcagccgcgacuuuguagaggggcuguccggagcgacguggguggacgucgugcucgagcacgggagcugcgugaccaccauggcuaaggacaagcccacccuugacaucgagcugcucaagacggaggucaccaaccccgcgguguugcggaagcugugcaucgaggccaagaucuccaacacuacaacggacagccgaugcccgacccagggcgaggccacccucgucgaggaacaagacgccaauuucgucugcagacgcacauuuguagaccgggggugggggaacggcugcgggcuguucggcaaaggaucccugaucacgugcgccaaguucaagugcgucacaaagcuagagggcaagaccguacaguacgagaaccugaaguacucggugauugugaccguacacacgggugaccaacaccagguuggcaaugaguccacagagcacggcacgaccgcgaccaucaccccccaagcccccagcacugagauccagcugacagacuauggggcacuaacccuggacugcucuccccgcacgggccuggacuucaacgagaugguccuccugaccaugaaggagaaguccuggcugguccacaagcaaugguuccuugaucuuccacugcccuggaccagcggggccuccaccagccaagagacguggaaccggaaagaucuccuggugaccuucaagaccgcgcacgcgaagaagcaggaggucguggugcuggguagucaggagggcgccaugcauaccgcccucacgggggccaccgagauccaaaccagcgggaccacgacuaucuuugccggucaccugaagugccgccugaagauggacaaacucacccugaaggguaugaguuaugucaugugcaccgggucguucaagcuggagaaggagguggcggaaacgcagcacggcacugugcucguucaaauuaaguacgaaggcaccgacgcgcccugcaagauccccuucuccacccaggacgagaagggggugacgcagaacggccggcugaucacggccaacccgaucgugacagauaaggagaagcccgucaacaucgaggccgagccgccauucggggagagcuacaucguuaucggggcuggugagaaagcccuuaagcugucuugguucaagaaaggaagcucuauuggcaagauguuugaggccacagcacgaggggcccggcguauggccaucuuaggcgacaccgcgugggacuucgggagcauagggggcgucuucaccagugucggcaaacuggugcaccagaucuuuggcaccgccuacggggugcuguuuucaggcgucuccuggaccaugaaaaucggcaucggcgugcuccugaccuggcugggucucaacagccgcucuacuagccucuccaugacaugcaucgccguggggcuggugacccuuuaucugggugugauggugcaggcugacagcgggugugucaucaacuggaagggccgggagcucaaaugcgguagcggcauauucgucacgaacgaaguucacacuuggaccgagcaauacaaauuccaagcggacagcccgaagcggcucagcgcagccaucggcaaggccugggaggaggggguguguggcauccgaucggccacccgccuggaaaacaucauguggaaacagaucagcaacgagcugaaccacauccugcuggagaacgacaugaaguuuaccguuguggucggggacguggcaggcauccuggcacaggggaagaagaugauacggccccagccgauggaauauaaauacuccuggaagaguugggguaaagcuaagaucaucggcgccgacgugcagaacacaacguucaucaucgacgggcccaacacgccggagugccccgacgaccagagggcguggaacauaugggaggucgaggacuacggcuucgggaucuucaccacgaacaucuggcucaaacugcgggacuccuacacccaagugugcgaccaccgccugaugucggccgcaaucaaggauuccaaggcuguccacgcagacaugggcuacuggaucgagagcgagaagaacgagacguggaagcucgcccgggccucauucaucgaggucaagacuugcaucuggcccaagagccauacgcuguggagcaacggcguacuggagagcgaaaugauaauccccaagaucuaugguggcccgauaucccagcauaacuaccgccccggguauuucacgcagaccgccgguccuuggcaccuggggaagcuggagcucgacuucgaccucugugagggcacaaccguggucguggacgaacacugcggaaaccgggggcccucguuaaggaccaccacggugacuggcaagauuauccacgaguggugcugccggagcugcacacuaccuccccugcgcuucaagggggaggacggcugcugguacgggauggagauccgcccuguaaaggagaaggaggaaaaccuggucaaauccaugguaagugccggauccggcgaggucgacagcuucucccuggggcuccugugcaucagcaucaugaucgaggaggugaugcggucccgcuggucgcgcaagaugcugaugaccggcacccucgccguguucuucuuacugauuaugggucagcucacguggaacgaccucauccggcuguguauuauggucggcgcgaaugccagugaucgaaugggcaugggcaccacuuaccucgcccugauggccacuuucaagaugcgcccgauguucgcagucggacuccuguucaggcgccugacgagcagggaggugcugcuccugacgaucgggcugagccuugucgcgagcguugagcugccaaauucucucgaggaguugggcgacggacuggcaauggguaucaugauccucaaauuacugaccgacuuccagagccaccagcugugggcaaccuuacucuccuugacguucauaaagaccaccuuuagccugcacuacgcauggaagaccauggcgauggucuuguccaucgugagcuuguuucccuugugccugucuacaacuucacagaagaccaccugguugcccguguugcugggcuccuuggggugcaaaccacucaccauguuccuuaucgccgagaacaagauuuggggccgaaaaagcuggccccuaaacgagggcaucauggccgucggaaucguuagcaucuuauuauccucacugcucaaaaacgacgugccccuagccgggccccugauagcaggcggcaugcucaucgcgugcuacgucaucucggguagcuccgccgacuugagccuggagaaggccgccgagguguccugggaggaggaggccgagcacagcggugcgucccacaacauccucgucgagguccaagacgacgggacgaugaagaucaaggacgaggaacgggacgacacccugacaauucugcucaaggccacucugcuggccgugucgggcguauacccgcucuccauucccgccacgcuauucgugugguacuucuggcagaaaaaaaaacaacgcagcggagucuuaugggauacccccucaccgccggagguggagcgagcggugcuagacgauggcaucuaccgcaucaugcagcggggccuacuggggcggagccaggugggcgugggggucuuccaagagaacguguuccacaccauguggcacgucaccaggggugcgguccucauguaccaagggaaacgccucgagcccuccugggccuccgugaaaaaagaccuuaucuccuacgggggcgguuggcggcugcagggcagcuggaacacgggggaggaggugcaggucaucgccguggagcccggcaaaaaccccaaaaacguacagaccgcccccgggacuuucaagaccucagagggcgagguaggcgcaaucgcgcucgacuucaagcccgggacgagcgggagcccgaucgugaaccgggaggguaagauugucggccuguauggcaacggggucgugaccacgagcggcaccuacguuagcgccauagcccaggccaaggcuucccaagagggcccccuuccggaaaucgaagacgaggucuuccggaagaggaaccucacgauaauggacuuacacccuggcagcgggaagacccggcgcuauuugccugccaucgugcgggaggccaucaaacgcaagcucagaacccugauccuagccccuacacgcguggucgccagcgaaauggccgaggcccucaagggcaugcccaucagauaccagacgaccgccgucaagagcgaacauacuggcaaggagaucguggaccugaugugccacgccacuuucacgaugcgucuucucucccccguccgcgugcccaacuacaacaugaucaucauggacgaagcccauuucaccgacccgagcucaaucgcugcacguggguauauuagcacccgcgugggcaugggggaggccgccgcaaucuucaugaccgccacgccgcccgguuccgucgaggccuucccccagagcaacgccgugauccaggacgaggagagggacaucccggaacguucauggaacagcggauacgaguggaucaccgacuuuccgggcaaaaccgugugguucguccccagcauaaagagcgggaacgacauagcaaacugccugcggaagaacgggaagcgcguaauccagcugucccgacgcaccuucgacacggaauaccaaaagaccaagaauaacgauugggacuacguugucaccacagacaucagugagaugggugcgaacuuccgggccgauagagucaucgaccccaggcgcugucucaagccggugauuuuaaaggacgggcccgagcggguuauauuagcuggccccaugcccgugacgguagccuccgcggcgcagcggcgggggaggaucggccggaaccacaacaaagaaggcgaccaguacaucuacauggggcagccgcuaaacaacgaugaggaccacgcccacuggaccgaagcgaagaugcuucuggauaacauaaacacccccgagggcaucauccccgccuuauucgagccugagcgcgagaagucugccgcgaucgacggggaguaccgccugcguggugaggcccggaaaaccuucguggagcuaaugcggcgcggagaccuuccaguguggcuguccuauaagguugcuuccgagggcuuccaguauagcgaucggcgcuggugcuuugacggcgagcggaauaaccaggugcucgaagagaacauggacguagaaaucuggacgaaggagggugagaggaagaagcuccggccccguuggcuggacgcgcggaccuacucggacccccuagcgcucagggaguucaaggaguucgcggccggccggaggagcguguccggggaucugaucuuagagaucggcaagcucccacagcaccuuacccagcgggcccagaacgcccuugauaaccucgugaugcugcauaauucggagcagggggggcgcgcguaucgccaugcuauggaagagcugccagauaccaucgagacucucauguuacuggccuuaaucgcgguguuaacgggcgguguaacccuguucuuccuguccggccgcggguuaggcaaaaccagcaucggccugcucuguguuauggccuccagcgcgcugcuguggauggccuccguggagccccacuggaucgccgccucgaucauccucgaguucuuccugauggugcugcucauccccgagcccgaccggcagcgcaccccgcaagacaaucagcuggccuauguggugaucgggcuccucuucaugauuuugacagucgcggccaaugagauggguuuacucgagacaaccaagaaggaccuggggaucggccacguggcaguggagaaccaccaccacgcagccaugcuggacgucgaccuccauccugcguccgccuggacccuguacgcuguggccacgaccaucauuacucccaugaugcggcacaccaucgaaaacacgaccgccaacaucagccuuacggcgaucgccaaccaggcugcgaucuuaaugggguuagacaagggcuggccaaucuccaaaauggacauuggagugccgcugcuugcguuagggugcuacagucaggucaacccacugaccuugacggccgcuguguuaaugcugguggcccacuacgccauaaucgguccggggcugcaggcgaaggccacccgcgaggcccaaaaacgcaccgcggccggcaucaugaagaacccaacgguggacggcaucguggcgaucgaccucgaccccguggucuacgacgccaaauucgagaagcagcugggccaaauaaugcuccugauccuguguacgucccaaaucuuacuaaugcggacaaccugggcccugugcgagaguaucacccucgccacgggcccgcugaccacccucugggagggauccccgggcaaguucuggaacaccacgauagccguaucuauggcgaacaucuucagggggagcuacuuggcuggcgccggccuggccuucucccugaugaagucccucgguggcgggcgacgagguacuggggcgcagggugagacgcugggcgagaaauggaagagacagcuaaaccaguuguccaaaucagaguucaacacauauaagcgcuccgguaucauggaaguggaucggagcgaggcgaaagagggccugaagcgcggcgaaacgacaaagcacgcugucucgcggggcaccgccaagcuccguugguucguggaacguaaccucgugaaaccggaggggaaggucaucgaucucgggugcggccgcgggggcuggagcuauuacugugccggacugaagaaggugacagaggugaagggauacacuaaaggugggcccggccaugaggagccgauccccauggcgaccuacggguggaaccuggucaaguugcacuccggcaaggacgucuucuucaucccgcccgagaagugcgacacccugcugugugauaucggcgaaagcucccccaaccccaccaucgaggaaggccguacgcuccgcgugcugaagauggucgagccguggcuucgggggaaucaauucugcaucaagauccucaaccccuacaugcccagcgugguagaaacacuggagcagaugcaacgcaagcacgggggcaugcugguucggaauccucuaucccgcaacucgacccacgagauguacuggguguccugcgggacgggcaacaucgugucugccgucaacaugaccucccggaugcugcugaaccgcuucacgauggcccaccgcaagccgaccuacgagcgcgacguggaucucggggccggcacccgccauguggcagucgagcccgagguggcgaaccucgacauuaucggucagcgaauugagaacaucaagcacgagcacaaaucuacuuggcacuacgaugaggauaaccccuacaagaccugggcguaucacggguccuacgaggugaagcccagcggcagcgccuccagcauggucaacgggguggugaaauugcuuaccaagccgugggacgugaucccgauggugacccagaucgccaugaccgacacuaccccauucggccaacagcgcguuuucaaggagaagguugauacccggaccccuaaggccaagcgcgggacggcgcagaucauggaagugaccgccaaguggcuguggggcuuucuaagccggaacaaaaaaccgaggaucugcacccgggaggaguucacccgaaagguccggagcaacgccgccaucggcgcgguguucguggacgagaaucaguggaauucggcgaaggaggccgucgaagacgaacguuuuugggaccucgugcaccgggagcgcgaguuacacaagcaggggaagugugcgaccugcguguacaacaugaugggcaaacgggagaaaaaguugggggaauucggcaaagcuaagggcucccgcgcuaucugguacauguggcugggcgcccgguucuuggaguucgaggcacugggcuucaugaacgaggaccacugguucucccgcgagaauucacucuccggugucgagggcgaggggcugcacaaauugggcuacaucuuaagagacaucucgaagauccccggggguaacauguacgccgacgacaccgccggcugggacacucgcaucaccgaggacgaccugcaaaaugaggccaagaucacggacaucauggagcccgagcacgcucugcucgccaaguccaucuucaagcuaaccuaccagaacaaggugguccggguccagcgcccggccaaaaacgggaccgugauggacgugaucagccgccgugaucagcgcgggucggggcaggucggcacguacggccuaaauacguucaccaauauggaggcccaacugauccggcagauggaaagcgaagguauuuuuucccccagcgaacuggaaaccccgaaccuggcgggccgcguguuagacuggcuggagaaacacgggguugagcggcugaagcgcauggccaucucuggcgacgacugcguggucaagcccauugacgaccgguucgccaccgcccuaaccgcccugaaugacauggggaaggugcgcaaagauaucccgcagugggagccgucaaagggguggaaugacuggcagcagguccccuucuguagccaucacuuccaccagcugaucaugaaggacggccgggagauuguggugcccugucgcaaccaggacgagcucgucggccgggcccgcgugagucagggcgcaggcuggucucugcgggagaccgccugccuggggaaauccuaugcccagauguggcagcucauguacuuccaucgcagggaccugcgauuggcggccaacgcuaucuguagcgccguuccggucgacugggugcccaccagucggaccacuuggagcauccacgcccaccaccaguggaugaccacugaggacaugcucaguguauggaaccgcgucuggauagaggagaaccccuggauggaggacaagacacauauuagcuccuggggcgacguuccuuaccugggcaagcgggaggaccaguggugcgguagccuuaucgggcucacugcgcgcgcuaccugggccaccaacauccaggucgccaucaaucagguccgccgacucaucggcaacgagaacuaucuggacuauaugaccuccaugaagcgcuucaaaaacgaaucggacccugagggggcccucugguaa

SEQ ID NO: 24529 - RNA, 9879 nt, Artificial Sequence
  derived and/or modified CDS sequence (opt11) from DENV-1__EU249491__SS-prME
ucagugacgaugcugcucaugcuuaugcccaccgcacuggccuuccaccucaccacccgaggaggggaaccccacaugauugugagcaagcaggagagaggcaagucgcugcuguuuaagaccagcgcaggggugaacaugugcacccucaucgccauggaccugggcgaguugugcgaggacacgaugaccuacaaguguccccguaucacugaggccgagcccgacgacguggacugcuggugcaacgccaccgauacgugggugaccuacgggaccugcagccagacaggcgaacaccgacgcgacaagcggaguguggcccucgcgccacacgugggccuggggcucgagacacgcaccgagaccuggaugagcuccgagggcgccuggaagcagauccagcgaguggagaccugggcccucagacaccccggguuuacggugaucgcuuuauuccuggcgcacgccaucggcacgaguaucacucagaaggggaucaucuuuauccuacucaugcuggugacccccuccauggccaugcggugcgucggcaucgguagccgcgacuucguggaggggcuaucaggcgccacguggguggacgugguucuagagcacggcagcugcguuaccaccauggccaaggacaagcccacgcuggacaucgagcuccugaagacggaggucaccaaucccgcuguguugcggaagcucugcaucgaggccaagauauccaacaccaccacggacagccgcuguccgacccagggcgaggcgacccugguggaggagcaggacgccaauuucgucugccggcgcacuuucguggaucggggcugggggaacgggugcggguuauucggcaaggggucccucaucacgugcgcaaaguucaagugcgugaccaaguuagagggcaagaucguccaguacgagaaccugaaguauucugucaucguaaccguccauaccggcgaccagcaccaggugggcaaugaguccacggagcacggcaccacagcgaccaucacgccccaggccccaacgaccgagauucagcucacggacuacggggccuugacccuggacugcagcccccgcacgggccucgacuucaacgagaugguccugcugaccaugaaggagaaauccuggcucgugcauaagcagugguuccuggaccugccucucccauggaccagcggcgccagcacuucccaggagaccuggaacagacaggaccuguuagugaccuucaaaaccgcccacgcgaagaagcaggaggucguggugcucggcagccaggagggcgccaugcacaccgcccugacuggggccaccgaaauccagaccucaggaacuacgaccaucuucgcggggcaccugaaaugcagacucaagauggacaagcuaacccugaaaggcaugagcuacgucaugugcacaggguccuuuaaacuugagaaggagguggcggagacgcagcacggcaccguccugguccagaucaaguaugaaggcacggacgcccccugcaagauccccuucagcacccaggaugagaagggggugacgcagaacgggcggcucaucaccgccaaccccaucgugaccgacaaggagaaacccgucaacaucgaggccgagccgcccuucggggaguccuacauagugaucggagcgggcgagaaggcccugaaguugagcugguucaagaagggguccucaaucggcaaaauguucgaggccacugcucgcggggcgcggcgcauggcgauccugggcgacacggccugggacuuuggguccaucggcggaguguucacuagcgucggaaagcuggugcaccagauauuuggcaccgccuacggggucuuguucaguggcgucagcuggaccaugaagaucgggaucggcguacugcugacguggcucggccugaacucccgcagcaccagucugucuaugaccugcauugcgguggggcucgucaccuuguaccuaggugccauggugcaagcagacuccgggugcgugauaaacuggaagggccgggagcucaaaugcgggagcggcaucuucgucacgaacgaggugcacacuuggaccgaacaguacaaguuccaggccgacagcccgaagagacuguccgccgccaucggcaaggccugggaggagggggugugcggcauccggagcgcgacccgcuuagagaacaucauguggaagcaaaucuccaacgaacucaaucacauccugcuggagaacgacaugaagcucaccgucgucgugggggacgucgccggcauccugggacaggguaagaagaugauccggccccaacccauggaguacaaauauagcuggaaguccugggggaaggccaagaucauaggagccgacgcgcaaaauacgaccuucaucaucgacggcccaaacaccccggaaugccccgacgaccaacgggcuuggaacauaugggagguggaagacuacggguucggcaucuuuaccacuaacaucuggcugaagcuacgggacagcuacacccaagugugcgaccaccgccugauguccgccgccaucaaggacagcaaggccguccacgcggacauggguuacuggauugaguccgagaagaacgagaccuggaagcuggcccgggccucguucaucgaggugaaaaccugcauuuggcccaagucccacacauuguggagcaacggggugcuggagucggagaugauuauccccaagaucuacggcgggccgaucucacagcacaauuaccgccccggcuauuucacccagacugccgggcccuggcacuuaggaaagcucgagcuggacuucgaccugugcgagggcaccacgguaguggucgacgagcacugcgggaaccggggcccaucccuccgcacgaccaccgucacggggaagauuauacacgaguggugcugccggagcugcacccugccaccccugcgcuuccggggcgaggaugggugcugguacggcauggagaucaggccaguuaaggagaaggaggagaaccucgugaaguccauggucagugcaggcagcggggagguggacuccuucucacugggccugcucugcaucuccaucaugaucgaagaagucaugcguagccgcuggucccggaaaaugcugaugaccgguacccuggcugucuuuuuccuacugaucaugggccaacugacguggaacgaccucauccgccugugcaucauggugggugccaacgcuagcgaccguaugggcauggggacgaccuaucucgcccucauggccaccuucaaaaugcggcccauguuugcgguggggcuguuguuccgacgguuaacgucucgcgaggugcugcuuuuaaccauaggccugucccugguggccucgguggaacuccccaacucucuggaggagcuuggggacggacucgccaugggaauaaugauccugaagcugcucaccgauuuccagucccaccagcuaugggccacccugcucagcuuaacguucaucaagacaacuuucucccugcacuacgcguggaaaaccauggccauggugcucucuaucgugucccuguucccgcuuugccucuccacgaccucccagaaaaccacuuggcugccgguucugcucgggagcuuaggauguaagccgcuuacuauguuccucaucgcugagaacaagaucugggggcggaaauccuggccccugaaugagggaauuauggccgucgggaucgucagcauccuucucagcucccugcugaagaacgacguuccccucgcaggaccccugaucgcgggcgggaugcugauugccuguuaugugaucuccggcuccagcgccgaccuaucccuagaaaaggccgccgaggugagcugggaggaggaggcugagcacaguggggccagccacaacauccuagucgaaguacaggacgacgggaccaugaaaaucaaagacgaggaacgcgacgacacccugaccauucugcuuaaagccacccuucuggccguguccggggucuacccgcugagcauccccgccacccucuucgugugguacuucuggcagaaaaagaagcagcggucgggggugcugugggacacccccuccccgcccgaggucgagcgcgcgguacuggacgacgggaucuaccggaucaugcaacgcggucugcucggccgcagccaggugggggucggcguguuccaggagaacguguuccauaccauguggcaugucacccgcggggccguucugauguaccagggcaaacgguuagagccgucaugggcauccguaaagaaggaccucaucagcuacggcgggggcuggcgcuugcggggguccuggaacacgggcgaggagguccaggugaucgcgguagagcccgggaagaaucccaaaaacguccagacagcccccggcaccuucaaaacccccgagggcgaggugggggcgauugcccuggacuuuaagcccggcacgagugggucucccaucgugaaccgagagggcaagauugucggccucuacgguaacggcgucgugaccaccagcgggaccuacgucucugccaucgcccaagcgaaggccucccaggagggcccccugccagagaucgaggacgaaguguuccggaagcgcaaccugaccauaauggaccuccaccccggcagcggcaagacccggcgcuaccugccggccaucguuagggaagccaucaagcgaaaacuucgcacacucauucuggcccccacccggguaguggcgagugagauggccgaggcgcugaagggcaugcccauccgcuaucagaccaccgcagucaagagcgagcacaccgggaaggagaucgucgaccucaugugccacgccaccuucacgaugcggcugcugucccccguacgugugccgaacuacaacaugaucaucauggacgaggcgcacuuuacugaccccaguuccaucgccgcccggggcuacaucagcacccgcgucgggaugggcgaagccgccgcgaucuucaugaccgccacaccgcccggguccguugaggcauucccacagucaaacgcugugauccaagacgaggagcgggauauacccgagcgcuccuggaacagcggcuacgaguggaucacagacuuccccgggaagaccgucugguucgugcccuccauaaaaagcgggaacgacaucgcgaacugccuccggaagaacggcaagcgcgugauccaacuaucccguaagaccuucgacacggaauaccagaagaccaagaacaacgacugggacuacguugucaccacggacaucagcgagaugggcgccaacuuccgcgcagaccgggugauugacccgcgccggugccugaagccggucauccucaaggacggaccagagcgcgugauccuggccgggcccaugccugugacgguagccuccgcggcccagcggcguggccggauuggucgcaaucacaacaaggagggggaccaguauaucuacaugggccagccacugaacaacgacgaagaccacgcucacuggaccgaggccaaaaugcuguuagacaacaucaacacccccgaggggaucauucccgcuuuguucgagccggagcgcgaaaaguccgcggccgucgauggcgaguaccgucugcgaggagaggccagaaagaccuucguggagcugaugcgccggggcgaccugcccguguggcucuccuacaagguagccucggagggauuccaguauagcgaccgucgguggugcuucgauggggagcgcaacaaccaggugcuggaggagaacauggauguggaaauauggacgaaagagggugagcggaagaaguugaggccccgguggcucgacgcacgcaccuacuccgacccccuggcguugcgggaguucaaggaguucgccgccggucgccguagcguguccggugaccucauccuggagaucggaaagcugccgcagcaccucacccagcgcgcgcagaaugcgcuggacaaccuggucaugcuccacaauagcgagcagggcgggagagcguaucgccacgcgauggaggaacuacccgacaccaucgaaacguuaaugcuccuggcccugaucgcugugcucaccgggggcgugacccuguucuuccucuccgggcggggccucggcaagaccagcauuggguuacugugcgucauggcgaguagcgugcuccuguggauggcuuccguggagccacauuggaucgccgccagcaucauccuggaguucuuccucaugguccuguugauccccgagccggaccgccagcggacgccgcaggacaaccaacucgccuacgucguaauuggccuacucuucaugauauuaaccgucgcggccaaugagauggggcuguuagagaccaccaaaaaggaucucggcaucgggcacguggccgucgagaaccaccaccacgccgccaugcuagacgucgaucugcaccccgccagcgcguggacccuauacgccguggccacgaccaucaucaccccuaugaugcgccacaccaucgagaacacgaccgccaacauuagccugaccgcuauugccaaccaggccgcgauacugaugggccucgacaaggguuggcccaucuccaagauggacaucggggugccccugcuggcgcuggggugcuauagccaagucaacccccugacccugacggccgccguacucaugcugguggcccacuacgcuaucaucggaccaggccugcaggcgaaggccacucgcgaggcucagaagcggaccgcugccgggaucaugaagaaccccacggucgacggcaucguggcgaucgaccuagaccccgugguuuacgacgcuaaguuugagaaacaguugggccagauaaugcugcucauccugugcacgucccaaauccuucuaaugcggaccaccugggcccugugcgagagcauaacgcuggcaacggggccgcucaccacguuaugggagggcuccccagguaaguucuggaacaccacgaucgcugugagcauggcgaacaucuuucguggcagcuaccuggcgggcgcagggcucgccuucagccugaugaagucccugggcgggggccgccgggggaccggcgcgcagggugagacccucggagagaaguggaagcggcagcugaaccaacugucgaaaagcgaguuuaauaccuacaagcgguccggcaucauggagguggaccgcucugaggccaaggaagggcucaaacggggcgagacuaccaagcacgccguuuccagggggaccgccaaacucaggugguuuguggagcgcaaccuggugaagcccgagggcaaggucaucgacuuagggugcgggcgaggcggguggagcuacuacugcgccgggcuuaagaaggugaccgaggugaagggcuauacgaaagggggacccgggcacgaggagcccaucccaauggccacguauggcuggaaccuggugaagcuacacuccggcaaggacguguucuucaucccgcccgagaagugcgacacccuccugugugacaucggcgaaucgucccccaauccaaccaucgaagaggggcgcacccuacgggugcuuaagauggucgagccuugguugcgagguaaccaguucugcaucaagauccugaacccguacaugcccagcgugguugagaccuuagagcagaugcagcggaagcauggcgggaugcugguacgcaacccgcuguccaggaacagcacccacgagauguacuggguguccugcggcaccgguaauaucgugucugccguaaacaugaccucgcgcaugcuccugaaccgguucacuauggcccaccggaagcccacauacgagcgcgacguggacuugggcaccggcacccgacacguggccgucgaacccgagguggccaaccucgacaucaucggccagcgcaucgagaacaucaagcaugagcacaagucaacguggcacuacgacgaggauaaccccuacaagacuugggcguaccacggcuccuacgaggugaagccgagcggauccgccagcagcaugguaaacggcguggucaagcugcugaccaagcccugggaugugaucccgauggugacccagaucgcgaugacggacacaacccccuucgggcagcaacgggucuuuaaggagaaaguggauacacgcacgccgaaggccaagcggggaacggcccaaauaauggaggugacggcgcgcuggcucuggggcuuccugucccggaauaagaagccacgcaucugcacccgggaggaauuuacgcgcaagguccgaagcaacgccgccaucggggcuguguuuguggacgagaaccaguggaacucagcgaaggaggccgucgaggacgaacgcuucugggaccuggugcaccgggaacgcgaacuccacaagcagggcaagugcgcgacaugcguguacaacaugauggggaagagggagaagaagcugggcgaguucgggaaagccaaaggaucucgcgcaaucugguauauguggcugggcgcgcgguuccucgaguucgaggcccugggguucaugaacgaagaucacugguucucccgcgagaacagccuguccggcgucgaaggggagggcuugcacaaacugggguacauccugcgcgacaucagcaagaucccaggcggcaacauguacgccgacgacaccgccgggugggauacccgcaucaccgaggacgaccuccagaaugaggcgaagaucaccgacaucauggagccagaacacgcacuguuagccaaggccaucuucaagcuaaccuaccagaacaaaguggugcgcguccagcguccggccaaaaacggcaccgugauggacgugaucucccgucgggaccaacgcgggucuggccagguaggcaccuacggguuaaacaccuucaccaacauggaggcccagcuuauccggcagauggaguccgagggcaucuucucaccaagcgagcucgaaacccccaaccuggcugagcgcgcgcuggacuggcucgagaaguacgggguugagcggcugaagcgcauggccaucagcggcgaugacugcguggucaagccgaucgacgaccgguucgccacggcccugaccgcgcucaaugacauggggaagguucgcaaagacaucccacagugggagcccuccaagggcuggaaugacuggcagcagguccccuucugcagccaucauuuccaccagcugaucaugaaggauggcagggagaucguggugccgugccgcaaccaggacgagcucgucgggcgggcucgcguuucgcagggggcgggguggucgcucagagagaccgcgugucugggcaagucauacgcgcagauguggcagcugauguacuuccaccgccgggaccuccgccuagcagccaacgccaucugcuccgcuguucccguggacuggguccccacuagccggacgaccugguccauccacgcgcaccaccaauggaugaccaccgaggacaugcugucgguguggaaccgcguguggaucgaagaaaaccccuggauggaagacaagacgcacaucuccucaugggaggacgucccguaucucgggaagcgcgaggaccaguggugcgggucccuuauuggucugaccgcgcgcgcgaccugggccaccaauauccagguggccaucaaccagguacgcagacucaucgggaacgagaauuaccuggauuacaugaccagcaugaaacgcuucaagaacgagagugauccggagggcgcgcugugguaa

SEQ ID NO: 24530 - RNA, 9879 nt, Artificial Sequence
  derived and/or modified CDS sequence (opt11) from DENV-1__EU249492__SS-prME
agcgugaccaugcugcuuaugcugaugcccaccgccuuagccuuccacuuaaccacucgcggcggggagccccacaugauugugagcaagcaagagcggggcaagagccugcuguucaagacaagcgccggugugaacaugugcaccuugaucgccauggaccugggcgaguucugugaggacacgaugaccuacaagugcccucgcauuaccgaggccgagcccgacgacguggacugcuggugcaacgcaaccgacaccugggucaccuacgggacgugcagucaaaccggcgaacauagacgcgacaagagauccguggcccuggcgccccaugucggccucgggcuggagacgaggaccgagaccuggaugucuuccgagggcgccuggaagcagauccagcgggucgagaccugggcccugcgccaccccggguuuacggugaucgcucucuuucuggcgcacgccaucggcaccagcauaacacagaaggggaucaucuucauuuuacugaugcuugugaccccaucuauggccaugcggugcguuggcaucgguagccgcgacuucguggaagggcucucgggagccacguggguagauguggugcucgagcacgggucaugugugaccaccauggccaaggauaagcccacccuggacaucgagcugcucaagacggaggucacaaaccccgcggugcugcggaaacugugcaucgaggccaagaucaguaacaccaccacugacucgcgcugcccgacccagggcgaagcaacucugguggaggagcaagacgccaauuucgucugucggcgcacauucguugaccggggcugggggaacggcuguggguuguucggcaaggggucguugaucacgugcgccaaguucaaguguguuaccaaacucgagggcaagaucguccaguacgagaaccugaaguacagcgugaucgugaccguccauaccggcgaucagcaccaggugggcaacgagaguacggagcacggcaccaccgcuaccauaacuccccaggcucccagcacggagauccagcuuacggacuacggcgcccucacccuggauugcuccccccggaccggccuagacuucaacgagaugguccuccugacgaugaaggagaaguccuggcuggugcacaagcagugguuccuggaccugccgcugcccuggacgagcggcgccuccaccagccaagagaccuggaaccgacaggaccuccucgugaccuucaaaaccgcccacgcgaagaagcaagaggucgugguguuaggcucccaagagggcgccaugcacacggcccucaccggggccacggagauacagaccagcggcaccaccacuaucuucgcugggcaccugaagugccgccugaagauggauaaguuaaccuugaagggcaugaguuacgucauguguaccgggagcuuuaagcuggagaaggagguggcggagacccagcacgguacugugcucguacagauuaaguacgagggcaccgacgcccccugcaagauccccuuuaguacccaggacgagaaaggggugacccaaaacggcagauugaucacggccaauccgaucgugaccgauaaggagaagcccgucaacaucgaggccgaaccgcccuucggggagagcuacauugugaucggcgcgggcgagaaagcccugaaguuguccugguucaaaaaagggaguuccauagguaagauguucgaggccaccgcccgcggggcccggcgcauggcgauccucggagacaccgccugggacuucgggagcauagggggcguauucacguccguagggaagcuggugcaccaaaucuucggcaccgccuacggggugcuguucagcggcgugucauggaccaugaagaucgggaucggaguacuccuaaccuggcugggccugaauucccgcuccacaagccugucaaugaccugcauagccguggggcugguuacccucuaccucggcgugauggugcaagccgauucagggugcguaaucaacuggaagggccgggaacugaagugugggaguggcaucuucgugaccaacgaggugcacacuuggaccgagcaguauaaguuccaggcggacagcccgaagcgccucagcgcugccaucggcaaggccugggaggagggggucugcggcauaagauccgcaacccgccuggaaaacaucauguggaagcaaaucuccaacgagcugaaccacauucuccuggagaacgacaugaagcuaacggugguggucggggacguggcgggcauacucgcccagggaaaaaaaaugaucaggccgcaacccauggaguauaaguacuccuggaaguccuggggcaaggccaagaucauaggagccgaugugcaaaacacuacguucaucaucgaugggcccaacaccccggagugccccgaugaccagcgcgcguggaauauaugggaggucgaggacuacggcuucgggaucuucacgaccaacaucuggcugaagcugcgugacuccuacacgcagaugugcgaccaccgccucaugagugccgcaaucaaggacuccaaagccgugcacgccgacaugggcuacuggaucgagagcgagaagaacgagaccuggaagcucgcgcgggccuccuucaucgaggugaagaccugcaucuggcccaagagccacacccuguggucgaacggcguccucgagagcgagaugaucauccccaagauauacgggggcccgaucucccagcacaacuaccgcccuggguacuucacgcagaccgccggaccuuggcaucuggggaaguuggagcucgacuucgaccugugcgaggggaccaccguggugguugacgagcacugcggcaaccgggggccgagucugcgcacgaccaccgucaccggcaaaauuauccacgaauggugcugccgguccugcacauuaccgccccugcgcuuuaagggggaggaugguuguugguacgggauggagauccggccugugaaggaaaaggaggagaaccuggucaagucgauggugagcgccggcuccggcgagguagacagcuucucccucggucugcuuugcaucagcaucaugaucgaggaagucaugcgcucccgguggucgcgcaagaugcucaugaccggcacccucgccguguuuuuccugcucaucauggggcagcugaccuggaacgaucuaaucagacucugcaucauggugggcgcgaacgccucggaccgcaugggaaugggcacaaccuaccuggcucugauggccacauucaagaugaggccgauguucgcugucggucuccuguuuaggcgccugaccagccgggagguccuacugcugacuaucgggcugucccugguggcgagcgucgaacugcccaacucccucgaggaacugggagacgggcuggccaugggcaucaugauccucaagcugcugaccgacuuucagagccaccagcucugggcaacccugcugucgaugaccuucauccgcacgaccuucagccuccauuacgccuggaagacgauggcgaugguccugucgaucgucagccuguuuccucucugcuuauccaccacgagccagaagaccaccuggcugcccgugcuccugggcucccugggauguaagccacucaccauguuccugaucgccgagaacaagaucuggggccgcaagagcuggccccugaacgagggcaucauggccgugggcaucgugagcaucuuacuguccagccugcucaagaacgacgugccccuggccggaccccugaucgccggcggcaugcucauagcgugcuacgugaucuccgggagcuccgccgaucuuagccuggagaaggccgccgagguauccugggaggaggaggcggagcacagcggcgcgucccacaacauccucguggaggugcaggaugacgggacgaugaaaaucaaggacgaggagcgcgacgacacccugaccauccugcucaaggccacccugcuggccgucagcggcguguauccgcucuccauccccgccacacuguucgugugguacuucuggcagaagaagaagcagcggagcggcgugcugugggacacgcccagcccgccugagguucagcgugccgugcuugaugaugguaucuaccgaaucaugcagcgcggacugcuugggaggagccaggucggcguggggguguuccaggagaacgucuuccacaccauguggcacgugacccgcggcgcggugcugauguaccaggggaaacggcucgagccgucaugggccagugucaagaaggaccugaucuccuacgguggagguuggcgccuccaggggagcuggaacacgggggaggagguccagguaaucgccgucgaaccuggcaagaaccccaagaacgugcagacggcccccggaaccuuuaagacauccgagggcgaggugggcgccauagcgcucgacuucaagccagggaccagcggcagccccauagucaaccgggaggggaagaucgugggccuguauggcaacgggguggucacgacuucuggcacauacgugagcgcaaucgcccaggccaaggcgagccaggaagggccacugccggagaucgaggacgagguguuccgcaagcggaaucucaccaucauggaccugcacccgggcucuggcaaaacucgucgguaccugcccgcgauaguccgcgaggcuauaaagcggaagcuccgcacccugauccuggcuccuacccgagugguggccuccgagauggcggaggcccucaagggcaugccgauccgguaccagacuacggccgucaagagcgaacacacgggcaaggaaaucguggaccugaugugccacgccacauucaccaugcgcuuacucucgcccgugagagucccgaacuacaacaugaucaucauggaugaggcccacuucacggauccgucauccaucgcggcccgcggguacaucagcacacggguggguaugggggaggccgccgccauuuucaugacagcgacgccgcccggcuccguggaggcuuucccccagagcaacgccgucauccaggacgaggagcgcgacaucccggagcgguccuggaacagcggguacgaguggaucacggacuuccccggaaagaccgugugguucgugcccuccauuaagagcgggaacgacaucgccaacugccuucgaaagaaugggaagcgggucauccagcucucccgcaaaacuuucgauaccgaguaucagaagacuaagaacaacgacugggauuacguaguaaccacugacaucagcgagaugggagcgaauuuccgggccgaccgcgugaucgauccccggcgcugccucaagccggucauccugaaggaugggcccgagcgggugauccuggccgggccuaugccagucacaguggccagugcggcgcagcgccgggggagaaucggcagaaaccauaacaaggagggcgaccaguacaucuacauggggcagccgcucaauaacgacgaggaccaugcgcacuggacggaagcaaagaugcugcuggacaacaucaacacccccgagggcaucauucccgcucuuuucgaacccgagcgcgagaaguccgcagcgaucgauggcgaguaccgccuaagaggggaggcucgcaagaccuuugucgaacugaugcggaggggggacuugccgguauggcucagcuacaagguggccuccgagggcuuccaguacagcgaccggcgcuggugcuucgauggcgagcggaauaaccagguccuggaggagaacauggacguggagaucuggacaaaggagggggagagaaagaaguuacggccgcgcuggcuugacgcccggacguacuccgacccccucgcucugcgcgaauucaaggaguuugcggccggaaggcgcucaguguccggggaccuaauccuggagaucggcaagcucccucaacaucugacucagcgugcacaaaacgcccuggacaaccucgucauguuacacaauagcgagcagggcggccgcgccuaccggcacgccauggaggaguuaccggacaccauagaaacccucaugcugcuugcccucauagccguuuuaacgggcgggguaacgcuguucuuccucuccggucgcggccugggcaagaccagcaucggccuucuaugcgucauggcguccaguguccugcuuuggauggcgaguguggagccccauuggaucgcugccucuauaauucucgaguucuucuuaaugguccugcucaucccggagcccgaccggcagcgcaccccucaggacaaccagcuggcauacguggugaucgggcuccuguucaugauccugaccgucgccgcgaaugaaaugggucugcucgagacgaccaaaaaggaccugggaaucggccauguggccguagagaaucaccaccacgccgccauguuggacgucgaccuccaccccgccuccgcauggacacuauaugcgguggcgacgacgauuaucacccccaugaugcggcacacgaucgagaacaccacggccaacaucagccugaccgccaucgcgaaccaggccgccauccucauggggcuggacaaaggcuggccaauuuccaagauggacauuggcgugccccugcuagcccuggggugcuauagccaggucaacccccugacccucaccgcggcgguucugaugcugguggcccauuacgccaucaucggccccggccuccaggccaaggcgacgcgcgaggcacaaaagcgcaccgcugcaggaaucaugaagaacccaaccgucgacgggaucguggccaucgaccuggaccccguggucuacgacgcgaaguucgagaagcagcugggucagauaaugcuccugauccugugcaccucucagauccuccugaugcgcaccaccugggcccugugcgaaaguaucacccucgccaccggcccucugacgacccugugggaggggucccccggcaaauucuggaacaccacgaucgccgugagcauggccaacaucuuccgcggaagcuaucucgcgggcgccggccuggccuucucccugaugaagucucucgggggcucccggcgcgggacgggcgcccagggggaaacccugggagagaaauggaagcgacagcucaaccagcucagcaaauccgaauucaacaccuacaagcgcagcggcaucauggaaguggaccgguccgaggcgaaagagggguugaagcgcggcgagacuacgaagcacgccgucagcagggggaccgccaagcugcgcugguuuguggagcggaaccucgugaagccagaaggcaaggucaucgacuuggggugcggccggggggggugguccuauuacugcgccggccugaagaaggugacggagguaaagggguacaccaagggcggucccggccacgaggagcccaucccgauggccacuuacggcuggaaccuagucaaacuccacagcggaaaggacguuuucuucauuccgccggagaagugcgacacccuucucugugacaucggcgaguccagcccaaaccccacuauagaggaggggagaacucuucgcgugcuaaaaaugguagaaccguggcugcggggcaaccaguucugcaucaaaauccucaaucccuacaugcccuccguaguggagacgcuggagcagaugcagcgaaagcacgggggcaugcugguccggaacccacucagccgcaacucuacccacgagauguacugggugucuugcggcacagguaacaucguuuccgcagucaacaugaccagccggauguuauuaaaccgcuucacgauggcucaccgcaagccgacauacgagcgugacguugaccucggugccgguacccgccacguggccgucgagcccgaaguggcgaauuuggauauuauuggccagcggaucgagaacaucaagcacgagcauaaguccaccuggcacuacgacgaggacaaccccuacaagaccugggcuuaccacggcuccuaugaggugaagccgagcgggagcgcgagcucaauggucaacggcgugguaaaguuacuuacgaagccgugggacguuauccccauggugacccagaucgccaugaccgacaccacgccuuucggucagcaacgcgucuucaaggagaagguggacacccgcaccccaaaggccaagcguggcacggcccagaucauggaggugacggcgaaguggcuguggggguuccugagccgaaacaagaagccgagaaucugcacccgggaggaguucacacgcaagguucgguccaacgccgccaucggugccguauuuguugacgaaaaucaguggaacucugcgaaagaggccgucgaggacgagcgcuucugggacuuaguacaccgggagagggagcuacacaagcagggcaagugcgcgaccugcguguacaacaugauggggaagcgcgagaagaagcuuggcgaguucggaaaagccaaggguucccgcgccauaugguauauguggcucggggcccgguucuuagaguucgaggcccuagguuucaugaacgaggaucacugguucagccgagagaacucccucagcggcgucgagggggagggccugcacaagcuaggguacauccuccgggacaucuccaagauccccggcggaaacauguacgccgacgacacggccggcugggacacccgcaucaccgaggacgaccugcagaacgaggccaagaucacagacaucauggagcccgagcacgcgcugcucgccaagagcaucuucaagcugacguaccaaaacaagguggugcggguccagcgcccggccaagaauggcaccgugauggacgugaucucccgccgggaccagcgcgggagcggacagguagggaccuacggccugaacacguuuacuaacauggaggcccagcucauccggcagauggagagcgagggcaucuucucacccagugaacuugacaccccgaaccuggccgggagagugcucgacuggcuggagaagcacggcgucgagcggcugaagcgcauggcgaucagcggggacgacugugucguaaagccgaucgaugacagguucgccaccgcccucaccgcccuuaaugacaugggcaaggugcgcaaggauaucccccagugggagccgagcaagggcuggaaugacuggcagcagguuccauucugcucccaucacuuccaccagcugaucaugaaggacggccgggagaucgugguccccugccgaaaccaagacgagcucgucggccgggcccguguaucgcaaggggcgggcuggucccugcgggagacggccugccugggcaagagcuacgcccagauguggcagcucauguacuuccacaggcgggaccuacgacuggcggcaaacgccauuugcuccgccgugccggucgacuggguaccaaccagccggaccaccugguccauccaugcccaccaccaguggaugacgacggaggacaugcucagcguauggaacagagucuggauugaggagaacccguggauggaggacaagacccacaucuccaguuggggcgacgugcccuaccuugggaagcgggaggaccaguggugcggcucccugaucggccucaccgcccgcgcgacaugggcuacaaacauccagguggccauaaaucagguucgccggcugcuggggaacgagaacuaccucgacuacaugaccagcaugaagcguuucaaaaaugagagcggcccggagggggcgcugugguga

SEQ ID NO: 24531 - RNA, 9879 nt, Artificial Sequence
  derived and/or modified CDS sequence (opt11) from DENV-1__EU249493__SS-prME
agcguaacaauguugcucaugcugaugcccaccgcgcuggccuuccaccucaccacgcggggcggagagccccacaugauuguuagcaagcaggagagaggcaagagccuccuguucaaaacgagcgccggggugaacauguguacccuaauugcaauggacuugggcgaguuuugcgaggacacgaugacuuacaagugcccgcgcaucaccgaggccgagcccgacgacguugacuguuggugcaaugcuaccgauacguggguuaccuaugggacuugcagccagaccggcgagcaccggagagauaagcgcuccguagcccucgcgccccacguaggcuugggauuagaaacacguaccgagacguggauguccuccgagggggccuggaagcaaauccagcggguggagacgugggcguuacgccaccccggguucaccgugaucgcccucuucuuggcgcacgccauuggcacgagcauuacccagaaggggaucauuuucauccugcucaugcuuguaacccccuccauggcgaugcguugcgucggcaucggcucucgcgacuucguagaggggcugucgggcgccacuuggguggacgucguccucgagcaugggucgugcgugaccacgauggccaaagauaagcccacguuagacauugagcugcucaaaacggaggucacgaaccccgccgugcugcggaaacugugcauugaggccaaaaucucaaauaccaccacggacagccguugcccgacccagggcgaggcaacccucguggaagagcaggacgccaacuucguguguaggcguaccuucguggaucggggcuggggaaacggcugcggucuguuugggaaggggucgcugaucacaugcgccaaguucaaaugcguuaccaagcuagagggcaagaccguccaguacgaaaaccugaaguacagcgugaucguuacgguccacaccggcgaucagcaccagguggggaacgaauccaccgagcacggcacuaccgcaacgaucacgccccaagcucccagcaccgagauccagcuuaccgacuacggugcccucacccuggacugcagccccaggacggggcuggacuuuaacgagaugguccuccuaaccaugaaggagaagucguggcuggugcauaagcagugguuccucgauuuaccacugccuuggaccagcggggcauccacuagccaggaaacauggaaccggaaggaccuccugguuacguucaagaccgcccacgcaaagaagcaggaaguagugguguugggcucccaggaaggcgccaugcacaccgcccucacgggugccaccgagauccagacgagcggcaccacaaccauauucgcugggcaccugaaguguaggcugaaaauggauaagcucacccugaaggggaugaguuacgucaugugcaccggcagcuucaagcuggaaaaggagguugccgagacgcagcaugguaccgugcucgugcagaucaaguaugagggaaccgacgcccccugcaaaauccccuucuccacccaggacgagaagggggugacgcagaacggccggcucauuacugccaacccaaucgugacagacaaagagaagccagucaacaucgaggcagagccgccguuuggggagucguacaucgugauuggcgcaggcgagaaagcccuuaaacuguccugguucaagaaaggcagcuccaucggcaagauguuugaggcgaccgccaggggugcccggcggauggcgauccucggugacacggcuugggacuuugggaguauuggcgggguguucaccuccgucgguaagcuggugcaccaaaucuucggcacggcguacggagugcuguuuagcggcgucuccuggaccaugaagauagggaucgguguccuccugacguggcuaggccucaacagccgcuccaccagccugaguaugacauguauugccguggggcucguaaccuuguacuugggggugauggugcaggccgauucugggugcgugaucaacuggaagggacgggagcuaaaaugugggagcgggauauucgugacuaacgaggugcauaccuggaccgagcaguauaaauuccaggcggauaguccgaaacgccucucugccgccauaggcaaggcaugggaggaaggggucuguggcauccgguccgccacacgccuggagaacaucauguggaagcagauaagcaacgaacugaaccacauccuccuggagaaugacaugaaguucaccguggugguuggugacguggccggcauccuggcccaagggaagaaaaugauccggccccagcccauggaguacaaguacuccuggaaguccuggggcaaagccaagaucauuggggcggacguucagaacacgaccuuuaucauagacgggcccaacacaccugagugccccgacgaccagagagcauggaacaucugggagguagaggacuauggguucggaaucuucaccacgaacaucuggcucaaacugcgggacuccuacacgcagguuugcgaccaccgccuuaugagcgcggccaucaaagacuccaaagcgguccacgcugacaugggcuacuggaucgaguccgagaaaaacgaaaccuggaagcucgcccgggccucuuucaucgaggucaagaccugcaucuggccaaaaagucacacgcugugguccaacggaguccuagagucggagaugauuauacccaagaucuauggagguccgauaucccagcacaacuaccgccccggguacuuuacacagaccgccggcccuuggcacuuagggaagcuggagcuggacuucgaccucugcgaagggacuacgguuguagucgaugagcauugcgguaaccgggggccuucauugcgcaccaccaccgugacuggcaagaucauucaugaguggugcugccguuccugcacacugccgcccuuaagguucaagggggaggauggcugcugguacgggauggagauccggccugucaaggagaaagaggagaaccugguuaaauccauggugagcgccgguucaggagaggucgacagcuucagccugggucuccugugcauaucuaucaugauagaagaggugaugagaucgcgguggucgcgcaagaugcugaugacuggcacccuugcaguguuuuuccuguugauaauggggcagcuuacguggaacgacuugauccgucugugcauaauggucggugcgaacgcuagcgaccgcauggggaugggcaccacuuaccucgcccugauggcaaccuucaagaugcgucccauguucgccguggggcuccuguuccgccgccugacguccagggagguacugcuccugacgauagggcugucccucguugcgagcguggagcugcccaacucccuugaggagcucggcgauggacuggccaugggcaucaugauucugaagcuccuuaccgacuuccagucucaccaacugugggccaccuuacucagucugacguucaucaagaccaccuuuucucuccacuacgccuggaagacuauggcgaugguccugucgaucgugucgcuguucccgcugugucugaguacgacgagccagaaaacaaccuggcugccugugcuccugggcucccugggaugcaaaccguuaaccauguuccucauagcugaaaacaagaucugggggagaaagagcuggccucugaacgaggggaucauggcggugggcauuguuaguauccuccugagcucacugcugaagaaugacguaccucuggcagggccccugaucgccggcggcaugcucaucgccugcuaugucauauccgguucguccgcagaccugagccuggagaaggcggccgaggugucgugggaggaggaagccgaacacagcggcgccucgcacaacauccugguggagguccaggaugacgggacuaugaagaucaaggaugaggaaagggacgacaccuuaacaauccugcucaaagccacccugcuugcggucagcggcguguacccgcucucuaucccagcaacguuguucgucugguacuucuggcagaagaagaaacagcgcagcggggugcugugggacacgcccagcccgcccgaagucgagagggccgugcuagacgacggcaucuacagaaucaugcaacgggggcuacucggcaggagucaggugggcgugggcgucuuccaggagaacguauuccacaccauguggcaugugacucggggggcggucuuaauguaccaggggaagcgacuggagccauccugggccagcguuaagaaggaccuaaucaguuacggcggcggguggcggcugcaggggucuuggaacacuggggaagagguucaggucaucgcaguggagccuggcaaaaacccaaagaaugugcagaccgcccccgggaccuuuaagaccuccgagggugaaguuggagccaucgcgcuggacuucaagccugguacgagcggcagcccgaucguuaaccgcgaggggaagauagugggucuguacgggaacgggguggugaccacgucaggcaccuacgugagcgccaucgcucaggccaaggcgucccaagaggggccucugccagagaucgaagacgagguauuccguaagcgcaaccucaccaucauggaucugcaccccggaagcggaaagacaaggcguuacuugcccgcuaucgugcgggaggcgaucaagaggaaacucaggacccugauucuggccccgacaagaguagucgccuccgagauggccgaggcccucaagggcaugcccauccgcuaccagacgaccgccgucaagucagaacacacggguaaggagaucguggaccugaugugccacgccaccuucacgaugcgauugcucucccccgugagaguucccaacuacaacaugauuaucauggacgaggcccauuucaccgacccuagcaguauugccgcccggggguacaucagcacccgcguuggcaugggggaggcagccgccaucuuuaugaccgcgacucccccggguucgguugaagcguuuccccaaagcaacgccguuauccaggaugaggagcgggauaucccggagcgcuccuggaacagcggcuacgaguggaucaccgacuuccccggaaagaccgugugguucguccccuccaucaagagcggcaacgauauagcuaauugccuacggaagaaugggaagcgcgugauccaguugucccgaaagacuuuugauacggaguaccagaagaccaagaauaacgacugggauuacgucgugaccacagauauaagcgagaugggagcgaauuuucgggccgaccgggucaucgacccccggcggugccucaagccgguuauccugaaggaugggcccgagcgcguuaucuuagccgguccuaugcccguaacggucgccuccgccgcucagcgacgagggcggaucggccgcaaccacaacaaggagggagaccaguacaucuacauggggcaaccgcucaacaacgacgaggaccacgcacacuggaccgaggcaaagauguugcuugacaacaucaacacccccgagggcaucauccccgcccuuuuugaacccgaacgugagaaguccgcggcgaucgacggggaauacagauuacgcggcgaagcccggaaaaccuucguggaacucaugcgccgcggggauuugcccguguggcugagcuacaaggucgcguccgagggcuuccaguauagcgaccgccgguggugcuucgacggcgagcgcaacaaccaggugcuggaggagaauauggacguagagaucuggacgaaagagggugaacggaagaaguugaggccccgaugguuggacgcgcgcaccuacuccgacccccuggccuugcgggaguucaaggaauucgcggccggacgacggucugucuccggggacuugauacuggagauuggcaagcuuccucagcaccuaacccagcgcgcccaaaacgcucuggauaaccucguaaugcugcacaacagcgagcagggggggcgggccuacaggcacgccauggaggagcugccggauacaauugaaacguuaaugcugcuggcccuuaucgccgugcugaccggaggggugacccuguuuuuccucuccggcagagggcucgguaaaacaagcauaggccuucucugcguaauggcuagcagcguacugcuguggauggcgagugucgagccucacuggaucgcagccaguaucauccucgaguucuuccugaugguguuacucauccccgagccugaccgccagcgaaccccgcaggacaaccaacuggcuuacguugugauuggguuacuauuuaugaucuuaacugucgccgcgaacgaaaugggauuacucgaaaccaccaagaaggaccuugggaucggccacguugccgucgaaaaccaccaccacgcugccaugcuggacguggaccuccaccccgccuccgcauggacccucuacgccguggccacgacaaucaucacaccaaugaugcggcacaccaucgagaacacgaccgccaacaucagccugacugcgauugcgaaucaggccgcuauacucauggggcuggacaagggcuggccgauauccaagauggacaucggcgucccgcugcucgccuuagggugcuauagccaaguaaacccucuaacgcugacggcugccguacuuauguuagucgcccacuacgccauaaucggcccaggguuacaggccaaggcgacccgugaggcacagaagcgcaccgcggcgggcauuaugaagaacccgaccguggacgguaucguggccauagaucuggaccccgucguguacgaugcgaaguucgaaaagcagcuaggccagaucaugcuacugauacugugcacgucacaaauauugcugaugcgcacaacaugggccuugugugaaucaauuacccucgcaacgggaccgcucaccaccuuaugggagggcagcccuggcaaauucuggaacaccacgaucgcagugucuauggcaaauauuuucagggggagcuaccuugcgggcgccggacuagcuuucagccuaaugaaguccuuggggggcgggagacggggcacuggggcccagggcgagacucugggcgagaaguggaagcgccagcugaaccaguuauccaagagcgaguucaacaccuacaagcggucugggauuauggaggucgaucgcucggaggcgaaggagggacugaagcgcggggagacgacuaagcacgcgguaucccgcgguaccgccaagcugcgaugguucgucgagcguaacuuggucaagccugaagggaaaguuaucgauuuaggcugcggcaggggcggguggagcuacuacugcgccgggcucaaaaaggugaccgaaguuaaagguuacacuaagggcgggccaggccacgaggagccaaucccuauggccacguacggguggaaucuggugaagcuacacuccggcaaggacguauuuuucaucccucccgaaaagugcgauacccugcugugcgauaucggggagucaucccccaaccccacgauugaggaaggccgaacgcuccgggucuugaagaugguagagccguggcugcgcgggaaccaguucugcauuaagauucuaaaccccuacaugcccagcgugguggaaacgcuggaacagaugcagcggaaacacgguggaauguugguccggaaucccuuguccaggaacagcacucacgagauguauugggugagcugcgggaccgguaacaucgucucggcggugaacaugacaucccguaugcuucucaaucgguucaccauggcccauagaaagccaaccuacgaacgagacguugaucucggggcgggcaccaggcacgucgccguggagccggagguggccaaccuggacaucaucgggcagcgcauugagaacaucaagcaugaacauaagagcacuuggcauuacgacgaggauaacccauauaagacaugggcguaccacggcucguacgaggugaagcccagcggaucggccuccucuauggugaauggggucguuaaacuacucaccaagccaugggacgucauccccauggucacgcagauagccaugacugacacgaccccauucggccaacaacgggucuuuaaagagaaagucgauacgcguacccccaaagccaagcgggggacggcgcagaucauggaggucaccgcgaaguggcuguggggguuucucucccggaacaagaagccgagaaucuguacgcgcgaagaguucacccggaaagugcggagcaacgccgccaucggugcuguguucgucgacgaaaaccaauggaacuccgcgaaagaggccguggaagacgagcgguuuugggaccuggugcaccgcgagcgggagcugcacaagcaggggaagugcgccacgugcgucuauaacaugaugggcaagagagagaagaaacugggagaguucggaaaagccaaaggcucacgcgccaucugguacauguggcuaggcgcgcgcuuccuggaguucgaggcccugggcuucaugaacgaggaccauugguucucucgggagaacagccucuccgggguggagggcgagggcuuacauaagcuaggauacauccuucgcgacaucagcaagauccccgggggcaacauguacgccgacgacaccgcaggaugggacacccggaucaccgaggacgaccuacagaaugaggccaagaucacggacauaauggagccagagcaugcgcuacucgccaagaguaucuucaagcugaccuaccagaacaaggugguccguguccagagaccggccaagaacggcaccgucauggaugugaucagccgaagagaucagcguggcucuggacaggugggcaccuauggccugaauacguucaccaauauggaggcccaacuaauccgccagauggagagcgagggaaucuucuccccgucugagcuggagacccccaaccuggcgggccgggugcucgacuggcuggagaagcacggcgucgagcgcuugaagcggauggcgauaagcggugaugacugcguggucaagcccauugacgauagauucgcuaccgcccucacggcccugaacgacauggggaaaguucgcaaagauaucccacagugggagcccagcaaaggcuggaaugacuggcagcagguccccuucugcagccaccacuuucaucaacucauuaugaaggacgggcgcgagaucguggucccgugccggaaccaggacgagcuagugggucgcgccagggugucccagggagcggguuggagccugcgcgacacggccugcuuagggaaguccuaugcacagauguggcagcucauguacuuucaccggcgcgaccuccgccuggccgcuaaugccaucuguucagccgucccaguggacugggugcccaccucccgcaccacguggucgauacacgcccaccaccaguggaugaccacggaggacaugcucuccguuuggaaccguguauggauugaagagaacccguggauggaagacaagacccacauaagcucguggggcgacguucccuaccugggcaagcgcgaggaccagugguguggcagcuuaaucgggcuaacagcccgugcaaccugggccaccaacauccaggucgccaucaaucaggugcgccgccugaucggaaaugaaaacuaccuugacuacaugaccucaaugaaaagguucaagaaugaguccgacccggagggggcccucugguga

SEQ ID NO: 24532 - RNA, 9879 nt, Artificial Sequence
  derived and/or modified CDS sequence (opt11) from DENV-1__EU249494__SS-prME
ucugugaccaugcugcuuaugcugaugcccaccgcucuagcguuccaccugaccaccagaggcggcgagccccauaugaucguuacuaagcaggagcggggaaaaucgcugcuguuuaagacaagcgcuggugugaacaugugcacuuugaucgccauggaccugggcgagcugugcgaagacaccaugacuuacaagugcccccggauaaccgaggcggagccagacgacguggacugcuggugcaacgcaaccgauaccugggucaccuacgggaccugcagccagacgggcgagcaucgucgugacaagcggagcguugcgcuugcaccccacgugggacugggucucgaaacuaggacggagacuuggaugucaagcgagggcgcauggaagcagauccagcggguggaaacuugggcccuccgacaucccggauucaccgugauugcuuuguuccuggcgcacgccaucggaacuuccaucacccagaaggguaucaucuuuaucuuacugaugcuggugacuccuuccauggcgaugcgaugugucggcaucggaagucgcgacuucguagagggacugucaggagccacauggguggacgucguucuggagcacggguccugugugacaacuauggcuaaggauaaaccaacucuggacaucgagcuccugaagaccgaggucacaaaccccgccguucugcggaagcuaugcauagaggcaaagauaagcaacaccacaacagacucccgcuguccgacacagggcgaggccacuuugauggaggaacaggacgcaaacuucgugugccggcgcacauucgucgauagaggcugggguaacggaugcgggcucuucggaaagggcucgcucaucacgugcgccaaauuuaaguguguuacuaagcuggaggguaagaucgugcaguacgaaaaccugaaguauuccgucaucgugaccgugcacacaggcgaucagcaucaggucgggaacgagagcaccgaacacggcaccacugcuacgaucacgccacaggcacccaccagcgagauccaguuaacagacuauggggcccuuacgcuggacugcaguccacgcacggggcuagauuucaacgagauggugcugcucaccaugaaggaaaaguccuggcucguacacaagcaaugguuccuggacuuaccgcuucccuggaccagcggggccagcaccagucaggagacguggaaccggcaagaccugcuggugaccuuuaagacugcacacgcgaagaagcaggaaguugucgugcucggcucacaggagggugccaugcacaccgcccugacaggggccacggagauccaaacuagcggcacgacaacgaucuuugccggucaucuuaagugccgccucaaaauggauaaguugaccuuaaagggcaugagcuaugugauguguaccgguuccuucaaacucgagaaggaggucgcggagacgcagcacggcaccgugcugguucagaucaaauaugagggcaccgacgccccgugcaagauccccuuuagcacacaggacgaaaagggggucacgcagaacggcagacugaucaccgccaauccgauugugacagacaaggagaagcccgugaacaucgaggcggagccgcccuucggggaguccuacaucgucaucggcgcaggcgagaaggcccugaagcuuucgugguuuaagaagggauccaguauuggcaaaauguucgaggccacggcacgaggggcacggaggauggcgauacuuggcgacacggccugggauuucggguccaucggcgguguauuuaccagcguggggaaacugguccaucaaauauuuggaacugccuauggggucuuauucuccggugugagcuggaccaugaagaucgggaucggaguccugcugacuuggcucggccugaacucacgcagcacaucgcugagcaugaccugcaucgccguugggcucgugacccuguacuugggcgcaaugguccaggccgauuccgguugcgugaucaauuggaagggccgugagcuuaagugcggaucaggcaucuucgugacgaacgagguccacaccuggaccgagcaguauaaguuccaggcagacagcccgaaacgccugucugccgcgaucggcaaggccugggaagagggggugugcgguauacggucagccacccgccuggagaacaucauguggaagcagauuucgaacgagcucaaucauaucuuacucgagaacgacaugaaguuuaccguggucgucggggacgugguuggcauccuagcccaggguaagaagaugaucagaccacaaccgauggagcacaaauacagcuggaaguccuggggaaaggcaaagauuaucggagccgacgugcagaacacgaccuucaucauugacgggcccaacaccccggagugccccgacgaucaacgcgcguggaauaucugggagguggaggacuacggcuuugggaucuucaccacaaauaucuggcuuaagcugcgggauagcuauacccagguuugcgaccaucgccucaugagugcggccauaaaggacaguaaggccgugcacgcugacaugggcuacuggaucgaguccgagaagaacgagaccuggaagcuggcgagagcuagcuucauugaggucaaaaccugcaucuggcccaaaucccacacgcuauggagcaacggaguccucgaguccgagaugaucauccccaagaucuauggaggcccuaucucucagcacaacuaccgcccgggguauuucacacagaccgcaggcccuuggcauuuagggaagcuggagcucgacuucgaccugugcgagggcaccaccguaguggucgacgagcacugcgggaaccgcgguccgagucuucgcaccacuacagugacuggcaagauaauccacgagugguguugucggagcugcacccuaccuccccuccgguucaagggggaagauggcugcugguacgggauggaaaucagacccgugaaagagaaggaagagaauuugguaaaaagcaugguaagcgccgggagcggcgaaguagacuccuucagcuuggggcuguugugcaucuccauuaugaucgaggaggugaugagaagccgguggucucgcaagaugcucaugacgggaacccuggccguguucuuacuacucaucaugggccagcugacguggaaugaucucauccggcugugcauuauggugggugcgaaugcuuccgaucgcauggggaugggcaccaccuaccuggcacucauggccaccuuuaagaugcguccgauguuugccgugggacuguuauuccggcgccucacgagucgggaggugcuauuacucacuaucggucugagccugguagcguccgucgagcucccuaacucucuggaggaauuaggcgacggguuggcgaugggcaucaugauucuaaagcugcucaccgacuuucagagucaccagcuaugggccacacuccucagccugacguucaucaagaccacccugucacuccauuacgccuggaaaaccauggcaauggugcuguccaucguuucccuguuuccccucugccuuucaacuaccagucagaagacgacauggcugccuguacuccugggcagccuagggugcaagccucucaccauguucuuaauugcugaaaacaagauuuggggccgcaaaaguuggccccucaacgaaggaaucauggccgucggugucguaaguauccucuugagcagccugcucaaaaacgacgugccauuagcugggccacugauugccggcggcaugcucaucgcaugcuacgucaucucggguucaagcgcugaccucucccucgagaaagcagccgaggugagcugggaagaggaggccgaacauuccggcgccagccacaacauucucguggagguccaggaugacgggaccaugaagaucaaggacgaggagagagaugacacucugaccauccuccucaaggccacccuucuggccguuuccggcgucuacccacucagcaucccggcaacgcuguucgucugguacuucuggcagaagaagaagcagcgcuccgggguucuuugggacaccccgagcccgcccgagguagaacgggccguccuagacgacggcaucuaccgcauaaugcagcggggacuccucgggcgcucccaggugggcgugggaguauuccaggagaauguguuccauaccauguggcacgugacgcggggcgcgguccucauguaccaggggaagcgccucgagcccaguugggcguccguuaagaaggaccugaucagcuacggcggcggguggcggcugcagggcaguuggaauacgggggaggagguucaggucauagccguggaacccggcaagaauccaaagaacgugcagaccgcucccgguaccuuuaagacccccgaaggggagguaggcgccaucgcccuugacuucaagcccggcacgagcggcucccccaucguuaaccgagaggggaaaauagucggacuguacggcaauggggucgugaccacguccggaaccuacgugagcgcuauugcgcaggccaaagcgucgcaggaggggccgcuacccgagaucgaggacgaggucuucaggaagaggaaccucacgaucauggacuugcacccagggagcggcaagacaaggcgcuaccuuccugccaucgugcgggaggccauaaagcgcaagcuccguacgcugauccucgcgcccacucgcgugguagcguccgaaauggcagaggcauuaaagggaaugcccauccgcuaucaaaccacugcugucaaguccgaacacaccggaaaagagauaguggacuuaaugugccaugcaacguucacgaugcgguuacucucccccguccgcgugccgaacuacaauaugaucaucauggacgaggcccacuucacugacccuagcuccauagcggccagaggguacaucagcacccgcgucggcaugggggaagccgcggccaucuucaugaccgcuacgccaccaggcucugucgaggcguucccucagagcaacgcagugauccaggacgaggagagagauauuccugagcgguccuggaacagcggguaugaguggaucaccgacuuuccgggcaagaccgucugguucguaccguccaucaagagcggcaacgauauagcgaauugccuucgaaagaacgggaagcgcgugauccagcucagccggaagaccuucgacacggaguaccagaaaaccaaaaauaacgauugggacuacgucguaacaacagauauaucggagaugggcgcgaacuuccgugccgaccgagugaucgacccucgccgaugccucaaaccggugauccugaaggacgggcccgagcgagucauccuggccggcccaaugccugugacggucgccuccgccgcgcagaggcgagggcggaucggucggaaccacaauaaggagggcgaccaguacauuuacauggggcaaccccuaaacaacgacgaggaucacgcccacuggaccgaagccaagaugcugcuggacaacaucaacaccccagagggcauuauccccgcacucuucgaaccggagcgcgagaaguccgccgcgaucgacggggaguaucgccuacggggcgaggcccggaagaccuucguugagcugaugcgccgaggagaucuccccgugugguugucuuauaagguagccagcgaaggguuucaguauagcgauagacgguggugcuucgacggagaaaggaacaaccaggugcuggaggaaaacauggacguggagaucuggacgaaggaaggagagcggaagaagcuccgcccccgguggcuugacgcccgcacguauuccgacccccuggcucuucgggaguucaaggaauuugcagcuggccgucgaagcguguccggggaccugauccuggagaucggaaagcucccccaacaucuuacccaaagggcacaaaacgcguuggacaaccuggugaugcugcauaacucagagcaagguggcagggcguaucgccaugccauggaggagcugccagacaccauugagacgcuaauguugcuggcccuuaucgcgguccugaccggcggggucacccuauucuucuugucugggcgggggcugggcaagacgagcaucgggcugcucugugucauggccuccagcgugcugcuuuggauggcgagcguggagccccauuggauugcagccuccaucauacucgaguuuuuuuuaaugguccugcucauccccgagccggaccgccagcggacgccccaggacaaccaacuagccuacgucgucauaggccuccucuucaugauccugacgguugcagcgaacgagaugggccugcuagagaccaccaagaaagaccugggaauaggacacguggccguugagaaccaccaccacgccaccauguuagauguggacuuacaccccgcuuccgccuggacgcuguacgcuguggccaccaccaucaucacccccaugaugcgccacacgaucgagaauaccaccgcgaacaucagcuugaccgcgauugccaaccaagccgccauucucauggggcuggacaagggcuggccgaucuccaagauggacaucggaguaccacugcucgccuuggggugcuacucacaggugaacccccucacgcugacggcagcggugcugaugcugguggcgcacuacgccaucauaggcccggggcuacaagcaaaggccacucgggaggcacagaagcgcacagccgccgggauuaugaaaaaucccacgguggacgggaucguggcgauagaucuggacccagucgucuacgacgccaaguucgagaagcagcuaggccagaucaugcuauugaucuugugcacgucucaaauccuccuuaugcgaaccaccugggcgcugugugaaagcaucacgcuggcuacgggaccccugaccacgcuuugggaggggucccccggcaaguucuggaacacaacaaucgccgugagcauggccaacaucuucagagggagcuaucuugccggcgcugggcuggccuuuagccugaugaagaguuuggguggcgggcgccggggaaccggcgcccagggggagacccugggggaaaaguggaaacgccaacugaaccaacucuccaagucggaguucaacaucuacaagagaagcgggaucauggaggucgaccgcagcgaggccaaggagggcuuaaagaggggagagacgacccgccacgcgguuucccggggcaccgcgaagcugagaugguucguggagcggaaccuugucaagcccgaggggaaaguaauagaccuagguuguggccgcgguggcuggaguuacuauugcgccggguuaaagaaagugaccgaggugaagggcuacacgaagggcgguccgggccacgaggagcccaucccgauggccacauauggguggaauuuagugaaacuacauuccggcaaagauguguucuucacgccgcccgagaagugugacacauugcugugcgacauuggggagaguuccccgaauccgacgaucgaggagggccggacccuccgcguccugaaaauggucgagcccuggcugagaggaaaucaauucuguauuaaaauucucaacccauauaugcccagcgugguugagaccuuggagcagaugcagcgcaagcacggcggaaugcuggugcggaacccgcucuccaggaauagcacccacgagauguacuggguguccugcgggaccggcaacaucguuagcgccgucaacaugacaucgcguaugcuucuuaaccgcuucaccauggcgcacaggaagccuaccuacgagcgggacguggacuuaggggccggaacacgccacgucgccguagagcccgaaguagccaacuuggacauuaucggccagcggaucgagaacaucaagcacgagcacaaaucgaccuggcacuacgaugaggacaaucccuacaagacaugggccuaucacggguccuaugaagucaaaccgagcggcagcgcgagcuccauggugaacggugucgugaagcuccugaccaagcccugggacgugauccccauggucacccaaauugccaugacagacaccaccccguucggacagcagcgaguguucaaggaaaaggucgauacccggacgccgaaggccaagcgcgggacugcacaaauuauggaagugaccgcccguuggcuguggggcuuccugucccgcaauaagaagccccggaucugcacccgcgaggaguucacgcgcaaggugcgauccaacgcugccaucggcgccguguucgucgaugagaaccaguggaacuccgccaaggaggcgguggaggacgagcgguucugggaccuuguccagaaagagcgugagcugcauaagcaggggaagugugcaacaugugucuauaauaugaugggaaagagagaaaagaaguuaggagaguucgggaaggcuaaggggagccgcgccaucugguacaugugguugggcgcccgguucuuagaguucgaagcgcugggcuucaugaacgaggaccacugguucucccgcgagaauagcuugagugggguggagggcgaaggacugcacaaacugggauauauucugcgggacauaucuaaaauaccugggggcaacauguaugcggacgacaccgccggcugggacacacguaucacggaggacgaucugcagaaugaggccaagaucaccgauaucauggaaccggaacaugcguuacuggcgacuagcaucuuuaaguugaccuaucaaaacaaggucguucgggugcaaaggccggccaagaacggcacggugauggaugugauuagccgccgggaucagcggggcaguggccaggugggcaccuacggucugaacaccuucaccaacauggaggcacagcuaauccggcaaauggagagugaggggaucuucucccccagcgaacuggagauccccaaccuggcggagcggguauuggauuggcuggagaaguacggcguagagcgacucaagcgcauggccaucucaggggacgauugcgucgugaagccgauugacgacagauuugcgacggccuugaccgcgcugaaugauauggggaagguacgaaaggacgugccucagugggaacccagcaagggauggaacgacuggcagcaaguccccuuuugcagucaccacuuucaccaguuaaucaugaaggacgggcgcgagaucgucguuccgugucggaaccaggacgagcucguuggccgggcccgcgucagccaaggggccggcuggagccugcgggagacagcgugccuggguaaguccuacgcccaaauguggcagcucauguauuuccaccgccgggaucugcgccuggccgccaacgcgauauguuccgcugugcccguagacuggguccccacgucccgaacgaccuggagcauucacgcccaccaccaauggaugacgaccgaggacaugcuaucaguguggaaccguguuuggauugaggagaacccuuggauggaggauaagacgcacguuagcuccuggggcgacgugcccuaccuggguaagcgagaagaucaguggugcggcagccugauuggccugaccgcccgcgcuaccugggccagcaauauccagguggccauuaaccagguccgacgccuuaucggaaaugaaaauuaucuagacugcaugaccagcaugaagcgauucaaaaacgagggcgaucccgagggagcccucugguga

SEQ ID NO: 24533 - RNA, 9879 nt, Artificial Sequence
  derived and/or modified CDS sequence (opt11) from DENV-1__EU249495__SS-prME
uccgugacuaugcugcuaaugcuaaugccaacagcgcuagcauuccaucucacaaccagaggaggugaaccccauaugauagucacuaaacaagaaagagguaaaagccuacuauuuaaaaccacugccggagugaacaugugcacuuuaaucgcaauggaucucggagaacuaugcgaagacacaaugacguacaaguguccaaggauaacggaagcugaacccgaugacgucgacuguuggugcaacgcaaccgacaccugggucacguacggaaccugcucgcaaacaggggaacaccgacgagauaaacggucaguagcacucgcuccccauguagggcugggccuugaaacacgaacagaaacauggaugucaagcgaaggggccuggaagcaaauacaaaggguggagaccugggcccuacgccacccaggauuuaccgugauagcauuauucuuagcccaugccaucggaacaucuauaacccaaaaagggaucauauucauccugcuaaugcuaguaaccccuaguauggcaaugcgaugcguaggcaucgggagccgcgacuucgucgaaggacucucuggcgccacauggguagacguaguacucgaacacgguaguugcguaacgacuauggcgaaagacaaaccgacccucgacaucgagcuacucaaaacggaaguaaccaacccggccguccuccggaaacugugcaucgaggcaaaaauaagcaacacgacgacagauucucgcuguccaacacaaggugaggcgacacuuauggaggagcaagaugcaaacuuuguaugccgucgcaccuucguagacaggggauggggcaacggaugcgggcuauucggcaagggcagcuugauaacaugcgccaaguucaagugcguaacaaagcucgaggggaaaaucguccaauaugaaaacuuaaaguauagcguuaucgucacgguucauaccggugaccaacaccaaguugguaaugaaagcacagaacacgggacgacggccacgauaacgccgcaagcgccuaccucagaaauccaacuuaccgacuacggcgcucugaccuuagacugcucgccacgaacugggcuagacuuuaacgaaaugguucuccuaacaaugaaagagaagucuuggcucguccauaaacaaugguuccuggaccucccucucccuuggacaagcggagcgucgacuagccaagagaccuggaaccgacaagaucuccucgucacauuuaaaaccgcccaugcgaagaaacaagaagucgugguccugggcucacaagagggcgcaaugcacaccgcccucacaggcgcaacagaaauacaaaccagcggcacaacgaccaucuucgcuggacaccuaaagugccggcucaagauggacaaacucacauugaagggcauguccuaugugaugugcacgggguccuucaagcucgaaaaggaaguagcagagacccaacacgggaccgugcucgugcaaaucaaguaugagggcaccgacgcucccugcaaaaucccuuucucaacccaagacgaaaaaggcguaauucagaauggaaggcugaucaccgccaacccgaucgugacggacaaggagaaaccaguaaauauugaggcggagccaccguucggugaaucguauauaguaauaggcgugggagagaaagcucuuaaacuaaguugguucaagaaaggcagcagcauugggaagauguucgaagcuacggcgcggggcgcgagacgcauggcgauccuaggagauacggcaugggauuuugguagcauaggugggguguucacuagcgucggcaaauuggugcaccagauauucggaaccgcauacggcgugcuauucuccggcguaagcuggaccaugaaaauagggauaggaguacuauugaccuggcucggauugaacagcaggaguacuagcuuaaguaugacgugcaucgcaguagggcugguuacccuauaccugggugucaugguucaagcugacagcggcugcguaaucaacuggaagggccgcgaacuuaaauguggcaguggcaucuucguaaccaacgagguccacacauggacagaacaguacaaauuccaggcggauucacccaaacgcuugucagccgccaucggcaaggcuugggaggagggcgucugugggauacgcagcgcaaccagauuggaaaacauaauguggaaacaaaucagcaaugaauuaaaucauauacuacuagagaaugauaugaaguuuaccgucguagugggggaugugguaggcauccuggcacagggaaagaagaugauaagaccgcaacccauggagcauaaguacucauggaaaucauggggcaaagcgaaaauaauaggggccgaugugcagaauacgacauuuauaaucgacggcccaaacacgcccgagugcccagacgaccaacgggcuuggaacauaugggaaguggaagacuaugguuuuggaauuuucaccacaaauauauggcuaaagcuaagagacucguacacucaggcuugcgaccaccgucugauguccgcggccauaaaggacagcaaagcgguacacgcagauaugggguauuggauagaguccgagaaaaaugagacauggaaauuagcgcgggcgagcuucauagagguaaagaccugcaucuggccaaagucacacacacuguggaguaacggaguguuggaaagcgaaaugguaauccccaaaaucuacggcgggcccaucagccagcacaacuacaggccaggguauuuuacgcaaacggcagggcccuggcaccucggaaaacucgaacuggacuucgaccuuugcgaagggaccacaguaguggucgacgagcacugcgggaaccgcggcccaucccuacggacaacgacaguaacagggaaaauaauacaugaauggugcugcagguccugcacucucccaccacuacgguucaagggagaagacggauguugguacggaauggaaauccgacccguaaaagaaaaggaagagaaccuugucaaaaguauggugagcgcgggcagcggagaaguagauagcuuuucucuggggcuccucugcaucagcaucaugauagaagaaguaaugcguuccagguggaguaggaaaaugcuaaugaccggaacacucgcgguauuucuccuucucaucaugggccaacuaacguggaacgaccuaauacgguugugcauuaugguuggcgcaaaugcgucagauaggauggggauggggacaacauaccuagcgcuaauggcgacguucaagaugcgccccauguuugcggugggccucuuguucaggcgauugacgucgcgggagguccuucuccucacuauaggacucagucuagucgcuagcguggaacuucccaacucacuggaagaacucggggacggguuagcuauggggauaaugauccuaaaacuucuaaccgacuuccaaucccaccaguuaugggcaacgcuccucucgcugacauucauaaagacgacacugaguuugcacuacgcauggaaaaccauggccaugguucuaagcauuguuucacucuucccgcuaugcuuaucuaccaccucgcaaaagacuaccuggcuucccguacuguuaggcucccuuggcugcaaaccguuaacaauguuccugaucgcagaaaacaaaaucuggggcaggaaaucuuggccucuaaacgaaggaauaauggccgucgggguggugucaauacuccucagcagccuccucaaaaacgacgugccccuagcaggaccccuaauagcgggaggaaugcucaucgcguguuacguaaucaguggauccucagccgaccuaagccuggaaaaagccgcagaaguuucuugggaagaagaagcagaacacagcggagcaucgcacaauauauugguagaaguccaggacgacggcaccaugaagauaaaagaugaagaacgagacgacacgcugaccauccuguuaaaggcaacccuccuagcagucucuggaguauacccccuuaguauccccgcgacccucuuugugugguacuuuuggcagaagaagaaacaacgaucagguguacuaugggacacccccagcccaccggaaguagaaagggccguccuugacgacgggauauacagaauaaugcaacgcggccuccuaggaaggucucaggugggaguagggguguuccaggaaaacguuuuccacaccauguggcacgucacccgcggggcaguacugauguaccagggaaaaagacuagagccaucgugggccucagucaagaaagacuuaauauccuauggcgguggcuggaggcuacaaggcucuuggaacacaggagaggaaguccaggugauagcugucgaacccggcaaaaaccccaaaaacguccagacagcaccugggaccuuuaaaacuccagaaggggaggugggugcgaucgcccucgauuucaaacccggcaccagcggcuccccaauaguuaacagagaaggcaagauaguaggccuuuacggcaauggcgucgugacaacaucgggcaccuacgucucugccauugcgcaagcgaaagccagucaagagggaccgcucccugagauagaagacgagguauuccgaaaacgaaaccuaaccauuauggaccuacauccaggaagcggaaaaacaagacgauacuuacccgccauagugagggaagcaauuaagcgcaagcucaggacacucauacuagcgcccacgcguguagucgcauccgagauggcggaggcgcucaagggcaugccgauaagauaucagaccaccgcuguaaaaagcgagcauacgggcaaggaaaucgucgaccucaugugccaugccacauucaccaugcgacuacuaucgccaguccgagucccgaacuacaacaugaucaucauggacgaggcccacuuuacagacccgucaucaaucgcugcacgcggcuauauaucaaccagaguuggaaugggggaggccgcugcaaucuucaugacagcgacgccuccggggaguguggaggcuuuuccacagaguaacgcagucauucaagaugaggaacgagauaucccagaaaggagcuggaacucgggauacgaguggauuacugacuucccgggcaaaacugucugguuugucccgagcauaaagucagguaacgacaucgccaacuguuuacggaagaacgggaaaagggucauacaacucagccgaaaaaccuucgauacggaauaucagaaaaccaaaaacaacgacugggacuacguagucaccacugauaucagugaaaugggcgccaacuuucgagccgacagagugaucgacccccgucggugccuaaaaccaguaauauugaaagacgggccggagagagucauacuugcgggaccgaugcccguaaccguagcauccgcggcccaacgucgcgggcgaauuggccgcaaucacaacaaagagggagaccaguacauauacaugggccagccccuaaacaacgacgaagaccaugcucacuggaccgaggcgaaaaugcuccuggauaauaucaacacgcccgaggggauaauccccgcacucuuugaaccggagcgcgaaaaauccgcagcuaucgacggcgaguacaggcugcgcggcgaggcgaggaaaacauuugucgagcuaaugcgccggggagaccugcccgucugguugaguuacaaaguagccagcgaaggauuucaauacagcgacagaagguggugcuucgacggagaaagaaacaaccagguacucgaggaaaauauggacguagagauauggacaaaagagggggaacgaaagaaacuccgaccacgcuggcuugacgcgcgaacauacagcgacccguuggcccugcgagaauuuaaagaguucgccgcgggccgacgcagcguaagcggcgaccuaauacuagaaauugggaagcugccacaacaucucacgcaacgcgcacagaaugcccuggacaaccuagugauguugcacaacuccgaacaagguggaagggcauauaggcaugccauggaggaauuacccgauacgauugaaacuuuaaugcuauuggcauuaauagcagugcugaccgggggagucacacuauucuucuuaucaggacgaggucuggggaaaacauccaucggacugcuaugcgucauggcuagcucaguccuucuauggauggccagugucgaaccccacuggauagcggcgaguaucauacuagaguucuuccuaaugguacuccucauccccgaacccgaccgccaaaggacgccacaagauaaucaacuugcguaugugguaaucggccuacuguucaugaucuuaaccgucgccgccaacgagauggggcuccucgaaacgacgaaaaaggaccugggaaucggacacguugcuguggaaaaucaccaucaugccacaaugcuagacguagaccuacacccagccucugcguggacccuguacgcaguggcgacaacgauaaucacacccaugaugaggcauaccaucgagaacacuacagccaacauuucgcugacggcgaucgcgaaccaggccgcgauccugaugggacuugacaaaggauggccaaucuccaagauggacauaggcguaccauugcuggcccuuggaugcuauucgcaagucaacccgcugacgcuaacagccgcagugcucaugcuuguggcucacuaugcuaucauagggcccggucugcaagccaaggcgacacgcgaggcccagaaaaggacggccgcgggcaucaugaaaaaccccacuguggauggaauaguagcuauagaccuugaccccgucgucuacgacgccaaguuugaaaaacaacugggacagaucaugcuccuuauauuauguacgagccaaauucucuugaugcgaacaacaugggcgcucugcgaaagcauaaccuuggcuacagggccgcucacgacguuaugggaaggcaguccaggcaaauucuggaauacaacaauagccgucagcauggccaacaucuuuagaggaucauaccuggccggagcgggguuggccuucucccugaugaagucuuuaggaggcgggaggcgaggaaccggcgcccaaggagagacacuaggcgaaaaauggaagcgacaacuaaaccagcuaucaaagucagaguucaacauauacaaacgauccggaaucauggaaguagaccgcuccgaagcaaaagaaggacuaaagagaggggaaacgacccgccacgcagucucgcgcggcacagcaaagcuacguugguucguagaaaggaacuuagugaagcccgaggggaaggugauagacuuaggaugcggucggggaggguggucguauuauugcgcagggcugaaaaaggugaccgaggucaagggcuacaccaaaggcgggccaggacacgaagaaccaauaccuauggcaacauacggauggaaccuagugaaacuccauucgggcaaagaugucuucuuuaccccucccgagaaaugugacacucuauuaugcgauauuggagaaagcagcccaaacccaaccauagaagagggcagaacccugagggugcugaaaaugguggaaccauggcuucgcggaaaccaauucugcaucaagauccuaaacccauacaugccaagugucguugagacauuggagcagaugcaacgcaaacacggcggcaugcuaguacguaacccccuaagcagaaacagcacccaugaaauguacugggugucaugcggcacaggaaacaucguuagcgcagucaauaugacaucacgcauguuacuuaauagauucacuauggcccaccguaaaccaaccuacgaacgagaugucgauuugggagcaggcacucggcauguagccguagaaccggaggucgcgaauuuggauauaaucggccagcgaauagaaaacauaaaacaugaacacaaauccacuuggcacuacgacgaggacaacccguacaagaccugggcguaccacggcucauacgaggucaagcccucaggcucagcguccaguauggucaacggcgucguuaaguuacucacgaagccgugggacguaaucccgauggugacccagauagcgaugaccgauacgacaccauucggacagcaaaggguguuuaaagaaaagguggacacacgaaccccgaaagccaaacgaggaacagcgcaaaucauggaaguuacagcccgcuggcuauggggauuucuaagccgaaacaagaaaccgcgaaucugcaccagggaagaauuuacacgcaaaguaagaucaaacgcggccauaggcgccgucuucgucgaugagaaccaauggaacagcgccaaagaagcggucgaagacgaacgcuucugggaccuaguacaaaaagaacgcgaacuucacaaacaaggaaagugcgccacauguguguacaacaugaugggcaaaagggagaagaaacugggcgaguucggcaaagcaaaagggagccgugcaauaugguacauguggcugggcgcccgcuuucuugaauuugaagccuuaggauuuaugaacgaagaccacugguuuucacgagagaacucgcuuuccggcguggagggugagggccugcacaaacucggguauauacucagggacaucagcaagauccccggcgggaacauguacgccgacgacacagcaggaugggacacccgcaucacagaagacgaucuccaaaacgaggcgaagaucaccgacauuauggagccugaacaugcacuacuagcaacgagcauuuucaaacuuaccuaccaaaacaaagugguccguguccaacgaccugccaaaaauggcacagugauggacguaauaagccgccgugaccagagggguagcggacagguaggaaccuacggacuaaauacauuuaccaacauggaagcacagcuaauacgacaaauggaaucagaggggauuuuccugccgagcgaacuugagacaccgaaucuggcagaaagggugcucgacugguuagagaagcacggggucgagcggcucaaacgcauggccauaagcggagacgacugugucgucaaacccauagacgaccguuucgcgacggcucucacugcgcugaacgacauggggaagguacggaaagacaucccacaaugggagccaucgaaaggauggaacgacuggcagcaagucccguucuguucgcaucacuuccaccaacuuauaaugaaagacggucgcgaaauagugguacccugccgaaaccaggacgagcugguaggccgggcuagggucucacaaggcgcgggcuggucccucagagaaaccgcgugccuuggcaagucguacgcgcaaauguggcaacuaauguauuuccacagaagagaccuacgucuagccgcgaacgccaucuguagcgcaguuccagucgacuggguucccacuuccaggaccacguggucaauccacgcacaucaccaauggaugacaacagaggauauguugucgguauggaaccgcguauggaucgaggaaaaccccuggauggaagacaaaacccacguaagcucuuggggagacguucccuaccuaggaaaaagagaggaccaauggugcggguccuuaauaggcuuaacagcacgugccacaugggccagcaauauccaaguagcaauaaaccagguaagaagauuaaucggcaacgaaaauuacuuagacuacaugacguccaugaaaagguucaagaacgaaggggacccggagggcgccuugugguaa

SEQ ID NO: 24534 - RNA, 9879 nt, Artificial Sequence
  derived and/or modified CDS sequence (opt11) from DENV-1__EU482794__SS-prME
agcgugacaauguuauuaaugcugaugccuaccgcccuggcauuccaucuaaccacccggggcggugagccccacaugaucgugacgaagcaggagcggggcaagagccugcuguucaagaccagcgcgggggugaacaugugcacucuaauugccauggaccugggcgagcugugcgaggacaccaugaccuacaaaugcccccggaucacagaggccgagcccgacgacguggacugcugguguaacgcgaccgauaccugggucaccuacgggaccuguucacagacgggcgaacaucggcgggacaagcggagcguggcccuggcgccccauguaggacuggggcuagagacccgcaccgagaccuggaugucgagcgagggugccuggaagcagauccagcgugucgaaacgugggcgcuccgccaccccggguuuacggugaucgcccuguuucuugcucacgccauaggcaccuccauuacacagaagggaaucauuuucauccucuuaaugcuggugacgcccagcauggccaugcggugcguaggcaucggcucccgcgauuucguggagggguugucgggggccacguggguggacgugguucuugagcacggcuccugcgugaccaccauggccaaggauaagccaacgcuggacaucgagcuacuaaagaccgagguaaccaaccccgcggugcugcggaagcucugcaucgaggccaaaaucagcaacaccacuaccgacucacgcugccccacccaaggcgaggcuacccugauggaggagcaagaugcaaacuucguuugccggcgcacguucgucgacaggggcugggggaacggcugcgggcuauuugggaaggggaguuugaucacgugcgccaaauuuaagugcgugaccaagcuggaggguaaaaucgugcaguacgagaaccuuaaguacuccgucaucgucacugugcauacgggcgaccagcaccaggucgggaaugagucgacggagcacgggaccaccgccaccauuacgccccaggcacccacuuccgagauccagcucaccgacuacggcgcgcugacucuggacugcagcccacgaaccgggcucgacuucaacgagaugguauuacuuaccaugaaagagaaguccuggcucguccacaaacagugguuccuggaucuaccgcuccccuggacguccggggcaucuaccucccaggagacuuggaaucgucaggacuugcuggugaccuucaagaccgcgcacgcgaagaaacaggagguugucgugcucggcagccaggagggcgccaugcacacggcccucacaggggccacggagauccagacguccggaaccaccacaaucuucgccgggcaccugaagugccgccucaagauggauaagcugacccugaagggcaugagcuacgucaugugcaccgguucauuuaagcuggagaaagaggucgcggaaacgcaacauggcacagugcucgugcaaaucaaauacgagggcaccgacgcccccugcaagauccccuuuuccacacaggacgagaaaggaguuacgcagaacgggcggcugaucacggccaauccuauaguuaccgacaaagagaaacccgugaacaucgaggccgagccgcccuucggggagucauacaucgucauaggagcgggcgagaaagcccugaagcucagcugguucaagaagggguccucgaucggcaagauguucgaagccacagcccggggggcccggaggauggcgauucugggggauacggcaugggacuucggguccgucggcggcguguucaccagcgucgguaagcuaguccaccagaucuucggcacugccuacgggguccuguucucuggcgucucauggaccaugaaaaucgggaucggugugcugcugacguggcuuggccuaaauucucgcagcacgucgcugagcaugaccugcaucgccgugggccucgucacuuuguaccugggcgucaugguccaggccgacuccgggugcgucaucaauuggaagggucgggagcucaagugcgggagcggcaucuucgugacgaacgagguacacaccuggacagaacaguacaaguuucaggcggauucuccgaaacgccuguccgccgccaucggcaaggcgugggaagagggggucugcgggauccgaagcgcuacccgccuggagaacaucauguggaaacagaucuccaacgagcucaaccacauucugcuggagaacgacaugaaguucaccguggucgucggugacguggugggcauccucgcgcaggggaagaaaaugauccguccccagcccauggaacacaaauacagcuggaaguccuggggcaaggccaagaucaucggugccgacguacagaacacgaccuucaucauugacgggcccaacaccccggagugcccagaugaucagcgagcauggaacauaugggagguggaggacuacggcuucgggaucuucacaacgaacauauggcugaagcuacgggacagcuacacccaggugugcgaccaccgcuugauguccgcggccaucaaggacagcaaggcaguccacgccgacaugggauacuggauugaguccgaaaaaaacgaaaccuggaagcuggcccgggcgucauuuaucgagguuaaaacuuguaucuggcccaagucccauacgcuguggagcaacggaguacucgagucagagaugaucauccccaagaucuaugguggcccgauaagccagcacaacuacagacccggguacuucacgcagaccgcuggucccuggcaccuagggaagcuggagcucgacuucgaccugugcgagggcacuacgguaguggucgacgagcauugcggcaacagggggccgucccugcggaccaccaccguaacgggcaagauuauccacgaguggugcugccgcucgugcacauugccgccucuccgcuucaagggggaggauggaugcugguacggcauggagauccggcccgugaaggagaaagaggagaaccuggucaaguccauggugagcgcuggcagcggcgaaguggacucuuucagcuuagggcuucuguguaucuccaucaugauagaagagguaaugcgcucaagguggucccguaaaaugcucaugacgggcacccuggcuguguuccugcucuuaauuaugggucagcugacuuggaacgaccucauccggcugugcauaauggugggcgcgaacgcuagcgaccgcauggggaugggcaccacguaucuggcucucauggccaccuucaagaugcgcccgauguucgccguggggcuucuguuccggcgcuuaacgucccgagaggucuugcugcucaccaucgggcuguccuuaguagccuccgucgagcuucccaacagcuuagaggagcuuggcgacggguuagcaaugggcaucaugauccugaagcuauuaaccgacuuccagucccaccaacugugggcaacccuacucagccugacguucauuaagacaacucugucccugcacuacgcauggaagaccauggccaugguguuguccauugcgucccuguucccgcugugcuuaagcacaaccucccagaagaccaccuggcugccaguucucuuagguagccugggcuguaaaccucucacgauguuccugaucaccgagacgaagaucugggggcguaaguccuggccucucaaugagggcauaauggccgucggcgugguuagcauccugcuaagcucccugcucaagaacgacguccccuuggccgggccccugaucgccggcggcaugcucauugccugcuaugugaucagcggguccagcgcagaccugucccuugagaaagccgcugaggugucaugggaggaggaggccgagcacuccggcgccucucacaacauccucguaguggugcaagacgacgggaccaugaagaucaaggaugaggagcgggacgacaccuuaacgauucugcucaaggcaacccuguuggccgucucuggcguguacccccucagcaucccagccacccuguucgugugguacuucuggcagaagaagaagcaacgaucugggguccugugggauacccccagcccgcccgagguggaacgggccgugcuugaugacgggaucuaccgcaucaugcagcgcggccuccugggcaggucccaggucggcgucgggguuuuccaggagaacgucuuccacacgauguggcacgugacgcggggcgcgguacugauguaccaggggaagcgccuugagcccagcugggcuuccgucaaaaaggacuuaauuuccuacggcggcggguggagauugcaagggucauggaacaccggggaggagguacaggucaucgcugucgagcccgggaagaaccccaagaaugugcagaccgccccaggcacguuuaaaacgccagagggagagguuggagccaucgcccuggacuucaagccagggacaagcggaucuccgaucgucaaccgcgagggaaagaucgugggccucuacggcaacgggguggugaccacgucuggcaccuacguuagcgcgaucgcucaagccaaggccagucaggaagggccucuacccgaaaucgaggacgagguuuuccggaagcgcaaucucaccaucauggaucugcaccccgggucggggaagacccggcgcuaccugccggcgaucguccgagaggccaucaagcgaaaacuacggacgcugauccuggcgccgacgcgcgugguugccucagagauggccgaagcgcugaaaggcaugcccauacgauaccagaccaccgccgucaagagcgaacauacaggcaaggagauaguggacuuaaugugucacgccaccuucaccaugcggcugcucucccccgugcgcgucccaaacuacaauaugauuaucauggaugaagcccauuuuacggaccccagcuccaucgccgcgcggggguauaucagcacgagagugggcaugggggaggccgccgccauauucaugacagccacgccgccaggauccguggaggcuuuuccccagaguaacgccgucauacaggaugaggaacgggacauucccgaaagauccuggaacagcggguacgaguggaucaccgauuuccccggcaagacggugugguucgugcccuccaucaagucaggcaacgacaucgccaacugucugcggaagaacgggaagcgcgucauacagcugagccggaagacguucgauacggaguaccagaagacgaagaacaacgauugggacuacguggugacuaccgacaucuccgagaugggcgcaaacuuccgcgcggaccgggucaucgacccacgccggugccucaaacccgugauccugaaggacgggcccgaacgugucauccuggccggcccuaugccugugacuguggccagcgcagcucagcgcagggggcggauaggacguaacuauaacaaggaaggagaccaguacaucuauauggggcagccacucaacaacgacgaggaccacgcacacuggaccgaggccaagaugcugcuggacaauaucaauacgccugagggcaucauaccugcgcuuuucgaaccggaacgggagaagagugccgccaucgacggggaguaccgccugcgcggcgaggcgcggaagaccuucgucgagcugaugcgccgcggcgaucuccccguguggcuauccuauaagguggcgagcgagggauuccaguauagcgaucgccggugguguuucgauggcgagcgcaacaaccagguccuggaggagaauauggauguagaaauauggaccaaggagggggagcgcaaaaaacuccggccccggugguuagacgcccgcaccuauuccgacccgcuggcccucagagaguuuaaggaauucgcagcgggccgccguuccgugagcggggaccugauccuggagauugguaagcucccgcagcaccuuacgcagcgugcccagaacgcucuugacaaccucguaaugcugcacaacagcgagcagggagggcgggccuaccgacacgcaauggaagagcuuccugacacuaucgagaccuugaugcugcuggcccucauugccguccugaccggcggggugacucuguucuuccucuccggccgggggcugggaaaaaccagcaucggacugcucugcgucauggccuccagcgugcugcuguggauggccuccguggagccccacuggaucgcggcgagcaucauccucgaguucuuccucaugguccugcucaucccggagccugaucgccaacggacgccccaggacaaccaguuggccuacguggucaucggucuauuguucaugauccugaccgucgccgcuaaugagaugggacugcucgagacaacgaagaaggaucucgggaucggccacguugcuguggagaaccaccaucacgcaaccaugcuggacguagaccugcaccccgccuccgccuggacguuguacgccgucgcgacuacgaucauaaccccgaugaugcgccacaccauagagaacaccacggccaacaucagcuuaaccgccauugcgaaccaagcugcgauccucauggggcuagauaagggauggccgaucuccaagauggacaucggagucccccugcucgcccuggggugcuauagccaggucaacccccugacccuaacagcugccguauugaugcugguagcccacuacgcaaucauaggcccggggcuucaggcaaaggccacccgcgaggcccagaagcgcaccgcggccggaaucaugaagaacccuaccgucgacgggaucguggcuauagaccuggaccccguggucuacgacgccaaguucgagaagcagcugggccagaucaugcugcuaaucuuguguacaucgcagauccuccucaugcgaacuaccugggcccugugcgaaucgaucacgcucgcgaccggcccauugacgacccucugggaaggguccccggguaaguucuggaacaccaccaucgcggugucaauggcaaacaucuucaggggguccuaccuagcuggcgccggccuggcauucagccugaugaagucccucgggggcgggcggcggggcacgggggcccagggcgagaccuuaggcgagaaguggaagcgucagcugaaucagcucuccaagagcgaguucaacaucuacaagcgguccgggaucauggagguagaucguagcgaggccaaggagggccugaagcgcggggagacaacaaggcacgccgucucacggggaacggcuaagcugcgcugguucguggagcggaaccugguuaagcccgaggggaaggucauugaccucggcugcggccgcgggggcuggucuuacuacugcgccggguugaagaaagugacugaggugaagggauacacaaagggcgggcccggccacgaggagccgaucccuauggccaccuacggguggaaccuggucaagcuccacagcggaaaggacguguuuuucacgccgcccgagaagugcgacacccugcugugugacaucggggagaguuccccuaacccgaccaucgaggagggcaggacgcuccgcguguuaaagauggucgagccuuggcuccggggcaaccaguucugcaucaagauccucaacccguacaugcccagcguaguggaaacccuggaacagaugcagcgaaagcacggcggcaugcugguccggaacccgcucucccgcaacagcacccacgaaauguacugggucuccugcgggaccggaaacauaguuagcgccgucaacaugaccuccagaaugcugcugaaccgcuucaccauggcccaucgcaaacccacguaugagcgagacguggaccucggggcgggcacacgccacguggcugucgagcccgagguggcuaaccuggacaucaucggccaacggaucgaaaauauuaagcaugaacacaagaguaccuggcacuacgacgaggauaaccccuacaagacaugggcauaccacggguccuacgaggugaagccgagcgguuccgccuccagcauggucaaugggguggucaagcugcucacaaaaccuugggacgugauccccauggugacccaaaucgcgaugacugacaccacucccuucgggcagcagcgcgucuucaaggagaagguggacacgcggacuccgaaggccaaacgcgggaccgcccagauaauggaggugacggcccgguggcuguggggcuuccugucgcgaaacaagaagccccggaucugcacgcgggaggaauucacccggaagguccguagcaacgccgcgaucggggccguauucguggaugagaaccaguggaacuccgcaaaggaagcuguugaggacgagagguucugggaccucgugcaaaaggagcgcgagcugcacaagcaggggaagugcgcuaccuguguguacaauaugaugggcaagcgugagaagaagcugggggaguuuggaaaggcuaaggggagccgcgccaucugguacauguggcucggcgcccgguuccuggaguucgaagcgcugggcuucaugaacgaggaccacugguucuccagagagaauucgcucagugguguugaaggcgagggguuacacaagcugggcuacauacuccgagacaucagcaagauccccgggggcaacauguacgcggacgacacggccggcugggacaccagaaucaccgaggacgaccugcaaaacgaggccaaaaucaccgacaucauggagccggaacacgcccugcucgccacgucgaucuucaagcugaccuaccagaacaagguugugcggguccagcgacccgcgaaaaacgggaccgugauggacgugauuagcagacgggaccaacgagggucugggcagguuggcaccuacggcuugaacacauuuacaaauauggaggcacaacucauacggcagauggagagcgaggggaucuuccuaccauccgagcuggagaccccaaaccucgccgagcgcgugcuggacuggcuggaaaaguacggaguggagcggcucaagcgcauggcaaucucgggggacgauuguguagugaagccgaucgaugaccgguucgccaccgcccugaccgcccugaaugacaugggcaaggugcgcaaggacauaccccagugggagcccucgaaaggguggaacgauuggcagcagguccccuucuguagccaucacuuccaccaacucaucaugaaggacggccgggagauaguaguaccgugccggaaccaggacgaguuggucggacgggcgcgcgugucccagggggccggcuggagccugcgagagacggcaugccucgguaagagcuacgcacagauguggcaacugauguauuuccacagacgagaucuacgcuuggccgccaaugccaucugcuccgcggugcccgucgacugggugcccacgagccggaccacgugguccauucacgcccaccaccaauggaugaccacagaggacauguuaagcguguggaaucgcgucuggauugaggagaaccccuggauggaggacaagacacacguguccaguuggggcgacgugccguaccuugggaagcgggaggaucaauggugcggaucccucaucggccugaccgcccgcgcaacgugggccagcaacauucagguagcaaucaaucaggugcgccggcugaucggcaacgagaauuaucucgacuacaugacauccaugaagcgcuucaagaacgagggcgacccggagggggcccugugguga

SEQ ID NO: 24535 - RNA, 9879 nt, Artificial Sequence
  derived and/or modified CDS sequence (opt11) from DENV-1__EU482795__SS-prME
ucugugaccaugcuucucaugcugaugcccaccgcccucgccuuccaucucacaacccgcggcggggaaccucacaugaucgucagcaagcaagagcggggcaagagcuuacuguuuaagacuuccgcuggcgugaacaugugcacccuaauugccauggaccugggcgaauucugcgaggacacgaugaccuacaaaugucccagaaucaccgaggccgagcccgacgacguugauugcuggugcaaugccacagacacguggguuaccuacgggaccugcagccaaaccggcgagcaccggcgcgacaagcguucaguagcccuggcaccccaugugggccugggguuagagacuaggacugagaccuggauguccuccgaaggcgccuggaagcaaauacaacgugucgaaacaugggcccugaggcaccccggguuuacggugaucgcuuuauuccuggcgcacgcgaucgggaccagcaucacccagaaggggaucauauuuauccugcucaugcugguuacaccauccauggcgaugcgcugugugggcaucggcucgcgcgacuucguugagggucuguccggggccacguggguggacgucgugcucgaacacgggagcugcgugaccaccauggccaaagauaagccuacccuggauaucgaacugcucaaaaccgaggugaccaaccccgcagugcuccggaagcugugcaucgaggccaagauuaguaacaccacaacugacagcagauguccaacucagggugaggccacccucguggaggagcaggacgcgaacuucgucugccggagaacuuucguggauagaggcugggggaacggcugcgggcuguuuggcaaggggucccugaucacgugcgccaaauucaagugcgucaccaagcuugagggcaagacaguccaguacgagaaccugaaguacucagugaucgugacuguacacacaggcgaccagcaccagguggggaacgaauccaccgagcacggcaccaccgcuaccauuacaccucaagccccgagcaccgagauccagcucaccgacuacggggcccucacacuggauugcagucccagaacgggacuggacuucaacgagaugguucuccugacaaugaaggagaagagcugguuggugcacaagcaaugguuccucgaccugccgcuacccuggaccagcggagccuccacaagccaggagacuuggaaucguaaggaccugcuggugaccuucaagaccgcccacgcgaaaaagcaggaggucgugguucuaggcucccaggagggcgcgaugcacaccgcccuuacgggggccacggagauccagacgagcggcaccacgaccaucuucuccgggcauuuaaagugccgccugaagauggauaagcucacgcugaagggcaugucuuacgugaugugcaccgggagcuucaagcuggagaaggagguggccgagacacaacacggcaccguauuaguccagauaaaguaugagggaaccgacgcgccgugcaagauccccuucagcacccaggacgagaagggggugacccaaaacggccgacugauuaccgccaaccccaucgugaccgacaaggagaagccggucaacauagaggccgagccgcccuucggugaguccuacaucgugauaggcgcgggcgagaaggcgcuaaagcugagcugguucaagaagggguccucaauuggcaagauguuugaggccaccgcccgcggggcgcgacgcauggcaauucucggagacacggcgugggacuuuggcaguauuggcgggguguucaccagcgucgggaagcuugugcaccagaucuucggcaccgccuauggagugcuauucuccggcgugagcuggacgaugaagaucggcaucggcgugcucuuaacguggcucggccucaauucccgcagcaccucccugagcaugaccuguauagccguagggcugguaacccucuaccuaggcguuauggugcaggccgacagcggaugcgucaucaacuggaagggccgggagcugaagugcggcucgggcaucuucgugacgaaugagguucacacuuggaccgagcaguacaaguuccaagccgacagcccgaagcgucucagcgcggcuaucgggaaagcuugggaggagggcgucugcggaauucggagcgccacccgccuggagaacaucauguggaagcagaucuccaacgaguugaaccacauccuccuggagaacgacaugaaguucaccgugguggugggggacgucgccggcauccuggcacaagggaagaagaugauucggccccagcccauggaguacaaguacagcuggaaguccuggggcaaggcuaagaucaucggagccgacguccagaacacgaccuuuaucaucgacggaccuaacaccccggagugccccgacgaccagcgcgcauggaacauuugggaggucgaagacuauggguucgggauauucaccacgaauaucuggcuuaaguugcgggacucguauacccaggugugcgaccaccgccugauguccgcggccauuaaggacagcaaagccguccacgccgacauggguuacuggaucgaguccgagaagaacgagacuuggaagcucgcccgcgccagcuuuauagaggucaagaccugcaucuggcccaagucacauacccuguggagcaacggcgugcuggagucagaaaugaucauuccgaagaucuacgggggaccgaucagccagcacaacuaccggccagguuacuucacccagaccgccggaccuuggcaccugggcaagcuagaguuggacuucgaucucugugaaggcaccacgguugucguggacgagcacugcggcaaccggggccccagucugcguacaacgacggugacgggcaagaucauacacgaguggugcugccgguccugcacuuuaccuccccuucguuucaagggggaagacggcugcugguauggaauggagauucggcccgucaaggagaaggaggaaaaccuagucaagagcaugguguccgccggaagcggggaggucgauuccuucagccugggguugcugugcaucuccauaaugaucgaggaggugaugcgcagccgguggucucgcaaaaugcugaugacuggcacccucgcgguauucuuccugcugaucaugggacagcucacguggaacgaccugaucaggcugugcaucauggucggcgcuaacgcaagcgaccgaauggggauggguaccacuuaucucgcacugauggccacauucaagaugcgcccuauguucgccgugggccuacuguuccggcgccugacgucccgcgaggugcugcugcucacaaucgggcuuagccucgucgccaguguggagcuucccaauucccuugaggaacuaggcgacggccuggcgaugggcaucaugauccugaagcuccugacggacuuucagucccaccagcugugggccacccuccugagccuaacguucaucaagaccaccuucucccuccacuacgccuggaagaccauggccaugguccuuagcaucgugucccugcucccccugugccugagcacgaccucacagaagacaaccuggcuccccgugcugcuuggcuccuuggguugcaaaccgcugacgauguuccuuaucgcggagaauaaaaucuggggccgaaagagcuggccccucaacgaggggaucauggcugucgguaucgugucuauccugcugagcucgcuccucaagaaugaugugccccuggccggcccccucaucgccggcggcauguuaauagccugcuacgucaucucgggguccagcgccgaccugucccucgagaaggccgccgagguuagcugggaggaggaggcugagcauuccggggcuagccacaacauccugguggagguccaggacgacgggacuaugaagauuaaggacgaggagcgggaugacacccugacaauacuccugaaggcgacccugcucgccguguccggcguguacccgcucaguauccccgccacgcuguucgucugguacuucuggcagaagaagaagcagcgcuccgguguccucugggauacccccagcccgcccgagguggaacgggcgguccuggacgacggcauauaccgcaucaugcaacgcggucugcuggggcgcucucaggucggcgugggggucuuccaagagaacguauuccacacuauguggcaugugaccaggggagccguauugauguaccaggggaagcgccuugaacccagcugggcguccgugaaaaaagaccugaucagcuacggcggcggcuggcggcuccagggauccuggaacacgggggaggaggugcaagucaucgcgguggagcccgggaagaaccccaagaacguucagaccgcccccgggacauucaagaccagcgagggcgagguuggcgccaucgcacuggauuucaagccugguacuagcggcucccccaucgugaaccgcgaggggaagaucgugggccuguacggcaacggggucgugacuaccaguggaacauacgucuccgcgaucgcgcaagccaaggcgagucaggagggcccucucccugagaucgaggacgaaguuuuccggaagcgcaaccugacgaucauggaucugcacccgggcucggggaagacccgaagguaccuccccgcgaucguccgggaagcaaucaagcgcaagcuacggacgcugauccucgcuccgacccgcguggucgccagcgaaauggccgaggcccugaaaggcaugcccauccgcuaccagacgaccgcggugaaguccgagcacaccggcaaggagaucguggaccugaugugccacgccaccuucacgaugagauuacuuagccccguccgcguucccaacuacaacaugaucaucauggaugaagcccacuucaccgacccguccagcaucgccgcacggggauacaucuccacccgcgugggcaugggggaggccgccgccauuuucaugacggcgacgccucccggcagcgucgaagcguucccccaauccaacgcgguaauccaggacgaggagagggacaucccggagcgcagcuggaacucaggguacgaguggaucaccgacuuccccgguaagaccguuugguucguccccagcauaaaauccggcaaugacaucgcaaacugucugcgcaagaacggaaagcgcgugauccagcucagccggaggaccuucgacacggaguaucaaaagacaaagaacaacgacugggauuacguggucaccaccgacaucuccgagaugggggccaacuuccgggcagaccgcgucaucgacccccggcgcugccugaaaccggugauccucaaggacggaccggagagggucauccucgcgggccccaugccagugacgguagcgagugcagcccagcgccgggggcgcaucggucggaaccacaacaaggagggcgaccaguacauuuacaugggucagccgcugaacaacgacgaagaccaugcucacuggaccgaggccaagaugcugcucgacaacaucaacacccccgagggaauaaucccagcccuguucgagcccgagcgcgagaagucagccgccaucgacggggaauaccgccugaggggcgaggcgcgaaaaacuuucguggaguuaaugcggcgcggggaccugccaguauggcugucuuacaagguagccucagagggcuuccaguauuccgaccggcgcuggugcuucgacggcgagaggaacaaccagguacucgaggagaauauggacguggaaaucuggacaaaggagggggagcgcaagaagcugcgacccagauggcuggacgcgcggacguacucugacccgcucgcgcuccgcgaguucaaagaguucgccgcgggacgaagauccgucucaggggaucucauucucgagauuggcaaacugccccagcaccugacccagcgggcccagaacgcauuggauaaccugguaaugcugcacaacuccgagcaaggcggccgcgcuuaucggcacgcgauggaggaauuaccggacaccaucgaaacgcuuaugcugcucgccuugauugccgugcugacgggaggggucaccuuauucuuccuaagcggccgggggcugggcaagaccuccauaggacuccugugugugauggcuagcucagcccuccuguggauggcgagcguggagccccacuggaucgccgccuccaucauccuugaguucuuccugaugguacuccugauacccgagcccgaccggcaacgcaccccgcaggauaaccagcuagccuacguggugaucgggcucuuauucaugauucuuacgguggccgcgaacgagaugggccuccuggaaaccaccaagaaggaucugggcaucggccacguugcuguagagaaccaccaccacgcagccaugcucgacguggaccuacacccggccagcgccuggacccuguacgcaguggccacgaccaucaucacccccaugaugcggcauaccaucgagaacacaaccgccaacaucucacucaccgccaucgcgaaccaggcugccauccugauggggcuggacaagggcuggccgaucaguaagauggacauuggcgugcccuuacuggcacuggggugcuacagccagguuaacccucucacucugacggcugccguccuuauguuagucgcacacuacgccaucaucggccccgggcugcaggccaaagcgacucgcgaagcccaaaagcgcaccgccgccggcaucaugaaaaacccgaccgucgacgggaucguggccaucgaccuggaucccgucgucuacgacgcaaaguuugagaagcagcucggacagaucaugcugcugauucucuguacgucccagauacugcugaugcgaacuaccugggcccucugcgagucaaucacgcuggccacgggcccccugaccacccucugggagggcagccccggcaaguucuggaauaccacgauugccgugagcauggccaacaucuuucgcggguccuacuuggcuggagcaggccucgcauucagccucaugaaguccuuagggggcggccggcgcgggaccggggcccaaggcgaaacccugggcgagaaguggaaacggcagcugaaccagcuuagcaaguccgaguucaacaccuacaagcgcagcgggaucauggagguggaccgguccgaggcgaaggagggccuaaagcgaggggaaacgaccaagcacgcagugagccgggggaccgccaagcucaggugguucguggagcggaaccuggugaagcccgaggguaaggucaucgaccucggcuguggccgcgggggcugguccuauuacugcgccggccugaagaaggugaccgaggugaagggcuacacgaagggcgggcccggccacgaagagcccauucccauggccaccuacgguuggaaccucgucaagcugcacagcggcaaagacguguucuucauuccgcccgaaaagugcgacacauuacucugcgauauaggggaguccucaccaaaccccaccauagaggagggccgaacgcugcgcgugcuuaaaauggucgagccguggcuccgggggaaucaauucugcaucaagauccugaaccccuacaugcccuccgugguagagacccuggaacagaugcagagaaaacauggcggcaugcucguucggaaccccuugucucgcaacuccacacacgagauguacugggugagcugcggcacuggcaacauugugucggcggucaauaugaccucaaggaugcugcucaaccgcuucacgauggcccaccgcaagccgaccuaugaacgggacguggaucuuggcgccggcacccgccacguagccguagagcccgagguggccaaccuggacaucaucggucagcggaucgagaacaucaagcacgagcacaagucuaccuggcauuacgacgaagacaaccccuacaaaacgugggcguaccacgggucauacgaggugaaacccagcggcagcgccagcuccauggugaaugggguggucaaacucuugaccaagccgugggacguaauccccauggugacccaaaucgcuaugacggacacgacgcccuucggccagcagcgcguauucaaggaaaagguggacacccgaacccccaaggccaagcgcgggacggcacagaucauggaggucaccgcaaaguggcuguggggcuuccucagccggaauaagaaaccacgcaucugcacccgugaggaguucacccgcaagguucguuccaaugcugccaucggcgccguuuucguggacgagaaucaguggaauagcgcgaaagaggcagucgaggacgagcgcuucugggaccuggugcauagggaacgcgagcugcacaaacaggggaagugcgcaacgugcguguacaacaugaugggcaagagggagaagaaacucggggaguucggcaaggccaaggggucucgcgcuaucugguacauguggcucggugcacgguuucuggaguucgaggcccucggguucaugaacgaggaucacugguucagccgcgagaacagucugagcgggguugagggcgagggccugcacaaacuuggcuacauccuucgagacaucucaaagauccccggugggaacauguaugccgacgacaccgcggguugggacacgagaaucacugaggacgacuugcagaacgaggccaagaucacggacaucauggagcccgagcacgcgcucuuagccaagucgaucuucaagcuaaccuaccagaacaagguggugcggguccagcgcccggccaagaacgggaccguaauggacgucauuagccgacgggaccagcgcggaucgggucaggucggcaccuacggccugaacacguucaccaacauggaggcccagcugauacggcagauggaguccgaggggaucuucagcccaucugagcucgagacccccaaccuugccggccgcguccuggacuggcuggagaagcacgguguggagcgacuuaagcgcauggcgaucaguggcgacgacugugucguaaaaccgaucgacgaccgguucgccacagcccucacggcccugaacgacaugggcaagguucgcaaagacaucccgcagugggagcccagcaagggcuggaacgacuggcaacaaguucccuucugcucccaccauuuucaccaacuuaucaugaaggacggcagagaaaucguggugcccugcaggaaccaagacgaacuggucgggcgggcccgcgugagccagggcgcgggguggucccugagggaaaccgccugccucggcaagucuuacgcucagauguggcagcugauguauuuccaccgccgugaccugcgccucgccgcgaacgcgauaugcuccgccgugcccgucgacuggguucccaccagccggaccacgugguccauccacgcccaccaucaguggaugaccacagaagacaugcugucggucuggaaccgcgucuggaucgaggagaaccccuggauggaggacaagacccacaucuccagcuggggcgacgugccuuaucugggcaagcgggaggaccaguggugcggcucccucaucggguugacggcccgcgcgaccugggccacgaacauacagguggcuaucaaccagguccgccgacugaucggcaacgagaacuaccucgacuacaugaccagcaugaagcgcuucaagaacgaguccgauccggagggagcccugugguga

SEQ ID NO: 24536 - RNA, 9879 nt, Artificial Sequence
  derived and/or modified CDS sequence (opt11) from DENV-1__EU482796__SS-prME
agcgugacuaugcuguugaugcucaugcccacggcgcuggcuuuucaccugacuacucggggaggggagccccacaugauugugaccaaacaagagcgagguaagagccugcuguucaagacuagcgccgggguaaauaugugcacccucauugcaauggaccucggugagcuaugcgaggacaccaugaccuacaaaugcccccgaaucaccgaggccgaaccagacgauguugacugcuggugcaacgcaacggacaccugggugaccuaugggaccugcagccaaacgggggaacaccggcgagauaagcggagcguugcgcuagcgccccacgugggacuugggcuggagacucgcacagagaccuggauguccucugagggagccuggaagcaaauacagcggguugagacgugggcgcucaggcacccaggauucaccguuaucgcacuguuccuagcgcacgccaucggaaccagcaucacccagaaagggauuaucuucaucuugcuuaugcugguuacgcccagcauggcgaugcggugcgucggcaucgguucccgcgauuucguugaaggucucagcggcgcuacauggguugacgucgugcuugagcacggcucaugcguuaccaccauggcaaaggacaagcccacucuggacaucgagcuccugaagaccgaggucaccaaccccgccguacugcggaaacuaugcauagaagcuaaaauaagcaacaccacgacagacucgcgcugccccacccagggcgaggcuacacucauggaggagcaggacgcuaacuuugugugccgcagaaccuucgucgaccggggcugggggaacggcugcggguuauucggaaaggggucguuaauuacgugcgccaaguuuaagugcgugaccaagcucgaaggaaagaucguccaguacgaaaaccuuaaguauuccgucauagugaccgugcauaccggcgaccagcaccaaguaggcaacgaaucuacagagcacggcaccaccgcuacgaucacgccucaggcacccaccucugagauccagcugaccgacuacggggcccugacccuggacugcucuccacgaacaggacucgacuucaacgagaugguucugcuuaccaugaaggagaagucguggcucguccacaagcagugguuccuggaccugccuuuaccuuggaccagcggugccuccacaagccaagaaacguggaaccggcaggaccugcucgugaccuucaagacagcccacgcgaagaagcaggagguggucgugcucggcagccaggagggcgcuaugcacacagcucugacuggggccacggagauccagacuuccggcaccacgaccauuuucgcagggcaucugaaaugccgccugaaaauggacaagcugaccuugaagggaaugagcuacgucaugugcacagguucguucaaacuugagaaggaggucgcggagacgcagcauggcaccguucugguucagauaaaguacgaaggaaccgacgccccaugcaagauccccuucaguacucaggaugaaaaggguguuacgcaaaaugggcggcugaucaccgccaacccgauugucaccgacaaggagaagcccguuaauauagaggccgagccucccuucggcgaguccuacaucgucauuggggcuggcgaaaaggcuuugaagcucucaugguucaagaagggguccagcauugggaagauguuugaggccaccgcccgcggcgcccgacgaauggcaauccugggcgauacggccugggauuucgguaguaucggcggaguguucacaucgauuggcaaauuagugcaccagaucuucggcaccgccuacggcgugcucuuuuccggaguuagcuggaccaugaagaucggaaucggcgugcugcucacgugguuaggccuaaacucccgcagcaccucccugucaaugacguguauagccgucggacucgugacccuauaccuuggaguaaugguccaggcggacuccgggugcguaauuaauuggaagggccgggagcucaagugcggguccggcaucuucgugacuaacgagguccacaccuggaccgagcaauacaaauuccaggcggacagcccgaagcgcuugagcgccgccauugggaaagccugggaggagggcguuugcggaauccguuccgcuacucgccuggagaacaucauguggaagcagaucuccaaugaacuaaaccacauccuacucgaaaaugacaugaaguucaccguggucgucggggacgucgucggcauacucgcgcaggggaagaaaaugauucggccccagccaauggagcacaaguacagcuggaaguccuggggcaaggccaagaucaucggggccgacguccagaacacgaccuucauuaucgacgggccgaauacccccgagugccccgacgaccaacgcgccuggaauauuugggagguggaggauuacggcuucgggauauucaccacuaacauuuggcugaagaugcgggauucuuacacccaaguaugcgaccaccgucuuauguccgcggccaucaaggacuccaaagccguucacgccgacaugggcuacuggauagagucugaaaagaacgagacguggaagcucgcccgggcgagcuucaucgaggucaagacuugcaucuggccuaagucccacacgcuguggagcaacgguguccuagagucugagaugauuaucccgaaaaucuacgggggcccgaucagccagcacaauuaccgccccggguauuucacgcagacggcuggccccuggcaccuugggaaacuggagcuggacuuugaccugugugagggaaccaccguaguggucgaugagcacugcggcaaccgggggccgagucuuaggaccaccacagugacgggcaagaucauccacgaauggugcugcaggagcugcacgcugccaccucugcgguucaagggggaggacggcugcugguacgggauggagauccggccugugaaggagaaggaagagaaccuaguaaagucaauggugagcgcggggagcggggagguugacucguucagccuuggguuacugugcaucuccauaaugaucgaggaggucaugcgaaguagguggucgcgaaagauguugaugaccggcacccuagccguguuccuguugcucauuaugggucagcugacguggaaugaucuuaucagacucugcauuauggugggugccaaugcgagcgaucggaugggcaugggcacgaccuaccuugcucugauggccacguuuaagaugcgccccauguucgccguuggucuguuguuccgacgccugacgucacgcgagguguugcuguuaacuauuggucuuagccugguggccucugucgagcugcccaacagcuuggaagaguugggcgacggucuggcgaugggcaucaugauccucaagcuguuaaccgacuuucagucccaccaacucugggcaaccuugcugagucucacguucauuaagaccacucucucccugcacuacgccuggaagaccauggcuauggugcucagcaucguuucucugauaccgcuuugucuuagcaccacgucgcagaagacgaccuggcugcccguccugcucgggagcuuggggugcaagccgcugacgauguuucucaucgcugaaaacaagaucuggggacgaaagucauggccccugaacgaagggaucauggcuguaggcguaguaagcauccugcucagcucccugcugaagaacgaugugccccuggccggacccuugauagccggcggcaugcugaucgccugcuacgucaucagcggauccagugcggacuuaucccuggagaaggccgccgaaguaucuugggaggaggaggccgaacacuccggcgcgucacauaacauccuggucgagguccaggacgacgggacaaugaaaaucaaggacgaggagagggaugauacccucacaauacugcugaaagcgacccugcuagccguguccgggguguacccacugaguaucccugccacacucuuugucugguauuucuggcagaaaaagaaacagcgguccggcguacucugggauacacccucuccgccggagguugaacgcgccguacuggacgacggcaucuaccgcauaaugcagcggggccuccucgggcgcucccaaguuggcgucggggucuuccaagagaacguguuucacaccauguggcaugugaccagaggugccguacugauguaccaggggaagagacuggaacccucaugggccuccguaaagaaagaccucaucagcuacgguggcggguggcggcuucagggcucguggaacaccggggaggaagugcaggucauagccguggagcccgguaagaaucccaaaaacgugcagaccgccccugggaccuuuaaaacgcccgagggcgaggucggcgccauugcauuagauuucaagcccgggacgucugguagcccgaucgugaaccgugaagggaagaucguaggcuuguacggcaauggggucgugacaaccucugguaccuacguaucagcgaucgcccaagccaaagccagucaggaggggccguuacccgagaucgaggaugagguauuccggaagcgcaaccugacgauuauggaccuccaccccggcagcgggaagaccagacgauaccugccggcgaucguccgggaagcgaucaagagaaagcugcggacgcucauccuugcccccacucgaguggucgccucagagauggccgaagcacucaagggcaugccaauuagguaucagacgaccgccgucaagucggagcauacaggcaaagagaucguugaccucaugugccacgcuacuuucacuaugagacuguugucccccguccgaguuccgaacuauaacaugaucaucauggaugaggcccacuucacggaccccagcaguauugcugcccgcggguacaucucuaccaggguaggaaugggggaggccgcggcgaucuuuaugaccgccacuccacccggcuccgucgaggcguucccgcagagcaacgccgugauacaggacgaggagcgagauauccccgagcgcagcuggaacucgggguacgaguggaucacugacuuccccggcaagacggugugguuuguacccuccauaaagucggguaacgacaucgcaaacugccuccggaagaacggaaagcgcgugauucagcuuucccggaagacguuugacacggaauaccagaagaccaaaaacaacgacugggacuacguaguaaccacagauaucucagagaugggugccaacuucagggcggaccgagucaucgacccacgccggugccugaagcccgucauccucaaagacgggcccgagcguguaauccuggcaggccccaugccgguaacgguagccuccgccgcucaacggcgcgggcggaucggucgcaaccacaacaaggagggugaucaguauaucuacaugggacagccccugaacaacgaugaggaccacgcucauuggaccgaggccaagaugcuccuagacaacaucaacacccccgaggggaucaucccggcucuauucgagccggagcgggagaaauccgccgccaucgacggggaguaccggcuccgcggcgaggcgagaaagaccuucguggagcugaugcggcgcggagaccugcccguguggcucuccuacaaggucgccagcgaggguuuccaguacagcgaccguagauggugcuucgacggggagcgcaacaaccaggugcuggaggaaaacauggacguggaaauuuggacgaaagagggagaaaggaagaagcugcgcccgcgguggcucgaugcgcgcaccuacucagauccccuugccuugcgggaguucaaggaauuugccgcuggucgccggagcguguccggggaccucaucuuagagaucgguaaacugccgcagcaucucacccagagagcccagaacgcgcuggacaaucugguuaugcuccacaacagcgagcagggugggcgggccuaccgccacgcgauggaggaauugcccgauaccauugagacucugaugcuccuggcacugauugccguguugaccggagggguaacccuguuuuuccugucaggccgggggcucggcaagacgagcauaggccugcuuuguguaauggcguccagcguguugcuguggauggccucagucgagccccacuggaucgccgcuucuaucauacuugaguucuucuuaauggugcugcucauccccgagccggaccggcagcggacaccccaggacaaccagcucgcuuauguggucaucgggcuguuguuuaugauccugacgguggccgcuaacgaaaugggguugcuagaaaccacgaagaaggaccucggaauaggacacguggccguugagaaccaccaucacgccaccaugcuggacguagaucuccauccugccagugcuuggacauuauaugcgguggcgaccacuaucaucaccccgaugaugcgccacacgauugagaacaccaccgcuaacaucucccugacugcaauugccaaucaggccgcgauccugauggggcucgacaagggauggcccaucucaaagauggacauaggcgucccccugcuagcccucgggugcuacagccaggugaauccccugacgcugaccgccgcagugcucaugcuggucgcgcacuacgccaucaucggcccggggcugcaggcgaaggcuacgcgggaggcccagaaaagaaccgcagccggcaucaugaagaacccuacgguggacgggaucguugccaucgaccucgaccccgucguguacgacgccaaauucgagaaacagcuaggucagauaaugcugcucaucuugugcaccucccagauacugcuaaugcgcacaaccugggcgcugugcgagagcaucacgcuugcgaccggcccccucaccacgcugugggaagggucgccggggaaauucuggaacacgacgaucgcaguaaguauggcuaauauuuuccgggguucuuaucuggccggugcuggccucgcguucaguuugaugaagucacuuggaggcggccgacgggggaccggggcccagggcgagacucucggugaaaaguggaagcgccagcugaaccaguuguccaagucggaguucaacaucuacaaacgauccgggaucauggaaguggacaggucagaagcaaaggaaggccucaaacgcggggagacgacucgucaugcaguaucccggggcacagcaaagcugaggugguuuguggagagaaacuuagucaagcccgaggggaaggugaucgaucucggcugcggccgcgggggcuggucauacuauugcgccgggcucaagaaggugaccgaggucaagggauacacgaaaggagggcccggccacgaagaacccaucccgauggccaccuauggcuggaaccuggugaagcuccacuccggcaaggacguguucuucacgccgcccgagaaaugugacacacuccuaugcgacauuggugagucgucucccaauccgacgaucgaggaaggccgcacuuugaggguccucaagauggucgagcccuggcugcggggcaaccaguucugcauuaagauccugaauccguacaugccaagcguggucgaaacucucgagcagaugcaacgcaagcacgguggcauguuaguccggaauccgcuaucccgcaacucaacccaugagauguacugggucuccugcgggaccggcaacaucgucuccgccguaaacaugacgucgcggaugcucuugaaccgcuucaccauggcccaccguaagcccacuuacgaaaaggacguggacuuaggggcaggcacccggcacgucgccguggaaccagaggucgccaaccucgacaucaucggccagcgcaucgagaauauuaaacacgagcacaaaagcacguggcauuaugacgaggacaaccccuauaagacuugggccuaccacggguccuacgaggucaagccgagcggauccgcgucaagcauggugaacggggucgugaagcugcugaccaagcccugggacguaauccccauggucacccagaucgcaaugacugacaccaccccuuucggccaacagcggguauucaaggagaagguggacacccgcacgcccaaggccaaacgggggaccguccagauuauggaagucaccgcaagguggcuuugggguuuccugaguaggaacaagaaaccacgcaucugcacccgugaggaauuuacaagaaagguccggagcaacgcagccauaggcgcgguguucguggaugagaaccaguggaacuccgccaaggaggccguggaggaugagcgguucugggaccuggucaagaaggaaagggagcuacacaagcaggggaagugugccaccuguguguacaacaugaugggcaagagagagaagaaacugggggaguuugguaaggcgaaggggagccgggcgaucugguacauguggcugggcgcccgcuuucuagaguuugaagcccucggauuuaugaacgaagaccauugguuuuccagggagaacagcuugagcgggguggagggcgaggggcuacauaagcugggcuauauccuacgcgacaucuccaagauuccgggagggaacauguaugccgacgacaccgcuggcugggacacccggaucaccgaagaugaccugcagaacgaggccaagaucacagacaucauggaaccggaacacgcucugcuggcuaccuccauauuuaaacucaccuaccagaacaaggucguccgcgugcagcggcccgcgaagaaugggacggugauggacgugaucucacgccgcgaccagcggggcagcggccagguaggcaccuacggcuugaacacguucaccaacauggaagcgcagcugauaaggcagauggaaucggaagggauuuuucucccguccgaacuggaaacgccuaacuuggccgagcggguccucgacugguuggagaaguacggcguggagcgcuuaaagcgcauggcgaucucuggcgacgacugugucguaaaaccgaucgacgaccgguucgccacugcccucacggcgcuaaacgauaugggcaagguucgaaaggacaucccucagugggagcccaguaagggguggaacgauuggcagcaagucccuuucugcagccaucacuuucaucaacucaucaugaaggacgggcgcgagauagucgugccgugucggaaccaagacgagcuggucggccgcgcacgcgucucacagggggccggguggagccugcgcgaaacagccugccugggcaagagcuacgcccagauguggcagcucauguacuuccaccggcgcgaucugcgcuuggcagccaacgcuaucugcuccgcagugcccguggacuggguccccacuagccgcaccaccugguccauccacgcucaccaccaguggaugacgacggaagacaugcucagcguauggaaucgcguguggaucgaggagaaucccuggauggaggauaagacccacgucuccagcuggggcgaugugccuuaccuggguaaacgcgaggaccaaugguguggcucccugauuggccucaccgcccgggcaaccugggccagcaauauccaaguagccaucaaucaaguacgccgccugauugggaacgaaaacuaucuggacuacaugacauccaugaagcgauucaagaacgagggugacccugaaggggcgcucugguga

SEQ ID NO: 24537 - RNA, 9879 nt, Artificial Sequence
  derived and/or modified CDS sequence (opt11) from DENV-1__EU482797__SS-prME
agcgugaccaugcugcucaugcugaugcccaccgcucuugccuuccaccucacgacucguggcggggaaccccauaugauagucagcaagcaggagcggggcaagucucugcuguucaagacaucugcgggggugaauaugugcacccucaucgcuauggaccugggcgaguuuugugaagacacgaugacuuauaagugcccgcgcaucaccgaggcggagccagacgacguggacugcuggugcaacgcgaccgacacgugggugacuuacgggaccugcagccaaaccggcgagcaccguagggacaagcgguccguagcccuggcgccccacguuggccucggccuggagacucgcaccgaaacguggaugagcuccgagggugccuggaagcagauccaacgggucgagacuugggccuugaggcacccaggguucacggucaucgcguuauuucuggcgcacgccaucggcaccagcaucacccaaaagggcaucauuuuuauccugcugaugcuugugacccccuccauggccaugcggugcgucggcaucggcucccgcgacuucguggaggggcuguccggcgccacguggguggacgucgugcucgagcacgggagcugcguuaccaccauggccaaggauaagcccacauuggacaucgagcugcucaagacggaggucaccaacccagcgguucugcggaagcugugcauagaggccaagaucuccaauaccaccacggacagccgcugcccgacccagggcgaagccacccucguggaggagcaagacgcaaauuucgucugcagacgcaccuucguggaccggggcugggggaacgggugcgggcuguucggcaaggguucccugaucacgugcgccaaguucaagugcgucacuaagcucgagggcaagaccguccaguaugagaaccuaaaguacagcgugaucgugacgguccacacaggcgaccagcaucagguggggaacgaguccaccgaacacggcaccaccgcgaccaucacgccccaagcgcccagcacagagauccagcugaccgacuacggggcacucacccuggacugcucaccucggacgggccuggacuucaacgaaaugguucuccuuacaaugaaagaaaaauccuggcuggugcauaagcagugguuucucgaccuaccgcugcccuggacuucaggggccuccaccagucaggagacguggaacaggaaggaccuccuggugaccuucaagaccgcccacgcuaagaagcaggaggucguggugcuugggucccaggagggcgccaugcacaccgcccucacgggggccacggagauacagaccagcggcaccacaaccaucuuugccgggcaccugaaaugccgccugaagauggacaagcucacguugaagggcauguccuacgucaugugcacugggagcuucaagcuggagaaagagguggcggagacgcagcacgguaccgugcucguccagaucaaguacgagggcacagacgcccccugcaagauccccuuuaguacucaggacgaaaagggcgugacgcagaacggcagacugaucaccgccaauccuaucgugaccgacaaggagaagcccgucaacauugaggccgagccgcccuucggggagagcuacaucgugaucggggcgggcgagaaggcccugaaacuguccugguucaaaaaggggagcuccaucggcaagauguucgaggccaccgcccgcggggcccggcgcauggcgauccucggcgacacggcgugggacuucgggagcauaggcggcguguucacauccgucgggaagcuggugcaccagauauucgguaccgccuacgggguguuauucagcggcguuuccuggaccaugaagaucgggaucggcgugcuccugaccuggcugggccucaauagccgcuccacgagcuuauccaugaccugcaucgcaguggggcuugucacccucuaccuuggcgugauggugcaggccgacagcgggugugucaucaacuggaaaggccgagagcugaagugcgggagcggcaucuuugugacgaacgaagugcauaccuggacagagcaguacaaguuccaggcggacuccccaaagcgccucagcgcugcaaucggcaaggcaugggaggagggugucugcgggauccgguccgccaccagacuggaaaacaucauguggaagcagaucagcaacgagcugaaccacauccuccuagagaacgacaugaaguucaccguaguggucggagacguggcgggcauccuggcccaggggaagaagaugaucaggccccagcccauggaguacaaguacuccuggaaauccuggggcaaggcaaagaucauaggcgcagacgugcaaaacacgaccuucaucaucgacggucccaacacccccgagugucccgacgaccagcgcgcguggaacaucugggaggucgaagacuacggcuucgggaucuucaccacgaacaucuggcucaaacugcgggacuccuacacccaggucugcgaccaccgccugauguccgccgccaucaaagacuccaaagccgugcacgccgacaugggcuacuggauugagucugagaaaaacgagaccuggaaacuagcgcgggccuccuucaucgaggucaagaccugcauauggcccaagagccacacgcugugguccaacggcgugcucgagagcgagaugaucaucccgaaaauauacggagggccaaucucccagcacaacuacaggcccggguacuucacccagaccgccggccccuggcaccucgggaagcuagagcuggacuucgaccucugcgagggcacgacgguggucguggacgagcacugcggaaaccgggggccgucgcuucgcaccacuaccgugaccggaaagauuauccacgaguggugcugucgguccugcacccugccgccccugcguuucaaaggggaggacgguugcugguacgggauggagauccggcccgucaaggagaaggaggagaauuuggucaagagcauggugagugccggcuccggcgagguggacagcuuuucauuaggacuccugugcaucagcaucaugauagaggaggugaugcgcucccgguggagccgcaagaugcugaugaccgggacccucgccguguuuuuccugcugaucaugggacagcucacguggaacgaccuaaucagauugugcaucauggugggcgcgaacgccuccgaccgcaugggaaugggcacaacauaccucgcccugauggccaccuucaagaugcgcccuauguuugcuguggggcuccuguuccgccgccugacgagccgggaggugcuacuccugaccaucgggcugagccucgucgcgagcguggagcugcccaauucacuggaggaacugggcgaugggcuggccaugggcauuaugauucugaagcuccugaccgacuuccaaucgcaccaacugugggccacgcuccugucccugaccuucaucaaaaccaccuucagccuccacuacgccuggaagacuauggcuaugguuuuaucgaucgugucucuguucccccucugccuuucuacgaccagucagaagaccacguggcugcccguucuccuggggucccuggggugcaagccgcucacgauguuucugauagccgagaauaaaauuuggggccgcaagagcuggccccugaacgaggguaucauggccgucggcaucgucagcauccuccuguccagccugcucaagaacgacgucccccuggcggggccccugauagccgguggcaugcucaucgcgugcuacgugauuuccgggucauccgccgaccugagccuggagaaggccgcagaggugagcugggaagaagaggccgagcacagcggcgcgucccacaauauucucguggagguccaggacgacgggaccaugaagauaaaggacgaggaacgggacgacacccugaccauccuccucaaggccacucuguuggccgugucaggaguguacccgcuguccauacccgcgacacuguucgucugguacuucuggcagaagaagaagcaaaggagcggggugcugugggacacccccuccccgcccgaaguggagcgggccguccucgaugacggcaucuaccgcauuaugcagcggggcuugcuggggcgcagccaagugggcgugggcgucuuccaagagaacguguuccacaccauguggcacguaacccguggagcgguccugauguaucaggggaagcggcucgagcccuccugggcuagcgugaagaaggaccugauuuccuacggcggaggguggcggcugcagggaucauggaacacuggagaggagguccaggucaucgccguggagcccggcaagaaccccaagaaugugcagacagcccccgggacguucaagacauccgagggcgaggucggcgccaucgcuuuagacuucaagcccgggacgagcggcagccccaucgugaaccgcgagggaaaaaucguuggucuguacggcaauggagucgugaccacuuccggcacuuacguuagugccaucgcccaagccaaggcgucccaggagggcccccugcccgagaucgaggaugaggucuucagaaagaggaaccucaccaucauggaccugcaccccggcagcgggaaaacccggcgcuaccugccugccaucguacgggaggccauuaagcgcaagcuccggacgcugauccuugcccccacacgcguagucgccucggagauggcggaggcccucaagggcaugcccauccgauaccagacgaccgcugucaaaagcgagcacaccggcaaggagaucguggaccugaugugccacgccaccuucacgaugcggcugcucagccccguccgcgugcccaauuauaacaugaucaucauggacgaggcccacuucacggacccgagcuccaucgcggccaggggguauaucagcaccagagugggcaugggggaggccgccgccaucuucaugacggcgacgccgcccggcuccgucgaagccuucccccaauccaaugcgguuauccaggacgaggaacgggacaucccggagcgcaguuggaacagcggguacgaguggaucaccgacuuccccggcaagaccgugugguucguccccuccaucaagagcggcaacgacaucgccaacugccuucggaagaacgggaaacgcgugauccagcugucccggaagaccuucgacacagaauaccagaagacgaagaacaacgacugggacuacgugguuacaacggacaucagcgagaugggcgcgaauuuccgcgccgacagggugauagacccccgccggugccucaagccgguaauacugaaggacgggcccgagagagucauacuggcaggcccgaugcccgugacggucgccuccgcugcgcaacggcgcgggcgcauaggccgcaaccacaauaaggagggcgaucaguacauauacauggggcagccgcuuaacaacgacgaggaucacgcccacuggaccgaggccaagaugcugcuggauaauaucaacacccccgaagggaucaucccugcacucuucgaacccgagcgggagaaguccgccgccaucgacggggaguaccgucugcgcggcgaggcucggaagaccuucguagagcugaugcgccgcggggaccucccgguguggcugucguacaaggucgccuccgagggcuuccaguacucugaccgcagauggugcuucgacggcgagcgcaacaaccaggugcuggaggagaacauggacguggagauuuggacgaaggaaggggagcggaagaaguuaagaccccgcuggcuugacgcucgcacauacuccgacccucuggcccuccgggaguuuaaagaguucgcggccggccgccggagcgucuccggggaccugaucuuagagaucggcaagcucccccaacaccugacccagagagcccagaacgccuuggacaacuuagucaugcugcacaacagcgaacagggcgggcgggcguaccgccacgcgauggaggagcugccugacaccauugagacccucaugcugcuggcacucauugccgugcugaccggcggggucacgcuguucuuccucuccggccggggccucggcaagaccagcaucgggcugcucugcgugauggcaucgagcguccuucuguggauggcuuccgucgagccccauuggaucgccgccagcaucauccucgaguucuuccuuauggugcugcucauccccgagcccgaccgccagcgaaccccacaggacaaccagcuggcauacguggucaucggacuccucuucaugauccugacgguggccgcgaacgagaugggccuguuggagaccaccaaaaaggaccuggguauaggccacguggccguugagaaccaccaccacgccgccaugcuggacguggaccuccaccccgccuccgcguggacccuauacgccgucgccacgaccaucaucacccccaugaugcgucacaccaucgagaauacgaccgcgaacaucagccugaccgccaucgccaaccaggccgcaaucuuaaugggucuggacaagggcuggccgaucuccaaaauggacaucggugucccccuucucgcccuggggugcuacagccaagugaacccgcugacccuuacggcggccgugcugaugcuggucgcucacuacgcgauaauagggccgggguuacaggcaaaggcgacaagggaggcgcagaaacgcacagccgccggcaucaugaagaacccgaccguggacgggauaguggccaucgaccuggaccccgucguguacgacgcaaaguuugagaagcagcugggccagaucaugcucuuaauccugugcacgucacagauacuccugaugcgaacuaccugggcacucugcgaaagcaucacacucgccacgggcccccuuacuacauugugggaagggucccccgguaaguucuggaauaccacgaucgccgugagcauggcuaacaucuuccgggggagcuaucucgcgggcgccggccuugccuucuccuuaaugaagucccuagggggcgggcgccggggcaccggagcccagggcgagacacugggcgagaaguggaagcgccagcugaaccagcucuccaagagcgaguucaacacguacaagcgaucuggcaucauggaagucgaucgaagcgaggcgaaggaggggcugaagcgcggggagacgaccaagcacgccguguccaggggcacggcgaagcugcggugguucguggagcggaaucucgucaagccugaggguaaggucaucgaccugggauguggccgcggaggauggagcuacuacugcgccggguugaagaaaguaacggaagucaagggguauaccaagggcgggcccggccacgaagaacccauccccauggcuacguacggcuggaaccugguaaaguuacauucuggcaaggacguuuucuucaucccgcccgagaagugcgauacccugcucugcgacauaggggagagcuccccaaaccccaccaucgaggaaggucggacgcuccggguccugaagaugguggaaccauggcugcgcgggaaccaguucugcaucaagauccuuaauccauacaugccgagcguagucgagacccuagagcagaugcagcggaaacacggcggcaugcuggugcguaacccccucucccggaacagcacacacgagauguacuggguauccugcgggaccggcaauaucgucagcgcggucaacaugaccagcaggaugcuacugaacagauucacuauggcccaucgcaagccgaccuacgagcgcgacguggaccucggggcuggcacccggcacguugccguggagcccgaaguggccaaccuggauaucauuggccagcgcaucgagaacaucaaacaugagcacaagagcaccuggcacuacgacgaggacaaccccuauaagacgugggcguaccacggguccuacgagguuaagcccagcggcagcgccuccagcauggucaacgguguugugaagcugcucaccaagccgugggaugugauuccuauggucacgcaaaucgcuaugaccgacacgacgccguucgggcagcagcggguguucaaggagaaaguagacacccgcacccccaaggccaagcgggggaccgcccagauaauggaggucaccgcgaaguggcuguggggguuucugucccgcaacaagaagccgagaauuugcacccgggaggaguuuacccggaaagugcgcagcaacgccgcgauaggggccguauucgucgacgagaaccaguggaacuccgcaaaggaggccguagaggacgagagauucugggaucucgugcaccgcgagcgugagcugcacaagcaggggaagugcgcaaccugcgucuacaacaugaugggcaagcgagaaaagaagcugggggaauuuggcaaggccaaagggagccgugccaucugguacauguggcucggcgcgcgcuuccuggaguucgaggcccugggcuucaugaacgaggaccacugguucuccagagagaacagcuuaagugggguggagggugaggggcugcauaaguuggguuauauccuccgcgacaucagcaagaucccugggggcaauauguacgccgacgacacagccggcugggacacgcgcaucacagaagacgaccugcagaacgaggcgaagaucacugacauuauggagcccgagcaugcgcugcucgcaaaguccaucuucaagcugaccuaccagaacaaggugguccgcguccaacggcccgcuaagaacgggaccgugauggacgucaucagccgccgugaucagcggggcuccggccaggugggaaccuacggccugaacacguucaccaacauggaggcacagcucauccgccagauggaaagugaggggaucuucucccccagcgagcuggagacccccaaccuggccggccggguguuagacuggcuggagaagcacggagucgagcgccuuaaacggauggcgauuuccggcgaugacugcguagugaagccaaucgacgaccgcuucgcuaccgcgcucacggcuuuaaacgacauggggaagguccggaaggacgugccgcaaugggagcccagcaagggcuggaaugacuggcagcaggucccauucugcagccaccacuuucaccagcugaucaugaaggacgggcgcgagauagucgugcccugcaggaaccaggacgagcucgugggccgagcgcgggucucccagggcgcgggguggagccugcgcgagaccgcuugccugggcaaguccuaugcacagauguggcagcuuauguacuuccaccggcgcgaccugcggcuggccgcgaacgcgaucuguagcgccgugccgguggacuggguccccaccucccgcacuacguggagcauccacgcccaccaccaguggaugaccaccgaagacaugcucuccguguggaaccggguauggauagaggagaaccccuggauggaagacaagacccacauuagcucauggggagacguccccuacuuaggcaagcgcgaggaccaguggugugguagccugaucggccugacggcccgggcgaccugggcuaccaacauccagguggccaucaaccaggugcgcaggcugauugguaacgagaacuaucuggacuauaugaccuccaugaagcgguucaagaacgaauccgauccggagggggcccucugguga

SEQ ID NO: 24538 - RNA, 9879 nt, Artificial Sequence
  derived and/or modified CDS sequence (opt11) from DENV-1__EU482799__SS-prME
agcgugacgaugcugcucaugcugaugcccaccgcucuggccuuccaucucaccacccggggcggggaaccgcauaugaucgugucuaaacaggagaggggaaagagccugcuguucaagacaagcgccggggugaacaugugcacccucaucgccauggaccuaggcgagcugugcgaggauaccaugaccuacaagugcccccgcauaaccgagacugaacccgacgacgucgacugcuggugcaacgccacggacaccuggguuaccuaugggaccugcagccaaacaggcgagcaucggcgggacaagcggucaguggcccucgcgccccaugugggccucgggcuggaaacccgcacagaaacuuggaugagcuccgaaggcgccuggaagcagauccagcgggucgagacgugggcccugcggcaucccggguucacaguaaucgcgcuguuucuggcccacgugaucgggaccagcaucacccagaaagggauaaucuucaucuuacugaugcuggucacucccuccauggcgaugcggugcgugggcauuggcagccgcgacuucgucgaggggcucuccggcgcaacuugggucgacgucgugcuggagcacgggagcugcgucaccacuauggccaaggacaagcccacgcuggacauagagcuccugaaaaccgaggugaccaaccccgccguauugcguaaacucugcaucgaggcgaagaucuccaacaccacgaccgacagccgcugcccgacccaaggcgaggcgaccuuggucgaggagcaggaugcuaauuucgugugucggcgcacuuucgucgaccgcggcugggggaacggcugugggcuguucggcaaggggucgcucaucacgugcgccaaguuuaaaugcgucacaaagcuggaggguaagauuguucaguaugagaaccuuaaguacagcgugaucgucaccgugcacacgggcgaccagcaucagguagggaacgaguccaccgagcacggcacuaccgccaccaucacaccccaagcccccaccaccgagauccagcuuacugauuacggggcgcugacgcuugacugcagcccccgcacaggccuagacuucaaugagauggugcugcuuacgaugaaggaaaaauccuggcucgugcacaagcagugguuccuggauuugccccuccccuggaccagcggggccucgacaucccaggagaccuggaaccggcaggaccugcuggucacuuucaagaccgcucaugccaagaagcaggagguggugguccucggcucgcaggaaggcgccaugcacacagcguugacgggggccaccgagauucagacauccggcacgaccaccauauucgccggacaccuaaagugccgccucaagauggacaagcugacccugaaggggaugagcuacgugaugugcacgggguccuucaagcucgaaaaggagguggcagagacccagcacggcaccguacuggugcagauaaaguacgagggcacggacgcccccugcaagauacccuucagcacgcaagacgagaagggggugacgcagaacgggcgguugaucaccgcgaacccgaucgucaccgacaaggaaaagcccgugaacaucgaggccgagccgcccuucggggagucuuauaucauuaucggcgcgggcgagaagacgcugaagcucagcugguucaaaaagggguccagcaucggcaagauguucgaagccaccgcgcggggugcccggcgcauggccaucuugggggacaccgccugggacuucggauccauaggcgguguuuucaccucaguugggaaguuagugcaucaaaucuucggcacggccuauggggugcuguucuccggcgucagcuggaccaugaagaucgggauaggcgugcuccugaccuggcucggccugaacucccgaagcaccucucugucgaugacgugcaucgcgguggggcucgugacgcuguaccuggggguaauggugcaggcggacagugggugcgucauuaacuggaagggccgggagcucaagugcgggagcggcaucuucgugaccaacgagauccacaccuggaccgagcaauacaaguuccaagccgacagcccgaagcgccuguccgcggccauaggcaaagcgugggaggaaggggugugcggaauccggagcgccacgaggcuggagaacaucauguggaagcaaaucucaaacgagcucaaucauauccuccuggagaaugacaugaaguucacugucgugguuggugauguugccggcauccuggcccaggggaagaagaugauccggccccagcccauggaguacaaguauagcuggaaaucauggggcaaggcaaagaucaucggcgcagaugugcagaacaccaccuucaucauagaugggcccaauacgcccgaaugccccgaugaccagcgcgccuggaacaucugggagguggaggauuacggauucgggaucuucacgaccaacaucuggcuuaagcugcgggacagcuacacccaggucugcgaucaccgacuuaugagugccgccauaaaggauagcaaggcgguccaugcagacaugggcuacuggauagaguccgagaagaaugagacguggaagcuggcgcgggcaaguuucaucgaggugaagaccugcaucuggcccaagucccacacccuguggagcaacggcguccucgaguccgagaugaucauccccaagaucuacgggggcccgaucucacaacauaacuaccgcccuggguacuucacccagacggccggccccuggcaccuggggaagcucgaguuagauuucgaccugugugaggguaccaccgugguggucgacgaacacuguggcaaucgcgguccuucacugcgcaccacgacggugacgggcaagauaauccacgaauggugcugucggagcugcacucugccgccccuccgcuuucgcggcgaggacgggugcugguacgggauggagauucgcccaguaaaggagaaggaagaaaaccuggucaaguccauggugagcgccggaagcggcgagguggacucauucagccucgggcuacucugcaucuccaucaugaucgaggaggucaugcggagccgcuggucccggaaaaugcucaugacggguacccuggccguguucuuccuucucaucauggggcagcugaccuggaacgaccugauccgacucugcauuauggugggcgcaaacgccagcgaccgcaugggcaugggcaccacguacuuagcccugauggcgaccuucaagaugcggccgauguucgcagugggccucuuauuucggcggcugacaucccgcgaggugcuccuccugaccaucgggcucagccuggucgccuccgucgagcugcccaacagccucgaggagcuuggcgacggucuggccaugggcauaaugaucuugaaacugcucacugacuuccaaagccaccagcucugggccacccugcugucgcucaccuucauaaagaccacguucucccugcauuaugcguggaagaccauggccauggugcugagcaucgucuccuuauucccccugugcuugagcaccaccucccagaagacgaccuggcuccccguacugcuagggagcuuggggugcaagccgcugaccauguuccugaucgccgagaacaagaucuggggccggcgcuccuggccucucaacgaggggauuauggccgugggcaucgucagcauucugcugucaagccuacugaagaacgacgugccccuggccgggccccucaucgccggcggcaugcugaucgccugcuacgugaucagcgggucuucggccgaccugucccucgagaaggccgcagaagucagcugggaggaggaggcugagcacuccggcgccagccacaauauccugguggaggugcaggacgacgggaccaugaagaucaaggacgaggagcgggaugauacccuaacgaucuuacugaaagccacccugcucgcagucuccggggucuauccgcugagcauccccgcgacacuguucgugugguacuucuggcagaagaagaagcagcgcuccggagugcucugggauacccccagcccaccagagguggagcgggccguauuagacgacggcaucuaccgcaucaugcagcggggcuugcugggacgcucccaggucggcgugggcguguuccaagagaacgucuuccacacgauguggcacgugacccggggcgcagugcucauguaucaggggaagcgccuggagccgagcugggccucagucaagaaggaccucaucucguacggaggcggguggcgacuccagggauccuggaacaccggggaggagguccaggucaucgccgucgaaccggguaagaaccccaagaacgugcagaccgcgccagggacguucaagacccccgagggcgagguuggcgccaucgcccuggauuucaagccggggaccagcggcucgcccauagucaauagagaaggaaagaucgugggacuguacggcaacgggguggucaccacgagcggcaccuacgugucugccaucgcccaggccaaggccucccaggaggguccgcuccccgagaucgaggacgagguguuccggaagcgcaaccugaccaucauggaucugcacccgggcagcgggaaaacucggagguaucucccugccaucguacgggaggcgaucaagcguaagcugcgcacgcugauacucgcgcccacgagagugguggccuccgagauggccgaggcccugaaggggaugcccauccgcuaccagaccaccgcagucaaaagcgagcacacuggcaaagagaucguggaccugaugugccaugcgacauuuaccaugcggcuucuaucccccgugcgcgucccuaauuacaauaugaucauaauggacgaggcccauuucaccgaccccaguucuaucgccgcgcggggguacauaagcacucgcgugggcaugggggaagccgcggccauuuucaugaccgccaccccgcccggcuccguggaggccuucccgcaaagcaaugccgucauccaggacgaggagcgcgauauucccgagcgcuccuggaacagcggguacgaguggaucacggacuuucccggcaaaacggugugguucgugcccagcaucaagagcggaaacgacaucgcuaacugccugcguaagaacgggaagcgcgucauccagcucucccggaagacguucgacaccgaguaucagaagacaaagaacaacgacugggacuacguugugacgaccgacaucagcgagaugggcgccaauuuccgcgccgaccgggucaucgacccgcgccggugccugaagcccgugauucugaaggacgguccggaacgcguaauacucgcggggcccaugccggugaccguggcguccgccgcccagcggcgcgggcggaucggucgcaaccacaacaaggagggcgaccaguacauauacauggggcagccccugaacaacgacgaggaccacgcccacuggaccgaggccaagaugcugcucgacaacaucaacacgccggaggggauuauacccgcgcuguucgaaccggagcgugaaaaguccgccgccaucgacggggaauaccggcugcgcggcgaagcccgaaagaccuucgucgagcucaugcgccgcggggaccucccgguguggcuguccuacaaggucgccagcgagggauuccaauacagcgacaggagguggugcuucgacggcgagcgcaacaaccaaguccucgaggagaacauggauguggaaaucuggacuaaggagggagagcguaagaagcucagaccccgguggcuggacgcgcguacauacuccgacccccucgcacugcgcgaguucaaggaguucgccgccggccggcggucuguguccggcgaccuuauccucgagaucgggaagcucccccagcaccugacgcagcgcgcccagaacgcguuggacaaucuggucaugcugcacaacagcgagcagggcggucgggccuaccgccacgccauggaggagcucccugacaccaucgagacccugauguuacucgcucugauagcugugcugaccggaggggugaccuuauucuuccugaguggccgaggacuggguaagacgagcaucggccuccugugcguaauggcauccagcguacugcuauggauggccuccgucgagccacacuggaucgcagccaguauaauccuggaguucuuccugaugguccuucugauccccgagccggacagacagcggacaccccaggauaaucagcuugccuacguggugaucgggcuccuguucaugauccugacugucgccgccaacgagaugggacuccuggagacgacgaagaaagacuuaggcaucggccacguggccguggagaaccaccaccacgcugcgaugcucgacguugaccugcacccagccucggcguggacucuguacgccguggccaccaccaucaucaccccgaugaugaggcauacaauugagaacaccaccgcgaacaucagccucacggccaucgccaaccaggcggcgauucuaauggggcuggauaagggcuggcccaucuccaaaauggacauuggcguuccgcuccucgcacucgggugcuacagccaggucaacccgcuaacccugaccgccgccgugcuaauguugguugcucacuaugcaaucaucggcccggggcuccaggccaaggcaacccgcgaggcgcagaagcgcacggccgcgggcaucaugaagaaucccacggucgaugggauuguggccauagaucuggaccccguugucuacgacgccaaguucgaaaagcagcucgggcagauaaugcuguugauccucuguaccucccagauccugcugaugcgcaccacgugggcccucugcgagagcaucacccuggccacaggcccccugaccacccucugggaggggaguccgggcaaguucuggaacacgaccauugcgguuucuauggccaauaucuuccggggguccuaucuugccggggccggacuggcauucagcuuaaugaagucccucggcggcgggcgccgggggaccggggcgcagggcgagacgcugggcgagaaguggaagcgccagcucaaccagcuguccaagagcgaguucaacaccuacaagcgguccggcauaauggagguggaccgcuccgaggcuaaggagggccugaagcgcggugagaccacgaaacacgcagucucucggggcacggccaagcuccggugguucguggagcgcaaccuggugaagcccgagggaaaagucauagaucugggcugcggccgcggugguuggaguuacuacugcgcggggcugaagaagguuaccgaggugaaggguuacaccaagggaggccccggccacgaagaaccuauccccauggcuacauacggguggaaccucgugaagcugcacuccgggaaggacguguucuucaucccacccgaaaagugcgauacgcuccucugcgauaucggcgagagcucccccaacccuaccaucgaggagggucgcaccuugagaguuuuaaagauggucgagcccuggcuacgcgggaaucaguucugcaucaagauccugaaccccuacaugccgagcguuguggagacgcuggagcagaugcagcggaagcacggcggcaugcucguccgcaacccgcucucccggaauagcacucacgagauguacuggguguccugcgggacuggcaacaucgugagcgccguaaacaugacguccaggaugcuucugaaccgcuucaccauggcccaccggaagcccaccuacgaacgcgacguggaccuaggugccggcacgcgucacguagcgguugagcccgagguggccaaucuggacaucaucggccagcgaaucgagaacaucaagcacgaacacaagagcaccuggcacuaugacgaggacaaccccuacaagacgugggccuaucacgggaguuacgaagugaagccgagcgguuccgccagcagcauggucaacgggguggucaaacuucugaccaagcccugggacgugauccccaugguuacgcagaucgccaugaccgacaccacccccuucggucagcagcgggucuuuaaggagaagguggacacgcgcaccccgaaagcgaagcgaggaaccgcccaaaucauggaggugaccgccaaauggcuguggggcuuccucucucgcaacaagaagccccgcaucugcacgcgcgaagaguuuacccggaaaguccgaucuaacgccgccaucggcgcgguguuuguggaugagaaccaguggaacucagccaaggaggccguagaggacgagcgguucugggaucuggugcaccgcgaacgggaguugcacaagcaggguaagugugcgacuuguguguacaauaugaugggaaagcgcgagaaaaagcucggcgaguuuggcaaagcgaaggggucacgggccaucugguacauguggcugggcgcccgcuuucuggaguucgaggcccucggcuuuaugaaugaggaccacugguucucacgggaaaacagccuguccggggucgagggcgagggucugcacaagcugggcuauauacugcgugacaucaguaagaucccagggggcaacauguacgccgacgacaccgcgggcugggauacgcggaucaccgaggacgaccuccagaacgaagcccgaaucacagacauuauggagccggagcacgcccuacuggccaaguccaucuucaaguugacguaucagaacaagguggugcgcguacagcggcccgccaagaacgggacggugauggaugugaucucucgacgggaccaacgcggauccgggcaggucgggaccuacggccucaacaccuucaccaacauggaggcgcagcugaucaggcagauggagagcgaggguaucuucagucccagcgaacuggagacucccaaccucgccgagcgcgugcuggacuggcuugagaaguacgguguggaacggcucaagcgcauggcuaucaguggggaugacugcgucgugaaaccgauugacgaccgauucgccaccgccuuaaccgcucuaaacgacaugggcaaggugcgcaaagacaucccucaaugggaacccagcaagggauggaacgacuggcagcaggucccauuuuguucccaccacuuucaccagcucaucaugaaggacggccgggagauaguggucccgugcagaaaccaggacgagcuuguuggccgggcccgcgugagucagggcgccggguggagcuuacgggagaccgccugccucggaaagagcuacgcccaaauguggcaguuaauguacuuccaccgcagagaccuucgcuuagcggccaacgccaucugcagcgccgugcccgucgacuggaucccgacgucccggaccaccuggagcauccaugcgcaccaccaguggaugaccacggaggacaugcuguccguguggaaccgcguguggaucgaggaaaaccccuggauggaggacaagacucacaucagcuccuggggcgacgucccguaccuggggaagcgcgaggaccaguggugcggcagccucaucggccugaccgcccgggcgaccugggccaccaacauccaaguggccauuaaccagguucgccggcugaucgggaaugaaaacuaccucgacuauaugacguccaugaagcgcuucaaaaacgagagugaccccgagggcgcguuaugguga

SEQ ID NO: 24539 - RNA, 9879 nt, Artificial Sequence
  derived and/or modified CDS sequence (opt11) from DENV-1__EU482800__SS-prME
agcgugaccaugcugcucaugcugaugcccaccgcacuggcauuucaccucaccacccgggguggggagccccacaugaucgugagcaagcaggagcggggaaaaucacugcuguuuaaaaccagcgcgggggugaacaugugcacccucaucgccauggaccugggagaguucugugaggauaccaugacuuacaagugcccccgcaucaccgaggccgagccugacgacguggacugcuggugcaacgccaccgacacgugggucaccuacgguaccugcagccagaccgggcagcaccgacgagauaagcgguccguggcacuggcgccccacgugggucucgggcuggagacgcgcacugagaccuggaugagcuccgagggcgccuggaagcagauccagcgggucgaaacuugggcucugcgccacccuggguucacugugaucgcacucuuccuggcacacgccaucggcaccucuaucacccagaaggggaucaucuucauccuguugaugcuggugaccccaucuauggcgaugcgcugugucggcaucggcagccgcgauuuuguggagggcuuauccggggccacguggguggacgucgugcuugagcaugggagcugcgugacuaccauggccaaggacaagcccacacuggacauagagcugcucaagacggaggucaccaaccccgcggugcugcggaagcugugcaucgaagccaagaucuccaacaccaccaucgacucacgcugcccgacgcaaggcgaggcaacccucguggaggagcaggacgcuaacuuuguaugccggcgaaccuucguggaccggggcugggguaacggcugugggcuguuuggcaagggaucccugaucacgugcgcaaaguucaagugcguuacgaagcuugagggcaagaccguccaguacgagaaccugaaguacaguguaauuguuaccgugcacaccggugaccagcaccagguggggaacgaguccaccgagcacggcaccaccgcgaccaucacgccccaagccccuagcacagaaauccagcugaccgacuauggggcccucacccuagacugcucaccgcggaccggcuuagacuucaacgagaugguucuccugacgaugaaggagaagucguggcuugugcacaagcagugguuucucgaucugccgcugcccuggaccucgggggccuccaccagccaggagaccuggaaccgcaaggaccuccuggucacguuuaagaccgcccacgcgaagaagcaggaggucguggugcugggcucccaggagggcgccaugcacaccgcccugaccggcgcuacggagauccaaaccucuggcaccacaacgauuuucgcggggcaucugaagugccgccugaagauggacaagcucacccugaagggcauguccuacgugauguguaccggaagcuucaagcuggaaaaggagguggcggaaacccagcauggcacggugcugguccagaucaaguacgaggggaccgacgcccccugcaagauccccuucucaacacaggacgagaaaggggucacucagaacggacggcugaucacggcgaauccuaucgugaccgacaaagaaaagcccguuaacaucgaggcagaaccccccuucggggagucuuacaucgucaucggggcgggcgagaaggcgcuaaagcugucuugguucaagaagggcagcuccaucggcaaaauguuugaggcuaccgccaggggggccaggcgcauggcgauccucggcgacaccgcuugggacuucgggagcauugguggugucuucacgagcgucgggaagcuggugcaccaaaucuucggcaccgccuacggcguacuguucagcggcgucuccuggaccaugaagaucggaaucggcguacugcugaccuggcucggacucaauucacguuccacgagccucuccaugaccugcauagccgugggguugguuacccucuaccuaggcgugauggugcaagccgacucugggugcgucaucaacuggaagggccgggagcugaagugcgggagcggcaucuucgugaccaacgaggugcacacuuggacggagcaguacaaguuccaggcggacuccccaaaacgccucagcgccgcuaucggcaaagccugggaggagggggucugcggcaucagaucggugaccaggcuggagaacauuauguggaaacagaucagcaaugaacugaaucacauccuuuuagagaacgauaugaaguuuacgguggucgugggggacguugccgguauccuggcgcaggggaagaagaugauccguccacagcccauggaguacaaguacucguggaaguccuggggcaaggccaaaaucaucggcgccgacguccagaacaccacguuuaucauagaugggcccaacaccccagagugccccgacgaccaacgcgccuggaacaucugggagguggaggauuacgguuucgggaucuucaccaccaacaucuggcucaagcugcgggacuccuacacccaggugugcgaccaccgacugaugagcgcggccauaaaggacucuaaggccguccaugccgacaugggcuacuggaucgagagcgagaagaacgagaccuggaagcucgccagggcaucuuuuaucgaggugaagaccuguaucuggccgaagagccacacccuguggucuaacggcguacuggagagcgaaaugaucaucccgaagauauacgggggcccgauaucccagcacaacuacagaccaggguacuuuacgcaaacugccggccccuggcaccucgggaagcuggaacuggacuucgaccugugcgagggcaccacagucgugguggacgagcacugcggcaauagagggccgagccuacgcacgaccaccgucaccggcaaaaucauccacgaguggugcugccggucaugcacacugccgccccugcgcuucaaaggugaggacggcugcugguacgggauggagauccggcccgugaaggagaaagaagagaaccuugucaagagcauggucagcgccggcucuggugagguggacagcuucucccugggccuccuguguaucucaaucaugaucgaggaggucaugcgcucccgguggagccgaaaaauguuaaugaccggcacccuugccguguucuuccuacucaucaugggccagcucaccuggaacgaccugauccggcugugcaucaugguaggcgcgaacgcgucagaccguauggggaugggcaccacguaccucgcucuaauggcgaccuucaagaugcgcccgauguucgccgugggauugcuauuccggcgacugacuagccgggagguucugcuccugaccauuggguuaagucucguggcaagcguugagcugcccaauucccuugaggagcucggagacggacuggcgaugggcauaaugaucuuaaagcuccugaccgacuuccagagccaccagcugugggccacccuccugagccugaccuucaucaagacuaccuucagccuccacuacgcuuggaagaccauggcgauggugcuguccaucguuagccuguucccccucugccugucuaccacgucacagaagaccaccuggcugccgguccuccucggcucccuggggugcaagccgcugacuauguuccugaucgcggagaacaagaucuggggucggaaguccuggccacugaacgagggaaucauggcuguggggauaguaagcauacuacugucuagccugcucaagaacgacguuccauuagccgggccccuuauugccggcggaaugcucauugcgugcuacgugaucuccgggagcuccgcggaccugucguuggaaaaagccgccgagguguccugggaggaggaggccgagcacagcggcgccagucacaacauccucgucgaggugcaggacgacgggaccaugaagaucaaagacgaggaacgggacgacacccuuaccaucuugcucaaggccacccugcuggcgguauccggcgucuacccgcucuccauccccgccacuuuguucgugugguacuucuggcaaaagaagaagcagagaucaggggugcucugggacacgcccucuccacccgaggucgagcgggccgugcucgacgauggcaucuaccgcaucaugcagcggggccuguuggggcggagccaggugggggucgguguguuccaagagaacgucuuccauaccauguggcacgucacccgaggcgcggugcugauguaucaggggaagcgccucgaacccuccugggcaagcgugaagaaagacuuaaucuccuacgguggaggguggcgccugcagggcagcuggaacaccggggaggagguucaggugaucgccguggagcccggaaaaaaccccaagaacguccagacggcccccgggaccuucaaaaccagcgagggcgaggugggcgccauugcccucgacuucaagcccgggaccucaggcucuccuauagugaaccgcgagggaaagaucgugggucuguauggcaaugggguugugacgacgaguggaaccuacgucagcgcgaucgcccaagcaaaggcuucgcaggagggaccccugccggagaucgaggacgagguguuccggaagcgcaaccucaccauuauggaucuccaccccggcucgggcaagacgcgcagguaucugccagcuaucguccgcgaggccaucaagcgcaagcuccgcacccugauccucgcaccgacacgcguuguagccuccgagauggcugaggcgcucaaaggcaugccgauccgguaccagaccacggccgucaagucagagcacaccgguaaggaaaucgucgaccugaugugccacgcuaccuucacaaugcgguuacugucccccgugcgcguaccaaacuacaacaugauaaucauggacgaagcccacuucacggacccguccuccauagcagcgcggggguacaucagcacgcgcgucgggaugggggaggccgcugccaucuuuaugaccgccacuccgcccggcuccguagaggcguucccccagagcaacgccgucauacaggacgaagagcgggacauccccgagcggucuuggaacagcgguuacgaguggauaacagacuuccccggcaagaccgucugguuugugcccuccaucaagagcgguaacgacauugccaacugccugcggaagaacggaaaacgcgugauccagcuuucccggaagaccuucgauaccgaguaccagaagaccaaaaauaacgacugggauuauguagugacaaccgacauuagcgagaugggugcaaacuuccgcgcggaccgggugauagacccccggcggugccucaagccggucauacugaaggaugggccagagagggugauccuggccggccccaugcccgugaccguugccuccgcagcccaacgacgcggucggaucggccggaaccauaacaaagaaggcgaccaguacaucuacauggggcagccuuugaacaacgacgaggaucacgcgcacuggacggaggccaagaugcuguuagacaauaucaacacccccgaggggaucauccccgcccuuuucgagcccgagcgggaaaaguccgccgccaucgauggggaguaccgccugcggggcgaggcgcguaagaccuuuguagagcugaugcggcgcggggaccucccggucugguugagcuacaaaguggccuccgagggcuuucaguacucugaccgccgguggugcuucgacggugagcgcaacaaucagguacuugaggagaacauggacguagagaucuggacuaaggagggggagcggaagaaacuccgcccgcgguggcuggacgcccgcacguacucggacccucuggcauuacgggaguucaaggaauucgccgcgggucgccggagcguguccggagaccugaucuuagagaucggaaagcucccccagcaccuaacgcagagagcccagaacgcccuggacaaccucgugauguuacacaacuccgagcaaggcgggcgggccuaccgccacgcgauggaggaacugcccgacacuaucgagacccucaugcugcuggcgcucaucgcgguccugacgggaggcgugacccuguucuuucucuccggccgggggcugggcaagaccagcauaggccugcucugcgugauggccaguagcgugcuguuauggauggcguccguggagccccacuggaucgccgccagcaucauucucgaguucuuccugaugguacuucucaucccagagcccgaucgucagcggacuccgcaggacaaccaacuggccuacgucgucaucggacuacucuucaugauccugaccgucgccgccaacgagaugggccugcucgaaacaacuaaaaaagacuuggggaucgggcacgucgcgguggaaaaccaccaccacgccgccaugcuggacguugaucuccaccccgcguccgcguggacacuguaugcugucgccaccacuaucauaacuccuaugaugcggcacaccaucgagaacacgacugccaacaucagccugacagccauagcgaaccaggcagcaauccugaugggguuagauaagggcuggccgaucuccaagauggacauaggcguaccccugcucgcccuggggugcuauagccaagugaauccccugaccuugaccgccgcgguccugaugcugguugcccacuacgcgaucauaggccccggguuacaggccaaagccacgcgagaggcgcagaagagaaccgcugcugguaucaugaaaaacccgaccguggacggaaucguugcaaucgaccuggaucccgugguguacgacgccaaguucgagaagcagcuaggucagaucaugcuacugauccuuugcacuucccagaucuuacugaugcgcacgacgugggcgcuaugcgagagcauuacgcucgcaaccggccccuuaacgaccuugugggaggguucccccggcaaguucuggaacaccaccaucgcagucagcauggcuaacaucuuccgcgggaguuaccuugccggcgcgggccuggcauucucccugaugaagucccucgggggcgggagacgggguacaggggcgcagggcgaaacccugggcgagaaguggaagcgccagcugaaccagcucucgaaguccgaguucaauaccuacaagcggaguggaauaauggaggucgauagaagcgaggcuaaggagggucucaagcgcggggagaccacgaagcacgcugugucccggggcacggccaaguuacggugguucgucgagcgaaaccucguuaagcccgaggggaaggugaucgaccugggaugcggacguggcgguuggucauacuacugugccgggcuuaagaagguuacugagguaaagggguacaccaaggggggacccggccaugaggagccgauccccauggccaccuacgguuggaaccuggugaagcuccauuccggcaaagacgucuucuucaucccacccgagaagugcgacacccugcuaugcgacaucggagaaucgucgcccaaccccaccauugaagaaggcagaacccuccgggugcuuaaaaugguggagccguggcugagagggaaccaguucugcauaaagauucuuaaccccuacaugccgucugucguggaaacgcuggagcaaaugcagcguaagcacggcggcaugcuggugcgcaacccgcucucccggaacagcacccacgagauguacuggguauccugcgguaccggcaacaucgugagcgccgugaacaugaccuccaggaugcugcugaaucgauucaccaugguccacaggaagccgacguacgaacgagacgucgaucucggagcgggcacccggcacguggccgucgagccggagguggccaaccuggacauuauaggccagcgcaucgagaacauuaagcaugagcacaagagcaccuggcacuacgacgaagauaaucccuacaagaccugggcauaccacgguuccuacgaggucaagcccagcggcagcgccucauccauggugaacggggugguaaagcugcucacgaagccgugggacgucaucccgauggucacucaaauugcgaugaccgacaccacgccauucggccagcagcggguguuuaaggagaagguggacacccgcacccccaaggcuaagcgggggaccgcccagaucauggaggugacggccaagugguuguggggcuuccucucucgcaacaagaagccgcggaucugcacccgcgaggaauucacccgcaagguccgcagcaacgccgcaaucggcgccguguucguggacgagaaccaauggaauuccgccaaggaggcggucgaggaugaacguuucugggaccucgugcaucgcgaacgggaacugcacaagcaggggaagugcgcuacuugcguguacaacaugaugggcaagagggagaagaaacugggcgaguucggcaaggcaaagggcagccgggccauaugguauauguggcucggcgcccgcuuucuagaguucgaggcccugggcuucaugaaugaggaucacugguucagucgugaaaauagcuuguccgggguugagggcgagggguuacacaagcuggguuacauccuccgcgacauuucaaaaaucccuggcggcaacauguacgcugacgacacggccgguugggacacccggaucacagaagacgaccugcagaaugaggcuaagaucaccgauaucauggaacccgagcacgcacugcucgcgaaguccauauuuaaacuaacguaucagaacaaggucgugcgcgugcagcggccggcgaagaacgggaccguaauggacguuaucucgcgccgcgaccagcgggggucuggacaggucggcaccuauggccuuaacacuuucacgaacauggaggcccagcugauucgccaaauggagagcgaaggcaucuucucccccagcgagcuggagacccccaaccuggccggccggguguucgauuggcucgagaaacacgggguggagcgccugaagcggauggccaucagcggggacgacugcgucgugaaacccaucgacgaccgcuucgccaccgcgcugaccgcccugaacgacauggguaaggugagaaaggacaucccgcaaugggagcccagcaagggcuggaacgauuggcagcaggucccuuucugcagccaccacuuccaccagcugaucaugaaagacggccgcgagaucguggugcccugccggaaccaggaugagcuggucgggcgcgcccgggugucccagggggccggguggagccucagggagacggccugccugggcaaauccuaugcgcagauguggcagcugauguacuuccaccggagggaccuccggcuggcugccaacgccaucugcagcgcaguuccggucgacugggugcccaccucccgcaccaccuggagcauacacgcucaccaccaguggaugacuaccgaagacaugcuguccguauggaaccgcgucuggaucgaagaaaaccccuggauggaggacaagacucauauaagcucuuggggugacgugccauacuuaggaaagcgugaggaccaauggugcggcucucugauagggcugaccgcccgggcaacgugggccaccaacauccaagucgcgaucaaccagguccgucgguuaaucggcaacgagaacuaccuggacuacaugaccuccaugaagagguucaagaacgagagcgauccggagggggccuuaugguga

SEQ ID NO: 24540 - RNA, 9879 nt, Artificial Sequence
  derived and/or modified CDS sequence (opt11) from DENV-1__EU482801__SS-prME
ucgguaaccauguuauuaaugcugaugcccacagcgcuggccuuccauuuaacgacgcggggcggggagccccacaugaucgugucgaagcaagaacggggcaagucccugcuguuuaagaccagcgccggcgugaacaugugcacccucaucgccauggaucugggcgagcugugcgaagacaccaugaccuacaagugcccccggaucaccgagaccgagccggacgacgucgauugcuggugcaacgccacggacaccugggucaccuaugggaccuguagucaaacgggcgagcaccggcgggacaagcgguccguggcuuuagcgccccacgugggucugggguuagagacacgcaccgaaaccuggaugaguuccgagggcgccuggaaacagauccaacggguggagacgugggcucugcgccacccuggguucaccgugaucgcucuuuuccuggcccacgcgauuggcaccuccauuacccagaagggcaucaucuuuauacuccugauguugguuacccccagcauggccaugcguugcguuggcauuggcagccgcgacuucguggaggggcuuuccggcgccacauggguggacgucgugcuggagcacgggagcugcguaaccaccauggccaaggacaagcccacgcuggacaucgaguuacugaagacggaggucacaaaccccgccgugcugcgcaagcucuguaucgaggcgaagaucucgaacaccacgaccgauagccgcugcccgacgcagggggaggccacucugguggaagaacaggacgcuaauuucguuugcagacguacguucguggacaggggcugggggaauggcugcgggcuguucggcaaaggaucccucaucacuugcgccaaguucaagugcgugacuaaacuggagggcaagaucguccaguacgagaaccugaaguacagcgugaucgugaccguccacaccggcgaccagcaucaaguggguaaugaguccaccgagcauggcacgaccgcuacgauaacuccccaggcgcccaccaccgagauacaguuaacugacuacggggcgcugacgcuugauugcagccccagaaccggccucgacuuuaacgagaugguccugcugacaaugaaagagaaguccuggcucgugcacaaacagugguuccuggaccugccccuacccuggacaagcggggcgagcacgucccaggaaaccuggaaccggcaggaucugcugguaacauucaaaaccgcccacgcgaagaagcaggaaguaguggugcucggcagccaagagggugcgaugcacacggcccuaacuggagccaccgagauccagaccagcggcacgaccaccaucuucgcagggcaccugaagugccgcuugaagauggacaagcugacccugaagggcaugagcuaugucaugugcacgggguccuuuaagcuagagaaggagguggccgaaacccaacacggcacaguucugguccagaucaaauacgagggaaccgaugcgccuugcaaaaucccguuuagcacgcaagacgagaagggggugacgcagaauggacggcugauaacggccaauccgaucgugacugacaaggagaagccggucaacaucgaggccgagccacccuuuggggagagcuacaucgugaucggcgccggcgagaaggcccugaaauugucgugguuuaagaaaggauccuccaucggcaagauguuugaagccacggcacgcggggcacggcgcauggcgaucuugggcgacaccgcgugggauuuuggauccaucggcggcguguuuaccagcguaggaaagcuggugcaucagaucuucggaaccgccuaugggguccucuucucgggcgucagcuggacuaugaagauugggaucggcgugcugcugacgugguuaggccugaacucccgcagcaccucccugagcaugacuugcauugccgugggguuggucacgcuguaucugggcgugauggugcaggcagacagcggaugcgucaucaacuggaagggccgcgaauugaaaugcgggagcggcauauucguuacgaacgaagugcacaccuggaccgagcaguacaaguuucaggcugacagcccgaagagacuguccgcggccaucggcaaggccugggaggagggggucugugggauucggagcgccacgcgccuggagaacaucauguggaagcagaucucgaacgaauuaaaccacauccuucuggagaacgacaugaaauuuacugugguggucggggacguggcgggcauccucgcgcagggaaagaagaugauccggccccagcccauggaguacaaguacagcuggaagucauggggcaaggccaagaucaucggcgccgacguccagaauaccacuuucauaaucgacggucccaacaccccugagugcccggacgaccaacgagccuggaacaucugggaggucgaggacuacggcuucgggaucuuuaccaccaacaucuggcugaagcugcgggacucauacacccagguuugugaccaccguuugaugagcgccgcgaucaaagacucaaaggccgugcacgccgacaugggcuacuggaucgagagugagaagaaugagaccuggaaacuugcccgggcgagcuucaucgagguuaagacaugcaucuggccaaaaucccacacccuguggucgaacggcgugcucgaguccgagaugauuauccccaaaaucuacgggggcccgaucagccagcacaacuaucgccccggguacuucacccagaccgcuggacccuggcacuuagggaagcuggagcuugacuucgaccuaugcgaggguacgaccguggucguggaugagcacuguggcaaccggggaccgucccugcgcacaaccacggugacaggcaaaaucauccaugaguggugcugccggagcugcacccugccaccccuccgcuuccgcggagaggacggcugcugguacgggauggagauccgcccgguaaaggagaaggaagaaaaccuggucaaguccauggugagcgccggcagcggcgagguggacuccuucucacucgggcugcuaugcaucuccauaaugaucgaggaaguuaugcggagccgguggagccggaagaugcucaugaccggcacacuggccguguuuuuccugcugaucauggggcagcugaccuggaacgacuugauccgccuuugcauuaugguaggagccaacgcaagcgaccgcauggggaugggcacuaccuaccuagcccugauggccacguucaagaugcgcccgauguuugccguugggcuccuguuccggcgccucaccucccgcgaggugcuacuacuaaccaucgggcuuagccuggucgccuccguugaguugcccaauagucucgaagaacugggcgacgggcuggcgaugggcaucaugaucuuaaaacugcuaacggauuuccagagucaccaacucugggccacacugcugucccucaccuucauuaagaccaccuucucccuccacuacgccuggaaaacgauggccaugguccugagcaucgugucccuguucccccuuugccugagcaccaccucccagaagacuacguggcuccccgugcugcuaggcagccuagggugcaagcccuugaccauguuccugaucgcggagaacaagauauggggaagacgcuccuggccccucaacgaggggaucauggcggucggcaucgugagcauacugcugagcucccugcugaagaaugacgucccccuggccggaccccucaucgcuggcgggaugcugauugcgugcuaugucaucagcggguccucugcggaccuguccuuagagaaggccgcggaagucagcugggaggaagaggccgagcacucgggcgccagccacaacaucuuaguggagguccaggacgacgggaccaugaagauaaaggacgaggagcgggacgacacccugaccauccucuuaaaagcgacuuugcucgccguguccgguguguacccgcugagcauccccgcaacacuguucgucugguacuucuggcagaagaagaaacagcgauccgggguccucugggacacacccagcccgcccgaggugggccgcgccguccuugacgacggaaucuaccgcauuaugcagcggggucugcugggacgcagccaggugggggugggcgucuuccaggagaacguguuccacacuauguggcaugugacgcgcggggccguccuaauguaucagggcaagcgccuggagcccagcugggcguccgugaaaaaggaccugaucaguuacggagggggcuggcggcuccagggcuccuggaauaccggcgaggaggugcaaguuauugccgucgagcccgggaagaaccccaagaacguacagaccgcccccgggaccuuuaagacgcccgagggugaagucggggccauugcccuggacuucaagcccgggacgagcgggucuccaaucgugaaccgcgaggggaagaucgugggccuguacgggaauggcgucgugaccaccagcggaacguacgugagcgcgaucgcccaggccaaggccucccaggagggcccgcuucccgagauugaagacgaggucuuccggaagcgcaaccugacgaucauggaccuacaucccgggagcggcaagacgcgucgcuaccucccggcgauugugcgcgaggccauaaagcgaaagcuacguacccuaauucucgcacccacacggguggucgccuccgaaauggcugaggcucugaaaggaaugcccaucagguaccagaccacagcugucaaauccgaacacacugggaaggagaucguggaccucaugugccaugcgacguucacaaugcgucuccugucccccguccgggugccgaauuacaacaugaucauuauggaugaggcccacuuuaccgaucccucuucaauagcggcgagaggcuacaucagcacccgcgugggcaugggcgaggcggcugcuaucuucaugaccgcaaccccgccggggucugucgaggcguucccgcagagcaacgccguaauucaagacgaggaacgggauauccccgaaagguccuggaacaguggcuacgaguggaucaccgacuuccccggcaagacugugugguucguucccucuaucaagagcgggaacgauaucgccaacugccugcggaagaacggaaagcgagugauucagcugucgaggaagacguucgacacggaguaccagaaaaccaaaaacaaugauugggacuauguggucacgacggacaucagcgagaugggggcaaacuucagagccgaccgggugauugacccgcgccggugccugaaacccgugauacugaaagacggccccgagcgcguuauucucgcggggccgaugccggugaccgucgccagugccgcccagcggcgugggcggaucggcagaaaucacaacaaggagggggaccaguauauauacaugggccagccucugaacaacgacgaagaucacgcgcacuggaccgaggcaaagaugcuucuggacaacaucaacacccccgagggcauaauccccgccuuguuugagccggagcgagagaaguccgccgccaucgacggcgaguaccggcugagaggggaggcgcggaagacguucguggagcuaaugcgcagaggggaccugcccguauggcugagcuacaagguggccucugagggcuuccaguacagcgaccgccgauggugcuucgauggggagcgcaacaaccagguucucgaggagaacauggacgucgaaaucuggaccaaggagggugagcguaaaaagcugcgcccucgcuggcuggacgcccgcaccuacucagauccccuggcacuucgggaguucaaggaguucgccgcggggcguaggagcgucucgggcgaccuaauccucgagaucggaaaacugccgcagcaccugacccagcgcgcccagaacgcccuagacaaccugguuauguugcacaauagcgagcagggcgggcgggccuaccgccacgccauggaagaacuacccgacacgaucgagacccugauguugcucgcccucaucgccgugcucaccgggggagucacccucuucuuccuguccgggagaggacuaggaaagacgaguaucgggcuccuuugcgugauggccagcagcgugcugcuuuggauggccucggucgagccccacuggauugcggccagcaucauacuggaguucuucuugaugguacuccugaucccugagccugaccggcaacguacgccccaggacaaccagcuugccuacgucgucauuggcuuacuguucaugaucuugaccguggcggccaacgagaugggacuccuugagaccacgaagaaggaucugggaaucgggcacguggcagucgaaaaucaccaccacgcagcuaugcucgacguggaucugcaccccgccuccgccuggacgcuguaugcgguggcaaccaccaucaucaccccgaugaugcgucacacuaucgaaaacaccacagcaaacaucagccuaaccgccaucgccaaucaggccgccauccugaugggccuagacaagggcuggcccaucuccaagauggacaucggggugccccuccuggcccugggcugcuauagccaggugaacccccucacccugaccgcugcggugcugaugcucgucgcgcacuaugccaucaucgggccgggucuacaagcgaaggccaccagggaggcgcaaaagcggacugccgcggggaucaugaagaacccgacggucgacggaauuguggcgaucgacuuagaucccguggucuacgacgccaaguucgagaagcagcucggccagauaaugcugcugauccucuguaccagccagauccuguuaaugcgcacgaccugggcguugugugagagcaucacccuggccaccgggcccuugaccacccucugggagggaucccccgggaaguucuggaacacgaccaucgccgugagcauggccaacaucuucagaggcuccuaccuggcuggcgcagggcuggccuucagcuugaugaagucccugggcggcggacgccgggggaccggcgcgcagggugagacgcugggggagaaguggaagcgccagcucaaccagcucuccaaguccgaguucaacacuuacaagagaucugggaucauggaggucgaccgaagcgaggccaaggagggacugaagcggggcgagaccaccaaacaugccgugucccgagggacugccaaacuccggugguucguggagcgcaaccuggugaagcccgagggcaaggucauugaccuaggcuguggucggggcggguggagcuacuacugcgccggacugaagaaagugaccgaggucaaaggguacacgaaagguggucccgggcacgaggaaccgaucccaauggccaccuacggcuggaaccuugugaagcuacauagugggaaggacguguucuucauaccacccgagaagugugacacccugcucugugacaucggugaaagcucccccaaccccacgaucgaggaggggaggacguugcggguucugaagaugguggaacccuggcuccgugggaaucaguucugcaucaagauacugaaccccuacaugcccagcguugucgagacucuggagcagaugcagcggaagcacggcgggaugcuuguacgcaauccucugucccggaacaguacccacgagauguauuggguguccugcggcacggggaacauugucagcgccgugaacaugacgagucguaugcuguuaaaucgcuucacuauggcgcacaggaaacccacauaugagcgcgauguugaccugggcgccggcacccggcacgucgccguggagcccgagguggcuaaccuggacaucaucgggcagcgaaucgagaacaucaaacaugagcacaagagcacguggcacuacgacgaggacaaccccuacaagacuugggccuaccacggcuccuacgaggucaagccgagcgggucugcgagcagcauggugaacggagucgucaagcuccugaccaagccaugggacgugauccccauggucacucagauugcgaugacggauaccacucccuucgggcagcaacggguguucaaggagaagguggacacccggacaccgaaggccaagcguggcaccgcucagaucauggaaguaacugccaaguggcuguggggcuuccucucccgcaauaagaagccgcguauuugcacccgcgaggaguucacgcggaaggugcguucgaacgcggccaucggggcaguguucguagacgagaaccaguggaacagcgccaaggaggcgguugaagacgagcguuucugggaccuagugcacagagagcgggagcugcacaagcagggaaagugcgcgaccugcgucuauaacaugaugggcaaacgcgaaaagaaacucggggaguucggaaaagcaaaaggcagccgcgccaucugguacauguggcugggcgcccgcuuccuggaguucgaggcgcucggguucaugaacgaagaccacugguuuucccgggagaacagccuguccggcguagagggcgaaggacuucacaaacucggguacauucugcgcgacauuucuaacaucccuggcgguaacauguacgccgacgauaccgccgggugggacacccggaucaccgaggacgaccugcagaacgaagcccgcaucaccgacauuauggagccggaacaugcgcuccuggcuaagucgaucuucaagcugacauaucagaauaagguuguacgcguacagcggcccgccaaaaauggcaccgugauggacgucaucagccgccgggaccagcgcggguccggccaggugggcacguaugggcugaacaccuucaccaacauggaggcccagcugauccgucagauggagucugaaggcaucuucuccccauccgagcuggagacaccgaaccucgccgagcgcgugcuggacuggcuggagaaguacggggucgagcggcuuaagcguauggccaucuccggugaugauugcguggugaaaccgaucgaugaccgguuugcuacagcccuaaccgcccugaacgauaugggaaaggucagaaaggauaucccccagugggagcccuccaaaggcuggaacgacuggcagcaggucccauucugcucccaccacuuucaccaguuaaucaugaaggauggccgggagaucguugugccgugccgaaaccaggacgagcugguugggcgagcccgcgugagccagggggcgggguggucucugcgggagacugcgugccucggaaaguccuacgcgcagauguggcaauugauguacuuccaccgccgcgaccugcgccucgccgccaacgccaucugcagcgccguccccguugacuggaucccuaccucccggaccaccugguccauccacgcgcaccaccaguggaugacaaccgaagacaugcugucgguauggaacaggguguggauugaggagaaccccuggauggaggacaagacgcacaucagcuccuggggcgacgucccguauuuagggaagcgcgaggaccagugguguggcagccucaucgggcugaccgcgcgggcgaccugggcgacaaacauccagguggcuauaaaucagguccgccgucugauaggcaacgaaaacuaccucgauuacaugaccucgaugaagcgcuucaagaacgaguccgaccccgagggggccuugugguga

SEQ ID NO: 24541 - RNA, 9879 nt, Artificial Sequence
  derived and/or modified CDS sequence (opt11) from DENV-1__EU482802__SS-prME
agugugaccaugcugcucaugcugaugccgaccgcuuuggccuuccaccucacgacccgaggcggcgagccccacaugaucgugagcaagcaggagcggggcaagagcuuacuauucaagacaagcgcgggggugaacaugugcacgcuaauagcaauggaccugggagaauucugcgaggacacuaugaccuauaagugcccacgcaucacugaggccgagccggacgauguggacugcugguguaaugcuaccgauacaugggucaccuacgggacuugcucccagaccggugagcaccggagggacaagagauccguagcccuggcgccccacgugggccucgggcuggagacgcgcaccgagacauggaugagcucugagggcgccuggaaacagauccaacguguugagaccugggccuuacgucaccccggcuuuacggugaucgcguuauuccucgcccacgccauaggcaccagcaucacccaaaaggggauaauuuucauccugcucaugcugguaaccccuuccauggcuaugcggugcgucggcaucggcagccgcgacuucguugaggggcugucgggcgccacguggguggacguggugcucgaacacgggucgugcgugacuaccauggcaaaggacaagcccaccuuggacaucgagcugcucaagacggaggugaccaaccccgcgguccugcggaaacuguguaucgaggccaagauuuccaacacuaccacggacagccgcugcccgacccagggcgaggccacauugguugaggagcaagacgccaacuucgucugcagacgaacuuucguggaccgcggcugggggaacggcugcgggcuguucggcaaggggucccugaucacgugugccaaguucaagugcgugacaaaguuagaggggaagaccguccaauacgagaacuugaaauacagcguaauagucaccguccacacgggugaccagcaccaggugggcaacgaguccacagagcacggcaccaccgcgacgaucacuccccaggcucccagcaccgagauacagcugaccgacuacggggcccuaacccuggacugcagcccccgcacgggccuggauuuuaaugagaugguccuccuuaccaugaaggagaaauccugguugguccacaagcagugguuccuugaccuuccgcugcccuggaccagcggggccuccaccagccaagaaacguggaaccggaaggaccuccuugugacauucaagacggcccaugcgaagaagcaggaaguugugguuuugggcucccaggaaggcgccaugcacacugcccucacaggggccaccgagauucagaccucagguaccacgacaaucuucgccgggcaccuuaagugccgccugaagauggacaagcucacccugaagggcaugucuuaugugauguguaccggaagcuucaagcuggagaaagaggucgcggagacgcagcacggcacuguccucguccagaucaaguacgagggcacagacgcccccugcaaaaucccuuucaguacccaggacgaaaagggggugacacagaacggccgacugauaaccgccaacccuaucgugaccgacaaggagaaacccgucaacauagaggcggagccgcccuuuggggagagcuacaucgugaucggagcgggcgagaaggcucugaagcugucuugguucaagaaggggagcuccauaggcaagauguucgaggccaccgcccgcggggcccggcgcauggcgauccucggcgauacggccugggacuucgggucuauuggcggcguguucaccuccgucgggaagcuggugcaccaaaucuucgggaccgccuacggcgugcuguucagcggggucuccuggaccaugaagaucgguaucggcguucuucugacguggcugggccucaauaguagauccacuucccucuccaugaccuguaucgccguagggcuggucacacucuaccugggcgugaugguucaggccgauucagggugcguuaucaacuggaagggccgagagcucaagugcgggagcggcaucuucgugacuaaugagguucauacguggacugagcaguacaaguuccaagccgacuccccgaagcgccucucagccgccaucggcaaggccugggaagaaggagucugcggcauccggagugcaacaagacuggagaauauaauguggaagcaaaucagcaacgagcugaaccacauucuucuggagaaugacaugaaguuuaccguuguggucggugacguggcuggaauucuggcccaagggaagaaaaugauccggccccagccgauggaguacaaguacuccuggaagagcuggggcaaggccaagaucaucggcgcggacguacaaaauacgaccuucaucaucgacgggcccaauaccccggagugccccgaugaucagcgcgcguggaacaucugggaggucgaagacuacggcuucggcauuuucaccacgaacauuuggcucaagcugcgggauuccuacacccaggugugcgaccaccgccucaugagcgccgccaucaaagacuccaaggccguucacgccgacaugggauauuggauugagagcgagaagaacgagaccuggaagcucgcgcgggcgagcuucauagaggucaagaccugcaucuggcccaaaagccacacccugugguccaacggggugcuggagucggagaugauuauccccaagauuuacgggggcccgaucucccagcacaacuaccgccccggguacuucacccaaaccgccggccccuggcaccuuggcaagcuggagcuggacuucgaucuaugcgagggcaccacgguggucguugacgagcacugcgguaaccgggggccgagccugcgaaccaccacugugacgggaaagaucauccacgaguggugcugccggaguugcacccugccaccccugcgcuucaaaggggaagauggcugcugguacgggauggagauucggcccgucaaagagaaggaggaaaaccuuguaaagagcaugguuagcgccggcaguggugaagucgacagcuucucccuaggguuguugugcaucagcauuaugaucgaagaggugaugcgcuccagguggucgcgcaaaaugcugaugacggguacccucgccguuuucuuucuguugaucauggggcagcucacguggaacgacuuaauccggcugugcauuauggucggcgcgaaugccuccgaccgcauggggaugggaaccacauaccuagcccugauggccacguucaagaugagaccgauguucgcagucgggcuccuguuccggcgucugacgucucgggagguacugcuccugaccaucggucugucccuaguagcuucaguugagcugccgaacucccucgaggagcucggcgacgguuuagccaugggcauaaugauauuaaaacuccuuaccgacuuucaaagccaccagcugugggcgacccuacugagucugacguuuaucaaaacaaccuucagccuccauuacgccuggaagaccauggcgauggugcugucgaucgugagccugcucccccugugcuuguccacgaccagccagaagaccacguggcuccccgugcuacugggcucccucgguugcaagccgcugacgauguuucugaucgccgagaauaaaauauggggccgcaaaucauggccacucaaugaagggauuauggcggucgggaucgucagcauccuacuguccagcuuacuaaagaacgacgugccccuggccgggccccucaucgcgggcggcauguugaucgcgugcuacgucaucuccgggucuuccgcggauuuaucucucgagaaggccgccgaggucucuugggaggaggaggccgagcauagcggcgcaucccacaacauccucguagagguccaggaugacgggacgaugaagaucaaggacgaggaacgggacgacacauuaacaauccuccugaaggccacccugcucgccgucaguggcgucuauccgcuguccaucccugccacgcuguucgucugguacuucuggcaaaagaagaagcagcgcagcgggguacucugggacacccccucaccacccgagguggagcgggcaguccuggaugacggaauuuacaggaucaugcagagaggucugcuggggcgcagccaagugggggugggggucuuccaggaaaauguguuccacaccauguggcacgugacucggggcgcggucuuaauguaccaagggaagaggcucgaacccuccugggccagcgugaagaaggaucugauuuccuauggcgguggcuggcggcugcagggcagcuggaacacgggggaggaaguacaaguuaucgccguggagccuggcaagaaccccaagaacgugcagaccgcccccggaaccuucaaaaccuccgagggcgaggucggcgccauagcgcuugacuucaagccagggacgagcggcagcccaaucguaaaucgugagggcaaaaucgugggccucuacgguaauggcguagugaccaccuccggcaccuacgucagcgcgaucgcucaggcgaaggcgucccaggaggggccccuccccgagaucgaggacgaggucuuucggaagcgcaaccugacgauuauggaccugcacccaggcucugggaagacccggcgcuaccuccccgccauagugcgggaggcaaucaagcgcaaacugaggacccugauucucgcacccacccgcguaguugccuccgagauggcggaggcucugaagggaaugcccauccgcuaccagacaaccgccgucaagagugaacacaccgguaaggagaucguugaccuuaugugccacgcaaccuucacgaugcgacuucugucccccguccgugugccgaacuacaacaugaucaucauggacgaggcccacuucaccgacccgagcuccauugcggcucggggguacaucagcacgcgcgugggaaugggggaggcggccgccaucuucaugaccgcuacgccuccuggcuccgucgaagccuucccgcagagcaacgccgucauccaggacgaggagcgggacaucccggaaagguccuggaacaguggguaugaguggauuaccgacuuuccaggcaagaccguuugguucguccccucgaucaagagcggcaacgacaucgccaauugccugcggaagaaugggaaacgugugauacagcucucccggcgcaccuucgacacagaguaccagaagacaaagaacaacgacugggacuauguggucaccaccgacaucagcgaaaugggcgcgaacuuucgggccgaccgcguaauugacccccggcgcugucugaagccggugauccuaaaagacgggcccgagcgggucauccuugccgggccaaugcccgugacggucgccuccgcugcgcagcgccggggaaggaucggccggaaccacaacaaggagggcgaccaguauauauacauggggcagccgcucaacaacgacgaggaccaugcccacuggaccgaagcuaagauguugcucgacaacaucaacacgcccgagggcauuauccccgccuuauucgagcccgagcgcgagaagucagccgcgauagacggugaguaccgccugcggggcgaggcacgcaaaaccuuuguggagcuaaugcggcgcggggaccugccgguguggcuuagcuauaaggucgccucggagggcuuccaguacagcgaccgucgguggugcuucgacggcgagcggaacaaccaggugcuugaggagaacauggacguggagaucuggacgaaggagggugagcgcaaaaagcugagaccccgcuggcuagacgcgcggacuuacuccgacccacucgcccugcgcgaguucaaagaguucgcggccggccggcgaagcguuucuggggaccugauccucgagaucggcaaacugccacagcaccuuacccaacgggcccagaaugcucucgacaaccugguuaugcugcacaacagcgagcagggcggccgcgcguaccggcacgccauggaggaacucccggacacaaucgagacgcugaugcugcucgcgcugaucgccgugcugaccggcggggucacccucuucuuucuguccggccgcgggcugggcaagaccucaaucggcuuacugugugucauggcauccagcgcgcugcucuggauggccuccguggaaccucacuggaucgccgccaguauuauccuggaguucuuucugaugguccuccuuauccccgagccagaccggcagcgcaccccgcaggacaaccaacuggccuacguggucaucggucuccuguucaugauccugacggucgcggccaacgagaugggccuccucgaaaccacuaagaaggaccuugggaucggacacguggccguggaaaaucaccaccaugccgcuaugcucgacgucgaccugcaccccgccuccgccuggacccuguacgccguggcgacgaccaucauuacuccgaugaugcgacacacuaucgagaacacgaccgccaacaucagccucacagcgaucgccaaccaagccgccauccugauggggcuugacaagggcuggccgaucucaaaaauggauaucggggugccccuccuagcgcuggguugcuacagccaggucaacccgcuaacacuuacagccgccguccugaugcucguggcgcacuacgccaucauaggccccgggcugcaggcaaaggccacccgagaggcccagaagcgcaccgccgcggguauuaugaagaauccgaccguugacgggaucguugcaaucgaccuggaccccguggucuacgacgccaaguucgagaaacagcugggccagaucaugcugcugauucuuugcacgucccagauccugcugaugcggaccacgugggcacugugugaaagcaucaccuuagccacgggcccccugaccacccugugggagggguccccgggcaaauuuuggaacaccacuaucgccguaagcauggcgaacaucuuccgggggagcuaucuggccggcgccggucuggcauucagcuuaaugaagucucucgggggcggucggcgcgggaccggggcgcagggcgagacccugggggagaaguggaagcgucagcucaaccagcuuuccaagagcgaauucaacaccuacaagcgguccgggaucauggagguggaccgaagcgaggccaaggagggccuaaagcgcggggagacuaccaagcacgccgucagucggggcaccgcgaagcuccgcugguucguggaacggaaccuggugaaaccugaggggaaggucaucgaccugggcugcggccgugggggcuggucauacuacugugccgggcugaaaaaggugaccgaaguuaagggcuacacaaagggcgggcccggacacgaagagccuauaccuauggcuaccuacggguggaacuuagucaagcugcacuccggcaaggacguguucuuuauccccccggagaagugcgacaccuuacucugcgauauuggggagagcuccccgaacccaaccaucgaggagggccgcacgcuacgcguucugaagauggucgagccguggcuacgggggaaccaguucugcauuaaaauucugaacccguacaugcccuccgugguugaaacccuggagcagaugcagcgcaaacauggcggcaugcuggugagaaacccucuaagucgcaacuccacccacgagauguacuggguguccugcgggaccgguaacaucgugagcgcgguuaacaugaccucccggaugcuguugaaccgcuucacgauggcccacagaaagccgaccuacgagcgggacguggaccuaggggccggcacuaggcacguggcugucgaacccgagguggcgaaccuggauaucaucggccagcggaucgagaauaucaagcacgagcacaagagcaccuggcacuacgacgaggacaaccccuacaagaccugggccuaucacggauccuacgaagugaagcccagcgguuccgccuccagcauggucaaugggguggugaaguugcugaccaagcccugggacgugauccccauggugacccagaucgcuaugaccgauacuacgccuuucgggcagcagcgcgucuucaaggagaagguagacacccggacacccaaauccaagcgcgggacagcacaaaucauggaggugaccgcgaaguggcuguggggauucuuaagcaggaacaagaagccgcgcaucuguacccgggaggaguuuacgcgaaaagucagaucgaacgcagccaucggcgccguguucguggacgagaaccaguggaauucugcgaaagaggcugucgaggaugagagguucugggaucuggugcaccgggagcgcgagcugcacaagcaggggaaaugcgccacgugcgucuauaacaugauggggaagcgggagaaaaagcucggggaguucggcaaggcgaaagggucccgcgccaucugguacauguggcugggcgcgcgguuucuggaguucgaggcccugggauuuaugaacgaagaccauugguucucacgagagaacucccucagcggggucgaaggcgaggggcugcacaagcucggauacauccuccgggacaucuccaagauccccgggggaaacauguacgccgacgacaccgcuggcugggauaccagaaucaccgaggacgaccugcagaacgaggccaagauaacggacauuauggagcccgagcacgcguuacuggccaagagcaucuucaaauuaaccuaccaaaacaagguggugcgggugcagcgcccggccaagaacgggaccgugauggacguuaucucccgccgugaccaacgcggcagcgggcaggucggcacuuaugggcucaacaccuucacgaacauggaagcucagcugauccggcagauggaguccgaggggaucuucagcccaucggagcuggagacccccaaucucgccggccgcguccuggacuggcuggagaagcacgggguggagcgguugaagcgcauggccaucucaggggacgacugcgucgugaaaccaaucgacgaccgguuugccaccgcuuugacggcccuaaacgauauggggaaaguccgcaaggauaucccgcagugggaacccagcaaaggcuggaacgacuggcagcaggugccuuucugcucccaccacuuccaucagcuuaucaugaaggacggcagggagaucguggugcccugcaggaaccaggacgagcugguugggcgagcccgaguuagccagggugcgggcugguccuugcgggagaccgccugccucggaaaaagcuacgcccagauguggcaguuaauguacuuucaccgccgggaccugcgccucgcugcgaacgccauaugcuccgcuguuccggucgacugggugcccacuucccggaccacuuggucgauccaugcccaccaccaguggaugacgaccgaagauaugcugagcguguggaaccgcgucuggaucgaagagaacccuuggauggaagacaagacccauaucuccagcuggggcgacgugcccuaccugggcaagcgugaggaccaauggugcggcucucucaucgggcugacggcccgcgcgaccugggccaccaacauccagguggccaucaaccagguaaggaggcugaucggcaacgagaacuaccucgacuacaugaccucuaugaaacgcuucaagaacgaguccgauccggagggggccuugugguga

SEQ ID NO: 24542 - RNA, 9879 nt, Artificial Sequence
  derived and/or modified CDS sequence (opt11) from DENV-1__EU482804__SS-prME
ucagugaccaugcugcucaugcuuaugcccacugcccuagccuuccaccuuaccacccggggaggggagccccacaugauugugagcaagcaagagcggggcaagagcuuauuguucaagaccucggccggggugaacaugugcacgcucaucgcgauggaccuuggcgaguucugcgaggacacgaugacuuacaagugccccagaaucaccgaggccgagccugacgauguagacugcugguguaacgcaaccgacaccugggugacuuacgggaccugcucacagacuggcgagcaccggcgggacaagcgguccguugcccuggcgccccacguuggccuggggcuggaaacgcgcaccgaaaccuggaugucguccgagggcgcguggaaacaaauccagcggguggagaccugggcccugcgccaccccggcuuuaccgugauagcccucuuccuggcgcacgccaucggcaccagcaucacccagaaaggcaucaucuucauccugcuuauguuagucacccccuccauggccaugcggugcgucgggaucgggagccgcgacuucguagaagggcucucgggggcuaccuggguggacgucgugcucgagcacgggucaugcguaaccaccauggccaaggacaagccuacccuagauaucgaacugcucaaaacggaagucaccaaccccgcgguacugcggaaacugugcaucgaggccaaaaucuccaauaccaccacggacagccgcugcccuacccagggcgaagccacccuuguagaggaacaggaugcgaacuuugucugccggcgcacuuucguggacagaggcugggggaacggcugcggacuguuuggcaagggaucccugaucacuugcgccaaguuuaagugugugaccaaauuggagggcaaagucguccaguacgaaaacuuaaaguacagcguuaucguuaccgugcacaccggugaccagcaccaaguggggaacgaguccacggagcacgguaccaccgcuacaauuacaccccaggcccccagcacggagauucagcucaccgacuacggggcccucacccuggacuguucgccccggaccggcuuagauuucaaugagauggugcuccugacaaugaaggagaaguccuggcuggugcacaagcagugguuucucgaccugccgcugccuuggaccucaggcgcuuccacaucccaggagacauggaaccggaaggacuugcuggugacguucaagaccgcgcacgccaagaagcaggagguggugguccugggcucccaggaaggcgccaugcauaccgcccucaccggggcaacugagauccagaccagcggcaccaccacgaucuuugcggggcaccugaagugccgucucaagauggacaaacucacccucaagggcaugagcuacgugaugugcacugguuccuuuaagcuagagaaggagguggcggagacccagcacggcacuguccucgugcagauuaaauaugagggcacagacgcucccugcaagauccccuucuccacucaggacgagaaggggguaacucagaacggucggcugaucacggcuaacccuaucgucacagacaaggagaagcccgugaacaucgaagcggaaccgcccuucggggaaaguuacaucguaaucggcgcgggggaaaaggcucuuaagcucuccugguucaagaaagggucguccaucggcaagauguucgaggcuaccgcgcgcggggcccgccgcauggcgauuuugggggacacugccugggacuucgggucgaucggcgggguuuucacuagcguugguaaacuugugcaccagaucuucggcacugccuaugggguccuuuucagcggcgugaguuggacgaugaagauagggaucggcgugcuccuaacuugguuaggccucaacucgaggucaacgaguuuauccaugacuugcaucgccgucgggcugguaacccuuuaccugggugugaugguacaagccgauagcgggugcguuauaaacuggaagggucgggaguuaaagugcgggagcggcaucuucguuaccaacgagguccauacuuggacggagcaauacaaauuccaggcagauuccccgaaacgcuuaagugccgccaucggaaaggccugggaggaagggguuugcgguaucaggucaacaacccgccuggaaaacauaauguggaagcagaucagcaacgagcugaaccauauccuacuagaaaaugacaugaaguucaccguggugguuggggacguggccggcauccuggcgcaagggaagaagaugauccggccccaacccauggaguacaaguacuccuggaaaagcuggggcaaggccaaaaucauuggcgcugacguacagaauacgaccuuuaucauugacgggcccaacaccccggaaugcccagaugaucagcgcgccuggaacaucugggagguugaggauuacggguucgguauauucaccaccaacaucuggcucaagcugcgcgacuccuacacccaagugugcgaucaccgccugaugucggcagcuaucaaagauucgaaagccguccacgcggacaugggguacuggaucgaaagcgagaaaaaugaaaccuggaagcucgcgcgggcuuccuucauagaggugaaaaccugcaucuggcccaaaagccacacacuguggaguaacggagugcuggagucagaaaugaucauccccaagaucuacgggggcccgaucucucagcacaacuaucgccccggguacuucacccagacggccggacccuggcaucucgggaaacuggagcuggacuucgacuuaugcgaaggcaccacggucgugguggaugagcacuguggcaaccgggggccgucccugcgcaccacuaccgucacggggaagaucauccacgaguggugcugccgcagcugcacccugccgcccuugcgcuuuaaaggagaggacggcuguugguaugggauggagauccggccugugaaagagaaggaggaaaaccugguuaaaagcauggucagcgccggcucuggggagguggacagcuucuccuuggggcuccuaugcauuagcauuaugaucgaggaggugaugcgcucccgguggagccgcaagaugcugaugacagguacccucgcgguuuucuuucugcuaauaacgggacagcuuacuuggaacgaccuaauccgccuuugcauuauggucggugcgaaugccucggaucguauggggauggggaccaccuaccucgcccuaauggccaccuucaagaugcgaccgauguucgccguagggcuacuguuccgucgccugaccagccgggagguuuugcuauugacgauaggucucuccuuaguggcaagcgucgaguugcccaacucccucgaggaguuaggggacggacuggcgaugggcaucaugauauuaaagcuccugacggacuuccaaagccaccaacugugggcgaccuugcugucccuuaccuucaucaagaccaccuuuagccuucacuacgccuggaagacgauggccaugguucuuucuaucgucucgcuguucccacucugccuguccacaacgucgcagaagacaacgugguugcccguccucuugggcucccugggcugcaaaccucucaccauguuccugaucgcggagaacaagauaugggggaggaagucuuggccgcuuaaugaagggaucauggcagugggcauagucagcauccuccuguccagccuauugaaaaaugacguaccucucgcaggaccucugaucgccggaggcaugcuaaucgccuguuacguaauuucgggcagcuccgcggaccugagccuggagaaggccgccgagguauccugggaggaagaggccgagcauaguggcgcaucacacaacauccucgucgaaguucaagacgaugggaccaugaaaaucaaggacgaggaacgggacgacacccugaccauccuacucaaggcgacucugcuggccgugagcgggguguacccgcucucaauccccgccacgcuguucguuugguacuucuggcagaagaagaaacagcgcucagggguacuaugggauacgcccaguccacccgaggucgagcgggccguguuagacgacggcauauaccguaucaugcagcggggacugcuggggaggucccaggugggcgucgggguauuccaagagaacgucuuucauacgauguggcacgucacucguggcgccgugcugauguaccaggggaagcgccucgaaccguccugggcgaguguaaagaaggaccugauauccuacggcggcggguggcgguuacagggcucguggaauacuggagaggagguccagguuauugccguggagcccgggaagaaucccaagaauguccagacagccccugggaccuucaaaaccucggagggcgaggugggcgccaucgccuuggacuuuaagccggggaccucugggagcccuaucgugaaccgggaggguaagaucgucggccuguacggaaaugggguggugaccacauccggcacguacgucagugcgauugcccaagccaaggcaucucaggaagguccccugcccgagaucgaggacgaagucuuccgcaaaagaaaccucacgaucauggaccugcaccccggaagcgggaaaacuagacgauaccugcccgcgaucgugagagaggccauuaagcgcaaauuacgcaccuuaaucuuggccccuacucgcgucguggcuagugagauggccgaagccuuaaagggcaugccaauacgcuaucagaccaccgccgucaaaagcgagcacaccggaaaggaaauagucgaucuuaugugucaugccacguucaccaugcgguuauuauccccugugcgcgugcccaauuauaacaugaucaucauggaugaggcccauuuuacggauccgagcucuaucgccgcgcggggcuacauuagcacacgcgucgguaugggugaagccgcagcuaucuuuaugacggcaacgccacccggcuccguggaggccuucccccagagcaacgccgugauacaggacgaggagcgcgacauuccggagcgcuccuggaacagcggguacgaauggaucaccgacuucccaggcaagaccguuugguucgugccaucuaucaagucuggcaacgacaucgccaauugcuuacggaagaacgggaagcgcgucauccaguuaagccggaagacauucgauaccgaguaccagaagacgaagaacaacgauugggacuaugugguuaccacggauauaagcgagaugggcgccaacuucagggcggaccgggucaucgacccgagacggugccucaagcccgucauacugaaagacgguccagagcgagucauccucgccggccccaugccuguuaccguggccucugccgcccagaggagagggcggaucggccgcaaccacaacaaggaaggggaccaguacaucuauauggggcagccgcuaaacaacgaugaggaccacgcgcacuggaccgaggccaagaugcugcuggacaauauuaauacgcccgaagguaucauccccgcccucuucgagccggagcgggaaaaauccgccgccaucgacggggaguaccgccugcgcggugaggcgcggaagacuuuuguggagcugaugcgccgcggggaccucccaguuuggcuuagcuacaaaguggccuccgagggcuuccaguacucggaucgccggugguguuuugauggagagcgcaacaaucaaguucuggaggagaauauggacgucgagaucuggacgaaggaaggggaacggaaaaagcuccgcccccgcuggcuagacgcgcgcaccuacucugacccucucgcccugcgggaguucaaggaguucgccgccggccgcagaagcguguccggggacuuaauacuggaaaucggcaagcucccccagcaccugacccaacgugcucaaaaugcauuggacaaccucguuaugcugcacaacagcgaacagggcggccgggccuacagacacgccauggaggagcugccggacacgauugaaacucucaugcuucucgcccucaucgccguccugaccggcggagugacccuguucuuucugucaggccggggucuaggcaaaacgaguaucggucuucucugcgugauggcuucuagugucuugcuguggauggcaagcguggaaccccauuggaucgcggccucuauuauucuggaguucuuccugaugguccugcucauucccgagccugaccgccaacggacgccacaggacaaccaacucgccuaugucguaaucggacuccucuucaugauccugacaguugccgccaaugagaugggucugcucgaaaccaccaagaaagaccuggguaucggccacguugcugccgagaaucaccaccacgccgccaugcuggacguggaccuccauccggcguccgcguggacgcuguacgccguagccaccaccaucauaaccccgaugaugcgccacaccaucgaaaauaccacggccaacauuucucuaaccgcgaucgcuaaccaggccgccauacucaugggguuagacaagggauggccgaucuccaagauggauauaggcguuccacuucucgcgcucggaugcuauucucaggugaauccacuuacccucaccgcggcuguucugaugcuugucgcccacuacgcuaucaucggcccggggcuccaggcaaaagcgaccagagaggcccagaagcgcacagcugccggcaucaugaagaacccgacggucgacggaaucguugcgaucgaccuggaccccgucguuuaugacgcgaaauucgagaagcaacugggccagaucaugcuccugauacugugcacaagccaaauccuccuaaugcgcacaaccugggcccugugugagagcaucacguuggccacuggcccucugacgacgcugugggaggggucaccaggaaaguucuggaauaccacgaucgcugucagcauggccaauaucuuccgugggagcuaccucgcuggagccggccucgccuucucccuaaugaagucccucgggggcggccgccggggcaccggggcgcagggcgagacgcuaggcgagaaguggaagcgccagcuuaaccagcucuccaagucggaguucaauaccuauaagcgguccgggaucauggaagucgaccgcagcgaggcgaaagagggccugaagcggggcgagaccaccaagcacgccgugagccgcggcacagccaagcugcgcugguuuguggagcgcaaccuugucaagccggaggguaaggugaucgaucugggcugcggcagagguggguggucauacuacugcgcgggccugaaaaagguaacggaaguuaagggauauaccaaaggcgggccgggacaugaggagcccauccccauggccaccuacggcuggaaccugguaaaguugcacuccgguaaagacguuuucuucauuccgccugagaaaugugacacccuguuaugcgacaucggggaaagcuccccgaaccccacaaucgaggagggccgcacccuccgagugcugaagaugguggagccguggcugcgagggaaucaguuuugcaucaagauauugaacccguauaugcccucuguggucgagacccuggagcagaugcagcggaagcacggcggcaugcugguucgcaacccucucucccguaacagcacucacgagauguacugggugaguugcgguaccggcaacaucgugucugcggugaacaugacgucgcgcaugcuacugaaccgguucacgauggcccaccgcaaacccaccuacgagagagacguugaccugggggcuggcacgcggcacgucgcaguggagccugagguggccaacuuagacauuaucgggcaacgcaucgagaauaucaagcacgaacacaagagcaccuggcacuacgacgaggacaacccuuacaagacaugggcguaccacgggaguuacgaggucaagcccucggguagugcuaguagcauggugaauggggucgugaaacugcuuacgaagccaugggaugugauaccaaugguaacucagaucgccaugacugacaccaccccauucggccagcagaggguguuuaaagagaagguugacacccgaacucccaaggcuaagcgggggaccgcccaaaucauggaggucaccgcuaaguggcuguggggcuuccucucccgcaacaagaagccgcgcauaugcacccgcgaagaguucacgcguaagguucgcagcaacgcagcuaucggcgccguuuucguggacgagaaccaguggaacagcgccaaagaggccguggaggacgagagguucugggacuuaguacaccgcgaaagggagcugcacaagcaggguaagugcgcgaccugcguuuacaacaugaugggaaagcgcgagaagaagcugggugaguucggcaaggccaaggguagcagagcgauuugguacauguggcucggagcgcgauuccuugaguuugaggcacugggcuucaugaacgaggaccacugguuuucccgugaaaacucccucuccgggguugagggugaggggcugcacaaacugggauacauacuccgggacauuucuaagaucccagggggcaacauguaugcagacgauaccgccggaugggauacccgaaucaccgaagacgacuugcagaacgaggccaagauuaccgacaucauggagcccgagcacgcacugcuugcgaaguccaucuucaagcugaccuaccagaacaagguagucaggguacagcguccggcuaagaacggcaccgugauggacgugaucucccgcagagaccagcggggauccggccagguggguacguacggccugaauaccuucacaaacauggaggcccagcucauccgccagauggagagcgaggggaucuuuucaccauccgagcuggagacccccaaccuggcuggccgggugcucgacuggcuagagaagcacgggguggagcgccugaaacggauggcgaucucaggagacgacugcguggucaagccaauugacgaccgcuucgccacggcucucaccgcccuaaaugacauggggaaggucaggaaggacauuccgcagugggaaccgagcaagggcuggaacgacuggcagcaaguccccuucugcagucaccacuuccaccagcuuaucaugaaagacggaagggagauaguuguccccuguaggaaccaagaugaguuaguggggcgagccagagugucccagggcgcgggcuggucccugcgcgagaccgccugccugggaaaauccuacgcccagauguggcagcuaauguacuuucaucggcgcgaucugcggcuggccgcgaaugccauuugcucagcggucccgguggauuggguuccgaccucccgcacuacguggagcauucacgcucaccaccaguggaugaccaccgaggacaugcucucuguuuggaaucggguguggauagaggaaaaucccuggauggaggacaagacacacaucucguccuggggagacgugccguauuuaggcaagcgcgaggaccaauggugcggcucccugaucggucugacugcccgggcuacgugggccacaaacauucaaguggccaucaaucaggugcgacggcugaucggcaacgagaacuaucuggauuacaugaccagcaugaagcgcuucaagaacgagucugacccggaaggggccuuaugguga

SEQ ID NO: 24543 - RNA, 9879 nt, Artificial Sequence
  derived and/or modified CDS sequence (opt11) from DENV-1__EU482806__SS-prME
ucugugaccaugcugcucaugcugaugcccacagcucuggccuuccaucuuacaacccgcggcggcgagccccacaugauagugaccaagcaggagcggggcaagagccuccuguuuaagaccucugcggggguaaacaugugcacacucauagccauggaccucggugaguugugcgaggacaccaugacuuacaaaugcccgcggauuaccgaggccgagcccgacgacgucgacugcugguguaacgccacggauacaugggucaccuacgggacgugcagccaaacgggcgaacaccggcgcgauaaacgguccguagcccucgcuccccaugugggccugggucuggagacccguacugagacguggaugaguucugagggcgcauggaagcagauccagcgggucgagacgugggcccucaggcaucccggguuuacugucaucgcccuguuccuggcgcacgcaaucggcaccucaaucacacagaaggguaucauauucauacuccuuaugcuggugacgcccaguauggccaugcggugcgucggaaucggcagucgggauuuuguagaggggcucaguggcgccaccuggguggacguugugcuggagcacggguccugcgugaccaccauggcgaaggacaagccaacgcuggacaucgaacuuuuaaagaccgaggucaccaacccugcggugcugcggaagcugugcaucgaggccaagaucucgaacacuacgaccgacagccgcugcccaacccaaggcgaagcuacccugauggaggagcaggaugccaacuucguaugcagacgcacguucgucgaucgggguugggggaauggcugugggcuguucggcaaggggucgcuaaucacgugcgccaaguucaagugcguuaccaagcuggagggcaagauuguucaguacgagaacuugaaguacagugucauaguaaccguucacacaggcgaccagcaccaagucgggaacgaaagcaccgagcacgguacaaccgcgaccauuacgccccaagcccccaccucugagauccagcucaccgauuacggagcccugaccuuagacugcagcccccguacgggccuugacuucaacgagauggugcuacugaccaugaaggagaaguccuggcucguccacaagcagugguuccuggaccugccgcuccccuggaccucuggggcaagcacgucccaggagacguggaaucgccaggaccugcuugugacguucaagacagcccacgcgaagaaacaagaggugguggugcucggcagccaggagggcgcgaugcacaccgcacugacaggagccaccgaaauccagaccucgggcaccacgacaaucuucgcuggccaccucaagugccgccucaagauggacaaacuuacguuaaagggcaugucguacgugaugugcacgggguccuucaagcucgagaaggaagucgcggagacgcaacacgggaccgugcuuguccaaaucaaguacgagggcacagaugcacccugcaagauccccuucaguacccaggaugagaagggugucacgcagaacggccggcuaauuacugcgaaccccaucgugacggauaaggaaaagccugucaacaucgaagccgagccgcccuucggggaguccuauaucguaaucggcgcgggugagaaggcucugaagcucagcugguuuaagaaaggcagcuccaucggaaaaauguucgaggccaccgcgcgcggugcacggcgcauggccauccugggcgacacggccugggacuucggguccauaggcggcguguucaccagcgugggaaaauugguccaccagaucuucggcaccgcguacgguguauuauucuccggcgugagcuggacaaugaaaaucgggauaggaguccuuuugacguggcucgguuugaacucccgaucaacgucacuaagcaugacauguaucgccgucggucucgugacccuguaccucggggucaugguucaggccgacuccgggugcgucaucaacuggaagggccgggagcugaagugcggaagcgguaucuuugucacaaacgaaguccacacguggaccgagcaauauaaguuccaggcggacucaccgaagcgucuguccgccgccauaggaaaggccugggaggagggagugugcgggauacggucagcgacacgcuuagagaauaucauguggaagcagauuuccaacgagcugaaccacauccugcuggagaaugacaugaaauucacuguuguggugggugaugucgugggcauucucgcucaggggaagaaaaugauccguccccaaccuauggaacauaaguacagcuggaaguccuggggcaaagccaagaucaucggagccgauguccagaacacgaccuucaucauagacgggcccaauacaccggagugcccggaugaccagagagccuggaacauaugggaggucgaggacuacggauucgguaucuucaccacgaacaucugguugaaacugcgagacagcuauacucagguaugcgaccaccgccuaaugucagcggcaaucaaagacagcaaagccguccacgccgacauggguuauuggaucgaguccgagaagaacgagacuuggaagcuggccagagcgucauucaucgaggucaagaccugcaucuggcccaagucgcauacgcuguggagcaacggcguccucgaaucagagaugaucauccccaagaucuacgguggcccaaucucucaacacaacuaccgccccggguauuuuacucagaccgcuggccccuggcaccuaggaaaauuagagcucgacuucgaccuaugcgaaggcaccaccgucgugguggacgagcacugcggaaaucgggggccguccuugcgcacgaccaccgugacaggcaagaucauccacgaguggugcugucgguccugcacacuuccaccucuccgguucaaaggggaagauggcuguugguacggaauggaaauccgucccguuaaggaaaaggaggaaaaucugguaaagagcaugguguccgccggaagcggugaagucgauuccuucucucucggucuacugugcauuucuauaaugauagaggaagugaugcgcucccgguggagccguaaaaugcucaugacagguacacuggccguuuucuuacuguugaucaugggccaacugacguggaaugaccugaucagacugugcauaauggugggcgccaacgcgagcgacagaauggggauggggaccaccuacuuggcccucauggccaccuuuaagaugcguccgauguuugccgugggccugcuguuuaggcgucucacgucccgggaggugcugcugcucaccaucggcuugagccugguugccucugucgaguugccaaacucccuggaggagcugggcgacgggcuugcgaugggcauuaugauccucaaacugcuaacggacuuucagagucaccagcugugggcgacguuauuaagccuaacguucauaaaaaccaccuuguccuugcauuacgccuggaagacuauggccaugguccuuagcaucguuucccucuucccccuuugccuaucgaccaccucccagaagaccaccugguuaccugugcuccuaggcagucuagggugcaagccgcucacgauguuccuuaucgcggaaaacaagaucuggggacgcaaauccuggccccucaacgaagguaucauggccgucggcgugguuagcauccuucuaagcucgcugcugaaaaacgacgucccccuggccgggccccugaucgccggcggcaugcucauagcgugcuacgugauaagcggguccagcgcugaccuaucccuggagaaggccgcagagguaucgugggaagaagaggccgaacacaguggugccucgcacaacauacucgucgaggugcaggacgacgggaccaugaagaucaaagacgaggagcgggacgacacucucacaauccugcucaaggcgacucuucuagcagucuccggcgucuacccgcugucgauacccgccacucuguuugugugguacuucuggcagaaaaagaagcaacgaagugguguucugugggauacaccuaguccgccagaggucgagcgggcuguucuggacgauggcauauaccgcauuaugcaaaggggccuacuggggaggucacaggugggugucgggguguuccaggagaacguguuccacacuauguggcacgucacacggggcgccgugcugauguaccaggggaagcgucucgaacccaguugggcuuccgugaaaaaggacuugaucagcuacggaggcggauggaggcuucaaggauccuggaacacgggggaggaaguccaggugaucgcgguggagcccgggaagaacccuaagaacguccagaccgccccaggcaccuuuaaaacccccgagggcgaagugggcgccaucgcacucgacuucaagccugggacgucaggcucccccaucgugaaccgugaggggaagaucgucggccuguacggcaauggggucgugaccaccaguggcacauacguaagcgcgaucgcccaggcgaaggcaucccaggaggguccccugcccgaaauugaggacgagguguucagaaagcgcaacuugacgaucauggaucuacaccccggcucggggaagacgcgucgguaccugccugcgauagugcgggaagccauuaagcgcaagcuacguacccugauccuggcccccacccgcgucguggcuucagagauggccgaggcauugaagggcaugccgauacgcuaccagacgaccgccguaaagucugagcauacaggcaaagagaucgucgaccuuaugugucacgccacguuuacuaugcggcuacugucccccguucgagugcccaacuacaacaugauaaucauggaugaagcccacuuuacggacccgagcuccaucgccgcucguggguacaucuccacccgugucggcaugggugaggcggccgccaucuucaugacagcgacuccacccggcagcguggaagcguucccgcagagcaacgcggucauccaggaugaggaacgagauauucccgagcgguccuggaacagcggcuacgaguggaucaccgacuuuccugggaagacuguuugguucguccccuccaucaagucaggcaaugauaucgcgaauugccugcggaagaacgggaagcgcgugauccaacugucccggaagacguuugacacggaauaccagaaaaccaagaauaacgacugggauuacgucgugaccaccgauaucagcgagaugggagcgaauuuccgcgcugaccgagugaucgacccgagacggugcuuaaaacccgucaucuuaaaggacggucccgagcgcgugauucuggccggacccaugcccguuacuguggcuucugccgcccagcgacgcggucggaucgggcgcaaccauaacaaggagggcgaucaguauauauacaugggucagccccucaacaacgacgaggaccacgcgcacuggaccgaggccaagaugcugcucgauaacaucaauacccccgagggcauaauccccgcgcuauucgagccggagcgggagaagucugcagccauagacggggaguacaggcugcgcggcgaggcccguaagaccuucguggaacuaaugcgacgcggggaccuccccgucuggcuguccuacaagguggccucggagggcuuccaguacagcgaccggcgguggugcuucgacggcgagcgcaacaaccagguacuggaggagaacauggacgucgaaaucuggacaaaggagggagagcgcaaaaagcuccgcccccgguggcucgacgcaagaaccuacuccgacccccuugcccuccgggaguuuaaggaguucgccgccggccgccggagcgucucgggggaccugauccuggagauugggaagcucccgcagcaucuuacccagcgcgcucaaaaugcucuggauaacuuagucaugcugcacaacagcgaacagggcgggcgagccuaucgccaugccauggaggagcugcccgauacaaucgagacgcucauguuacucgcccuuaucgccguccugaccggcggggugacgcuauucuuucucuccggccggggucugggcaagaccucgaucggacugcucugcguuauggccuccuccguccuacuguggauggcaucuguggaaccccauuggaucgcggccucgaucauccucgaguucuuucugaugguguuauugauccccgagccugacaggcaacggacgccccaggacaaccagcuggcguacgucgugaucggccuucucuuuaugauacugacgguggccgccaacgaaaugggccugcuagagacuaccaagaaggaccuggggaucggccacguugcgguggagaaucaucaccacgccaccaugcuggacguggaccuccacccggcgucugccuggacgcucuacgccguagccaccaccaucauaaccccgaugaugcgccauacgaucgaaaauaccacagccaacauuagccugaccgccaucgccaaccaggccgcgauacucaugggucuugauaaaggcuggccgaucucaaagauggacaucggcguaccucugcucgcacuggggugcuacagccaggugaauccccugacuuuaaccgccgcaguccugaugcuaguggcgcauuacgccaucauagguccggggcuccaggccaaggcgacucgggaggcccaaaagcgaaccgcugcggguaucaugaagaaccccacggucgacggcaucgucgccaucgacuuagaccccgugguguacgacgccaaguucgaaaagcaguugggccagauaaugcuccugauuuuaugcacgucccaaauacuccugaugcgcacaacgugggcccugugcgaguccauuacgcuagcgaccggcccccuaaccacucugugggagggguccccaggcaaauuuuggaauacuacaaucgcagucagcauggcuaacaucuucagaggguccuacuuggcaggcgccgggcuggcguucagccuaaugaaguccuuaggggguggaagacgggggaccggggcccagggugagacgcugggugagaaauggaagcgccaacugaaucagcucaguaaaagcgaguucaacaucuacaagagguccgggaucauggagguggacagguccgaggccaaggagggacugaagcgcggggagacgacccgccacgccgugagucggggaacagcgaagcugcgcugguucgucgagcgcaaucugguuaagccugaagggaaagugaucgaucucggauguggccgcgggggauggucuuacuauugugccggacuuaagaagguuaccgaagugaaggguuacaccaagggaggacccggccacgaggaaccaaucccgauggcaacguacggcuggaaccuggugaagcuacacuccggcaaagacgucuucuuuacgccacccgagaagugcgauacccuuuuaugcgacaucggggagagcuccccuaacccgacgaucgaggaagggaggacccuccggguccuaaagaugguagagcccuggcugcgggggaaccaguucugcaucaagauccucaauccuuacaugcccagcguuguggagacccuagagcagaugcagcggaagcauggcggcaugcuggugcguaauccccucucccgcaacagcacccacgagauguacuggguauccugcgggacgggcaacaucguuucugcugugaacaugacuucccggauguugcugaaccgcuucacaauggcucaccguaagcccaccuaugaacgugacgucgaccugggcgcgggaacccgccacguagcaguagagccagaggucgccaacuuagacauaauugggcagaggaucgagaauaucaagcacgagcacaagagcacguggcacuacgacgaagacaaccccuacaaaaccugggcuuaccacggaagcuacgaagugaagccgagcggcagugccaguagcauggucaacgggguagugaagcucuuaaccaagcccugggacguuaucccuauggucacccaaaucgccaugacggacaccaccccguucggccaacagcgcgucuucaaggagaagguugacacccgaacgccgaaggcgaagaggggaacggcucagauuauggaagucaccgcccgguggcuguggggcuuccugucccgcaacaagaagccccguaucugcacccgcgaggaguucacgcggaagguacgaagcaacgccgcgauuggugcuguuuucguggaugagaaccaauggaacuccgccaaggaagccguggaggacgagagauuuugggaccuuguucagaaggagcgggagcugcacaaacagggaaaaugcgcgaccugcguauacaacaugaugggaaagcgggaaaagaagcugggugaguucggcaaggccaagggaagccgcgccaucugguacauguggcuaggcgccagguuccuggaguucgaagcccucggcuucaugaacgaggaccacugguucucccgcgaaaauucucucuccgggguggaaggcgagggacugcacaagcugggcuacauucuucgugauaucucuaagauacccgggggcaacauguaugccgacgauacagcgggcugggacacccgaaucacugaagacgaccugcagaacgaggccaagaucaccgacauaauggagccagagcaugcccugcuugcuaccuccauauucaaguugaccuaccagaacaaagucguaagaguccagcguccagcaaagaacgggacugucauggacguuaucagcaggcgcgaucagcgcggcuccggccagguggguaccuacggccugaacaccuucaccaacauggaggcacaguuaaucaggcaaauggagagcgagggcaucuucuccccaugcgagcuggaaaucccaaaccuggcagagcgcgugcucgacuggcuggagaaguacggcguugagcgacugaagaggauggccauaagcggcgacgacugcguggucaaaccuauugaugaccgcuucgcaacggccuuaacagcccugaacgauauggggaagguacggaaggacguaccgcagugggagccuucgaagggguggaacgacuggcaacaagugcccuucugcucucaccacuuccaccaacuuaucaugaaggauggccgggagauaguggugccgugcaggaaccaagacgagcucgucggccgagcucgcguaucucagggggccggcuggagucugagggagaccgccugcuugggcaagagcuacgcccaaauguggcagcuaauguauuuucaccgccgugacuuacgccuggccgccaaugccaucuguuccgcgguccccgucgacugggugccuacaaguaggaccaccuggucaauccacgcgcaccaccaauggaugacaacggaagacaugcucagcguguggaaucgugucuggaucgaggagaaccccuggauggaagacaaaacgcacgugucguccuggggcgacguuccguaucuggguaaacgcgaagaucaguggugcggaucccugaucggccucaccgcccgcgccaccugggccucaaauauccaggucgcgaucaaccaggugaggagacugaucggcaacgagaacuaccuggacuacaugaccagcaugaagcguuuuaagaacgaaggcgaccccgaaggagcucucugguag

SEQ ID NO: 24544 - RNA, 9879 nt, Artificial Sequence
  derived and/or modified CDS sequence (opt11) from DENV-1__EU482807__SS-prME
uccgugaccaugcugcucaugcugaugcccacagcccuggccuuccaucucacgacccgcggcggggagccacauaugaucgugagcaaacaggagcgggggaaaagucugcuuuucaaaaccucugcgggggugaacauguguacccuggucgccauggaucuuggggaauuuugugaagauacgaugaccuacaaauguccccgcaucacugaagcagaacccgacgacguagacuguuggugcaaugcaaccgacacgugggugaccuacggaaccugcucccagaccggggagcaccggcgcgauaagcgguccguggcccuggcgccccacgugggcuuagggcuggagacgcgcaccgagaccuggaugagcucugaaggcgccuggaagcaaauccagcggguggagaccugggcccugcgucacccgggguucacggucaucgcgcucuuucuggcacacgccauuggcaccagcaucacacaaaagggcaucauuuucauucuacucaugcuggucacccccuccauggccaugcggugcguggggaucggaagccgcgacuucguggaggggcuguccggcgccacaugggucgacguggugcucgagcaugggucgugcgucaccaccauggccaaggauaaaccgaccuuagauauugagcugcucaagacggaggugaccaaccccgcggugcugcguaaguuaugcaucgaggcaaagaucucaaacaccacgacggacagccgcuguccgacgcagggggaggccacccuagucgaggagcaggaugccaauuucgugugccgccgcacauuuguggacaggggcuggggaaacgguugcgggcuguuugguaaggggucccugaucacuugcgcaaaguucaagugcgucacgaaacuugaaggcaagacagugcaguacgagaaucugaaguacagcgugaucgugacuguccauacgggcgaucaacaucagguggggaacgaaucuaccgagcacggaaccaccgcgaccaucacgccacaggcccccagcaccgagauccagcugacugacuauggggcucucacucuggacugcucuccccgcaccggccuggacuucaacgagaugguacuccugaccaugaaggagaaguccuggcuggugcacaagcaaugguuccucgaccugccguugccauggacgagcggggccuccaccagccaggaaacguggaauaggaaggaccuccuggucacauuuaagaccgcgcacgcgaagaagcaggaggucgugguauugggcucccaggagggugccaugcacaccgcccuuaccggggccacggagauccagacgagcggcaccacaacaaucuucgccgggcauuuaaaguguaggcucaagauggacaagcucacccugaagggcauguccuacguaaugugcaccggcucuuucaagcuggaaaaggagguggccgagacgcagcacggcacgguccuagugcagaucaaauaugagggcaccgaugccccguguaagauccccuucuccacccaggacgagaaaggggucacgcagaacggccggcugaucaccgccaacccgaucguaaccgacaaggagaagccugugaacauugaggcugaaccgcccuucggagagagcuauaucguaaucggcgcgggcgagaaagcccuuaagcuguccugguucaagaaaggaagcagcaucggcaaaauguucgaagccaccgcgcgcggggcccggcguauggcgauccucggcgacacagcaugggacuucgggagcaucgggggcguguucacaagcguggguaaacugguucaccagauauuuggcaccgccuacgggguauuauucaguggcguuuccuggaccaugaagauugggaucggcguauuacuuacguggcugggcuuaaacagucgcaguaccagucuguccaugaccugcaucgccgucgggcuggugacccuauaccugggcguuaugguccaggcagacagcgggugcgugaucaacuggaaaggcagggagcuuaagugcggaagcggcaucuucgugacuaacgagguacauacauggaccgaacaguacaaauuccaggccgacucgccgaagcgguuaucugccgccaucggcaaggccugggaggagggcgucugcggaaucaggucggccacccggcucgagaacaucauguggaaacagauuucaaacgagcuaaaccacauccuccuggagaacgacaugaaguucaccguggucguaggggauguggcuggcauccucgcccaagggaagaaaaugauccggccucagcccauggaguacaaauauuccuggaaaucauggggcaaggccaaaaucauaggagccgacguacagaacacgaccuuuaucaucgacggacccaauaccccggagugucccgaugaccagcgugcguggaacaucugggagguggaagauuacggcuucgggaucuuuaccaccaacaucugguuaaagcugcgggauuccuacacucaagugugcgaccaccggcugaugagcgccgccaucaaagacuccaaagccguccacgccgacaugggcuauuggaucgagagcgagaagaacgagaccuggaaguuagcgagggcgaguuuuaucgagguaaagacuugcaucuggcccaagagccacacgcucuggaguaacggcgugcuggaguccgaaaugaucauaccuaagauauacgggggcccgaucucccagcacaacuaccgccccggcuacuuuacccaaaccgccggccccuggcauuuggggaaacuggagcuggacuuugaccuuugugaggggaccacggucgugguggacgaacacugcggcaaccgcgggccaagccugaggaccacaaccgugacggggaaaauuauccacgaguggugcugccgguccuguacccugccaccccugagguucaagggggaggauggcuguugguacggcauggaaauacggcccgugaaggagaaggaggaaaauuuggucaagagcauggucagcgcgggauccggcgaaguggacucguucucccugggacucuuguguauaagcaucaugaucgaggagguuaugcgcucccgguggucacgcaagaugcugaugaccggcaccuuggccguguucuuucugcugaucaucggacaacucacguggaacgaccuuaucaggcugugcaucauggugggcgcaaacgcuuccgaccgcaugggaaugggcaccaccuaccucgcccucauggccaccuucaagaugagaccgauguucgccgugggcuuacuguuccggcgucugacgagucgggaaguccuccuccuuaccaucggcuuaucccucguagcgagcgucgagcugcccaauucguuggaggagcugggagacggguuagccauggguaucaugaucuuaaagcuccugaccgacuuccagucucaucaacugugggccacguuacucagccugacguucaucaagaccaccuucagucuccacuacgccuggaagaccauggccaugguguuaaguaucgugagccuguucccacucuguuuauccacuaccagccagaagacuaccuggcugcccguccuccuaggcuccuugggcugcaaaccgcucacgauguuccugaucgccgagaacaaaauauggggcaggaggucguggccccugaaugaggggaucauggccguaggcaucguaagcauccucuuauccagccuguuaaagaacgacguccccuuggccggaccgcugaucgcgggcggcaugcucaucgcgugcuacguaauauccgggagcuccgcggaccugagccuagagaaggccgccgaggugucuugggaggaggaggccgagcacucgggcgcgucccacaacauucugguugaggugcaggacgacggaaccaugaaaaucaaggacgaggagcgcgaugacacccugaccauccugcugaaggccacccugcuagcgguaagcggaguuuacccacucuccauccccgcgacccuguuugugugguacuucuggcagaaaaagaagcagcggucaggaguccugugggacaccccgagcccgcccgaggucgagcgcgccgugcucgacgacgggaucuaccggaucaugcagcgaggccugcuggggcguucccaagugggcgucggugucuuccaggaaaacguguuucacaccauguggcacgucacgcgcggugcgguacugauguaccaggggaagcgguuagaacccuccugggcgagcguuaaaaaggaccuaaucucauacggcggcggguggaggcuucagggaagcuggaacacgggggaggagguccaggugaucgccguugagcccggaaagaaccccaagaacguccaaaccgccccugggaccuuuaagaccuccgagggugaggucggcgccaucgcgcucgacuuuaaacccggcacgagcgggagccccaucgugaaccgagagggaaagauagucggcuuauaugggaacgggguggugaccacuucggggacguacgugucugccaucgcccaggccaaagcgucccaggaggggccacugccggagaucgaggaugagguguuccgcaaacgcaaccugaccaucauggaccugcaccccggcagcgggaagacccgccguuaccugccggccaucgugcgcgaggccauaaagcggaaguuaagaacccuuauccuggccccuacgcgcgucguggccucugagauggccgaggccuuaaagggaaugccaauacguuaucagacaacugccguuaaaagugagcacacgggcaaagagaucgucgaccuaaugugccaugccaccuucacgaugcgccuacuuucccccgugcgggugcccaacuauaacaugaucaucauggacgaggcccauuucaccgacccgucgagcaucgcggcucgcggauauaucagcacucgggucggcaugggugaagcggccgccauuuucaugaccgcgacgccgcccggcaguguugaggcguuuccccagagcaacgccgucauacaggacgaggagcgcgacauaccggaaagauccuggaacagcggguacgaguggauaaccgauuuccccggcaagaccgucugguucguacccuccaucaaaucuggcaacgacaucgcuaacugucugcgcaagaaugggaagcgggugauccaacugagccgcaagacauucgacaccgaguaccagaagaccaagaacaacgacugggacuacgucguuaccaccgacaucagcgagaugggcgccaacuuucgggccgaucgcgugauagacccccggcgcugccucaaaccgguaauccugaaagacgggccggagagagugauucuggccgggccuaugcccgucacgguggccuccgcagcgcagcguagaggccguaucggccggaaccacaauaaggagggugaucaguauaucuacauggggcaacccuuaaacaacgacgaggaccacgcccacuggacugaggccaagaugcuacuagacaauaucaacaccccagagggcaucauccccgcccucuucgagcccgagagggagaaguccgccgcgaucgacggggaguaccgguuacgcggagaggcccgcaagacguuuguggagcugaugaggcgcggggaucucccgguaugguuauccuauaagguggcaucagagggcuuccaauauagcgaccggcgcugguguuucgacggugaacggaauaaccaggugcucgaggagaacauggacguggaaaucuggaccaaggagggggaacgcaagaagcuccguccccgcuggcucgacgcgcggacuuacucggacccgcuggcccuacgcgaguuuaaggaguucgcagcaggucggagaagcgugucaggggaucuaauccuggagauaggcaagcugccccagcaccugacccagcgggcccaaaaugcgcuggacaaucucgugaugcuacacaauagcgagcaaggagggcgcgcguaccggcacgcuauggaggagcugccggauaccaucgagacgcugaugcuucuggcucucaucgccguccugacgggcggggugacccuguucuuucucucuggccgcggguuagguaagaccagcauaggccuccucugcgugauggccuccagcguccuacuguggauggcguccguugagccgcacuggaucgccgccagcaucauacucgaguucuuucuaauggugcugcucauccccgagcccgaucggcagcguaccccgcaagacaaucaacuugcguacguagugauuggucuccucuuuaugauccugacgguggcggcgaacgaaaugggccuauuggagacaaccaaaaaggaccuggguaucgggcacguugccguggaaaaccaccaccacgccgccaugcuggacguggauuuacaccccgcguccgcguggaccuuauacgcuguggcgacgacgaucauaaccccgaugaugcggcacacuaucgagaacacgacggccaacauaucccugaccgccaucgcuaaucaagccgccauucucauggggcuggauaaaggauggccgaucagcaaaauggacaucggcgugccccugcuagcccuuggguguuacucgcagguuaacccucuaacccucacggccgcggucuugaugcuaguagcacacuacgcaaucaucggccccgggcugcaagcaaaggcgacucgcgaggcccagaagcgcaccgccgcgggcaucaugaagaacccgacgguagaugggaucgucgccaucgaccuggaccccgugguuuacgacgcgaaguuugagaagcaacugggccaaauaaugcuccuaauucugugcacaucccaaauucuccugaugcgcacgaccugggcccugugcgagucuaucaccuuggccacgggcccucugaccacgcugugggagggcuccccgggaaaauucuggaacacgacgauugccgucagcauggccaacauuuuuagggguucauaccucgcgggcgccggauuagccuucucccugaugaagucccucgggggcgggcggagaggcacaggggcccaaggugaaacgcuaggcgagaaguggaaacggcaacugaaccagcuauccaagagcgaguucaacaccuacaagcgaucggggaucauggaaguggaccgcagcgaggccaaagagggucugaagagaggggaaacgaccaagcacgccguaucccgggguacugcgaagcugagaugguucgucgaacggaaccucgugaaaccggaggggaaagugauugaccugggcugcggccgcggcggcuggaguuacuauugcgccgggcugaagaaggucaccgagguaaagggcuacacgaagggcgggcccggccacgaggagccgauccccauggcaaccuacggauggaaccuggugaagcuacacuccggcaaggacgucuucuuuaucccgccggaaaagugcgacacccugcugugcgauauaggggagagcucccccaaccccaccaucgaggagggccggacucuacgcgugcugaagaugguagaacccuggcugaggggcaaccaguucuguaucaagauccucaaccccuacaugcccuccgucguggagacccuggagcgcaugcaacggaagcacggcggcaugcugguacgcaacccccucuccagaaauucgacccacgagauguauugggucucuugcgguacagguaauauugugucagcggugaacaugaccucccgcaugcuucugaaccgcuucacgauggcccaccggaagccgaccuaugagcgcgacguggaccucggagcuggaacccgucacguggccguggagcccgagguggccaaccuggacaucaucggccagcgcaucgagaauaucaagcaugagcacaagagcacguggcacuacgacgaggacaaccccuacaaaacuugggcguaccacggguccuaugaagugaaacccagcggcagcgcgagcaguauggucaacgggguggugaagcuccucaccaagccgugggacgucauccccauggugacucagaucgccaugacggacacaacccccuucggccaacagcggguguucaaggagaaagucgacacccgcacccccaaggcuaagagggggacggcccagaucauggaaguuaccgcuaaguggcuguggggcuuucugucccggaauaagaagccgcggaucugcacccgcgaagaguucacucggaagguacgaagcaacgccgcuaucggcgcugucuucguggacgagaaccaguggaacuccgcgaaggaggccguagaggacgagcgguucugggaccucguccaucgcgaacgggagcugcacaagcaagggaaaugcgccacuugcguguacaacaugauggggaagcgggagaagaagcugggggaguucgggaaggccaaagggagcagggcaaucugguacauguggcucggcgcacgcuuucuggaguucgaggcccuuggcuucaugaacgaggaccacugguucucccgggagaacagucugagugggguggagggcgaggggcugcauaaguuaggcuacauccuccgcgacaucagcaagaucccugggggcaauauguacgcugacgacaccgccggaugggacacccggauaacugaagacgaccugcagaacgaggcgaaaauuaccgacaucauggagccagagcacgcgcuguuggccaagagcaucuucaaacugacauaccagaacaaagucguccguguacaacgcccggccaagaacgggaccgugauggacguuauuagccgucgcgaccagcgggguuccggccaggugggaacguacggccugaacacguucacgaacauggaggcgcaacuuauucgccaaauggagagcgaggguauauucucaccuagcgagcucgagacacccaaccuggccgggcgggucuuagacuggcuggagaaacacgggguagagcgccugaagcggauggcuaucucgggugacgacugcgugguaaagccaaucgacgaccgcuucgccacugcgcucacggcccugaacgacauggggaaggugcguaaggacaucccgcagugggagcccagcaagggcuggaaugacuggcagcagguccccuucugcagccaccacuuccaccagcugauaaugaaggacggccgcgagaucgucguucccugccggaaccaggacgagcucguggggcgagcccgggucucucaaggcgcgggguggagccugcgcgagacggccugccugggcaaguccuacgcccagauguggcagcucauguacuuccacaggcgggacuugcggcuggccgcgaacgcgaucugcagcgccgugcccguggauuggguccccacaucgcgcacuacguggagcauccaugcccaccaccaguggaugaccaccgaggacaugcucucgguguggaaccgcguguggaucgaggagaauccauggauggaggauaaaacacacauuucguccuggggcgacguccccuaccucgguaaacgcgaggaccaguggugcggcagccugauugggcucaccgcccgcgcaaccugggccaccaacauccagguggccaucaaccaggugcggcgccugauugggaacgagaacuaccuggauuacaugaccuccaugaagcgguuuaaaaacgaguccgacccagaaggcgcucucugguaa

SEQ ID NO: 24545 - RNA, 9879 nt, Artificial Sequence
  derived and/or modified CDS sequence (opt11) from DENV-1__EU482808__SS-prME
agcgugaccaugcuucugaugcucaugccaaccgcccuggccuuccaccucacgacccguggcggggagccacauaugaucgugagcaagcaggagcggggcaagagccuucuguucaagaccucagccggggugaacaugugcacccucaucgccauggaccugggcgaguucugcgaggacacuaugacguauaagugccccagaaucaccgaggccgagcccgacgacguggacugcuggugcaacgccaccgacacguggguuacauacgggaccugcagccagacuggagagcaccggcgggacaagcgguccguagcgcuggcgccccaugugggccucgggcuggagacgaggaccgagaccuggaugagcuccgagggcgcguggaagcagauccagcgaguggagaccugggcccugcgccaccccggcuucacugugaucgcccucuuccuggcgcacgccauugguaccagcaucacccagaaggggauaaucuucauccugcuuaugcugguuacccccuccauggcaaugaggugcgucggaaucggcagccgcgauuucguggagggguuguccggcgccacguggguggaugucguacucgagcacgggagcuguguaaccaccauggccaaagauaaacccacccuggacauugagcuguugaagacggaggucaccaauccagcggugcuacggaagcuaugcaucgaggccaagaucaguaacacgaccacggacagccgcugcccgacccaaggcgaggccacccucgucgaggagcaagacgccaacuucgucugucggcggaccuuuguggaccggggcugggggaacggcugcgggcuguucggcaagggcucccugaucacgugcgccaaauucaagugcgugaccaaacucgaaggcaagaccguccaguacgagaaccugaaguacagcgugaucguuaccguccauacgggcgaucagcaccagguggggaacgagaguaccgagcacgggacaaccgcgaccaucacgccccaggcacccagcaccgagauccagcucaccgacuacggggccuuaacacuggacugcuccccccggacggggcuggacuucaacgagaugguccuccugaccaugaaggagaaguccuggcuggugcacaaacagugguuccucgaccugccgcugcccuggaccagcggggcaucaacaucgcaagagacauggaacagaaaggaucuccuggugaccuucaagaccgcccacgcgaaaaagcaggaggucguggugcuggguucccaggaaggagccaugcauaccgcucucacgggugcuaccgaaauucagaccagcggcacuacgacuaucuucgccgggcaccugaagugccgccugaagauggacaagcucacccuuaaggggaugucuuacgucauguguaccgggagcuucaagcuggaaaaggagguggcggaaacccagcacggcaccgugcucguacaaauuaaguaugagggcaccgacgccccgugcaagauccccuucaguacccaggacgagaagggugugacgcagaacggcaggcugaucaccgccaacccgaucguuaccgacaaggagaagccuguuaacauagaggcggaaccgcccuucggggagagcuacaucgugauaggcgccggcgagaaggcccugaagcuguccugguucaaaaagggaagcuccaucggcaaaauguucgaggccaccgcccgcggggcccgcaggauggcgaucuuaggcgauacggccugggauuucgggagcauuggcggcguguucaccuccgucggaaagcuggugcaccagaucuucggcaccgccuacggggugcuguucagcggcgucucguggaccaugaagauagggaucggcgugcuccucacguggcugggccucaauucacguagcaccagccugucaaugaccugcaucgcugugggucuggugacccucuaucugggcguaauggugcaagccgauucagggugcgucaucaacuggaaaggccgggagcugaaaugcgggagcggcauauucgucacgaacgaggugcacaccuggaccgagcaguacaaguuucaggcggacucgccgaagagacugagcgccgccaucgggaaagccugggaagagggggucugcggcauccgguccgccacccgccuggagaacaucauguggaagcagaucagcaacgaacugaaucacaucuuauuggagaacgacaugaaguucaccguggucgugggggacguggcgggcauccuggcccaggggaagaaaaugauacggccccagcccauggaguacaaauacuccuggaaguccugggggaaagccaagaucaucggcgcagacgugcagaacacgacguucauuaucgacgggcccaacacgccggagugccccgaugaccaaagggcguggaacaucugggaggucgaagauuacggcuuuggaaucuucaccacuaauaucuggcuaaagcugcgggacuccuacacccaggugugcgaccaccgccugaugagcgccgccaucaaggacuccaaggcugugcaugcggacaugggcuacuggaucgaaucugagaagaacgaaaccuggaagcucgcgcgagcguccuucaucgaggucaagaccugcauauggcccaagucccacacgcugugguccaacggcguucuggagagcgagaugauuauccccaagaucuacgggggcccgaucucccagcacaacuaccgcccuggauacuuuacacagaccgcgggcccuuggcaccucgggaagcuugagcuggauuucgaccucugcgaaggcaccacaguggucguggacgagcacugcggcaacagagggccgagccugcgcaccacuaccgugacgggcaagauaauccacgagugguguugccgguccugcacccugccgccccugcgcuucaagggggaggauggcugcugguacgggauggagauccggcccgucaaggagaaggaggagaaccugguuaagagcauggugucugcuggcucuggcgaggucgacucuuuuucucuggggcuccugugcauuagcaucaugauagaggaggugaugcgcucccgguggucccgcaagaugcugaugaccggcacgcucgccguguucuuccugcugauaaugggucagcucacguggaacgaccugauucgacugugcaucauggucggcgcaaaugccuccgaccgcauggggauggguaccaccuaccuugcccugauggccaccuuuaagaugcgcccuauguucgccgucgggcuccuguuccggcgccugacgagccgagaggugcugcuccugaccaucgggcugucccuagucgcgagcgucgagcugcccaacucacuagaagaacucggcgacgggcuugccaugggcaucaugauccuaaagcuccugaccgacuuccagucacaccaacugugggcgacguuguuaucccugacguucaucaagaccaccuucagccuccacuacgccuggaagaccauggcgaugguacuguccauugugagccuuuucccccucugucuguccacgaccagccagaagaccacauggcugcccguucuccugggcuccuuggggugcaagccgcucacaauguuccucaucgccgaaaacaagaucuggggccgcaagagcuggccgcugaaugaggggaucauggccgucggcauagugagcauccuucuguccagccugcucaagaacgacgugccccuggccgggccccuuaucgccggcggcaugcugaucgcgugcuacguuaucuccgggagcagcgccgaucugagccuggagaaggccgcggagguguccugggaggaggaggccgaacacagcggcgcgucgcacaacauccuaguggagguccaggacgacgggacgaugaaaaucaaggacgaggagcgggaugacacccugaccauccuguuaaaggccacccugcuggccguuagcggcguguacccgcucuccaucccagccacgcuguucgucugguauuucuggcagaaaaaaaaacagcgcuccggggugcuuugggacacccccucuccgccggagguggagagagccguccucgacgacggcaucuaccgaaucaugcagcgggggcugcuggggcgcucccaggugggcgucggagucuuccaggagaacguguuccauaccauguggcacgugacgcggggcgcggugcugauguaccaggggaagcgccucgagcccuccugggcuucugugaagaaggaccuuaucucguacggcggcggguggcggcugcagggcagcuggaacacgggggaggaggugcaggucaucgccguagagccgggcaaaaaccccaaaaacgugcagaccgcuccugggaccuucaagaccuccgagggggaggucggcgccaucgcgcucgacuucaagcccggaacgagcggcagccccaucgucaaccgcgaggggaagaucgugggacuauacggcaauggggucgugaccaccaguggaaccuacgugagcgccaucgcccaggccaaggcgucccaggaggguccgcugccggagaucgaggacgaggucuuccggaagcgaaaccucacgaucauggaccuacaccccggaagcgggaagacccgacgcuacuugcccgccauaguccgggaggccaucaaacggaagcuccggacccucauacuggccccgacccgcgucguugcuuccgagauggcggaggcccuaaaagggaugcccauucgguaccagaccaccgccgucaaaagcgagcacaccggcaaggagaucguugacuuaaugugccacgcaacauuuacgaugcgacuucucucaccgguccgcguaccaaacuacaauaugauaauuauggacgaggcacacuucaccgacccgaguucaauugcggcccgcggguauaucagcacccgcgugggcaugggggaggccgcggccaucuucaugaccgcaacuccgccaggcuccgucgaggccuuuccucagagcaacgcugugauucaggacgaggaacgggacaucccggaacgcuccuggaacagcggguaugaguggaucaccgacuucccaggcaaaaccgugugguucgugcccuccaucaagagcggcaacgacaucgccaacugccuacggaagaacgggaagcgcgugauccagcugucccggaagaccuucgacacggaauaccagaagaccaagaacaacgacugggauuacgucgucacuaccgacaucagcgagaugggcgcgaauuuccgcgccgacagggucaucgacccccgcaggugccucaaaccggugauccugaaggacgggcccgagcgcgucauccuugcaggcccaaugcccgugacggucgccuccgccgcccagcggcgcgggcggaucggccgcaaucacaacaaggagggcgaccaguacaucuauauggggcagccacucaacaacgacgaggaucaugcacacuggacugaagccaagauguuacuggauaacaucaacacccccgaaggcaucauccccgcccucuucgaacccgagcgggaaaaguccgcagcgaucgacggggaguaucgccugcgcggcgaggcucggaagaccuucguggaguuaaugcgucgcggggaccucccgguguggcugagcuacaaggucgccuccgagggcuuccaguacagcgauaggcgcuggugcuucgauggcgagcgcaauaaccaggugcuggaggagaacauggacguggagaucuggacgaaggagggggagcggaagaagcuccgcccccgguggcuggacgcccguacauacuccgacccccuggcccuaagggaguucaaggaguucgcggccggccgccggagcgucuccggggaucugauccuugagaucggcaaguuaccccaacaccucacccagcgcgcccagaacgcccuggacaaccucgugaugcugcauaacagcgagcagggcgggcgggcguaccgacacgccauggaggagcugccggacaccaucgagacacucaugcuccuggcccucaucgccgugcugaccgguggggucacccuguucuuccugagcggccgugggcugggcaagaccagcauaggacugcugugcgugauggccuccagcgugcugcuauggauggcguccgucgagccccacuggaucgccgcgucgauuauccucgaguucuuccugaugguccuucucauccccgagcccgaccgccagcggaccccgcaggacaaccaguuagccuacgugguaaucgggcucuuguucaugaucuuaaccguugccgcgaacgagaugggcuuacucgaaaccaccaagaaggaccuggggaucggccacguggccguagaaaaccaccaccacgccgccaugcuggacguggaccuacaccccgccuccgcguggacccuguacgcagucgccacuaccauuaucaccccaaugaugcgccacaccaucgagaacacgaccgccaacaucagcuugaccgccauagcgaaccaggccgccauccuuauggggcuggacaagggcuggccgaucagcaagauggauaucggcgucccccuccuggcccuggggugcuacagccaagucaacccgcugacccucacggccgccgugcugaugcuggucgcccacuaugcuaucaucggccccgggcuccaggccaaagcgacccgggaggcccagaagagaaccgccgccggcaucaugaagaacccgacuguagaugggaucguggccaucgaccuugaccccgucguguacgacgcgaaguucgaaaaacagcuggggcagaucaugcuccuaauauugugcacaucccagauccugcugaugcgcaccaccugggcccugugugaaagcaucaccuuagccacgggaccccugacuacccugugggaggguuccccaggcaaguucuggaacaccacgaucgccguaagcauggcgaauauauuccgggggagcuaucucgcgggcgccggacucgccuuuucccugaugaaaucccuagggggcggucguagagggaccggggcccagggcgagacgcugggagagaaguggaagaggcagcugaaccaguuauccaagagcgaguucaauaccuacaagagauccgggaucauggaggucgaucgcagcgaagcgaaggagggucugaagcgaggggaaacgaccaaacacgccguuucccgcggcaccgccaagcugcggugguuuguggaacgcaaccucguaaagcccgaagggaaagugaucgaccuggggugcggucgaggcgggugguccuacuauugcgccgggcugaagaaggucacugaggucaaaggauacacgaagggcgggcccgggcacgaggagcccauccccauggccaccuacggcuggaaccugguaaagcuucauucuggcaaggacguauucuucaccccacccgagaagugcgacacccugcugugcgacauuggggagagcucccccaaucccacgaucgaagagggccgcacucuccggguccugaaaaugguggagccguggcuucgcgggaaccaguucugcaucaagauccucaaucccuacaugcccuccgugguagaaacccuggagcaaaugcagcggaagcacgggggcaugcucgugcgcaacccccucucccggaacagcacccacgaaauguauuggguguccugcgguaccggcaacaucgucucggcggugaacaugacgucccgcaugcugcuuaaccgguucacgauggcccaccgcaagccgaccuaugagcgcgacguggaucucggggccggcacccggcacgucgccguggagcccgagguggcuaaccuagacauaaucggacagcgcaucgagaacauuaagcacgagcacaaaagcacguggcacuaugacgaggacaaucccuacaaaacgugggcguaccacggguccuacgagguuaagcccucgggcagcgccucgucaauggucaacggggucgugaagcuacucacaaagccgugggacgugauacccauggucacccagaucgccaugacagacacaacccccuuugggcaacagcgggucuuuaaggagaaaguggauaccaggacgcccaaggccaagcgggggacugcccaaaucauggaggucaccgcgaaguggcuguggggauuuuuaucccgcgacaagaagccgcggaucugcacccgcgaggaguucacucggaaggugcguuccaacgccgccaucggcgcuguguucguagacgagaaccaguggaacagugcaaaagaggccguugaggacgagagauucugggaccucgugcaccgcgagcgggaacugcacaaacagggcaagugcgcaaccugcgucuacaacaugauggguaaacgcgagaagaagcugggggaguucggcaaggcuaaggggucgcgggccaucugguacauguggcucggugcccgauuccuggaauucgaggcgcugggcuucaugaacgaagaccacugguucucccgcgagaacagccuaucggggguggagggcgaggggcugcauaagcugggguacauucuccgagacaucagcaaaaucccagggggcaacauguacgccgacgacaccgccggaugggacaccagaaucacugaagacgacuugcaaaacgaggccaagauuacggacaucauggagccagagcaugcgcuuuuagcgaaguccaucuucaagcugaccuaccagaacaaggugguaagagugcagcggccggccaaaaacggcacugucauggacgucaucagccgccgcgaucagcggggcuccggccaggugggcacguacggccuuaacaccuucaccaacauggaggcccaguugaucagacagauggaaagcgaggggaucuucagucccucagagcuggagacccccaacuuagccggccgggugcuggacuggcuggagaagcacggggucgagcgccugaagagaauggcgaucucuggcgacgacugcguggugaaacccaucgacgaccgcuucgccacugcucucaccgcccugaaugacaugggaaagguccggaaggacaucccgcagugggagcccucuaaaggcuggaacgacuggcagcaggugccauucugcagccaccauuuccaccagcugauaaugaaggacggccgcgagaucgucguccccugucggaaccaagacgagcucgugggacgcgcccgggugucccagggcgcgggguggagccugcgugagaccgcgugcuugggaaagagcuacgcccagauguggcagcucauguacuuccaccggcgcgaccuucggcuggccgcgaaugccaucugcagcgccguaccgguggacugggugccaaccuccagaacgaccuggaguauacacgcccaucaccaauggaugacgaccgaggacaugcucuccgucuggaaccgaguguggaucgaagagaacccauggauggaagauaagacgcauauuagcaguuggggagacguccccuaccugggcaagcgcgaggaucaauggugcggaagccugaucgggcucaccgcccgggcaacuugggccaccaacauccaggucgccauaaaccaagugcgccgccugaucggcaacgaaaacuaccuggacuacaugaccucuaugaagcgguucaagaaugagucagacccggagggugcccucugguga

SEQ ID NO: 24546 - RNA, 9879 nt, Artificial Sequence
  derived and/or modified CDS sequence (opt11) from DENV-1__EU482809__SS-prME
ucagugacaaugcugcugaugcugaugcccaccgcgcuggccuuccaucucacgacccggggcggcgaaccgcauaugaucgugucuaagcaggagcgggguaagagccugcuguuuaaaacaagcgccggggugaacaugugcacccucaucgccauggaucuaggagaguuuugcgaagauaccaugacguauaaguguccgcgcauuacagaggccgaacccgacgacguggacugcugguguaaugccaccgauacguggguaacauacgggacguguagccagacuggcgagcaccggagagacaagcggaguguugcgcuugcuccccacguuggacugggucuggaaacccgcacugagaccuggauguccucggaaggcgccuggaagcagauccaacggguagaaaccugggcccugcgccauccaggguuuacggugaucgcccucuucuuggcgcacgcuauuggaacaagcaucacccagaagggaaucaucuuuauacugcuaaugcuugugacccccuccauggcgaugcggugcgucggaauuggaagcagggacuucguggaagggcuguccggcgccacguggguggaugucgugcuggagcacgguagcugcgugaccaccauggccaaggacaagcccacucuggauaucgaguugcuaaagacggaggucacuaaccccgccguacugcggaagcuguguaucgaggcaaagauuuccaacacgaccacggacucccguuguccgacccagggcgaggccacccucguagaggagcaagacgccaacuuugucugccggcgcaccuucgucgaccggggauggggaaacggcugcgggcuguucggaaaggguucccugaucacgugcgccaaguucaagugcgugaccaaacucgagggaaagaucguacaguacgagaaccugaaguauagcgugaucgugacuguccacaccggcgaccagcaccagguggggaaugaguccacggagcacggaaccaccgcuaccauuacgccccaggcaccaucuacggaaauucagcugacggauuacggagcccucacccuggacugcucuccucgcacaggccuggacuucaaugagaugguauugcugacgaugaaggagaaaucuuggcuagugcacaagcagugguuccuggaccuaccgcugcccuggacgagcggugcgucaacaagccaggagacauggaaccggcaggacuugcuggugacauucaaaaccgcccacgcgaagaagcaagaggucguggugcuaggcucccaagagggcgccaugcacaccgcccuuaccggcgcaacagagauacagacaagcggcacaacaacgauuuucgccggucauuuaaaaugucgccugaagauggacaagcucacccugaagggcauguccuacgucaugugcaccgggagcuucaagcuggagaaggagguagcggagacacagcacggaacugugcucguacagaucaaguacgagggcacagaugcgccaugcaaaauccccuucuccacccaggaugagaagggggugacccagaacggccgccucaucacugcaaauccgaucgugaccgacaaagagaagccagucaacauagaggcagagccccccuucggggagagcuacaucgugaucggcgcgggcgaaaaggcccuuaagcuuuccugguuuaagaaggguucguccauuggcaagauguucgaagccaccgcccgcggggcacggcgcauggcgauacugggggauaccgccugggauuuugggagcauuggcggcguguucacaucaguugggaagcuggugcaccagauuuuuggcaccgccuacgggguccuguucagcggggucucauggaccaugaagauuggcauuggcguguuacucaccuggcugggacucaacagccgcuccaccagccugucgaugaccugcaucgcaguggggcuggucacccucuaucugggcgucaugguccaagccgauagcggguguguaaucaacuggaaagggcgggagcugaagugcgggucgggcaucuucgugaccaacgagguccacacuuggaccgagcaguauaaauuccaggcggacucgccaaaaaggcucucugccgcuauuggaaaggccugggaggagggggucugcggaauaaggucugcgacucgccuggaaaacaucauguggaagcagaucaguaacgaacuaaaccacauucucuuggagaacgacaugaagcuaaccguaguggucggagacguggcaggcauccucgcccaggggaagaagaugauacggccccagcccauggaguacaaauauuccuggaaauccuggggcaaagccaagaucaucggggccgauguucaaaauaccacguuuaucaucgacggaccaaauacgccagaaugccccgacgaccaacgcgcguggaauaucugggaggucgaggauuauggauuugggauuuucacuaccaacauauggcugaaacugcgggauucguacacacaggugugcgaucaccggcucaugagcgccgcuaucaaggacaguaaggccguacacgccgauaugggcuacuggaucgagagcgagaagaacgagaccuggaagcuggcccgggccucauucaucgagguaaagaccuguauauggcccaaaucucauacccuguggagcaacggcguguuagagagcgagaugaucauucccaagaucuacgguggcccgauaagccagcacaauuaucgccccggcuauuucacgcagaccgccggccccuggcacuuggguaagcuggagcucgacuucgaccugugugagggcaccaccguaguggucgacgaacacugcgggaaucgggggccgucccugcgcacgaccacuguaacuggcaagaucauucacgagugguguuguagaucgugcacccugccgccucucagauucaaaggggaggacggaugcugguaugguauggagauacggccggucaaggagaaggaagagaaucuggucaagucuaugguguccgccggguccggggaagucgauaguuucucucucgggcugcugugcaucagcauaaugaucgaggaagucaugcgcuccagauggucccggaagaugcucaugaccggcacacuugcuguguucuuccuccuaaucauggggcagcugaccuggaacgacuugauccggcucuguaucaugguuggcgcgaacgcuucggacaggauggguaugggcacgaccuacuuggcacugauggcgaccuucaaaaugcgccccauguucgcugucggccuccuguuccggcgucugaccucgcgggagguacucuugcugacgauugggcucucucuggucgcgagcguggagcugcccaacagucucgaggagcugggggacggacucgcaaugggcaucaugauacucaagcuucugaccgacuuccagagccaccaguuaugggccaccuugcugagucuaacuuucauccgcacgacguucagccugcacuaugcauggaagaccauggccaugguccuuuccaucgugagccucuucccccugugccuuuccaccaccagccaaaagaccaccuggcuccccguccugcugggcuccuuggggugcaagccgcugaccauguuccugauugccgaaaacaagaucuggggcaggaagucauggccccucaacgaagggauaauggccgucggaaucgugucuauccugcugaguucccuccugaaaaacgacgugccccuggccgggccacucaucgccggcggcauguuaauugcgugcuacgucaucuccggguccuccgccgaccugucgcucgagaaagcggccgagguguccugggaggaagaggccgaacacagcggcgcgucccacaacauauugguagagguccaggacgacgggacgaugaaaaucaaggacgaggagcgggacgacacccugaccaucuuacugaaggccacccugcucgccgucucuggggucuacccucuguccauccccgcaacgcuguucgucugguacuucuggcaaaagaagaaacaacggagcgggguuuuaugggacacgcccucacccccagaggucgaacgagcagucuuggacgacgguaucuaccggaucaugcagcgcggguuacuugggagaagccaagucggcgugggcgucuuccaagagaacgucuuccacaccauguggcacgucacccgcggagcggugcucauguaccaagggaagcgguuggagccuucuugggccagcgugaagaaggaccuaauauccuacggcggaggcuggcggcuacagggcuccuggaacacgggggaggaggugcagguuauugcaguggaacccggcaagaaccccaagaaugugcagaccgcgccggggacuuucaagaccucggagggcgaggucggcgccaucgcccuugauuucaagcccgggaccucggggucaccuaucgugaaucgugaggguaagaucguuggacuguaugguaauggugucgugacuaccuccgggacguacgugagcgcuaucgcccaggccaaggccagucaggagggaccccucccugagaucgaggaugaggucuucagaaagcggaaccuuacuauaauggaccugcaccccggcagugggaagacgcgccguuaccucccugccaucgugcgugaggccaucaagaggcgccugcgcacauuaauucuggccccuaccagaguagucgccagcgagauggccgaggcguuaaagggcaugcccaucagauaccagacuacugccguaaagagcgagcacaccggaaaggagaucgucgaccugaugugucacgcaacauucaccaugcgccugcugucacccguccgcgugcccaacuacaacaugaucaucauggaugaggcccacuucacggacccgagcucaaucgcggcccggggguauauuagcacccgcgugggcaugggggaggcugcggcgaucuucaugaccgcaacgccgccagguucugucgaagccuuuccucagagcaacgccguaauccaagacgaggagcgggacaucccagaacgcuccuggaacucaggguacgaguggaucacggacuuuccgggcaagaccgugugguucgucccaagcaucaaaagcggaaaugacaucgcgaacugccugcggaagaacgggaaacgcgugauccagcuaucccggaaaaccuucgacaccgaguaucagaagacgaaaaacaacgacugggacuacguggugaccaccgauaucucagagaugggagcgaacuuccgcgcagaccgcgucauagacccccgccggugccugaagccggugauacuuaaggacggccccgagagggugauccucgcuggcccuaugccuguaacagucgccucagcagcacagcggcgcgggcggaucgguaggaaccacaacaaagaaggcgaccaguacaucuauaugggacaaccgcugaacaacgacgaggaccaugcucacuggacggaggcaaagaugcuccucgacaauaucaacacccccgagggcaucauccccgcccuguucgagccugaacgcgaaaaguccgccgcaaucgacggggaguaucggcugagaggugaggcacggaagaccuuuguggaguugaugcgccguggggaccugccggucuggcuguccuacaaaguggcgucggaaggcuuccaauacagcgaucgccggugguguuucgauggggagcgcaacaaccagguacucgaggagaauauggacgucgagaucuggacaaaggagggagagcgaaaaaagcuaagacccagguggcuggaugcccgcacguacagugacccccucgcccugcgggaauucaaggaauuugcagcgggucgccgaucggucaguggagaucuaauacuagaaaucggcaaacugccacaacacuuaacccagcgcgcccagaacgcccuugacaacuuggugaugcuacacaauagugaacagggcggccgggcguaccgccacgccauggaggagcuaccagacacaaucgaaacccugaugcuccucgcgcuaaucgccgugcugacgggcggggucacccucuucuuucuguccggcagaggguugggcaaaaccagcaucggccuucugugcgugauggccagcucuguccugcuauggauggcgucaguggagccccacuggauugcagccucaaucauacuagaguucuuccugauggugcucuugaucccugagccugaccgccagagaaccccgcaggauaaccagcuagccuacguggucauuggccugcuguucaugaucuuaaccguagccgcaaacgagaugggauuacuggagacuaccaagaaggaccugggcauaggccacguggcagucgagaaccaccaccacgccgccauguuagacgucgaccugcaccccgccagugccuggaccuuauacgcaguggcuaccacgaucaucacccccaugaugcgccacaccauagagaacacuacggcaaacaucagccuaacagccaucgcgaaccaggccgcgauccugauggggcuugacaagggcuggccaauuuccaagauggacauaggcgugcccuuauuggcccugggcugcuacagccaaguuaacccauuaacccugaccgcggcaguguuaaugcuagucgcccacuaugccauaaucggcccuggucuccaggccaaggcuacucgcgaggcucaaaaaagaacagccgccgggauaaugaaaaacccuaccguggacggaaucguugccauugaccuggacccggucguauacgacgccaaauuugagaagcagcucggacagauaauguuacugauauugugcaccagccagauacugcugaugcgcacgaccugggcacucugcgaaucuaucacccuagcuaccggcccccugacgacccucugggaggggucucccggcaaguuuuggaacacaaccaucgcugugagcauggcuaacaucuuccgggggagcuauuuagcgggcgcaggacucgcguuuucgcucaugaagagucuaggaggcgggcgccgggggacgggggcccagggcgaaacguugggcgaaaaauggaaacgccagcucaaccaguuauccaaaagcgaauucaauacauacaagaggucgggaauuauggaggucgaccggagcgaggcgaaagagggccugaagcgcggugagaccacaaaacacgcuguaucccgcggcacagccaagcuccggugguucguggagaggaaccugguuaagcccgaggggaaagugaucgaccucggcugcggccggggcggguggaguuacuauugcgccggguugaagaaggugaccgaggucaagggguacacgaaggguggaccgggccacgaggagccuauuccaauggccacguacggguggaaccucgugaagcugcauagcggcaaggacguguucuucaucccaccugaaaagugcgacacccugcucugugacauuggagagagcucuccuaauccaacuauagaggaaggccgcaccuuacggguccugaaaaugguggagccguggcuccgcggcaaccaguuuugcaucaagauauugaacccauacaugccgagcguagucgagacgcuggaacagaugcagcggaagcacggcggaaugcucgugcgcaaucccuuaucccguaauucgacccacgagauguacugggucucaugcgggacuggaaauaucgucagcgcugugaacaugaccucucgcaugcuucuuaacagguucaccauggcccaccggaagccgacguaugagcgcgacguugaccugggggcuggcacgcggcaugucgccguggagcccgaaguagccaaucuagacaucaucggccagaggaucgagaacaucaagcacgaacacaagucgaccuggcacuaugacgaggacaaccccuacaagacuugggcauaccacggauccuacgaggucaagcccuccggaagcgccuccagcauggugaacggggucgucaagcuccugacgaagccgugggacguaauccccauggucacacagaucgccaugaccgacaccacgcccuuuggccagcaacgggucuucaaggagaagguugacacaaggacccccaaggccaaacggggcacggcccagauuauggagguuacugcaaaguggcuguggggcuuccugucccgcaacaagaagccccggauaugcacccgcgaggaguucacucggaaggugcgcagcaaugccgccauuggggccguguuugucgaugagaaucaguggaauuccgccaaggaagccguggaggacgaaagguucugggaccuggugcaccgcgagcgggagcugcacaagcaggggaagugcgcgaccugcgucuacaacaugaugggcaagcgcgaaaagaagcucggggaguucgggaaggccaaggggagcagagccaucugguauauguggcugggcgcgcgcuuccuggaguucgaagcccugggcuucaugaacgaggaccacugguuuucccgugagaauagucuguccggggucgagggcgagggucugcauaaguugggcuacauccugcgcgacauaagcaaaauacccggaggaaauauguacgcagacgacacagccggcugggacacccggaucaccgaggacgaccugcaaaacgaggccaagaucacagauaucauggagcccgagcaugcgcucuuggccaagucgauauuuaaacugacguaccagaacaaggucgugcgcguccagaggccugccaagaaugguaccgugauggacgugauaagccggagagaccagcggggauccgggcagguuggcaccuauggucucaauacuuucacgaauauggaggcacaauugauccgccaaauggaaagcgagggcaucuucuccccgagcgaacuagagaccccuaaucucgcgggccgggugcuggauuggcuagagaagcacggggucgagcgccuuaagcgaauggcgaucucgggggacgauugcgucgugaagccaaucgaugaucgcuucgcaaccgcccugaccgcccugaacgacauggguaaggugcggaaggauaucccgcagugggaacccucaaaggguuggaacgacuggcaacaggugcccuucuguagccaccauuuccaccagcucaucaugaaggauggccgggagaucgugguccccugucggaaucaagacgagcuuguugguagagcccgcgucucccagggagcgggauggagccuacgggagacggccugcuuggguaagucguacgcccagauguggcaacugauguacuuccacagaagagaccugcgccucgccgcgaacgcuaucugcagcgccgucccgguggacuggguacccaccucgcgcacgacauggagcauucaugcacaucaccaguggaugacuaccgaagauaugcuguccgucuggaauagggucuggauagaggagaauccauggauggaggacaaaacccauguguccuccuggggcgauguccccuaucugggcaaaagagaggaccaguggugcgggagccucaucgggcugaccgccagggcuacgugggcaaccaacauccagguagcuaucaaccaaguccgacggcuccucggcaaugagaacuaccuggacuauaugacgucuaugaagcgguucaagaacgagucggacccggagggggcucugugguaa

SEQ ID NO: 24547 - RNA, 9879 nt, Artificial Sequence
  derived and/or modified CDS sequence (opt11) from DENV-1__EU482810__SS-prME
agcguaaccaugcugcucauguuaaugcccaccgcccuugccuuccaccucaccacccgcggcggagagccccacaugaucgugagcaaacaagagcggggcaagagccuccuuuucaagacuucggccgggguaaauaugugcacccucaucgccauggaucugggcgaguucugcgaggacacgaugaccuauaagugcccucgcaucaccgaggccgagcccgacgauguggacugcuggugcaacgccaccgacaccugggucaccuacgggaccugcagccaaacuggcgagcaccggcgcgacaaacggaguguggccuuggcgccccacguggggcucggccuggagacgcgcaccgagacuuggaugucuuccgagggcgcguggaagcaaauccagcgggucgagaccugggcccugcgccaucccggguucacggugauugcacucuuccucgcucaugccaucggcacgagcaucacccagaaagggaucaucuucauccugcucaugcuagucacccccaguauggccaugcggugcgucggcauagggucgcgcgacuuuguggagggccuuuccggagccacguggguggacguugugcucgagcacgggagcugcgugacgacuauggcuaaggacaaaccgacccuggauaucgagcugcucaaaacggagguaaccaaccccgcgguacugagaaaguuauguaucgaagccaagaucuccaauacuaccacggacagccguugcccgacccagggugaggcaacccucguggaggaacaggaugccaacuuuguuugccgucgcacguuuguggaucgcggcugggggaacggcugugggcuguucggcaaagggucccugauaaccugcgcgaaguucaagugugugacuaagcucgaaggcaagaucguucaauacgagaaucugaaguauagcgucauagucacaguccacacgggcgaccagcaccaggucggcaacgaguccaccgagcaugggaccaccgcuacuaucacaccccaagcccccagcacggagauacagcugacugacuacggagcccuuacccuggacugcagcccgcggacgggccuagacuucaacgagaugguccuacugacgaugaaggaaaaguccuggcugguccauaagcagugguuccucgaccugccgcugcccuggaccagcggggcuucgacgagccaggagaccuggaaccggcaggacuugcuggugacguucaagaccgcccacgcgaagaagcaggaagucguggugcugggcagucaggagggcgccaugcauaccgcccuaaccggagccacggagauucagaccagcgggaccaccacgaucuucgccgggcaccugaagugccgccuuaagauggacaaguuaacccugaaggguauguccuacgucauguguacugggagcuucaagcuggagaaggagguggcggagacccagcauggcacagugcucguccagaucaaguacgaggggacggaugcccccugcaagauccccuucuccacacaggacgaaaagggggugacccagaacggccggcugaucacggcaaacccaaucgugacugacaaggagaagcccgucaauaucgaggccgagccacccuuuggggagagcuacaucgugaucggggcgggcgagaaggcccugaagcuguccugguucaagaaggggaguagcaucggcaagauguucgaggccaccgcccgcggggcccggagaauggcgaucuuaggggacacugccugggacuucgguucuaucggcggcguguucaccuccgucgggaaacuuguacaccagaucuucggcaccgccuacgggguacuguucucgggcgucuccuggaccaugaagauugggaucggcguucuccuuacguggcugggcuugaacagcagguccacgucacuguccaugaccugcauagccguagggcuggucacacuguaccuagguguuauggugcaggccgacagcgggugcgucaucaacuggaaaggccgggagcugaaaugcgggagcgggaucuucgugaccaacgaagugcacacguggaccgaacaguacaaguuccaggcggacaguccgaaacgcuugucagccgccaucggcaaggccugggaggagggggucugcggcauccguuccgcuacccgcuuagaaaacaucauguggaaacagauaucaaacgaacugaaccauauccuccuggagaacgauaugaaacugaccgugguggugggugacguggcgggcauccucgcucaggggaagaagaugaucaggccccagcccauggaguacaaguacucauggaaguccuggggcaaggccaagaucaucggcgcugacgugcagaacacuacguucaucaucgacggacccaacacucccgagugucccgacgaccaacgcgccuggaacauuugggaaguagaagacuacggcuucgguaucuucaccaccaacaucuggcuuaaguugagggacuccuauacgcagaugugugaucacagacuaaugucagccgccauaaaggacuccaaggccgugcacgccgacaugggcuauuggauagagagugagaagaaugagaccuggaagcuggccagagcauccuucaucgagguuaagacguguaucuggcccaagagccacacccugugguccaacggcguccuagagucugagaugaucauccccaagaucuacggugggccgaucucccagcacaacuaccggccuggguauuucacccagaccgcggggcccuggcaccuggguaagcucgagcuggacuucgacuuaugcgaaggcaccaccguggugguugaugagcacuguggcaaucgggggccgagccugcgcacuaccaccgugaccgggaagauaauacacgagugguguugcagaucuuguacgcuuccuccccuucgcuucaaaggagaggacggcugcugguacgggauggagauccggcccgucaaggagaaggaggagaaccuggucaagagcauggugagcgcgggcuccggcgagguggacagcuucucacuugggcuguugugcaucagcaucaugaucgaggaggucaugcgaucaagguggagccgcaagaugcucaugacgggcacccuggccguguucuuucugcugaucaugggccaguuaaccuggaacgaccugauacggcuaugcaucauggugggcgcgaacgccuccgaccgcauggggaugggcacgaccuaccucgcccugauggccacuuucaagaugcgcccgauguucgcugucgggcuccuguuccggcgccugacuucgcgggaggugcuucuccucacgaucggacucucccugguggcgagcgucgagcugcccaacucccucgaggagcuuggcgacgggcuugccauggggaucaugauccuuaagcuguuaacugacuuccagagccaccaguugugggccacuuuacuguccaugacguucauucgcaccacuuucagccuccacuacgccuggaagacuauggcgauggugcuguccauagucagccuguucccgcucugucugucgaccacaucucagaagaccaccugguuaccaguacucuuaggcaguuuggguugcaaaccccucaccauguuccugaucgcugaaaauaaaauuuggggcagaaagagcuggcccuugaacgaagggaucauggccguuggaauaguguccauccuccucaguagccugcuuaagaaugacgugccccuggccgggccccugaucgccgggggcaugcucauugcuugcuacgugauauccggcagcuccgcugacuugagccuggagaaagccgcagaaguuuccugggaggaggaggcugaacacagcggcgcuucccacaacauucuuguggaggugcaggacgacgggacgaugaaaaucaaggaugaggaaagagacgacacccugaccauccugcucaaggccacccugcuggcagucagcggcguguacccacucuccauucccgccacccuguucgugugguacuucuggcagaagaaaaagcaacggagcggugucuuaugggacacgccaucgccgcccgagguucaacgcgccguguuggacgaugggaucuaccggaucaugcagcgcggccugcuggggcggagccagguaggggugggcguuuuccaagagaacgucuuccacaccauguggcacgugacucgcggggcgguacugauguaucaggggaagcgguuggagcccuccugggcguccguuaagaaggaucugauuucguacggcggcggguggcgccugcagggcagcuggaacaccggggaggagguccaggugaucgccgucgagccuggcaagaacccaaagaacguccagaccgcgcccgggaccuucaaaaccuccgagggcgaagugggcgccaucgcgcucgacuucaagcccgggacgagcggcagccccaucgucaaccgggaggggaagaucgugggccuguacggcaaugguguggugacgaccagcggcaccuacgugagcgcgaucgcacaagcgaaggcgucccaagagggccccuuaccagagaucgaggacgagguguuccgcaagcggaaccucacaaucauggaccugcacccaggcucggggaaaacccgccgguaccuaccggccauuguccgcgaggccauaaagcggaaacuccgcacccugauucuugccccgacacgugugguugcauccgagauggcagaggcgcucaagggcaugcccauccgguaccagaccacggccgucaagagcgagcacaccggcaaggaaauaguggaccugaugugucacgccaccuucaccaugcgcuuacucagcccggugcgggucccuaacuacaauaugaucaucauggacgaggcgcacuucacagacccgagcuccauugcugcccgcggguacaucuccacgcggguggggaugggggaggccgccgccaucuucaugacugcgacgccgccuggcucugucgaagccuucccccagucgaaugccgucauucaggacgaagaacgagacaucccggagcgguccuggaacucgggguacgaguggaucacggacuuccccggcaagaccgucugguucgugcccuccaucaaguccggcaacgauaucgccaacugccuacggaagaacgggaaacggguaauccagcugucccgcaaaaccuuugacaccgaguaccagaaaacgaagaacaacgacugggacuauguggugaccaccgacaucucagagaugggcgcgaacuuccgggccgaccgcgucaucgacccccggcgcugccucaaaccggugauccugaaagauggacccgagcgggugauucuggccggccccaugcccgugaccguugcauccgccgcgcagcgccgggggcggaucggccggaaccacaacaaagagggcgaucaguacauauauauggggcagccgcucaacaacgacgaggaucaugcccacuggacggaggcaaagaugcuacuggauaacaucaacacccccgagggcaucauccccgccuuguucgagccugaacgugagaagucagcagcuauugacggggaguacagauuacggggcgaggccagaaaaacauucgucgagcugaugaggcgcggggaccucccgguguggcuuagccacaagguagccuccgaggguuuccaguacagcgacaggagauggugcuucgacggcgagcgcaauaaccaggugcuggaggagaacauggacguggaaaucuggaccaaggagggggagcgcaagaaguugcggccccgcuggcuggacgcccggacuuacucugacccuuuggcccuccgcgaguucaaggaguucgccgccggccgucgcuccguguccggagaccugauccuggagaucgguaaacucccccagcaucuuacccaacgggcccagaacgcacuugacaaccuagucaugcugcacaacagcgagcagggugggcgcgcguaccggcacgccauggaggagcugccggacacgaucgagacacuuaugcugcuggcccucaucgccguuuuaaccggaggggugacucuguucuuccucuccggucgagggcugggaaaaaccagcaucgggcuguugugugucauggccuccuccgugcugcuguggauggcguccguggagccccauuggauagcggccagcaucauccucgaguucuuccugaugguguugcucaucccagagcccgaccggcagcgcaccccgcaggacaaccaacucgcguacgugguuauagggcucuuguucaugauccugaccguagccgcgaacgagaugggccugcucgagaccacgaagaaggaucugggaauuggccacguggccguagagaaucaccaccaugcagccaugcuugacgucgaucuccaccccgccuccgcguggacccuguacgccguugcuacaacgaucaucacccccaugaugcggcacaccaucgagaacaccacugcgaacaucagccugaccgccaucgcgaaccaggcagcaauccucauggggcuugacaaaggauggccaauaucuaagauggacauuggcgugccccugcucgcccuggggugcuacagccaggucaacccccugacccuaaccgcggccguguuaaugcugguggcgcacuacgccaucauaggacccgggcuccaagccaaggcgacucgcgaggcccagaagcgcacagccgccgguauaaugaagaacccgacaguggacgggaucguggccauugaccuggaccccguggucuaugacgcgaaguuugagaaacaguuaggccagauaaugcuccuaauauugugcaccagucagauacuccugaugcggacgaccugggcgcugugcgagagcauuacccucgccaccggcccccucacuacuuuaugggaggggucccccggcaaguucuggaacaccaccauagccgugagcauggccaacaucuuccgugggagcuaucucgcgggugcgggcuuggccuucucccugaugaaaucccucgggggcagccggcgcgggacgggcgcccaaggagagacccugggcgaaaaguggaaacggcaacugaaccagcucagcaaguccgaguucaacaccuacaagcggagcggcaucauggagguggaccggucggaagcgaaggaggggcugaaaaggggcgagacuacuaaacacgccguaucucggggaacugccaagcugcgcugguucguggagcggaaucucgugaagccggagggaaaggucauagacuuaggaugcggccgcggcgggugguccuauuacugugcaggccugaagaaaguaacugaggugaagggguacaccaagggcgggcccggccacgaggaacccaucccgauggccacuuauggcuggaaccuugucaagcuccacagugggaaggacguguucuucaucccgccugagaagugcgacacgcugcugugcgauauaggcgagagcuccccuaaccccaccaucgaggaggggcggacccuccgggugcuaaagauggucgagccguggcugcggggcaaccaguucugcauaaagauacucaauccguacaugccgucggugguggaaacgcuggaacagaugcaacgcaaacacgggggcaugcugguccggaacccccucuccaggaacuccacccacgaaauguacugggugagcugcgguacggggaacaucguguccgcggucaacaugaccagccgcaugcugcugaaccgcuucaccauggcccaccgcaaaccgacguacgagcgggacguggaccucggcgccgggacacgucacguugccgucgagcccgagguagcaaaccuugacaucaucggccaacggaucgagaacaucaagcacgagcacaaaucaaccuggcacuacgacgaagacaacccguacaagacuugggcguaccacgggagcuacgaggugaagcccagcgguagcgccagcuccaugguaaacggcgugguaaaacugcucacgaagcccugggacguuauaccuaugguuacccagaucgccaugacagacacgacuccuuucggacagcaacgcgucuucaaagagaaaguggacacccgcacgcccaaggccaagcgcgggaccgcccagaucauggaggugacggcgaaguggcuauggggguuucuuagccgcaacaaaaagccacgcauaugcacccgggaggaguucacccgcaagguccgguccaacgccgcgauuggcgccguguucguggacgagaaccaguggaacagcgccaaagaggccgucgaggacgagcgcuucugggaucucgugcaccgggaacgcgagcugcacaagcaggggaagugcgcuacaugcguguacaacaugauggggaagcgggagaaaaaguugggcgaguucggaaaggcuaagggcucccgcgccauuugguacauguggcucggugcgcgguuccuggaguucgaggcccuuggcuucaugaacgaggaucacugguuuagccgcgaaaauucccuaagcggggucgaaggcgaaggucuacacaaauugggguacauucuccgggacauauccaagauccccggcgggaauauguaugccgacgauacggcgggaugggacacccggaucaccgaggacgaccugcagaacgaagccaaaaucaccgacauuauggagcccgagcacgcgcugcucgcaaaaagcaucuuuaagcugacguaccagaacaaagugguccggguccagcgcccggcuaagaacggcaccguuauggacgucauaagucgccgggaucaacgcggcagcggccaaguugggaccuacggccuaaauacguucacgaacauggaggcccagcucauucgucagauggaauccgagggcaucuucagccccagugagcuggauacccccaaccuugccggacgugugcucgacuggcuggagaagcacggcguggagcggcugaagcgcauggcgaucagcggggacgacugcgugguuaaacccaucgaugaccgguucgcuaccgcucucaccgcccugaacgacaugggcaaggugcgcaaggacaucccccaaugggagcccagcaagggcuggaacgacuggcagcagguccccuucugcucccaccacuuccaccaacuuaucaugaaagacggccgagagaucguggugcccugccgcaaccaggacgagcuggucggccgggcucgcgugucacagggggcuggcuggucccugcgggagacggcaugccugggcaagagcuacgcccagauguggcaguuaauguacuuucaccgccgggaccugcguuuagccgcgaaugcgauaugcuccgccgugccggucgacugggugcccacgagccggacuacauggucgauccaugcccaccaccaguggaugacaacugaggacaugcugagcguguggaaccgcgucuggaucgaagaaaaccccuggauggaggacaagacccauauuucgucuuggggcgacgugcccuaucugggaaagcgggaggaccaauggugcggaucccuuaucggccucacggcccgugcaacaugggccacaaauauccagguggccaucaaccaggugcgccggcuucuggggaacgagaacuaccuugauuacaugaccucaaugaagcguuucaagaacgagucgggcccugagggggcccugugguga

SEQ ID NO: 24548 - RNA, 9879 nt, Artificial Sequence
  derived and/or modified CDS sequence (opt11) from DENV-1__EU482811__SS-prME
agcguuacgaugcuguuaaugcuuaugccuacagcccuggccuuccaccucaccacccggggcggggaaccccacaugauugucagcaagcaggaacggggcaagagccuguuguucaagaccagcgccggaguaaacaugugcacacucaucgccauggaccugggcgagcuaugcgaggauaccaugacuuacaagugcccccggaucaccgaggcggaaccggacgauguugacugcuggugcaacgccaccgacacguggguuaccuacgggaccuguucccagacuggcgagcaccggcgagagaaacgguccguggcacuugccccucauguugggcuaggacuggagacgcgcacagaaaccuggaugaguucugagggcgcauggaagcagauccagcgggucgaaaccugggcacucaggcacccgggguuuacgguuaucgccuuauuccuggcccacgccaucgguacaagcaucacccagaagggaauaauauuuauacuccugaugcuggugacacccuccauggccaugcggugcgucggcaucggcagccgcgacuuuguugaggggcuguccggcgcaacguggguggacguagugcucgaacacggcagcuguguuacuaccauggccaaagauaagccuacacuggauaucgagcucuuaaagacggaggucaccaacccugcggugcugcggaaguuaugcaucgaagccaagauaucgaacacaacgaccgacucucggugccccacgcaaggggaagcgacuuuaguugaagaacaagacgccaacuuugucugccggcgcaccuucguggaucggggauggggaaacggcuguggguuguucggcaaagggucgcuccugaccugugccaaguucaaaugcgucaccaagcuggaggggaagauaguccaauacgagaaccucaaauauagcgucaucgugaccguccacaccggcgaucaacaccagguggggaacgagaguacagaacacggcaccaccgcuaccauuacgccgcaggcuccuaccacugagauacagcugacagacuacggggcccuuacccuugacugcuccccaagaacgggccuggauuucaaugagauggucuugcucacaaugaaagagaagaguuggcugguacauaagcagugguuuuuggaccucccucugcccuggaccagcggggcaucgacaucccaggagacauggaaccggcaagaucugcuugugaccuucaagaccgcccaugcaaagaagcaggagguuguggucuugggcucacaagagggcgccaugcacaccgcccuaacgggugccacagaaauucagaccuccgggaccacaacuauauuugccggacacuugaagugucggcugaagauggacaaacuuacgcuaaaggguaugagcuacgugaugugcaccgguaguuuuaaacuugagaaggaggucgcggagacgcagcacgggacugugcugguacaaaucaaguacgaggguacugacgcacccugcaaaauucccuucucgacccaggacgaaaagggggugacacaaaacggccgguugauaaccgccaaccccaucgucaccgacaaagaaaaacccguaaauaucgaggccgagccgccauucggagagagcuauauagugaucggcgcgggcgaaaaggccuuaaaauuaucuugguucaagaagggguccucaaucggcaagauguucgaagcaaccgccagaggggccaggcgcauggccaucuugggcgacacggcuugggauuucggaucaaucgguggcguguucaccucuguggggaaguuagugcaccagaucuucggcacagccuauggggugcuguucucgggcgucaguuggaccaugaaaaucggaauagggguacugcucaccuggcugggccuaaauucccgcucgaccagccuaagcaugacgugcaucgccguugggcuggucacccuuuaccucggcgugauggugcaggcggacuccgggugcgucaucaauuggaagggaagggaacucaaguguggguccggcaucuucgugacgaacgagguacacaccuggacagagcaguacaaguuucaagcagacuccccgaaacgccugagugcugccauuggcaaggccugggaagaggggguuugcggcaucaggagcgcaacaagacucgagaacaucauguggaagcaaaucuccaacgaguuaaaucauauuuugcucgagaacgacaugaaguucaccgugguggucggggacguugccgguauucugguccagggcaagaagaugauccggccgcagcccauggaauacaaguacucuuggaaguccuggggaaaggccaagauuaucggugccgacguccaaaauuccaccuuuauuauugacggacccaacaccccggaguguccggacgaucagcgggcauggaacaucugggagguggaggacuacggcuucggcauuuucacaaccaacaucuggcugaagcuccgggacuccuacacccaggucugugaccaucgccugaugagugcggcgaucaaagacagcaaagccguccacgcugacaugggcuauuggauagagagcgaaaagaacgagacuuggaaguuggcccgggcaucguucauugaagucaaaaccugcaucuggcccaagagccacacucugugguccaauggcguccuggaaagcgagaugauuauccccaagauacauggggguccaauuucccagcauaacuaccgccccggguacuucacacagaccgcuggcccauggcaucugggaaaacucgaguuggacuucgaccucugcgagggaaccaccguagugguggacgagcacuguggaaaccgggguccgagccuccgcacuaccaccgucaccggaaagaucauacacgaguggugcugucgguccugcacucugccuccacugagguuccgcggggaggacggcugcugguacgggauggaaauacgucccgugaaggagaaggaagagaaccucguaaagagcaugguuagcgccggauccggagagguggacagcuucagccucgggcugcuuuguaucagcaucaugaucgaggagguaaugaggucccguuggagcaggaagaugcucaugacugggacccuggcugucuuuuucuuacugaucauggggcagcugacauggaacgacuuaaucaggcucugcauaaugguuggcgccaaugcaagugaccgcaugggcauggguacgacguaccuggcccugauggcgacguucaagaugaggccuauguucgccguuggccugcuuuucaggaggcucaccucgcgcgagguccuccugcucaccaucgggcugucccuagucgccagcgucgaauugcccaacucccuggaggaguugggcgacggccuggcgaugggcaucaugaucuuaaagcugcucaccgauuuccagaguuaccaacugugggcgacccuucucucauugaccuucaucaagacuacguucagccuccacuacgccuggaagacuauggccauggugcugagcauagugucacuguuccccuugugucucuccaccacuagccagaagaccaccuggcugccugucuuacucgggucccugggguguaagccgcuuaccauguuccuaaucgcggaaaauaagaucuggggcaggaaaaguuggccccugaacgagggcaucauggccgugggcaucguguccauccugcucuccagccuucuuaagaacgacgucccacucgcagggccccuaauagccggaggaaugcugaucgccugcuauguaauaucggggagcuccgcggaccuaagccuggaaaaggccgcugaaguuucuugggaagaggaggccgagcacaguggcgccagccacaacaucuuaguugaggugcaggacgacggaacgaugaagaucaaagacgaggagcgugaugauaccuuaacuauccuacugaaagcaacccuccuggccguaucuggcguuuacccgcuguccauccccgcaacguuauucguauggcauuucuggcagaaaaagaagcagagaagcggaguucucugggauacgccaagcccucccgaaguugagcgcgccguacuggacgacggcauuuaucggauuaugcaaaggggccuguuagggcggagccaggugggcgucgggguguuccaggagaauguguuucacacaauguggcaugucacccgcggagccguucugauguaccaggggaagcgccuggagcccuccugggcgucugugaagaaagaucugauuuccuacggcggaggauggagguuacagggcagcuggaacaccggagaagagguucaggugaucgcgguggagccaggcaagaauccuaagaaugugcaaacugcaccggggacuuuuaaaacccccgagggagaagugggggccaucgcucuggacuuuaagcccgggacaucgggcagcccgaucgugaaucgugaagggaagaucgucggccuuuacggcaacgguguugugacgaccucgggcaccuacgugucggcgauugcccaggcgaaagcgucucaggaggggccgcugcccgagaucgaagacgagguguucagaaagcggaacuuaacaaucauggaccuccaucccggcucuggcaagacuagacgguaccuuccggcgaucgugcgcgaggcuaucaaacguaaacugcgcacccuaauacucgcucccacccgaguaguggccucagagauggccgaggcacugaaagguaugcccauccgguaccagacgacggccguaaagagugaacacacgggcaaggagaucguagacuuaaugugucacgccacguuuaccaugagguuacucucccccguucgggugccgaacuauaauaugauuaucauggacgaggcccacuucaccgaucccaguagcaucgccgccagaggguacaucucaacuagggucggaaugggggaggccgccgcuaucuucaugaccgccacucccccaggcagcauggaagccuucccacagucaaacgccgugauccaggacgaggaacgugacauaccugagaggagcuggaacucagguuaugaguggauuacugacuucccagguaaaaccgugugguucgugcccagcaucaaggcuggcaaugauaucgcaaacugccucagaaagaauggcaagcgggugauccaacugagucgcaagaccuuugauaccgaguaccagaagacuaaaaacaaugacugggacuacguggucaccacugacaucagugagaugggcgcaaauuuccgcgccgaccgcgugauugacccccggcgcugucuaaaacccgucauuuugaaagacgggcccgagcgggucauccuggcuggcccaaugccgguaaccguggcuucugccgcccagcgcagagggcgcauaggccggaaccacaacaaagagggcgaccaguacaucuacaugggucaaccccugaacaacgaugaggaucaugcccauuggaccgaggccaaaaugcuucuugauaacaucaauaccccagaggggaucaucccagcccuguucgagccggagagggaaaaguccgcugcgaucgauggugaguaccgccuccggggagaggcccgcaagacauucguggagcugaugcggcggggagacuuacccguguggcucuccuacaaggucgccagcgagggauuccaguauagcgaucggcgcuggugcuucgacggagaacggaacaaccaagucuuggaggaaaacauggauguugaaaucuggaccaaggagggggagcgcaagaaguuacggccacgcuggcuggacgcgcggacuuacuccgacccccuggcccugagggaguucaaagaguucgcagcgggccggcgcagcgucuccggggaccucauccuggagauuggcaaacuuccgcagcaucucacccagagagcccagaacgcacuggacaaccuggugaugcuccacaauagugaacagggugggagggccuaucggcacgcaauggaggagcugcccgacacuauagagacacugaugcuacuggcccugaucgccguucucacuggcgggguaacacuguucuuucuauccggcaaagggcucgggaagaccagcaucggcuuacuuugcguuauggccuccuccguacuccucuggauggcguccgucgaaccccacuggaucgcggccagcaucauccuugaauuuuuccuuauggugcugcucauuccagaaccagaucgacagcgcacgccgcaggacaaucagcucgccuacguggucaucgggcugcuguuuaugauccucacaguggccgcgaacgagaugggucuguuggagacgaccaaaaaggaccucgggauaggccauguggcugucgagaaucaccaccacgcugccauguuagauguggaccugcaccccgccucugcguggacccuuuacgccguggccacgacgaucaucaccccaaugaugcgacacacgaucgagaacaccaccgccaauaucagcuuaacugcaauagccaaccaggcagccauccuuauggggcucgacaagggcuggcccaucuccaagauggauaucggggucccccugcuggcccucggcugcuacucgcaagugaacccccucacccuuaccgcugccgugcuaaugcuggucgcccacuacgcgauuaucggcccggggcugcaggccaaagcgacgcgggaggcacagaagcguaccgccgccggcauuaugaagaaccccaccaucgacgggaucguggccaucgaccucgaccccguugucuacgaugcuaaauuugagaagcagcucggucaaauaaugcuucucauccuaugcaccucccaaauccucuugaugcguaccacaugggcccucugcgagucuauaacccuagcuacgggccccuuaacgacccucugggagggaucuccggguaaauuuuggaacacaaccaucgcuguaagcauggccaacauuuuccgggguagcuacuuggcgggagccggcuuggccuucagcuugaugaagucgcucggaggagggcgccgggggacuggugcccagggcgagacuuugggggagaaauggaagcgccagcugaaccaguugucuaagagcgaguucaacacguacaaacguuccgggauuauggagguagacagaagcgaggcuaaggaaggccuaaagcguggggagaccacgaagcacgcgguaucacgcggcacagccaaauugcggugguuuguggaacgcaaucugguuaagcccgaggggaaagucaucgaucugggcuguggcagagggggauggagcuacuacugugcggggcucaagaaggugacagagguuaaaggcuacaccaaaggcggcccuggccacgaggagcccauccccauggcaaccuacggauggaauuuagucaagcugcauucuggcaaggacguguucuuuauaccacccgagaagugcgacacguuacugugugacaucggggagagcucccccaauccgaccaucgaagagggccgcaccuuacguguacuaaagaugguagaaccgugguuacgcgguaaccaauucugcaucaagauacugaaccccuacaugcccagcgugguggaaacucuugaacaaaugcaacggaagcacggcggcaugcuagugcgcaacccgcuguccagaaacagcacccacgagauguauugggugaguugcgguacgggcaacaucgugagcgcugucaauaugacgagucgcauguuacugaaccgcuucaccauggcccacagaaaaccuacguacgagagagauguggaccugggugccggcacacggcacguggccguugagcccgagguggccaacuuggacaucaucggacaacgcaucgagaauaucaagcacgaacacaagagcaccuggcacuacgacgaggacaaccccuacaagacaugggcguaccacggguccuaugaggucaagcccagcggcuccgccaguagcaugguaaacggcguggucaaacuucugacaaagcccugggacgugauccccauggucacacagauugcaaugaccgacaccacacccuuuggccagcaaagagucuucaaggagaagguggacacgagaaccccgaaggcaaagcgggggaccgcccagauaauggaagugacggcacgauggcucuggggauuuuugagccggaacaagaagccccgaaucugcacccgugaggaguucacccgcaaggugcgcagcaacgcggccaucggcgcaguguucguugacgagaaucaguggaacuccgcgaaggaggcgguugaggaugacagauucugggaccuggugcaccgggagagggaacuccauaagcaagggaagugcgcaacaugcguauauaacaugaugggcaagcgggaaaagaaacugggggaguucggaaaggcuaagggaucacgugcuaucugguacaugugguuaggcgcgcgguuucucgaguucgaggcccucggauucaugaacgaagaucauugguucagucgagagaacuccuugucgggaguagagggcgagggacuccauaaacuuggcuacauccugcgggacauaagcaagaucccugggggcaacauguaugccgacgauacggcgggcugggauacucgcaucacagaagacgaccuccaaaacgaggccaagaucaccgacaucauggagccggaacacgcguuacuagcaaaguccaucuucaagcucacguaucagaacaagguggugcggguccagaggccagccaagaaugggacggucauggacguuauuagcagacgggaucaacgcggcucagggcaggucggaacauacggccugaacaccuucacgaauauggaggcccaacuaauacgacagauggaaagcgaggggauauuucucccaaaugagcuggagacccccaacuuagccgggagaguauuggacuggcuggagaaguacggaguggagcggcugaagaggauggccaucucgggggacgacugcgucgucaagccgaucgaugaucgguucgcaaccgcccucaccgcccugaacgacauggggaaggugagaaaggacaucccgcaaugggagcccagcaaaggcuggaacgacuggcagcagguccccuuuugcucccaucauuuccaucagcugaucaugaaggacggccgggagaucguggugcccuguagaaaccaggacgaacucgucgggcgggcccgcgugucgcaaggcgcgggguggucucugagagagacggcaugccugggcaagucauacgcccagauguggcagcugauguacuuucaccgccgggaccugcgccuugccgcgaacgccaucuguucagccgugcccgucgacuggguucccaccucccggaccaccuggagcauccaugcgcaccaccaguggaugacuaccgaggacaugcucuccguguggaaccgcgucuggaucgaggaaaaccccuggauggaggacaaaacccguaucagcucaugggaggacgugccauaucugggcaagcgcgaggaccaguggugcgggucucugauuggccucacagcccgagcgacaugggccaccaacauccagguugccaucaaccaaguacggcgacugauagguaacgaaaacuauuccgacuauaugaccagcaugaaacgauucaagaacgagucggagccagagggcgcgcucugguga

SEQ ID NO: 24549 - RNA, 9879 nt, Artificial Sequence
  derived and/or modified CDS sequence (opt11) from DENV-1__EU482812__SS-prME
agcgugacgaugcugcucauguugaugcccaccgcacuggccuuccaccuaaccacccggggcggugagccccauaugaucgugagcaaacaagagcggggcaagagccugcuguucaagaccagcgccggggugaacaugugcacgcucaucgcaauggaucugggagagcucugugaggacacaaugaccuacaaaugcccgcggauuaccgaaacagagccagaugacguggacugcuggugcaaugcgacagauacuuggguuaccuacgggaccugcagccagacgggagagcaucggcgagacaaacgguccguggcccucgcgccccacguaggcuugggacuggagacgcgcacagagacguggaugagcagcgagggcgccuggaagcagauccagcgcguagaaacgugggccuuacggcaccccggauucaccgugaucgcgcuguuucuagcccaugccaucgguacaagcaucacccagaaagggaucaucuucauacuucuaaugcugguaacgcccaguauggccaugcggugcgugggcaucggcagccgcgacuucguggaagggcuauccggggcaaccuggguggaugugguacuggaacacgggucgugcgugaccaccauggcuaaagacaagcccacacuagacaucgagcuucuaaagaccgaggucaccaaccccgcaguccugcggaagcucuguaucgaggccaagaucaguaacaccaccacggacagccgaugccccacgcagggugaggccacgcugguggaggaacaggaugccaauuucguaugucggcgcaccuucguggaucggggcugggggaacggcugcggguuguucggcaaggggucacugaucacgugcgccaaauucaagugcgucaccaagcuugaagggaagaucguacaguacgagaaccucaaguacuccguuaucgugacaguacauacgggcgaucagcaccagguggguaacgaguccaccgaacacggcaccacagcaaccaucacgccacaggcacccaccaccgagauacaguuaaccgauuauggggcgcugacccuggacugcaguccucgcaccgggcucgacuucaacgagaugguccugcugaccaugaaggagaagucuuggcuggugcauaagcagugguuccuggaucugccucuacccuggacgucuggggccaguacgucccaggagacauggaaccggcaggaucugcuggugaccuucaagacggcccacgccaagaagcaggaaguuguggugcuuggaagccaggagggcgcgaugcauacggccuugaccggugcuacugagauccagaccuccggcacaacgaccauuuucgcugggcaucugaagugucgccucaagauggacaagcuaacgcugaagggcaugucguacgucaugugcacaggguccuuuaagcucgagaaggagguggccgaaacccagcaugguaccgugcuaguccagaucaaguacgaagggacugacgcgcccugcaaaauuccuuuuagcacgcaggacgagaagggggcaacccaaaauggccggcugauuaccgccaacccaaucgucacugauaaggagaaacccgugaauaucgaggccgagccaccguucggggaguccuauauugucaucggagcgggcgaaaaagcguugaaacucagcugguuuaaaaaagguuccaguauuggcaagauguucgaggccacggcgcggggagcccggcguauggcgauucuuggcgauaccgccugggacuucgggagcaucggcggcgucuucacaucgguggggaaacugguccaccagauauuuggcaccgccuacggggugcuguuuuccggcguaucauggaccaugaagauagguaucgguguauuacucaccuggcucggccugaacucuagauccacgucccuuaguaugacuugcauugccguggggcucgugacacuguaccuaggugucauggugcaagcggauucgggcugcgugaucaacuggaaggggcgggagcucaagugcgggagcggaauuuucgucacuaacgaggugcacaccuggaccgaacaguauaaguuucaggcagacucuccaaagcgccucuccgccgcuaucgguaaggccugggaggagggggugugcggcauccggucugccacucgacuggaaaacaucauguggaagcaaaucuccaacgagcucaaccauauccugcuggagaacgacaugaaguucacgguggugguuggggacgucgcgggaauccucgcccaggguaagaagaugauccgaccgcagccgauggaguauaaguacagcuggaaguccuggggcaaggccaagauuauuggcgccgacgugcagaacaccaccuucauuaucgacgggccuaacacuccggagugccccgacgaccagagagcguggaacaucugggaggucgaagacuauggcuucgggauuuucacuacgaacaucuggcucaaguuacgggauagcuauacgcaggucugcgaccaccgccucauguccgccgccaucaaggacagcaaagccguucacgccgacaugggcuacuggaucgagucugagaaaaacgaaacauggaagcuggcacgugccagcuuuauugaggugaagacgugcaucuggccaaaaucccacacccuguggucaaacgggguacucgaauccgagaugaucauccccaaaaucuacgggggcccgauaagccagcauaacuaucgucccggauacuuuacccagaccgcaggacccuggcaccuggguaagcuggagcuagacuucgaucugugcgagggcaccaccgugguugucgaugagcacugcggcaaccgggggccaucucugaggacaaccacagugacgggcaagaucauacaugaaugguguugcagaagcugcacacugccuccccucagguuccgcggugaggauggcugcugguacgggauggaaauccgucccguuaaggagaaagaggagaaccugguuaaguccaugguuuccgccggcucgggcgagguggacucuuucagcuuaggacugcugugcaucuccaucaugaucgaggagguuaugcgcagccgcuggagcaggaaaaugcuuaugaccggcacguuagcgguuuucuuccuucuaauaaugggucaauugacauggaacgaccuuauucgcuuaugcauuauggugggcgcaaacgccagcgauaggauggggaugggaacgaccuaucuggcucugauggccacguucaagaugcggccgauguuugccguaggccuucuuuuccgucggcuuacgucgcgcgaagugcuccugcugaccaucgggcucucguuaguggcuuccgucgagcuuccgaauagccuggaggaauuaggagacgguuuggcgaugggcauuaugauccucaaacuguuaaccgacuuccaaucacaccagcucugggcuacucugcugagccuuaccuucaucaagaccaccuuuucccuucauuacgcauggaagacgauggcgaugguccugaguauugucucccucuuccccuugugucugucgacaaccucccagaagaccacguggcucccgguguugcugggcagccucgguugcaagccucugacaauguuucugaucgcugagaauaagaucuggggccgucgcaguuggcccuugaacgaggggauuauggccgugggcauuguuaguauacuucuaaguucccuccuaaagaacgauguuccccuggcagggccccucauagcgggggggauguugaucgcgugcuacgugaucucaggguccagugcagaucuaucucuggagaaggccgcggaagucuccugggaagaggaggcagagcacuccggcgccagccacaacauccuuguggaaguucaagacgacggcacuaugaagaucaaggacgaggagcgggacgacacauugacuauacuuuuaaaagccacgcugcucgccguuucuggcguguauccucugucaaucccugccacccuguucguaugguacuucuggcagaagaaaaaacagagguccgggguccucugggacacuccaucgccgccagaggucgaacgggccgugcuggaugaugguaucuaccgcauuaugcagcggggucugcuggggcgcucccaagugggcgugggagucuuccaggagaacguauuucacacaauguggcacgugacgagaggcgcggugcucauguaccaggggaagcgcuuggagcccucaugggcauccgugaagaaggaucugauuucuuacggcggcgguuggcgccuccaaggaucguggaacacgggagaggagguccaggugauugccguagagcccggcaagaacccgaagaacgugcagacagcgcccgggaccuucaagacgcccgaaggcgaagucggcgcuauagcgcuggacuucaaacccggaacgagcggcucucccaucgucaaccgggaggggaagaucguuggccuguacgggaacgggguggugaccacaagcggcacguaugugagugccaucgcucaggcuaaggcgagccaggaagguccgcuccccgagaucgaggaugagguauuucggaaaagaaaccuaaccauuauggaccuccaucccggcucagggaagacccgacgcuaucugccggccaucguccgggaggccauaaagcggaagcugagaacccugauccucgcucccacucggguggucgccucagaaauggccgaggcuuugaagggcaugcccaucagauaucagaccaccgccguaaagucugaacacaccggcaaggagaucguggaucugaugugccacgccacguucaccaugcggcuucugucacccgugcgcgucccgaacuacaacaugaucaucauggacgaggcccacuuuaccgacccgucguccaucgcagcucgcggguauaucagcacccgcguuggcaugggggaggcugccgccauauucaugacagcgaccccgcccggcagcguggaggccuucccgcaaaguaacgcagucauccaggaugaggagagagacauacccgaacgcucguggaacagcggguacgaauggaucaccgacuuccccggcaagaccgugugguuugugcccucuaucaagucggggaacgauaucgccaacugucuucggaagaauggaaagcgcgucauccagcucuccagaaagaccuuugacaccgaguaucagaagaccaagaauaacgauugggauuacguggugacaacugacaucucagagaugggcgcgaacuuuagagccgaccgagucaucgauccccgccggugccugaagccgguaaucuugaaggacgguccggaacgcgugauccuagccgguccuaugccggugacgguggccuccgcagcucagcggcgcggucgcaucggccgcaaccacaacaaggagggggaccaauacauauacaugggacagccccuuaacaacgacgaagaucacgcucacuggaccgaggccaagaugcuacucgacaacaucaacacgccagaggggaucauucccgccuuguucgagccggaacgcgagaagucagcggcgauagacggggaauaucgguugcgaggcgaagcgcggaagacguuuguugaacuaaugcgccguggggacuugcccguguggcugucuuacaagguggcaagcgaaggcuuccaauacagcgacaggagauggugcuuugauggcgagcguaauaaccaaguacuggaggagaacauggacguggagaucuggaccaaggaaggggagcgcaaaaagcugcgaccacgguggcuggacgcucgcaccuacucggacccacucgcgcugcgcgaguucaaggaguuugcggccggccgccggagcguguccggggaccugauccucgaaaucggcaagcugccgcaacaccugacccaacgggcccagaaugccuuagacaacuuggucaugcugcacaacagcgagcagggcgggcgggcguaccgccacgcaauggaagaacuccccgacaccauagagacucuaaugcugcucgcccugaucgcagugcucaccgguggggugacccucuucuuccuuuccggcagagggcuggguaagaccaguauuggccugcugugugucauggcuaguagcgugcuauuauggauggcguccguugagccccacuggaucgccgccuccaucauccuugaguucuuccugaugguguuguuaaucccugaaccggaucgccaacggacuccucaagacaaccagcuggcauacguggugaucgggcugcucuuuaugauccugacagucgcugcgaacgagauggggcugcuggagaccacuaagaaagaucuugggaucggccacguggccguugagaaucaccaucaugcugccaugcucgacguugaucuacauccggccucagcauggacgcuguacgcaguugccacuaccaucaucaccccgaugaugcgccauacgaucgagaauaccaccgccaacaucagccucaccgccaucgcaaaccaggccgccauccucaugggguuagacaagggcuggcccaucagcaagauggacaucggcgucccccuacuggcccuuggaugcuauucacaaguuaaucccuuaacucuaaccgcggccgugcugaugcucguggcccacuacgccaucauaggcccggggcugcaggcgaaggcgacuagggaggcccaaaagagaaccgcugccgggauuaugaaaaacccuacggucgacgggaucguagccaucgacuuagacccagucgucuaugaugccaaauuugagaagcagcugggucagaucauguuauugauccucugcacaucccagauccuccugaugcggacgacuugggcccuaugcgagucaaucacccuugcuaccggcccccuaaccacccucugggagggguccccggggaaguucuggaacacgaccaucgccgugagcauggccaacaucuucagaggguccuaccuggcgggcgccggauuagccuucagccucaugaaaucccucgggggggggcgccgggggaccggggcccaaggcgagacccugggcgagaaguggaagaggcagcuuaaccagcuauccaagagcgaauucaacacguacaagcggucuggaauuauggaaguugaccgcucggaggcuaaggaaggcuuaaagagaggggagaccacaaagcaugccguaucccgcggcacugccaagcuucgcugguucguggagcgcaacuugguuaagccugaggggaaagucauugaucuugggugcggccgcggaggcuggagcuacuacugcgccgggcuaaagaaagugacggaggugaaaggcuacaccaagggcggucccggccacgaagagcccaucccgauggccaccuauggguggaaccuuguuaagcugcauaguggcaaggacguguucuucauuccgcccgagaagugcgacacucuucucugcgacauaggggagucauccccaaaucccacgaucgaggagggcaggacccugcgaguccugaagauggucgagcccuggcuccgggguaaccaguuuugcauuaaaauccugaaucccuacaugccuucgguugucgagaccuuagagcagaugcagcggaaacacggcggcauguuaguccggaacccguugaguaggaacagcacccacgagauguauugggucuccugcgggaccggaaacaucgugagugcggucaacaugacgucgcgcaugcuuuugaaucgcuucaccauggcccaccggaaacccaccuacgaacgcgauguggaccugggggccgggacccggcacguggcgguugaaccagagguggccaaucuugacauaaucggccagcgcauagagaacaucaagcacgaacauaagucgaccuggcacuacgacgaagacaaccccuacaaaaccugggcguaucacggguccuacgaagugaagccgagcggcuccgcgucgagcauggucaauggggugguuaagcuuuugaccaagcccugggacgugauccccauggugacgcaaaucgcgaugacggacaccacacccuucggccaacagcggguguucaaggagaagguggacacccgcacgccgaaggcuaagagaggaaccgcccagauuauggaggugaccgccaaguggcuguggggcuuccucaguagaaacaagaagccacggauuugcacccgggaagaguucacgcgcaaggucaggucaaaugcggcaaucggugccguguucguggacgagaaccaguggaauucggcgaaggaggccgucgaggacgaacgguucugggaccugguacaccgagagcgcgagcugcacaaacaggggaagugugcgaccuguguguacaacaugaugggcaagcgcgagaagaaacucggggaguucggaaaggccaaagggagccgggccauaugguacaugugguuaggcgcgcgcuuccuggaguucgaggcccuaggcuucaugaaugaggaccauugguucucucgggaaaacagccuguccgggguagaaggcgaggggcugcauaagcucggcuacauccuccgagacauauccaaaaucccaggagguaacauguaugccgacgacaccgccgguugggacacccggauuacggaggacgaccugcagaacgaagccagaauuacagacauuauggagccggagcacgcgcuacuggccaaauccauuuucaagcugacauaccaaaacaaggugguacguguccagcggcccgcaaagaacgggacggugauggacgugaucagccgccgcgaccaaagaggaagcggccagguaggaacguacggauugaauacuuucaccaacauggaggcccagcugauccgccagauggagucggaggggaucuucucacccagcgaguuggagaccccaaaccuagccgaaagggugcucgacuggcuugagaaguacggcguagagcggcucaagcgcauggcgaucucgggggacgacugcgucguuaagccaaucgacgauagauucgcuacggcuuugacagcucugaacgauauggguaaggugcgaaaggacauaccacagugggaaccgucaaagggguggaacgacuggcagcagguccccuucugcagucaccauuuccaccagcucaucaugaaggacggucgggagaucguagucccaugucgcaaccaggaugagcugguggggcgugcucgugugucccagggcgcgggcuggucgcugcgcgagaccgcgugccucggcaagucauacgcccaaauguggcagcuaauguacuuccaccgccgggaccuccgacucgccgcgaacgccaucugcucugccgugcccgucgacuggauuccaaccuccagaacaaccuggagcauccacgcucaccaccaguggaugaccaccgaggacauguuguccguguggaaccgcguguggaucgaagagaaccccuggauggaggauaagacccacauaucguccuggggugacguaccguacuuagggaaacgcgaggaucaguggugugggucacucaucggccugaccgcgcgcgcaaccugggcaacaaauauucagguggcaauaaaccaggugcgucgguuaaucggaaacgagaacuaccucgacuacaugaccuccaugaagcgcuucaagaaugaaucggauccugaaggcgcccugugguaa

SEQ ID NO: 24550 - RNA, 9879 nt, Artificial Sequence
  derived and/or modified CDS sequence (opt11) from DENV-1__EU482813__SS-prME
agcgugaccauguuacuaaugcuuaugcccacggcguuagcguuucacuuaacgacccgggguggugagccccacaugauugugagcaagcaggaacggggcaagagccuucuguucaagaccagugccggggugaacaugugcacccucaucgccauggaucugggugaauuuugcgaggacacgaugacuuacaagugcccaaggaucaccgaggccgagcccgacgacguggacugcugguguaacgccacagacacauggguuaccuauggcacgugcucucaaaccggugagcaccggcgugacaagcgguccguagcccuggcaccccacgugggcuuggggcuggagacucgaaccgagaccuggaugagcagugagggcgccuggaagcaaauacagcggguggagaccugggcccugagacauccuggguuuacggugaucgcccucuuccuggcccacgccaucgggaccagcaucacgcagaaagguaucauauucauccugcucaugcuggugacccccucaauggcuaugcgaugcgucggcaucggcucccgugacuucguggagggguuaagcggcgccacauggguggacguggugcucgagcacgguucuugcgucaccaccauggcgaaggacaagccaacccuggacaucgagcugcucaagacggaggucacgaaucccgcggugcugcgaaagcuauguaucgaagccaagaucuccaauaccaccaccgacucucgcugcccgacucagggcgaggccaccuuaguggaggagcaggacgccaacuucgucuguaggcgcacguucguggacagaggcuggggcaacggcugcgggcuguucggcaaagggucccucaucacgugugcuaaguucaaguguguaaccaagcuagagggcaagacaguccaauaugagaaccuaaaauacagcgugaucgucacuguucauacaggcgaccagcaucagguggggaacgaauccaccgagcacggcacuaccgcgaccauuacgccccaggccccgagcacggagauacaacugaccgacuacggcgcacucacacuggacugcagcccccggacuggccucgauuuuaacgagaugguccuccugacgaugaaggaaaagucuuggcuggugcacaaacagugguuccucgaccugccgcuccccuggaccagcggugccucuacuagucaggagacguggaaccggaaggaccucuugguuaccuucaagaccgcccacgcuaagaaacaggaggucgucguucuaggcagccaggagggcgccaugcacacugcccugacgggggcaaccgagauccagaccagcggaaccacgaccaucuucgccgggcaccugaagugccgccugaagauggauaagcucacccuaaagggcaugucauacgugaugugcacuggguccuucaaauuggagaaggaggucgcggagacgcaacauggcacggugcucguccagaucaaguacgaaggaaccgacgccccgugcaagauccccuucucaacccaggacgagaagggggugacgcagaacgguagacuuaucacugccaacccgaucguuaccgauaaggagaagcccgugaacaucgaggcggagccgcccuucggcgagagcuacaucgugaucggcgcgggcgaggaagcucugaagcuuagcugguucaagaaggggagcucaaucggcaagauguuugaagccaccgcccguggggcccggcgcauggcuauucuaggggacacugccugggauuucggguccaucggcggcguauucaccuccgucgggaaacuggugcaucagaucuucggcacggcguacggggugcuguuuagcggcguauccuggacaaugaagaucgggaucggcgugcuccuaacauggcugggccucaauagccgcucuaccagccuuuccaugaccuguaucgccguggggcuggucacgcucuaucugggcgugauggugcaggccgacucagggugcguuauuaauuggaagggucgggagcugaagugcggcagcgguaucuuuguaacuaacgaggugcacaccuggaccgagcaguacaaguuccaggcggacagcccgaagcgccucuccgcggcaaucggcaaagccugggaggagggggucugcggcauacgguccgccacccgacuggagaacauuauguggaagcagaucagcaacgaacugaaccacauccuccuggagaaugauaugaaguucacggugguggucggggauguggcuggcauccuggcccaggggaagaagaugauccgcccccagcccauggaauauaaguacuccuggaaaucguggggcaaggccaagauaaucggcgccgacgugcaaaacacuacauucaucauagacggacccaacacaccagagugcccagacgaccagcgugcguggaacauuugggaagucgaagacuauggcuuugggaucuucaccacgaacaucuggcucaagcuuagagacuccuacacccaggugugcgaccauagacugaugagcgccgcuauaaaggacuccaaggcagugcacgccgacaugggcuacuggauugaaagcgaaaaaaaugagaccuggaagcucgcgcgagccuccuucaucgaggucaagaccugcaucuggcccaagagccacacgcuuuggucuaauggcgugcuggagagcgagaugaucauccccaagaucuacggaggaccgaucucccagcacaacuaccgccccggguauuucacacagaccgccgggcccuggcaccuggggaagcucgagcuggacuucgaccucugcgaaggcaccacggucgucguagacgagcacugugguaaccgggggccgagccugagaaccaccaccgugacaggcaagauuauacacgagugguguugccggagcugcacucugccgccccugcgcuucaaaggggaagacgguugcugguacgggauggagauccggcccgugaaggagaaggaggagaaccuggucaagucaauggugagcgccggcucgggcgaggucgacagcuucucccuagggcuccuguguaucagcaucaugaucgaggaggugaugcgcucgagguggagcagaaaaaugcuuaugaccggcacccuggccguguucuuccugcugaucauggggcagcucacguggaaugaccucauucggcuguguauuaugguaggugcuaacgcuagugaccggauggggaugggcaccaccuaccuggccuuaauggccaccuucaaaaugaggccgauguucgccguggggcuccuguuccggcgccugacgucgagggagguguuacuacucaccaucggucugucccucgucgcaagcguggaguugcccaauucucuggaggaacucggcgacggacuggccauggguaucaugauccucaagcucuuaaccgacuuccagagccaccagcugugggccacucugcuaucccuuacguucauuaagaccaccuucagucuccacuacgcuuggaagacgauggcgaugguucuguccaucgucucgcuguuuccccucugccuguccacuaccagucagaagaccacauggcugcccgugcuccuaggcuccuugggcugcaagccguugaccauguuccugaucgcagagaauaagauuuggggccgaaagagcuggccccugaacgaaggaauuauggcagugggcaucgugagcauccuuuugagcagccuauuaaagaacgacgugccguuggccggaccccugaucgccggcggcaugcucauagcgugcuacgucauauccgggucguccgccgacuugucacuggagaaggccgccgagguguccugggaagaggaggcagagcacuccggcgcuucccacaacauccucgucgagguccaagacgacgggacgaugaaaaucaaggacgaggagcgggacgauacacugaccauccuguuaaaggccacccuucuggccgugagcggcguguacccgcucucuauccccgccacgcuguuugucugguacuucuggcaaaaaaagaagcagcgcucuggaguguuaugggacacacccucaccgcccgagguggagcgggcaguucuggaugauggaaucuaccggauaaugcagcggggccugcuagggcgcagccagguuggcgugggggucuuucaggaaaacguauuccacacgauguggcacguuacccggggcgcgguccugauguaccaagggaagcgacucgagcccuccugggccagcguuaagaaggaucugaucuccuacggcggaggauggcgguuacagggcucauggaacacgggggaggaggugcaggucauagccguggaacccggcaagaaccccaagaacgugcagaccgcccccgggaccuucaagaccuccgagggugaggucggugccaucgcgcucgacuucaagcccgggacguccggcagcccaaucgugaaccgagaggguaagauagugggccuguaugguaauggggucguuaccaccuccggcacuuacgugagcgcaaucgcccaagccaaggccucccaggagggaccucugccggagaucgaagacgaggucuuccggaagagaaacuugacgauaauggacuuacacccuggcagcgggaaaacgcggcgcuacuugccugcgaucgugcgggaggccaucaagcgcaaacuacggacccugauccuggcaccaacccgaguggucgcuuccgagauggcggaggccuugaaaggaaugcccauccgcuaccagacgaccgccgugaagagcgagcacaccggcaaggaaaucguugaccugaugugccacgccaccuucacgaugcgucugcucucccccguccgagugcccaacuacaacaugaucaucauggacgaagcccacuucaccgacccaagcuccaucgcggcccggggguauaucagcaccagagugggaaugggggaagcagccgcaaucuuuaugacggcaaccccgcccggcucggucgaagcguucccccagagcaacgccgucauccaggaugaggaaagagacaucccggagcgcuccuggaacagcggguacgaguggauaaccgacuucccuggcaagaccgugugguuuguccccaguaucaagagcggcaacgacaucgccaacugcuugcggaagaacgggaagcgcgugauacaacugucgcggaagaccuucgacaccgaguaucagaagacaaaaaacaacgacugggacuacguggucaccacagauaucagcgagaugggcgcgaacuuccgcgccgaccgggugaucgacccccgccggugccucaaaccggugauccugaaggauggcccugaacgcgugauucuugccggccccaugcccgucaccgucgccuccgcagcgcaacgucgcgggcguaucggucgcaaccauaacaaggagggcgaucaguacaucuacaugggucagccucucaacaaugacgaagaccacgcccacuggacagaggccaagaugcuucuggacaacaucaacacccccgaagguaucauacccgcuuuguucgagcccgagcgggagaaauccgcagcgaucgacggggaauacaggcuucgcggcgaagcccggaaaacguuuguggagcugaugcgccgcggggacuugccuguauggcugagcuauaaggucgccucugagggauuccaguauagcgaccgccggugguguuucgacggggaacgcaauaaucagguucuggaggagaacauggacguggagaucuggaccaaggaaggggagcggaagaagcuccgcccccgguggcucgacgcccgcacauacuccgauccccuagcccuccgugaauucaaggaguucgcugccggacgccggagcgucuccggggaccugauccuggagaucggcaagcugccccagcaccugacccagcgcgcacagaaugccuuggacaaucucgugaugcuacacaacucugaacaaggugggcgggcguaccgccacgcuauggaagaacugccagacacaauagaaacccuaaugcugcuggccuugaucgccgugcugaccggcggggugacacuguucuuucucuccggccggggauuaggcaagacgucaaucggccugcuuugcguuauggcguccucugugcugcucuggauggcgucuguugaaccccacuggauagccgccagcaucauucucgaguucuucuugaugguguugcucaucccugagcccgaccggcagcggaccccccaagacaaccagcuggccuacgugguuauugguuuacuuuucaugauccugacgguugcagcgaacgagaugggacugcucgaaaccacaaagaaggaccuggggaucggccacguggccgucgagaaccaccaccaugccgcaaugcuggacguagaccuccaccccgccuccgcguggacccuguacgccguggccacgaccauuaucaccccuaugaugagacacacaaucgagaacacgaccgccaacaucagccugaccgcaauugcgaaccaggccgccaucuuaauggggcuggacaagggguggccaaucucgaagauggacaucggcgucccucugcucgcccuggggugcuacagccaggugaaucccuuaaccuugacggcggccgugcugaugcugguagcccauuacgccauaauuggaccggggcuccaagccaaggcaacacgggaggcccagaagcgcaccgccgccggcaucaugaaaaacccgacuguggaugggaucgucgccaucgaccuggaccccgucgucuacgacacgaaguucgagaagcagcugggccagauaaugcuccuaauccugugcacaucacaaauccuccuuaugcgcaccaccugggcgcugugcgagagcaucacccucgccaccggaccucucaccacccucugggaggggucccccggaaaguucuggaacacgaccaucgcagugagcauggcgaauaucuucagagggucuuaccucgccggcgcgggccuagccuucucccugaugaaaucacucggcggcgggcgccgggggacuggggcccagggggagacucugggcgaaaaguggaagcgccagcuaaaccaauuauccaagucugaguucaacacguauaagcguuccgggaucauggaggucgaccgcagcgaggccaaggagggcuuaaagcgcggagaaaccaccaagcacgcgguguccagaggcaccgccaaguuacggugguucguugagcgaaaucucgucaagccugaggggaaagugauugaccugggcugcggccgcgguggguggucguacuacugcgccggacugaaaaaggucacggagguaaagggcuacaccaagggcgggcccggccacgaggagcccauccccauggcaaccuacggguggaacuuagugaaguuacacuccggcaaggacguguucuucaucccgcccgaaaagugcgacacccugcucugcgacauuggggagaguagccccaaccccacgaucgaggagggucgcacccuccgggugcugaaaaugguggagccuugguugcgggggaaccaauucugcaucaagaucuuaaaucccuacaugcccagcguggucgagacccuggagcagaugcagcgcaagcacgguggcaugcuagugcgcaacccccucucccggaacucgacacacgagauguacuggguguccugcggcaccggcaacaucguauccgcugugaauaugacgucccgcaugcuccugaacagauucacuauggcgcaccgcaagccuaccuacgagcgggacguggaccucggggccggcacccggcacgucgcuguggagcccgagguugcaaaccuugauaucaucggccagcgcaucgagaauaucaagcacgagcacaagagcacguggcauuacgacgaggacaaccccuacaagacaugggccuaccacggaucguacgaggucaagccuagcgggagcgcauccucuaugguaaauggggucgugaagcuccucaccaagccuugggacgugaucccuaugguuacccagaucgcgaugacggacaccacccccuucggucaacagcgcguguucaaagagaagguggacacacgcacuccgaaggccaaacgggggaccgcccagaucauggaagucaccgccaagugguuguggggcuuccucucccguaauaagaagccacggauuugcacccgcgaggaguucacgcggaaggugaggagcaacgcggcaaucggcgccguuuucguagacgagaaccaguggaacucagccaaggaggcgguggaagacgagcgguucugggaccucgugcacagagagcgggaauugcacaaacaggggaagugugcgacgugcgucuauaacaugaugggcaagcgcgagaagaagcucggcgaguucggcaaggccaaaggguccagggccaucugguacauguggcucggugcucgcuuccucgaguucgaggcgcugggcuucaugaacgaggaccacugguucucccgcgagaacagccucagugggguggaaggcgaggggcugcacaagcugggcuauauacuccgcgacaucucgaagaucccggggggaaacauguaugccgacgacaccgccggcugggacacccgcaucacggaggacgaccugcagaacgaggccaagauuaccgacaucauggagcccgagcacgcccugcucgcgaaguccaucuucaaacugaccuaccaaaauaagguugucagagugcaacggcccgccaagaacggaaccgugauggacgucaucucccgcagggaucagcggggaucaggccaggugggcacguacggccugaacaccuucaccaacauggaggcgcaguugauccgccagauggagagcgaggggaucuucuccccaagcgagcuggaaacucccaaucuggccggacggguacucgacuggcucgagaaacauggugucgagcgacugaagcggauggccaucucgggcgacgacugcguggugaaaccaauagacgaccgcuucgcgaccgcucucaccgcccugaacgauauggggaagguccggaaggacaucccgcagugggagccgagcaagggcuggaacgacuggcagcagguccccuuuugcagccaccacuuccaccagcugauaaugaaggauggccgcgagaucguggucccuugccggaaccaggaugagcucguaggccgugcccgggugagccagggugccggguggaguuugcgggagaccgcaugccugggcaaguccuacgcacagauguggcagcucauguacuuucaccggcgcgaccugcggcuggccgccaacgccauuugcagcgcgguaccgguggauugggugcccaccagucgcacgaccuggagcauccacgcccaccaccaguggaugaccaccgaagacaugcucuccgucuggaaucggguguggauagaggagaacccguggauggaggacaagacgcauauuaguuccuggggcgacgugccuuacuuagguaaaagggaggaccaauggugugguucacugaucgggcuaaccgcccgggccaccugggcgaccaauauccaggucgcgaucaaccaggugcgccgccugaucggaaacgagaacuaccuggauuacaugacauccaugaagcguuucaagaacgaaagcgacccagaaggugcgcugugguaa

SEQ ID NO: 24551 - RNA, 9879 nt, Artificial Sequence
  derived and/or modified CDS sequence (opt11) from DENV-1__EU482814__SS-prME
uccgugacgauguuacucauguugaugcccaccgcccuagcauuccaccucacgacccggggcggugagccccacaugaucgugagcaagcaagagcggggcaaaagccugcuguucaagacaagcgcgggggugaacaugugcacccucaucgcuauggaccugggugaguucugcgaggacacgaugaccuacaagugcccccgcaucaccgaggccgagcccgacgacguggauugcuggugcaacgccaccgacacgugggucaccuacgggaccugcagccagaccggcgagcaccggcgggacaagcgguccguggcccuggcuccccacgugggcuucgggcucgagacgcgcaccgagaccuggaugagcuccgagggcgccuggaagcagauccagcggguagagaccugggcccugcgccaccccggguucacggugaucgcccuguuccucgcacacgccauaggcaccagcaucacucagaaaggaaucauuuucauccuguuaaugcucgugacccccucuauggccaugcggugcgucggcauugggagccgcgacuuuguggaggggcuguccggcgccacguggguggacgucgugcuggagcacgggagcugcgugaccaccauggccaaggacaagcccacccucgacaucgagcugcugaagacggaggucaccaaccccgcgguccuccguaagcugugcaucgaggccaagaucuccaacaccaccacggacagccgcugccccacccaaggcgaggccacccugguggaggagcaggacgcuaacuucgucugccggcgaaccuucguggaccggggaugggggaacggcugcggacucuucggcaaggggucccugaucacgugcgccaaguucaagugcgugacaaaguuggaaggcaagaccguucaguacgagaaccucaaauacagcgugaucgugaccguucacacgggcgaccaacaccagguggggaaugaguccaccgagcacggcaccacagcgaccaucacgccccaagcccccagcacagagauccagcugacagacuauggggcacugaccuuagacugcagcccccggacaggccuggacuucaacgagaugguccugcucaccaugaaagagaaguccugguuggugcacaagcagugguuccuggaccucccccuacccuggaccagcggggccucgaccucucaggagacguggaaccguaaggaccugcucgugacuuucaagaccgcccaugcgaaaaagcaggaggucguggugcuagguucccaagagggcgccaugcacaccgcccugacgggggccaccgagauacagaccagugguaccacgaccaucuucgccgggcaccucaagugccgccugaagauggacaaacucacccucaaaggcauguccuacgucaugugcaccgggagcuucaagcuggagaaggagguggcggagacgcagcacggcaccgugcugguccagaucaaguacgagggcaccgacgcgcccugcaaaauacccuucuccacccaggacgagaagggcguaacgcagaacggccggcuaaucaccgccaacccaaucgucaccgacaaggagaagcccgucaacaucgaggccgagccucccuucggugagagcuacaucgugaucggggcgggcgagaaggcacucaaguugucaugguucaagaaggguagcucuaucggcaagauguucgaggcaaccgcccgcggggcgcggcgcauggcgauucugggcgacacggccugggauuucgggucaaucggugggguguucaccuccgucgggaagcucgugcaccagaucuucggcaccgccuacggggugcuguucagcggcgucuccuggaccaugaagaucgggauaggcguccugcuaaccuggcugggccugaacagucgcuccaccucguuguccaugaccugcaucgccguugggcugguaacccuuuaccuaggcgugaugguucaggccgacagcgggugcgucauuaacuggaagggccgggagcugaaaugcgggagcgggaucuucguuacaaacgaggugcacaccuggaccgagcaguacaaguuccaggcggacucgccgaagcgccugagcgcagcuauaggcaaggccugggaggagggggucuguggcauccgguccgcgacgcgccucgagaacaucauguggaagcagaucagcaacgaauuaaaucacauucugcucgagaacgacaugaaguucaccgugguugugggggacguggcgggcauccuugcccaggggaagaagaugauccggccccagcccauggaguacaaguacuccuggaaguccuggggcaaggccaagaucaucggugcugacgugcagaacacgacauucaucaucgacgggcccaacaccccggagugccccgacgaccagagggcguggaacaucugggaggucgaggauuacggauucgggaucuucacgacgaacaucuggcucaaacuuagggacuccuacacccaggugugcgaccaccgccugauguccgcugccaucaaggacuccaaggccguacaugccgacaugggcuacuggaucgagagcgagaagaacgagacguggaagcuggcgagggcuuccuuuaucgaggucaagaccuguaucuggcccaaaagccacacgcucugguccaacggcgugcuggagagcgagaugaucauccccaagaucuacgggggccccaucucccagcacaacuaccgccccggguacuuuacccagaccgccggccccuggcaccuagggaagcucgaacuggacuucgaccugugcgagggcaccacgguggugguggacgagcacugcggcaaccgggggccgucguuacgcaccaccaccguaacgggcaaaaucauucacgaguggugcugccgcagcuguacucugccgccgcugcgcuucaagggggaggacggcuguugguaugggauggaaauccggcccguuaaagagaaggaggagaaccucgucaagagcauggugagcgccggcuccggcgaggucgacagcuucucccugggguugcucugcauaucuaucaugaucgaggaggugaugcgcucccgcuggagccggaaaaugcugaugaccggcacccuggccguguuuuuccuccugaucauggggcagcugacguggaacgaucucauccggcugugcaucaugguaggcgcgaacgccuccgaccgcauggggaugggcaccaccuaccuggcccucauggcaaccuucaagaugcgcccgauguucgccgugggcuugcuguuccggcgccuaacgucucgggaggugcuccugcucaccaucgggcugucccuggucgcgagcguggagcucccgaacucccuggaggaacugggcgaugggcucgcaaugggcaucaugauucuuaagcugcucaccgacuuucagagccaccaacugugggcuaccuuacucucccugacauucauuaagaccaccuucagcuugcacuacgcuuggaagaccauggcgaugguccucuccaucgugucacuguucccccugugccucucgacgaccagccagaagaccaccuggcugcccguguugcucggcucccugggauguaagccgcucacgauguuccucaucgcagagaacaagaucuggggccgcaagucauggccucugaacgaggggaucauggccgucggcaucgucagcauccugcucuccagccugcugaagaacgacgugccccucgcggggccucugaucgccggcggcaugcugaucgcgugcuacguuauuuccgggagcucugccgaccucagccuggagaaggccgccgaggugucuugggaggaggaggccgagcauagcggcgcgucccacaacauccugguggaaguccaggacgacgggaccaugaagaucaaggacgaggagcgggaugacacccucaccaucuuacugaaggccacccuccuggccgugagcgguguguacccguuauccauacccgccacccuguucgucugguauuuuuggcagaagaagaagcagcgcucaggggugcugugggacacccccagcccucccgagguggagagagcgguccuggacgacggaaucuaccgcaucaugcagcgaggccucuugggacgcagccaggugggcgugggggucuuccaggagaacguguuccacaccauguggcacgugacccggggcgcgguacugauguaccaggggaagcgccuggagcccuccugggcaucagugaagaaggacuugauauccuacggcggaggguggcggcuccagggaagcuggaacacgggggaggaggugcaggucaucgccgucgagcccggcaaaaaucccaaaaacgugcagaccgcccccgggaccuuuaagaccucagaaggcgaggucggcgccauugcgcuggacuucaagccagggacgagcggcagccccaucguaaaccgcgagggaaagaucguaggccucuacggcaacggggucgugaccaccuccggcaccuaugugucagccaucgcucaggccaaggcgucccaggaggggccccugccggagaucgaggacgaggucuuccgaaagagaaaccugacgaucauggaccuccaccccgggagcgggaaaacccggcgcuaccugcccgccaucguccgggaggcuaucaagcggaagcugcggacccucauccuggccccgacccgcgucguggccuccgagauggcggaggcccuuaaaggcaugcccauccgcuaccaaacgaccgccgucaagagcgagcauaccggcaaggagauuguggaccucaugugucacgccacguucacgaugcgguugcugucccccguccgcgugcccaacuacaacaugaucauaauggacgaagcccacuucaccgacccgagcucuauagcggcccgaggguacaucagcaccaggguggguaugggggaggccgccgccaucuucaugaccgcgacgccgcccggauccguugaggccuucccccagagcaacgccgugauccaagacgaggagcgggacauccccgagcgcuccuggaacagcggguacgaguggaucaccgacuuccccgguaagacagugugguucguccccaguaucaagagcggcaacgacaucgcuaacugccuccggaagaacggaaaacgcgugauucagcugagcaggaagaccuucgacacggaguaucagaagaccaagaacaacgacugggacuacguagucacgaccgauauuagcgagaugggcgcgaacuuccgcgccgaucgggugaucgacccccgccggugccugaagccggugauacucaaggacgggcccgagcgcgugauccuagccggccccaugcccgugacggucgccagugcugcucagcggcgagggcggaucgggcgcaaccacaauaaagaaggcgaccaguacauuuacauggggcagccguuaaacaacgacgaggaccaugcccacuggaccgaggccaaaaugcuccuggacaauaucaacacucccgagggcaucauccccgcacuauucgagcccgagcgggagaaguccgccgcgaucgacggggaguaccgccucaggggcgaggcccggaagaccuucguggagcugaugcgccgcggggaccugccgguauggcucuccuacaagguggccuccgagggcuuucaguacagcgacaggcgguggugcuucgacggggagcgcaacaaccaggugcuggaggagaacauggacguggagaucuggacgaaggaaggggagcggaagaagcugcgaccccgguggcucgacgcccgcaccuauuccgacccccuggcccuucgggaguucaaggaguucgccgccggccgccggagcgugucaggggaucucauccuggagaucgguaaacuuccccagcaccucacucaaagagcgcagaacgcccuggacaaccuggugaugcuucacaacucggagcagggcgggcgggcguaucgccacgccauggaagaacugcccgacaccaucgagacgcugaugcugcuggcuuugaucgccgugcucacaggcggggucacccuguuuuuccuguccggccggggacucggcaagaccucgaucggccugcugugcgugauggcguccagcguuuuacuauggauggcguccgucgagccccacuggauugccgccagcauaauccuggaguucuuccucaugguguuacuuauccccgaacccgaccgccagcggaccccgcaggauaaccagcucgccuacguggucaucggccugcuguucaugauccucacgguggccgcgaacgaaaugggccuauuagagaccaccaagaaggaccucgggaucggccacguggcggucgagaaccaccaucacgccgccaugcuggacguggaccugcacccagcauccgcguggacacucuacgccguggccacgaccauaaucaccccgaugaugcggcacaccaucgagaacacgacugccaacaucagccugaccgccaucgcgaaccaggccgcuauccugaugggguuggacaagggcuggccgauuuccaagauggacaucggcgugccgcugcuggcccucgggugcuauagccaggugaacccacugacccugacagcggccgugcucaugcuggucgcccacuacgccauaaucggcccagggcugcaggccaaggcgacccgggaggcccagaagcgcaccgccgcuggcaucaugaagaacccgaccguggacgggaucguggccaucgaccucgacccuguuguguaugacgcgaaguucgagaaacaacugggacagaucaugcugcucauucugugcacgucccagauccuguuaaugagaaccacuugggcccuuugcgagagcaucacccuggccacgggcccccuuaccacccugugggaggggucgccaggcaaguucuggaacaccacgaucgccgugagcauggccaauauauuccgggggagcuacuuagcgggcgccggccucgccuucucccugaugaagucccucgggggcgggcgccgggggaccggggcccagggcgagacccucggcgagaaguggaagcgccagcugaaucagcuauccaagagcgaguuuaacacauacaagcgguccggaaucauggaggucgaccgcagcgaggcaaaggagggccucaagcgcggggagacgaccaagcaugccguguccagaggcaccgcuaagcuacggugguucguggagcgcaaccuggucaagccggaggggaaggucaucgacuuaggcugcggccggggcggguggagcuauuauugcgccgggcugaagaaggugaccgaggucaagggguacacgaagggcgggcccggccacgaggagcccauacccauggccaccuacggguggaaccuggugaagcugcacuccggcaaggacguguucuucaucccacccgagaagugugacacccuccugugcgacaucggggaaagcucccccaaccccaccaucgaggagggucgcacgcugagaguccucaagaugguggagccuuggcugcgcgggaaccaguucugcaucaagauccuaaaccccuacaugcccagcguggucgagacccucgagcagaugcagcggaagcacggcggcaugcuggugcguaacccgcugucccggaacagcacccaugagauguacuggguguccugcggaaccggcaacaucgugucugcagugaacaugaccucccgcaugcuucugaaucgguucacgauggcccaccgcaagccaacauacgagcgcgacguggaccugggggccggcacccggcacgucgccguggaacccgagguagccaaccucgacaucaucggccaacgcaucgaaaacaucaagcacgagcacaagucaaccuggcacuacgacgaggacaaccccuacaagacgugggcguaccacggguccuacgaggucaagcccagcggcuccgccuccagcauggugaacggggucgugaagcuguugaccaagccgugggacgugauccccauggucacccagaucgcuaugaccgauacgacccccuuuggccaacagaggguguucaaggagaagguggacacccgcaccccgaaggccaagcgggggacugcccagaucauggaagucaccgcgaaguggcucuggggcuucuuaucccgcaacaagaagccgcggaucugcacucgcgaggaguucacgcgcaaggugcgcagcaacgccgccauuggcgccgucuucgucgaugagaaccaguggaacuccgcgaaggaggccguggaggacgagcgauuuugggaccuugugcaccgggagcgggagcuccauaagcaggggaagugcgccacgugcgucuacaacaugaugggcaagcgcgagaagaagcugggggaguucggcaaggccaaggggagcagagccaucugguacauguggcugggcgcgcgcuuccucgaguucgaggcucugggcuucaugaacgaagaccacugguucagucgggagaacucacuguccgggguggagggcgaagggcuccacaagcuggguuacauccugcgcgacaucagcaaaauccccgggggcaacauguacgccgacgauaccgccggcugggacacccggauuacagaggacgaccuccagaaugaggccaagauaacggacaucauggagcccgagcacgcauuacuggccaaguccaucuuuaagcucaccuaccagaacaaagugguccgcgugcagcggccggcuaagaaugggaccgugauggacgucaucagccgccgcgaccagcggggcucgggccaaguuggaacuuacggccugaacacguucaccaauauggaggcccagcugauccgccagauggagucugaggggaucuucucccccucggaacucgagaccccuaaccuggccggccggguccuggacuggcucgagaagcacggggucgaacgccugaagcggauggcgaucucuggagacgacugcguggugaaacccauagacgaccgcuuugccaccgcccugacggcucucaacgacauggggaagguccggaaagacaucccgcagugggaacccagcaagggcuggaaugacuggcagcagguacccuucuguagucaccacuuccaccagcucaucaugaaggauggccgcgagauagugguccccugccggaaccaggacgagcugguaggccgagcacgggugucucagggcgcgggguggucucuccgcgagaccgcgugccugggcaaauccuacgcccagauguggcagcugauguacuuccaccggcgcgaccuccggcuggccgcgaacgcuaucugcagcgccgucccgguggacugggugcccaccucacgcacgacguggagcauccacgcccaccaccaauggaugaccaccgaggacaugcuguccgucuggaaccggguguggaucgaggagaaccccuggauggaggacaaaacccacaucagcucauggggcgacgugcccuaccucggcaaacgcgaagaccagugguguggcagcuuaaucgggcucacggcccgggcgaccugggccacuaacauccaggucgccaucaaccaggugcgcagacucaucggcaaugaaaacuaccuggacuacaugaccuccaugaagcgguuuaagaacgagagcgacccggaaggggcccugugguga

SEQ ID NO: 24552 - RNA, 9879 nt, Artificial Sequence
  derived and/or modified CDS sequence (opt11) from DENV-1__EU482815__SS-prME
agugugaccaugcuauugaugcuaaugcccgccgcccuggcguuccacuuaaccacccggggcggggaaccgcacaugaucgugaguaagcaggagcggggcaagagccugcuauucaaaaccagcgcaggcgugaacaugugcacgcucaucgccauggaccugggcgaguucugugaggacaccaugacguacaaauguccccguaucaccgaggccgagcccgacgacgucgacugcuggugcaacgccaccgacaccugggucacguacgguaccugcagccagaccggcgagcaccggcgggacaagcgguccguagcguuggccccgcacgugggccuagggcucgagaccaggacggagaccuggaugagcagcgaaggcgccuggaagcagauacagcggguugaaacaugggcccuuaggcacccuggguuuaccguuaucgcccuguuccuggcccacgccaucggcacgaguaucacccagaagggcaucaucuucauccugcucaugcuugugacccccucgauggccaugcggugcgucggcauaggcagccgcgauuucguggaggggcuguccggggcaaccuggguggauguuguuuuggagcacgguagcuguguaacgaccauggcgaaggacaagcccacccuggacaucgaguugcucaaaaccgaagucacuaacccugcugugcugagaaaguuguguaucgaggccaagaucuccaacacuacaaccgacucucgcugcccgacgcagggcgaggcaacccugguggaagagcaggaugcaaauuuugucugccggcgcaccuucguggaccggggcugggggaacggcugcggacuguucggcaaagggucacuaaucacgugugcgaaguucaaaugugugacgaagcuugagggcaagaccguccaguaugagaaucugaaguacagcguaacugugacuguccacacgggcgaccagcaucaggugggcaacgaguccaccgagcacggaacuaccgcgaccaucaccccucaggcccccagcaccgaaauccaguuaaccgacuacggggccuuaacccuggacuguagcccacggacgggccuggacuucaacgagaugguccugcucacaaugaaggaaaaauccuggcuaguucacaagcagugguuccuagaccugccgcugcccuggaccagcggggccuccaccagccaggaaacguggaacagaaaggaucucuuaguaaccuucaaaaccgcgcacgccaagaagcaggaggucguuguucugggcucccaggagggcgcuaugcacacagcccucacgggggccacugagauccagaccagcggcaccacgacaauauucgcggggcaccugaagugccgccuuaagauggacaagcucaccuuaaagggcaugagcuacgucauguguaccgggaguuucaaguuagagaaggaggucgccgagacgcagcacggaaccgugcucguucagaucaaguaugagggcaccgaugcccccugcaaaauccccuucucgacacaggaugagaaggggguuacucagaacggccggcuaaucaccgcuaacccgauagugaccgacaaggagaagcccguuaauaucgaggcggagccgcccuucggggagagcuacauugugauaggagcaggcgaaaaagcccuaaagcugucaugguucaagaaggggagcaguauuggcaagauguucgaggccacggcccgcggcgcacggaggauggcaauauuaggcgacacggccugggauuucgggagcauaggcggcguauucaccuccgucgggaagcuggugcaccagaucuucggcaccgccuacggggugcuguuuagcggcgucuccuggaccaugaaaauagguaucggcgugcuccugacgugguuaggccucaauucuagauccaccucgcuuucuaugacgugcaucgccgugggguuggucacccucuaccugggcgugaugguccaggcggacagugggugcgucaucaacuggaagggccgggagcugaaaugcgggagcggcaucuucgugacaaacgaggugcacacauggaccgagcaguacaaguuucaggcagacuccccgaagaggcucucagccgcaaucgggaaggcaugggaggagggggucugcgggauccgguccgcgacgagacuggagaacaucauguggaagcagaucagcaacgagcuuaaccacauucuccuggagaacgacaugaaauucaccguggucgucggggacgucgccggcauuuuggcccaggggaagaagaugauacgcccacagccuauggaauacaaguacuccuggaaguccuggggcaaggccaagauuaucggggcggacgugcagaacacgacauucaucaucgacggccccaacaccccggagugcccggacgaccagagagccuggaacauaugggaggucgaggacuacggcuuuggaauauucaccacgaacaucuggcucaagcugcgggacuccuacacccagguaugcgaccaucgccugaugagugccgccaucaaggauuccaaagcggugcaugcugacauggguuacuggaucgagucagaaaaaaacgagacauggaagcuggcccgcgccuccuucaucgaggucaaaaccugcaucuggcccaaaagccacacucuguggucuaauggcgugcucgagagugaaaugaucauccccaagaucuacgggggcccgaucucccaacacaacuacaggcccggauacuucacucaaacggccggacccuggcacuuggggaagcuggaacuggauuucgacuugugcgaggggaccacuguugucguggacgagcacuguggcaauagaggcccgagccugcgcaccaccacagugacgggaaaaaucauccacgagugguguugucggucaugcacccugccgccccugagauucaagggggaggacggcugcugguacggaauggagaucagacccgucaaagaaaaggaagagaacuuggucaaguccauggugucagccgguuccggcgagguggacaguuucucuuuggguuuacugugcauuagcaucaugaucgaggaggugaugcguagccgcuggucacgcaaaaugcugaugaccgggacacucgcgguguucuuccugcugauuauggggcagcuaacguggaacgaccugauuaggcuguguaucaugguaggcgccaacgcuuccgacagaauggggaugggcacgaccuaccucgcccugauggcuacauucaagaugcggccgauguucgcggugggccuccucuuccgccgccugacgagccgggaggugcugcuccugaccaucgggcugucccucgucgcuaguguggagcugcccaacucccuggaagaauuaggcgacgggcuggccaugggcauuaugaucuugaaguugcugaccgacuuccagagccaccagcugugggccacccuccugucccugaccuuuaucaagacuacguucagccuccauuacgcguggaaaaccauggccauggucuugucaaucguuucucucuucccccucugccuguccacgaccagccaaaagaccaccuggcucccgguguugcugggcucccuggggugcaaaccacucacaauguucuucauagccgagaauaaaaucuggggacgcaagagcuggccccucaaugaggggaucauggccgucggcaucgucagcauccuguuauccagcuugcucaaaaacgacguaccccucgcagggcccuugaucgcgggcggcaugcuaaucgccugcuacguaaucuccgggagcuccgccgaccugucgcuggaaaaggccgccgagguguccugggaagaggaggcggagcacagcggugccagucacaauauccugguggaggugcaggacgacggcaccaugaagauaaaagacgaggagcgggacgacacuuugacgauccugcucaaggccacccuucuggcagugucggguguguauccucuguccaucccggcuacccucuucgugugguacuucuggcaaaagaagaagcagcgcaguggggugcugugggacacucccagcccccccgaaguugaacgggcggucuuagacgacggcaucuaucgcaucaugcaacggggccuccugggacgcucgcagguaggcguggguguuuuccaggagaacguguuccacaccauguggcacgugacccggggcgccguccugauguaccaggggaagcgccuggagccauccugggcuagcgugaagaaggaccuaaucaguuacggcggcggguggcggcuccaggguagcuggaacacgggggaggaggugcaaguaauugcaguggagcccggcaagaacccgaagaacgugcagaccgcccccgggaccuuuaagaccuccgagggcgaagucggcgcgaucgcccuggacuucaagccagggacgagcggcagccccaucgugaaccgcgagggaaagaucgugggccucuacggaaauggggucgucaccaccuccggcacuuacgugagcgccaucgcccaggcuaaagcaucccaggaggguccccugccggagaucgaagaugaggucuuccggaagcguaaccuuacgauaauggaccuccaccccggcagcgggaagacccgucgcuaccuaccugccaucguccgcgaggccaucaagcgcaagcugcggacccuaauccuagcccccacgcgcguggucgcgucagagauggcggaggcccuuaaggguaugccaauacgcuaccagacgaccgccgucaagagcgagcacaccggcaaggagaucguggaccucaugugccacgccaccuucacgaugcgguuacuguccccgguccgcguucccaacuacaauaugaucauuauggacgaggcucauuucacggaccccagcuccaucgcugcccguggauacaucuccacccguguggguaugggggaggccgcggccaucuucaugaccgcuacgccacccgguuccgucgaggccuucccccagagcaacgccguaauccaggacgaagagcgugacaucccggagcguuccuggaacagcggguacgaguggaucaccgacuuccccggcaaaaccgugugguucguccccucaaucaagagcggcaacgacaucgcgaacugccuacgaaaaaaugggaaacgcgugauccaacugucacggaagacguucgauacggaguaucagaagacuaagaacaaugauugggauuacgucgugaccacugauaucagcgagaugggggccaacuuccgugccgaccgugucaucgacccccgcagaugccugaagcccgugauccucaaggaugggcccgagcgcgucauccuggcaggccccaugcccguuacagucgccagugcggcccagcggcgcggaaggaucggccgaaaccacaacaaggagggcgaccaguacaucuacauggggcagccgcugaauaacgaugaggaccaugcccauuggaccgaggccaagaugcuucucgacaacauaaacacuccggaaggcaucauccccgcccucuucgagccggagcgggagaaguccgcggccauagacggcgaguaccgucuccgaggcgaggcucggaagaccuucguggagcugaugagacgcggugaccuaccaguaugguuaagcuacaagguagccuccgagggcuuccaauacuccgaccgacgcugguguuucgacggugagcgcaacaaccaggugcuggaagaaaauauggacguggagaucuggacgaaggagggagagcggaagaagcuucgccccagguggcucgacgcccgcaccuacuccgacccccuggcgcugcgggaguucaaggaguuugccgccggccgccggagcgucucgggggaccuuauccuugagauuggcaagcugccccaacaccugacccagcgcgcccagaacgcgcuggacaaccuggucaugcuccacaacagcgagcaggguggucgggccuaucgccacgccauggaggagcugccggacaccaucgagacgcuaaugcuacucgcccugaucgccguuuugaccgggggggucacacuuuucuuccuguccggcagggggcuaggcaagacuagcaucggccugcugugcgugauggcauccucagcccuacuguggauggccuccguggagccccacuggauagcugccagcaucauccuggaguucuuccucaugguccugcugaucccggagcccgaccgacaacgcaccccgcaggacaaccagcuugcguacguggugaucggacuccuguucaugaucuuaacggucgcugccaaugagauggggcugcuggagaccaccaaaaaggaucuggggaucggccacguggcuguggagaaccaccaucaugccgcuauguuggacgucgaccugcaccccgccuccgccuggacacucuacgccguggccacgaccaucaucaccccuaugaugcgccacaccaucgagaacacaaccgccaacaucagcuuaaccgccaucgccaaccaggccgcgaucuugauggggcucgauaagggcuggccuaucucaaagauggacauaggcgugcccuuacuggcccucggaugcuacagccaggucaacccgcugacucugacggccgcagugcucauguuagucgcgcacuacgcgaucauuggccccgggcugcaggcgaaggccacacgggaggcccaaaaaaggacggccgcgggcaucaugaagaauccuaccgucgaugggaucgucgccaucgaccucgacccgguggucuaugacgccaaguuugagaagcagcugggccagauaaugcugcucauccuuugcacgagucagaucuuacugaugcgcacgacaugggcccugugcgagagcaucacccuggcuacagguccccucaccacccugugggagggauccccgggcaaguuuuggaacaccaccaucgccguaagcauggccaacaucuucagagggagcuacuuggcuggugcgggccucgcguuuagucugaugaagucccucggcggcgggaggcgagguaccggugcccagggugagacccucggcgagaaauggaagcgccaacugaaccagcuguccaagucugaauucaacaccuacaaacgguccgggaucauggagguugaccgcagcgaggccaaggagggccuuaagcgcggagaaacgacaaaacacgccgucucccgcgguaccgcgaagcugcggugguucguggagcgcaaucugguuaagccagagggaaaagucaucgacuuaggcugcggucgcgguggguggagcuacuacugcgcgggguugaagaaggugaccgagguaaagggguacacgaagggcggccccggccacgaggagcccauaccaauggccaccuacggguggaaucuggugaagcugcacuccgggaaggacguguucuucaucccgcccgagaaaugcgacacccuccugugcgacaucggggagagcucccccaauccaacuaucgaagaaggccgcacgcugcgggugcuaaagauggucgagcccuggcugcgcgggaaucaguucuguauuaagauccugaauccuuacaugcccucggugguggagacguuagagcagaugcagcguaagcacggcgguaugcugguccgcaacccacuguccaggaacagcacccacgagauguacuggguuuccugcgggacgggcaacaucgugagcgccgucaacaugaccucgcgaaugcuucucaaccgguucacaauggcccaccguaagccgacauacgagcgcgacguggacuugggggccggcacacggcacguagccgucgagcccgaggucgcuaaccucgauaucauuggccagcgcaucgaaaacauaaagcacgaacacaaaagcaccuggcacuaugacgaagacaaccccuauaagaccugggccuaccauggguccuaugagguuaagcccagcggcagcgcauccagcaugguuaacgggguggucaagcugcugacgaagccgugggacgugauaccuauggugacccagaucgcaaugaccgacacgacacccuuuggccagcagagagucuucaaggagaagguggacacccguacccccaaggcgaagcgggggacggcgcagaucauggaagugaccgccaagugguuauggggcuuccugucgcgcaacaagaaaccacggaucugcaccagagaggaguuuacgcggaagguccgaucuaacgccgcgaucggcgccgucuuugucgacgagaaccaguggaacuccgccaaggaggccgucgaggacgagcgguucugggaccuggugcaccgcgagcgggaguuacacaagcagggaaagugcgccacaugcguguacaacaugauggggaagcgcgagaagaagcuaggggaguucggcaaggccaaggggagccgagccaucugguacauguggcugggcgcccgcuuccucgaauuugaggcccugggcuuuaugaacgaggaccacugguucucccgggagaacucauugucaggcguggagggcgaggggcuccauaagcugggcuacaucuuacgcgauaucagcaagauccccgguggcaacauguacgccgacgacaccgcgggaugggacacucggaucaccgaagacgaccuccaaaaugaggccaagaucacggacaucauggagcccgagcacgcccugcuggcgaaguccaucuucaagcucaccuaucagaacaagguggugcguguucagcggccggcgaagaacgggaccgugauggacgucaucucccgccgcgaccaacgagguuccggucaggucgguaccuacggccugaacacguucaccaacauggaggcucaacugauccgccagauggaguccgaggggaucuucucccccucagagcucgagacccccaaccuggccggccgggugcuggacuggcucgagaaacacgggguggaacgccugaaacggauggccauaucgggcgacgacugcgucgugaagcccaucgacgaccgcuuugcaaccgcccugacggcgcucaacgacaugggcaaagugcggaaggacauuccgcagugggagcccagcaaaggcuggaacgacuggcagcaggucccauucuguagccaccacuuucaccagcugauuaugaaggauggucgcgaaauugugguccccugccggaaccaagacgaguuggucgggagggcccgcgugucccagggcgccgguuggucucuccgcgaaaccgccugcuuaggcaaguccuaugcgcagauguggcagcugauguacuuccaccggcgggauuuaaggcuggcugccaacgccaucugcagcgccgugcccgucgacugggugccaacgagccgcaccacguggagcauccacgcgcaccaccaguggaugaccaccgaggacaugcugucgguguggaaccgggucuggaucgaagagaaccccuggauggaagacaagacucacauuuccuccuggggcgacgugcccuaccucggcaagcgcgaggaccagugguguggcagccugaucgggcugacggcacgggcuacgugggccaccaacauccagguggccaucaaccagguccgccgccucaucgggaaugagaacuaccuggauuacaugaccuccaugaagcgauucaagaacgaaagcgacccagaaggggcgcugugguga

SEQ ID NO: 24553 - RNA, 9879 nt, Artificial Sequence
  derived and/or modified CDS sequence (opt11) from DENV-1__EU482816__SS-prME
agcgugaccaugcuccucaugcugaugccaaccgcguuggccuuccauuugaccacccggggcggggaaccccacaugaucgugucgaagcaggaacggggcaagucccuucuguuuaagaccagcgccggcgugaacauguguacacucaucgccauggaucuaggagaguucugcgaagauacgaugaccuauaagugcccccgcaucacggaagccgaaccggacgauguagacugcugguguaacgcuaccgacaccugggugaccuacgggaccugcagccagacgggcgagcaccggagagacaaaagguccguggcccuggcgccccacguaggacucgggcuagagacacgcaccgagaccuggaugucauccgagggugcuuggaagcagauacaacggguugagacaugggcccugcgucacccgggcuuuacagugauugcacuuuuccuggcgcacgccaucgggacaagcaucacccagaaggggaucauauucauuuugcucaugcuggugacccccuccauggccaugcggugcgucggcaucgggucccgcgauuucguggagggucuuuccggagcaacauggguggacguuguucucgagcauggaagcugcgucaccaccauggcgaaagacaaacccacccuggacaucgagcuacucaaaacggagguaaccaaccccgcggugcugaggaaguuguguaucgaggccaagauuuccaacacgacuacggacagccgcuguccuacccaaggcgaggcgacccucguggaagaacaggacgccaacuuugucugccgccgcaccuucguggaccguggcugggggaacggcugugggcuguuugggaaggggucacugauuacgugugccaaguucaaguguguaaccaagcucgaagggaagacgguccaguacgagaacuugaaguacuccgugaucgugacgguccauacgggggaccagcaccaggugggaaacgaguccaccgagcauggcaccacggcaaccauuacgccccaggcgccaagcaccgagauccaauuaaccgacuacggggcgcuaacccucgauugcagcccacggacgggccucgacuucaacgagauggucuugcugaccaugaaagagaagucuuggcuaguucacaaacagugguucuuggaucugccccuuccguggaccucuggggccuccacgagccaggagaccuggaaccggaaggaucuucuggugaccuucaagaccgcccacgcgaagaagcaggaagucguugugcugggcucccaagagggcgccaugcauaccgcccucacaggggccacggagauccagaccagcgguaccacgacgaucuucgcuggucaccuaaaaugucgccugaagauggauaaacucacccugaaagguauguccuacgucaugugcacugggagcuucaagcuggaaaaagaggucgcggagacucagcauggcaccgugcucgugcagaucaaguaugagggaaccgacgcacccugcaaaauccccuucucaacccaggacgagaaggggguuacgcagaacggccggcugaucacagccaacccgaucguaaccgauaaagagaagcccgucaacaucgaggccgagccgccauucggcgaaagcuacaucgugaucggcgcgggcgagaaagcccugaagcucuccugguucaagaaggggagcucaaucggcaagauguucgaggccaccgcccgcggugcucggcguauggcaauccuaggagacaccgccugggacuucgggagcaucggcgggguguucaccucggucgggaaguuagugcaccaaaucuucggaaccgccuacgggguccuguucucaggagucagcuggaccaugaagaucgggaucggugugcuauugacguggcugggccuuaacagccguucaaccucucugucgaugaccugcauugcaguaggucucgucacccuuuaccugggugugauggugcaggcggauagcgggugugucaucaauuggaaggggcgggagcuuaagugugguagcggaauuuucgugacgaacgaggugcacaccuggaccgagcaguacaaauuccaggcugacucgcccaagcgccucagcgccgcuauaggcaaggccugggaagagggugucugcggcauccggucagccacucgccuugagaacaucauguggaagcaaaucagcaacgaauugaaccauauccuccuggaaaacgacaugaaguucaccguaguagucggggacgucgcgggcauucuggcucaggguaagaagaugauaaggccgcagcccauggaauacaaguacagcuggaaauccuggggcaaggccaagaucauaggcgccgacgugcagaacacgacuuucaucaucgacgggcccaauaccccugagugucccgacgaccagcgcgcuuggaacaucugggagguagaggacuauggcuucggcaucuucacuacgaacaucuggcuaaaacuuagagacuccuacacccaggugugugaucaccgccucaugagcgccgccaucaaggauuccaaggccguccacgccgacaugggcuacuggauugagucugagaagaaugaaaccuggaagcucgcgcgggccuccuucaucgaggucaaaaccugcauauggcccaaaagccauacacuguggucgaaugguguacuggagucagaaaugauuauccccaaaaucuacgguggcccgaucucccagcauaacuaccgccccgguuauuuuacccagacugccggccccuggcaccucgggaagcuagagcucgacuucgaccuaugugaggguacgacgguggugguggaugagcacugcggcaaccgggggccgagcuugcgcaccaccaccgugacuggcaagauuauccacgaguggugcugccgguccuguacacuaccgccgcuacgcuucaaaggggaagacggcugcugguaugggauggaaauacggccgguuaaagaaaaggaggagaaccuggucaagucaaugguaagcgcugguagcggcgaggucgauagcuuuucccucggucuucucuguaucucaauuaugauagaggaggugaugcgcagucgguggucacgcaagaugcucaugaccggcacucuagcaguguucuuccugcugauaaugggucagcucacguggaacgauuuaauccggcugugcaucauggucggcgcaaacgccucugacagaaugggcauggguaccaccuaucuagcucucauggccacauucaagaugcgcccuauguucgcagugggguuacuguuucggcgccugacgagcagagaagugcuguuacuaaccaucgggcugucccucgucgccagcguggaguuaccaaacucccuggaggagcucggugacggacuggcuauggguaucaugauccugaaguuacugacugauuuucagagccaucaguuaugggccacgcuccugucccugaccuucauaaagacaacauucagucuccauuacgccuggaaaacaauggcuaugguccugucuauagugagccuguucccccucuguuuauccaccacuucucagaagaccacguggcucccgguucuccuggguucuuugggguguaagccccucacgauguuccugaucgcugagaacaagaucuggggccgcaaguccuggccgcucaacgaggguauaauggcagucggcauugucucuauuuugcuaucgagccuuuuaaagaacgacguaccacuggccgggccgcugauagccggcgggauguugaucgcgugcuacgugauuuccgggucauccgcagaccuaagccuggagaaggccgccgaggucuccugggaggaagaggccgagcacucuggcgcgucccauaacauccucguggagguccaggacgacgggacgaugaaaaucaaggacgaggaaagggaugauacgcuaaccauccugcucaaggccacccuguuagcugugagcgggguauacccauuauccaucccagccacgcuuuucgucugguacuucuggcagaaaaagaagcagcggagcggggugcugugggacacucccagcccgcccgagguagagcgggcugucuuagacgacggcaucuacaggaucaugcaacggggacugcucgggcgaucucagguuggcgugggggucuuccaggagaacguauuucauaccauguggcacguaacucguggcgcgguccugauguaccaaggcaagcgccucgaacccuccugggcuagcgucaaaaaggaccuuaucucguacggcgggggcuggcgccuccagggcagcuggaauaccggcgaagagguccaagucauugccguggagcccggcaagaaccccaagaaugugcaaaccgcccccgggacguucaagaccuccgagggcgaggucggcgccaucgcgcucgauuucaagcccgggacaagcgggagcccgaucgugaaccgugaggggaagauagucggcuuauacggcaacggaguugugacaacgagcgggacauacguauccgcaaucgcacaggcgaaggcgucccaggaagggccccucccagagaucgaagaugaagucuuccggaagcguaaccucacgaucauggaucugcaccccgggagcgggaagacccggcguuaccugccagccauaguccgggaggccaucaaaagaaagcuccgcaccuugauucuugccccgacgcguguggucgcuuccgagauggcggaggcauugaagggcaugccgauucgcuaccagacaacggccgucaagagcgagcacacuggcaaggaaaucguugaccuaaugugucaugcgaccuucacgaugcggcugcucuccccaguccgggugcccaacuacaacaugaucaucauggacgaagcccacuucacugacccgagcuccaucgcggcucggggguacauuucuacccgcgucgggaugggagaggcagccgccauuuucaugaccgcgacaccgccugggagcguagaggcuuucccccagagcaacgccgugauccaggaugaggagcgggauauaccggagcgcuccuggaacucuggcuaugaguggauuacagacuuccccggcaagacaguuugguucgugccuuccaucaagagcggcaacgacauugcgaacugcuugcguaagaacgguaagagggugauccagcugucgcgcaagacuuuugauacggaauaccaaaagaccaagaauaacgacugggacuacguggucaccacggauaucagcgaaaugggcgcgaacuuccgcgccgaccgugugaucgauccccggcguugucuuaagccagugauacugaaggacgggcccgaacgcgucauccuggccgggccgaugcccguaacggucgccuccgcagcacagcggcgcggucggaucggucguaaccacaacaaggagggugaccaguacaucuacauggggcaaccucuuaacaacgaugaggaucacgcccauuggacggaagccaagaugcuguuggacaacaucaauacccccgaaggcauuauccccgccuuauucgagccugagagggagaaauccgccgcgaucgacggagaauacaggcugcgaggcgaagcgcggaagacauucguggaacuuaugcgccgcggagaccucccgguaugguuaagcuacaaagucgccuccgaaggguuucaguauagcgaccgucgauggugcuucgacggagagcgcaacaaccagguccuagaagaaaacauggacguagagaucuggacgaaagagggcgaacggaagaagcuccgaccccguuggcucgacgcccgcacuuacucggacccccuggcccucagggaguucaaggaguucgcagccggccgccgaagugucucuggugacuugauccuagaaauugggaagcucccccagcauuugacccagcgugcccagaacgcccuggacaaccucgugaugcugcauaacagcgagcagggcggaagggcguaccgccaugccauggaggagcugccggacaccaucgaaacacucaugcugcucgcacucaucgcgguucucacgggaggugugacccuguucuuccucucgggccggggucuaggaaagaccucgauugggcugcucugcgugauggccuccucagugcucuuguggauggcguccgucgagccccauuggaucgcugccagcaucauccucgaguucuucuuaauggugcuguugauuccugagccagaccgccagcggacgccgcaggacaaccagcuggccuacgucguaaucggucugcuuuucaugauacugacgguggcagcgaaugaaaugggacugcucgaaacgaccaagaaggaccucgguaucggccauguggccgucgaaaaccaucaccaugcggcgaugcuggauguugaccuccaccccgccuccgccuggacccuguacgcgguggccaccacaaucauaacgcccaugaugcgccacaccaucgagaacacaaccgcaaacaucagccucaccgccauagcgaaucaggcagcaauccucauggggcuugacaagggcuggcccauuagcaagauggacaucgguguuccccuccucgcacuggggugcuauagccaggugaacccucugacccugacggcggccgugcugaugcuggucgcucacuacgcuaucaucggccccggguuacaggcgaaggcgacacgagaggcccagaagcgcaccgccgcuggaauuaugaagaacccaaccgucgacgggaucguggccauagaucuagaccccguagucuacgacgcgaaauucgaaaagcaacugggccagaucauguugcugauccuaugcacaucacagauccuccuaaugagaaccacaugggcccugugcgagagcauuacccucgccacgggcccucugaccaccuuaugggaaggguccccuggcaaguucuggaauaccacaaucgcagugucgauggcgaacaucuuccgagggagcuaucuagcgggcgccggccuggccuucucccugaugaaguccuuaggaggcgggcgccgcggcacgggggcccaaggcgagacgcugggcgagaaguggaagagacaacuaaaucagcucuccaagucggaauuuaacacauacaaaagauccgggaucauggaagucgaccggucggaggcaaaggagggacugaagcgcggagagacgaccaagcacgccgugagccgugggaccgcgaagcugcgcugguucguggagcgaaaucucgucaagccggaggggaagguaauugaccuggguugcggucgcggcggguggagcuacuacugugccgggcugaagaaggugaccgaggucaagggauacacgaagggcgggccgggacacgaggagcccauacccauggcaaccuacggauggaaccuaguuaagcuccacuccgguaaggacguguuuuucacacccccugaaaagugcgacacccuccugugcgacaucggggaaagcuccccaaaccccacgauugaggagggccgcacgcucagggugcugaagaugguggagcccuggcugcgagggaaccaguucugcaucaagauccugaaucccuacaugcccagcguggucgagaccuuggaacagaugcagcgaaagcacggugggaugcuugugagaaacccgcuaucccgaaacagcacccacgagauguacuggguuuccugcgggaccggcaacaucgugagcgcgguaaacaugacgagccgcaugcugcugaacagguucacgauggcgcaccgcaagccgacuuaugagcgagacguagaccucggagcaggcacccggcacgucgccguggaaccagagguagcaaaccuggacaucauuggccaacgaaucgagaauaucaaacacgagcacaagagcacuuggcacuaugacgaagauaacccguauaagacuugggcguaucacggguccuaugaggucaaaccuagcggaucagccuccaguauggugaacggcguagugaagcuguuaaccaagccgugggacguuauccccaugguuacccagaucgccaugacggacaccaccccauucggacagcagagaguguucaaggaaaagguggacacccgcacgcccaaggcuaagcgcgggaccgcccaaaucauggaagucaccgcgaaauggcuguggggcuuccuguccaggaacaagaagccgcggaucugcacccgggaagaguucacgcgaaaagugcggaguaacgccgccaucggcgccguguucgucgacgaaaaucaguggaacuccgcgaaggaggccguggaagacgagcguuucugggaccuaguccacagagagcgggagcugcacaagcagggaaagugcgcgaccugcgucuacaauaugaugggaaagagggagaagaaguuaggagaguuugggaaggccaaggggucucgggcuaucugguacauguggcucggcgcucgcuuucuugaguucgaggcccugggcuucaugaacgaggaucacugguucucccgggaaaacagccucuccgggguggagggcgaggguuugcacaaacugggcuacauccuccgugacauuucaaaaaucccagggggcaacauguaugccgacgacaccgccggaugggacacccggauaacggaggacgaccugcagaacgaggccaagaucaccgacauuauggagcccgaacaugcuuugcucgccaaguccauauucaagcucaccuaccagaacaaggugguccgcguacagcguccggccaagaacgggaccgugauggacgucaucagucgccgcgaccagcgggguuccggucaagucggcaccuacggccugaauaccuucaccaacauggaagcacaguuaauccgccagauggagagcgaggggauuuucucccccucagaguuggagaccccaaaccuggccggcaggguguuggacuggcuggaaaagcauggggucgagcgccugaagcguauggcgaucuccggagacgacugcguggugaagcccaucgacgaucgcuucgcuacagcgcucacggcacugaacgacaugggaaaggucagaaaggacaucccgcagugggaaccuucaaaaggcuggaacgacuggcagcagguuccuuuuugcagccaccacuuccaucagcugauuaugaaggacggccgcgagaucgugguccccugcagaaaucaggacgagcucguggggcgcgcucgcguaagccagggcgcgggguggucauuacgugagaccgcgugccuugggaagucuuacgcacagauguggcaguugauguacuuccaccggcgcgaccugcgacuggcagcgaacgccaucuguagcgcagucccuguggacugggugccaacuagcaggacgaccuggagcauccacgcccaccaccaguggaugaccacugaggauaugcuaucggucuggaacagaguguggaucgaggagaauccuuggauggaggacaagacgcacaucagcuccuggggcgacgugccuuaucucggcaagcgcgaagaccaguggugcggcagccugauagggcucaccgcccgggcuaccugggccaccaauauccaggucgcuaucaaccaagugcgccgucugaucggcaacgagaacuaccuggacuauaugaccaguaugaagcgguuuaagaacgagagugacccggagggcgccuuaugguga

SEQ ID NO: 24554 - RNA, 9879 nt, Artificial Sequence
  derived and/or modified CDS sequence (opt11) from DENV-1__EU482821__SS-prME
agcguuaccaugcuguugaugcugaugcccaccgcccuggcauuccaccucaccacacgggguggggagccccauaugaucgugagcaaacaagagcguggcaagagccugcuguucaagaccucggcuggcgugaacaugugcacccucauugcgauggaccucggcgagcugugcgaggacaccaugacauacaagugcccccgcaucacagagacggagccggaugacguugacuguuggugcaacgccacggacacuugggucaccuacgggaccugcagccaaaccggggagcaccgacgcgauaagagguccguggcccuagccccccacgugggacuagggcuggagaccagaaccgagacguggaugucauccgagggcgcguggaagcaaauacaacggguggaaacaugggcccuccgccaccccggguucaccguaaucgcacuguuccuggcccacgcaauaggcaccuccaucacucagaaggggauaauauuuauccuccugaugcuggucacgcccuccauggcuaugcggugcgugggcauaggcaaccgcgauuucgucgaggggcucuccggcgccaccuggguugacguagugcuggaacacgguucuugcgugaccaccauggccaaggauaaaccaacgcuagacaucgagcuucugaagaccgagguaacuaacccugccguccuacggaagcucugcaucgaggcgaaaauuaguaacaccacuaccgacucacgcugcccaacccagggugaagccacucugguugaggagcaggaugcaaauuuugucugccggcgcacuuucguagaccgggguugggggaacgggugcgggcuguucggaaaagggagccucauuacgugugccaaguuuaagugcguaacgaagcuggagggcaagauuguccaauacgagaaccugaaguacucagugauagugacuguccacaccggagaccagcaccagguggguaaugagagcaccgagcacggcaccacggccacaaucacaccccaggccccuacgaccgagauccaacucaccgacuacggugcccuaacgcuggauuguagcccccggaccggccucgacuuuaacgagaugguccuguugaccaugaaagagaagucguggcucguccacaagcaaugguuccuggaccugccccuucccuggacguccggcgccuccacgagccaggagaccuggaaccggcaggaccugcuggugacuuuuaagaccgcacacgcuaagaagcaggaggucgugguuuuaggcucccaggaaggugcgaugcauacggcccugacgggggccacggaaauccagacgagcggcacgaccaccauuuuugcggggcaucuuaaguguaggcucaaaauggacaagcuaacccugaaaggcaugagcuaugugaugugcacgggcuccuucaaacuugaaaaagaggucgcugagacgcagcaugggaccgugcuggugcagaucaaauacgaaggcacugaugcgcccugcaagaucccguuuuccacgcaagacgagaaaggggugacccagaacggacgguuaauaacugccaauccgauuguuaccgacaaggaaaagccgguaaacaucgaggccgaaccgccguuuggggaaucuuacaucgugaucggcgcaggcgaaaaggcccugaagcuuuccugguucaagaaagguucuuccaucggcaaaauguucgaagccacagccagaggggcucggcgcauggcaauccuuggugauaccgcgugggauuuugggagcaucgggggcguauucaccuccgucgggaagcuugugcaccaaaucuucgggaccgcauacgggguccucuucagcgguguaucauggacaaugaaaaucgggaucggcguccuguuaacauggcugggccuuaacucccgaucaacaucccuguccaugaccuguauugccguggggcucguaacacuguaccuuggagucaugguucaggcggacagcgguugcguuaucaacuggaagggccgggagcuuaaaugcgggaguggcauuuucgugaccaaugaagugcacaccuggaccgaacaguacaaauuccaggccgacagcccaaagcggcugagcgcggcuauaggcaaggccugggaagaggggguaugcggaaucagaucagcuacccgccuggagaauauuauguggaagcagaucaguaacgagcucaaccacauccuauuagaaaacgauaugaaguucaccguggugguaggugacguggccggcauccucgcccaggggaaaaaaaugauccggccccaacccauggaguacaaauacucauggaaguccuggggcaaagccaagaucaucggcgccgacgugcagaacaccacauucaucaucgauggccccaauaccccggagugcccugacgaccagcgcgccuggaacauuugggaggucgaggauuacggcuuugggaucuucacgaccaacauauggcugaaacugcgggacuccuauacccagguaugcgaccaccgccucaugagcgccgccaucaaggacuccaaggccgugcaugcagacaugggcuacuggaucgaaagcgagaagaacgagacguggaagcuggcccgggcgucguucauugaggucaagacaugcaucuggcccaagagccauacccugugguccaauggcguguuggagucggaaaugauuauccccaagaucuacgggggcccgaucucacaacacaacuacagacccggguacuuuacacaaaccgccggccccuggcacuuggggaaguuagagcucgacuucgaccugugcgagggcacaacggugguuguggacgagcacugcgguaaccgggggccgagccugcguaccacgacggugacuggcaagauaauccacgaauggugcugccggucguguacccugccaccccuccgcuuccgcggggaggacggcugcugguacgggauggagaucaggcccgucaaggagaaggaagagaacuuagucaagagcaugguguccgcaggcagcggcgaggucgacucguucucauuggggcugcugugcaucucaaucaugaucgaagaagugaugcguucucgcuggagccggaagaugcucaugacagggacgcuggcgguguuuuuuuuacucauuauggggcaacuaaccuggaacgaccugauccggcugugcauuauggucggcgccaacgcuucugaccgcauggggauggggaccaccuacuuagcccugauggcaaccuucaaaaugcggcccauguucgccgucggacuguuguuccgacggcugacgagccgcgaggugcuacugcugaccaucggguuguccuuagucgccagcguugagcugcccaacucccuugaggagcugggcgacggccuggcgaugggcaucaugauccucaagcugcugacugauuuccagucucaccaguugugggccacacuguugucacucacuuuuaucaaaacaaccuucucucugcauuacgccuggaagacgauggccaugguccuguccaucguguccuuauucccucugugccugucgaccacaagccaaaagaccacuuggcuccccgugcuguuagguucccucggcugcaagccccuaaccauguuucugauugcggagaacaagaucuggggucggcgcaguuggccccucaaugagggcaucauggccgucggcaucgugaguauacugcugagcucccuccugaagaaugacguuccccucgcugggccccucaucgccgggggaaugcugaucgcauguuacgucaucagcggaagcucugcggaccugucucucgaaaaggccgcagaggugucaugggaggaggaggccgagcacucaggcgcgucccacaacauccugguagagguccaggacgauggcaccaugaagaucaaggacgaggagcgggaugacacccugaccauacucuuaaaagcaacgcuccuagccgugucgggcguguauccguugagcaucccugccacucuguucgucugguacuucuggcaaaagaaaaagcagcggagcggugugcucugggauacgcccuccccgccggaggugggccgggccgugcuggaugacgggaucuaccgcauaaugcagcggggguuacugggcaggagccagguggggguaggugucuuccaggaaaauguguuccacaccauguggcacguuacgcgcggggcuguccuaauguaccagggaaagcgccuggagccuuccugggcuucuguaaagaaggaccuaaucuccuauggagggggguggcgguuacaggggagcuggaauaccggugaggagguacagguaaucgccguggagcccgggaaaaacccuaagaacgugcagacagcucccgguaccuuuaaaacuccggaaggugagguuggggcaaucgcccuggacuucaagccaggcacauccgggucacccauugucaaucgagaaggaaagaucgugggccuguacgggaacggcgucgugaccacgucugggacguauguauccgcuauagcacaggccaaagcuucucaagagggcccguugccugagauugaggacgagguguucaggaagcguaaccugaccauaauggaccugcaccccggguccggaaagacccggcguuaccucccagcaaucgugcgggaggccaucaaaagaaaacuacgcacccugauuuuagcccccacgcgagugguugccagcgagauggccgaagccuugaaggguaugccaauccgauaccagaccacggccguuaagagugaacacaccgggaaggagaucguggaucuaaugugccacgccacguucacuaugcgucuacugucgcccgugcgcgugccuaacuauaauaugaucauaauggacgaggcacauuucacagaccccuccagcaucgcagcgcggggauacaucucaacccgcgucgguaugggcgaggccgccgccauuuucaugacggcaacgccucccgggagcgucgaggcguucccgcaguccaacgccguaauccaggacgaggaaagagacauacccgagaggagcuggaacuccgguuacgaauggauaacagacuuucccggcaaaacugugugguuuguaccgucaaucaaguccgggaacgacaucgccaacugcuuacgaaagaaugguaagcgagucauccaacucucccggaagacguuugacaccgaguaccagaagacgaaaaacaacgauugggauuacguugugaccacggacauuucugagaugggggccaauuucagagcggaccgaguaauagacccccgucgaugccuaaagcccgugauccugaaggaugggcccgaacgggucauucucgccgguccgaugccggugaccgucgcgucugcagcucagcguagaggaagaaucgggcgcaaccacaacaaagagggggaccaguacauuuacaugggccagccccugaauaacgacgaagaccaugcgcacuggaccgaggcaaagaugcuacucgacaacauuaacacaccugaggggaucaucccugccuuguucgagccggagcgagagaagagcgcggcaaucgacggggaauaccggcuacguggggaagcacggaaaacuuucguggagcucaugaggcguggggaucugcccguuuggcucagcuauaaggucgcuucagagggcuuccaguauagcgaccgccgguggugcuucgauggggaaaggaacaaucaggugcucgaagagaacauggacgucgagaucuggaccaaggaaggcgagagaaagaaacugcgcccgagaugguuggacgccaggaccuacagcgacccacucgcccucagggaauucaaggaguucgccgcggggcgccgguccgucaguggcgaccugauccucgaaaucgguaaguuaccgcagcaccugacccagcgcgcacagaacgccuuagacaaucuggugaugcugcacaacuccgagcagggaggccgcgccuaccgccacgccauggaggagcuucccgauacgaucgaaacucugaugcugcuggcccugaucgccguccugaccgggggcgucacccuauuuuuccugucaggacggggucugggcaagacguccaucggguuacuuugcgugauggcuagcuccgugcugcuuuggauggccucuguugagccccauuggaucgcggcuuccaucauacuggaguucuuccucaugguucuacugauacccgagccagaccgccagcggacgccccaagacaaccaguuggcguacguggugaucggccuacuguucaugauccuaaccguugccgccaaugagauggggcucuuagaaaccaccaagaaggaucugggcauaggccauguugcggucgagaaccaccaccacgccgccaugcucgaugucgaccuacaccccgccucggcguggacgcuauacgcuguggccaccaccaucauuaccccgaugaugcgccacacgaucgaaaacacaaccgccaacaucucucugaccgccauugcaaaccaagcggcgauccugaugggccuggacaagggauggcccauaagcaagauggauaucggugucccgcuccuggcacugggcugcuacucccaggugaacccgcucacgcugaccgccgcagugcugaugcuggucgcccacuacgccaucaucgggccgggacuucaagcaaaggccacccgcgaggcgcagaagcggacugccgccgggaucaugaagaacccgacgguggacgggaucguggcgauagacuuagacccagucguguacgacgccaaguucgaaaagcagcuaggccaaauaauguugcuuauccucugcacaucucagauccugcugaugcgcaccaccugggcguuaugugaguccaucacguuagccacggggccccugaccacacucugggagggaagcccggggaaguucuggaacacgacaaucgcaguguccauggccaacaucuuccggggaagcuaucuugcgggcgcggggcuggcguucucccugaugaagucccugggcgggggcaggcgggggaccggcgcucagggcgagacccugggggagaaguggaagcgccaacucaaccagcugagcaaaagcgaguuuaauacuuauaagaggagcggcaucauggagguagacagguccgaggccaaagaggggcugaaacgaggcgagacuaccaagcacgcggucagccgggggacggcaaagcuccggugguuuguggagcguaaucuggucaaacccgagggcaaggugaucgaccucggaugcgggaggggcgggugguccuacuauugcgccggccugaagaagguuacugaggucaaaggguacacgaagggcggcccagggcacgaggagcccauaccgauggccaccuacggcuggaaucucguaaaacugcacagcgggaaggauguguucuucaucccgcccgagaagugcgacacuuugcucugcgacauaggggagucgucucccaacccgacaauugaggaggggcgcacacugagggugcucaaaaugguugagcccuggcuccgcgggaaccaguucugcaucaaaauucugaacccuuauaugccguccgugguugaaacccuugagcagaugcagcggaagcacggcgggaugcuggugcgcaacccacucagccggaacagcacccacgagauguacuggguuagcugcggcacggggaacaucguguccgcuguuaacaugacuagccguaugcuacucaaucgcuucaccauggcgcaccgcaaacccacauacgagagggacguggaccuuggcgccgggacccggcauguggccguggaacccgagguggccaaccuggacaucauuggacagcgaauugagaacaucaagcacgagcacaaguccacguggcauuacgaugaggauaaccccuacaagaccugggccuaccauggcagcuacgaggucaaaccaagcgggagcgccuccagcauggugaacggcgucgugaaacucuuaacgaagcccugggacgucauuccgauggucacgcaaaucgccaugacggacaccacuccauucgggcagcagcguguguucaaggagaagguggacaccaggaccccgaaggcuaagcggggcacggcccagaucauggaaguaacagccaaauggcuguggggcuuccucucacgcaacaagaagccccggauuugcacacgcgaagaguuuacacggaagguucgcucaaacgcggcgaucggggccguguucguagaugagaaccaguggaacagugccaaggaggccguggaagacgagcgguucugggaccucgugcaccgcgagagagaguuacacaagcaaggaaagugcgcgacgugcguguacaauaugauggggaagagggagaagaaacucggggaauuugggaaagcuaaaggcagcagggccauaugguacauguggcucggagccagguuccuggaguucgaggcgcuaggcuucaugaacgaggaccacugguucucucgggagaauucccuaagcgggguggagggggaggggcuccacaagcucggguacauccugagagauauauccaacauccccggcggaaacauguacgcggacgacaccgcugggugggacacccgcauuacggaggacgaucugcaaaaugaggccagaaucaccgacaucauggaaccagagcacgcacuccuggcuaagagcaucuucaagcuuaccuaccagaauaaggugguccgugugcagaggcccgccaaaaauggcacggugauggacgucaucucucgccgggaccagagaggaucgggccaggugggaacguacgggcucaacacuuuuacgaacauggaggcacagcugaucagacaaauggaguccgaggggauauucucacccuccgagcuugagaccccaaaccucgccgagcgcguguuagauuggcuggaaaaguacgggguugagagauuaaaacgcauggccauuagcggcgaugacuguguugugaagccaauugaugaccguuucgcgacggccuugacggcgcuuaacgauauggguaagguccgcaaagacaucccccagugggaacccucaaagggcuggaacgacuggcagcaggugccuuuuugcagccaccacuuccaccaguugaucaugaaagauggccgugagaucguagugccgugucgcaaccaggacgagcucguagggcgggcucgcgugagucaaggcgccggguggagucugcgggaaaccgcuugccucggcaagagcuacgcccagauguggcagcugauguauuuccaucggcgggaccugcgucuggcagccaacgcgaucugcuccgccguccccguggacuggauccccaccucucggacgaccugguccauccaugcucaccaucaauggaugacuaccgaggauaugcuguccgucuggaacagggucuggaucgaggagaaccccuggauggaagacaaaacgcacauaucguccuggggcgacgucccguaccuaggcaaacgcgaggaccaguggugcggcuccuugaucgggcuaacugcgcgcgccaccugggcaaccaacauccagguggcaaucaaccaggucaggcgucugaucggcaacgagaacuaccuggacuauaugacgucgaugaagcgauuuaagaaugagucugaccccgagggggcgcugugguaa

SEQ ID NO: 24555 - RNA, 9879 nt, Artificial Sequence
  derived and/or modified CDS sequence (opt11) from DENV-1__EU482822__SS-prME
uccguuacaauguuauuaaugcuaaugcccaccgcacuggccuuccaccucacaacccggggcggggagccccacaugauagugacgaagcaggagcguggcaagucacugcuguucaagacgucggccggggugaacaugugcacccucauugcuauggaucugggcgaacuuugugaggauaccaugaccuacaaauguccccggauuacugaggccgagccggacgacguggacugcuggugcaaugccacggauacaugggugaccuacgggacaugcucucagacaggcgagcaccggcgcgacaagcggagcguggcccuugcgccccacgugggccuggggcuugaaacccgcaccgagacguggaugucuagcgagggcgccuggaagcaaauccagcggguugagacgugggcucucaggcaccccggguucacggugaucgcccuguuccuggcgcaugcuaucggcaccuccauaacucagaaggggaucaucuucauccuccugaugcuuguuacacccagcauggccaugcggugcgucgggaucggcucccgcgacuuuguggaggggcucagcggcgcuaccugggucgauguugugcuugaacacggcuccugcgugacgacaauggcgaaggauaagccgacacuggacauagaacuccugaagaccgaggugaccaaccccgcgauucuacguaagcugugcaucgaggccaaaaucuccaacaccacgacagauucccgcugccccacacaaggcgaggccacccuuauggaggagcaggacgccaacuucgugugccggcgcacguucguggaccgcggcugggggaacgguugugggcuauucggcaaagggucgcucaucacgugcgcuaaguucaaaugcguuaccaaacuagagggcaagauaguacaguacgaaaaccugaaguacuccgugaucgucacaguacacacgggggaccaacaccaggugggaaacgaaagcacggagcacgguaccaccgcuacuaucacgccccaggcaccgacuuccgaaauucagcucaccgacuauggggcccugacccuggacugcucuccccgaacgggccucgacuucaacgaaaugguccugcugaccaugaaagagaagucguggcuggugcacaagcagugguuucuggaucugccgcugcccuggacgagcggggcuagcaccagucaggaaaccuggaacagacaggaccugcuugucaccuucaagaccgcccaugccaagaaacaggaggucguggugcucggcucacaagagggcgccaugcacacagcccugacuggggcuacugagauccagaccuccggcaccacuacgauauucgcugggcaucuaaagugccgccuuaagauggacaaguugacccugaagggcaugucauaugugauguguaccggguccuucaagcucgagaaggagguggcggagacgcagcauggcacgguccugguucaaaucaaguacgaaggcaccgacgcacccugcaagaucccauucucaacucaagaugaaaaggggguaacgcaaaacggccgccugauuaccgcgaacccgaucgucaccgacaaggagaaacccgugaacaucgaggcagagccgccauucggggaguccuacaucgugaucggcgcgggcgagaaggccuugaaacucagcugguucaagaagggguccagcaucggcaagauguucgaggccacugcgcggggcgcucggcggauggcgauccugggcgacacggccugggacuucggcuccauuggcggggucuucaccagcaucgggaaguuagugcaccagaucuucgguaccgccuacgggguccuguucuccggcgucagcuggaccaugaagaucggaauuggcguguugcugacguggcucgggcugaacagucgcagcacgaguuugagcaugacuugcaucgcugucgggcucgucacccuguaccugggcgugauggugcaagcugacuccgggugcgucaucaacuggaagggccgugagcugaaaugcgggagcggcaucuuugucacgaacgaagugcacaccuggacugagcaguacaaguuccaagcggacucaccgaagcgcuuguccgccgccauaggcaaggcaugggaggaaggugucuguggcauccggagcgcuacccggcucgagaacauaauguggaagcaaaucaguaacgaauugaaccacauccugcuagaaaaugacaugaaguucacugugguuguaggggacguggugggcaucuuagcgcaggggaaaaagaugauucggccacagcccauggagcacaaauauagcuggaaguccuggggcaaggccaagauuaucggagcagacguccagaacacgaccuucauaaucgacgggcccaacaccccagaaugccccgaugaccagcgcgccuggaacauaugggagguugaagacuacggcuucgggauauucaccacaaacauuuggcugaagaugcgggacucguacacgcaagugugcgaccacagguuaaugucagcggccaucaaggauagcaaagccgugcacgccgauaugggcuacuggaucgaguccgaaaagaacgagacguggaagcuagcccgggcgucuuucauagaggugaagacguguauuuggcccaagucacauacucuguggagcaacggcgugcuggagagcgagaugaucauccccaagauuuacgggggcccuaucucgcagcacaacuaucgcccaggguacuucacccaaaccgccggcccauggcaucucgggaaacuggagcuggacuucgaccuaugcgagggaaccacggucgugguugacgagcacuguggcaaccgggggccuucccugcguaccaccaccgucacggguaaaauuauccacgaguggugcugccggucuuguacccugccgccccuccgcuucaaaggcgaggacggcugcugguacgggauggagauccggccagugaaggagaaggaagagaaucuggucaagucgauggucucggccggcagcggcgaggucgacuccuucagccuggggcucuugugcaucuccaucaugauagaggaggugaugcgcagccgguggagucgcaagauguugaugacuggaacgcuagccguguuucugcuccucauaaugggucagcuaacguggaacgaccugauccgucucugcauuauggugggcgccaacgcaagcgaccgcauggggaugggcaccaccuaccuugcccugauggccacauucaagaugcgcccgauguucgccgugggacuccuguuccggcgucugacgucccgggagguccucuuacugaccauuggccuaagccugguggccuccguggaacugcccaacagccuagaggagcuaggagaugggcuagcgauggggaucaugauccugaagcugcugacggacuuucaaucgcaccagcucugggcuacccugcugagccugacuuucaucaagacuacuuuguccuugcauuacgccuggaagaccauggccaugguacucagcaucgucucucuuaucccccuuugccucagcacgaccucccagaagacgacguggcugcccguccuacucggcagccugggguguaagccguuaacgauguuccucaucgcggagaacaaaauauggggccguaaguccuggccccugaacgaggggauaauggccgugggcgucgucucuauccucuuaagcucacuacugaagaacgacgugccccucgccggaccccugauagccggaggcaugcuuauugccugcuacgugaucucggggaguucggccgaccucagccuggagaaggcugcugaggucagcugggaggaggaggccgagcauucgggcgcuagccacuccauccugguagagguccaggacgacggcaccaugaaaaucaaggaugaggagcgggacgacaccuugaccauacuccugaaagcuaccuugcuggccguaagcggcguguauccguuauccauacccgccacccucuucgugugguacuucuggcagaaaaagaaacagcgcucagggguccugugggacacccccagcccacccgagguggagagagcagugcuggacgacggcauauaccgcaucaugcagcggggccugcucggccggucucaagucggcguggggguguuucaggagaacguguuucauaccauguggcacguuacacgcggugccgugcuuauguaucagggcaagcgacuggagcccagcugggcgagcgugaagaaggaccucauaucauacgggggcgguuggcggcuccagggcagcuggaacacaggggaggagguccaggugauugccgucgagcccggaaagaaccccaaaaacgugcaaacggcucccgggaccuucaagaccccggaaggcgaggugggcgccaucgcccuggauuucaagcccgggacguccggcagucccauagucaaccgcgaggggaaaaucgugggccucuacggcaacggggugguuacgaccucggggaccuauguauccgccaucgcgcaagccaaggccagucaggaggggccccucccagagauagaggacgagguguuccggaagcgcaaccugaccaucauggaccuccacccgggcucagggaaaacucguagguaccugccggcaaucguccgcgaggccaucaagagaaagcugcggacccugauauuagccccgacucgcgugguggcuagcgagauggccgaagcgcuaaaggggaugccuauacgcuaccagacgaccgccgucaaguccgagcacaccggcaaggagaucguggaccuaaugugucacgccaccuuuacgaugagacugcucagccccgugcgcgucccuaacuacaacaugaucauuauggacgaggcccauuuuaccgacccuuccagcauagcugcgcguggguacaucaguacccgcguugguaugggggaggccgccgccaucuucaugaccgcaacaccgccggggagcgucgaggcguucccgcaguccaaugccgucauccaagacgaggaacgggauauccccgaacgaagcuggaacuccgguuacgaguggauaaccgauuucccuggcaagaccguaugguucgugccuaguauuaaguccggcaacgauauugccaacugccuccggaagaacgguaagcgcgucauacagcugagccggaagaccuucgacacugaguaccaaaagaccaaaaacaacgacugggacuauguugugaccaccgacaucuccgagaugggcgcaaacuuccgcgcggaccgggucauagacccgcgucggugccuaaagcccgugaucuuaaaagacgggcccgaacgggugauauuagccggcccgaugccggucaccguggccagcgcggcccagagaagaggccggauaggccguaaccacaacaaggaaggagaccaauacaucuacauggggcagccccugaacaacgacgaagaccacgcucacuggaccgaggccaagaugcuccuggacaacaucaauacccccgaaggaaucauccccgcccuguuugagccggagcgggagaagucagccgcaaucgauggggaauacaggcuaaggggagaggcgcggaagacguuugucgagcugaugcgcagaggggaccugcccguguggcucaguuacaagguggccucggagggcuuccaguacucugaccgccgguggugcuucgauggggagcggaauaaccagguccuggaagagaauauggacguggagaucuggacgaaggagggggagcggaagaagcugcgcccccggugguuagacgcacgcaccuacagcgacccgcucgcccugcgggaguucaaggaauuugccgcgggccgucgauccgugagcggggaccucauacuagagaucggcaaguuaccacagcaccucacccagcgcgcccagaaugcccucgacaacuuagucaugcuccacaauuccgagcagggagggcgggccuaucgccacgcaauggaggaacucccggauaccaucgagacgcugaugcuccuggcccugaucgccgugcucaccggcggggugacccucuucuuucugagcggccgggggcucgggaagacaucaaucggcuuauuaugcgucauggcaagcucagugcuucuguggauggccagcguggagccacacuggaucgcggcauccaucauccuggaguucuuucucaugguccugcugauccccgaaccggacagacagcgaacaccucaggauaaucaguuggccuacgucgugaucggccugcuguuuaugauauuaacugucgcugcaaacgagaugggccuguuagagacaaccaaaaaggaccucgggauaggccacguugcagucgagaaucaccaccacgcaaccauguuggaugucgaccugcaccccgccagcgccuggacgcucuacgcuguggcgaccacaaucauuaccccaaugaugcgccacacgauugaaaauaccacagccaacaucucccugacugccaucgcuaaccaggcagcgauccugaugggccucgacaagggcuggcccauaagcaagauggacauuggcgugccguuguuggcccucgggugcuacagucagguaaacccgcugacgcugaccgccgccgugcucauguugguggcgcacuacgccaucaucggccccgggcugcaggccaaagcgaccagggaagcccagaagcgcaccgcugccggcaucaugaagaaccccacugucgacgggaucguggcuaucgacuuagacccgguaguauacgaugccaaguucgagaagcaacugggccagaucaugcugcucauccugugcacaagccagauccugcuaaugcgcacgacaugggcgcugugugaguccaucacgcuggcgacaggcccccucaccacccucugggaagggagcccugguaaguucuggaacacgaccaucgccgugucaauggccaauauuuuccgggggagcuaccuggccggcgccggccucgcguucucucuuaugaagucccuugggggagggcgccgugggaccggggcccagggcgagacccugggcgagaaguggaagcgacagcugaaucagcugaguaagucggaguucaauaucuacaagcggagcgggaucauggagguggaccgcucugaggccaaggagggccucaagcgcggggagacgacgagacacgccgucagccggggcaccgcgaaacugcgcugguuuguggagcgcaaucuggugaagccggaggggaaggugaucgaccuggggugcggccgcggagggugguccuacuacugcgccggucucaagaaggugacugaggucaagggauacacgaagggugggccaggccacgaggagccgaucccgauggccacguacggguggaaccuggucaagcugcauagcggaaaggacguguucuucacgccuccagaaaagugcgacacccuacugugcgauaucggggaguccagccccaaccccacgaucgaggaggggaggacucugcgcgugcucaagauggucgagcccuggcugcgagggaaccaguucugcaucaagauccugaaccccuauaugcccuccguuguggagacccucgagcaaaugcagcgcaaacacggcggcaugcugguccggaacccccugagccgcaacuccacucacgagauguauugggugagcugcgggaccgguaacaucguauccgcggucaauaugacaucgcguaugcuccugaaccgcuuuaccauggcccaccgcaaacccacuuacgaaaaggacguggaucugggggcgggcaccagacacgucgcggucgagcccgagguugcgaaccucgacaucaucgggcaacgcauagagaacaucaaacacgagcacaaauccacuuggcacuacgacgaggacaauccauacaaaaccugggccuaucaugggagcuacgaagugaagccauccggcagcgccuccuccauggucaaugggguugucaagcugcugaccaagcccugggaugugauucccauggugacccagaucgcaaugacggauacgacccccuucggccagcaacgugucuuuaaagaaaagguggauacacgcacgcccaaagccaagcgggggaccgugcagaucauggaggucaccgccagguggcucuggggcuucuugagccggaauaagaagccccgcaucugcacccgcgaggaguucacccgcaaagugcggagcaaugcggccaucggcgcgguguucguugacgagaaccaauggaacagcgcaaaggaggcaguugaggacgagcgcuucugggacuuggugaagaaggaacgggagcuccacaagcaggggaagugugcaaccugcgucuacaacaugaugggcaagcgugagaagaagcugggggaguuuggcaaggcuaaggggucgcgugcuaucugguacaugugguuaggggcccgcuuucuugaguuugaggcccucggcuucaugaacgaggaccacugguucagccgggaaaacucccugagcggcgucgaaggcgaggggcuccacaagcugggcuacauccugcgugacaucaguaagaucccagggggcaacauguacgccgacgacacagcgggcugggacacccggaucacggaggacgaccuccagaacgaggccaagauuacugauaucauggagccggaacacgcccuccuggcuaccucaaucuucaaacucaccuaccaaaacaaaguggugcgcgugcagcggcccgccaaaaacgggacggugauggacgucauaucccgccgcgaccagcgggguucaggucagguuggaaccuacggccugaacacguucacaaacauggaggcgcagcugauucgucagauggaguccgaggggaucuuccugccaucugagcuggaaacucccaaccucgccgagcgggugcucgacuggcuggagaaguacggcguagaacgccugaagcguauggcaaucuccggggacgacugcguggugaagccgaucgacgacagguucgccaccgcccucacggcacuuaacgacaugggcaagguccgaaaggacaucccgcagugggagccgagcaagggguggaacgacuggcagcagguucccuucuguagucaccauuuccaucagcugauuaugaaagauggccgcgagaucguggucccgugccggaaccaggacgaacucgugggccgggcacggguuagccagggggccggcuggagcuuacgggagaccgcaugccuggggaaguccuaugcccagauguggcagcucauguacuuccaccggcgggaccuaagauuagcugcgaacgccaucugcagcgcaguucccgucgacugggugccaacgucccguaccaccuggagcauacacgcucaccaccaguggaugaccacggaggacaugcuguccgucuggaaccggguguggaucgaagaaaaccccuggauggaggacaagacgcacgugucuuccuggggcgacgucccguaccuggguaagcgcgaggaccaauggugcggcagccugaucggccucaccgccagggcuaccugggccuccaacauccagguggcgaucaaccaggugagacgauuaaucgggaacgagaacuaccuggacuacaugaccagcaugaagcgguucaagaacgagggcgaccccgagggggcguuaugguga

SEQ ID NO: 24556 - RNA, 9879 nt, Artificial Sequence
  derived and/or modified CDS sequence (opt11) from DENV-1__EU482476__SS-prME
agcguuacaaugcuacucaugcugaugcccaccgccuuggccuuccaccuaaccacacggggcggggaaccccacaugaucgugaccaagcaggagcgggggaagagccugcuguucaaaaccucggcgggcgugaacauguguacccucauagcgauggaccugggagaacugugcgaggacaccaugacguauaagugcccacgcaucacugaggccgagccggacgacguggacugcugguguaacgcaacggauacaugggugacuuacgggaccugcagccagacaggcgagcaccggcgcgacaagaggagcguagcguuagcgccccacgugggcuuaggguuagaaaccagaacagagacguggaugagcagcgagggcgccuggaaacagauccagcggguagaaacgugggcauuacgucacccuggguucaccgugaucgcccuguuuuuagcccacgcgaucggcaccuccaucacccagaaggggaucauuuuuauccuucucaugcuggugacuccuuccauggcuaugcgaugcguugguaucgguagccgcgacuucguggagggacucagcggcgccaccugggucgacgugguucuggagcacggauccugcgugacgaccauggccaaggacaagcccacgcuggauaucgaguugcugaagacggaaguaaccaaccccgcaguacuccggaagcucugcaucgaggcgaagaucagcaacaccacuaccgacucacgcugcccaacccagggcgaggccacccugauggaggagcaggaugcaaacuuugugugucggcgcacguucgucgacagaggcugggggaacggcuguggguuauucggcaaaggcagccucaucacgugugccaaguucaaguguguaacaaagcuggaggggaagauuguucaguacgaaaaccugaaauauucugucaucguaaccgugcacacgggagaccagcaccaggucgguaacgagagcacagagcacggcacgacugcgacuaucacgccccaggccccgaccagugagauccagcuaaccgacuauggggcacuaacacuugacugcagcccccgaacaggccuagauuucaacgagauggugcugcugacgaugaaggaaaaauccuggcucguacacaagcagugguuucuggaucugccacuccccuggacaagcggugcgagcaccucccaggagacguggaaccggcaagaccuccuggugaccuucaagaccgcccacgcgaaaaaacaagaaguagucguguuaggaagccaggagggcgccaugcauaccgcucugaccggggcuaccgagauccaaaccuccggcacuacgacaaucuuugccgggcaccuuaagugucgccucaaaauggauaaacugacccuuaagggcaugagcuacgugaugugcaccggguccuuuaaacuugagaaggaggucgccgagacucaacacggcaccguucugguucagaucaaguacgaagggaccgacgcccccugcaaaauccccuucucuacgcaggaugagaagggcguaacucagaacggacguuugaucacugccaaucccaucgugaccgacaaggagaaaccugucaacaucgaggcggaaccgcccuucggggagucuuacaucgucauuggcgccggugagaaggcccuuaagcucaguugguucaagaaggggucgagcaucggcaagauguucgaggccaccgcccggggcgcccggaggauggcgauccugggcgauacggccugggauuucggcuccaucggcggcguguucaccagcguggguaagcugguccaccagaucuuuggcaccgcguaugggguucuguucucgggagugagcuggacaaugaagaucgggauuggcguccugcuaacuuggcuaggacugaauucacgcagcaccucacugagcaugaccugcauagcagugggguuggucacgcuauaucugggcguaauggugcaggcagauuccgggugcgugaucaacuggaagggccgggagcucaaaugcgggagcggcaucuucguuacaaacgaggugcacaccuggaccgagcaguacaaauuccaggcggacagcccgaagcgccuuuccgccgcuaucggaaaagccugggaggagggggugugcggcauccggagugcaacccgccuggaaaacaucauguggaagcagaucaguaacgaacucaaucacauccugcuggaaaacggaaugaaguucaccgucguggugggcgacgucguggggauccucgcucagggcaagaaaaugauccggccccagccaauggagcacaaauacucuuggaagucaugggguaaagccaaaaucaucggagccgacgugcagaacacgaccuucauaaucgacgguccgaacacccccgagugcccugacgaccaacgcgcuuggaacaucugggaggucgaggauuacggauuuggcaucuuuaccacaaauaucuggcugaagcugcgagauucauacacgcaggugugugaccaucggcucaugucugcggccaucaaggauucuaaggccgugcacgcugacauggguuacuggauugaguccgagaagaaugaaaccuggaaguuagcucgcgcgagcuucauugaggucaagaccuguaucuggcccaaaucacacacgcuauggagcaacggggugcucgagucggagaugaucauccccaaaaucuacggcgggccuaucagccagcacaacuaccgccccggauacuucacccagacggccgggcccuggcacuugggaaagcucgagcucgauuucgaucugugugaggguaccacggucguaguggacgagcacugcggcaaucgggguccgucguugaggacaacuaccgugacgggcaagauuauccacgaauggugcugcaggucuugcacccugccgccccuccgcuucaagggcgaggacgggugcugguacggcauggagauccggccggugaaggagaaggaggaaaaccuggugaagagcauggugagugccggcucaggugaggucgauucguucagccucggccuguuaugcaccuccaucaugaucgaggaggucaugcgcagccgcuggucccgcaagaugcuaaugaccgggacgcuggccguuuuccugcuccugaucauggggcaacugaccuggaacgacuuaauucggcucuguaucauggucggggccaaugcaagugauagaauggggaugggcaccaccuauuuggcccucauggccacuuucaagaugcgcccgauguucgcuguggggcugcuguuccgucgauugacgagucgugagguucugcugcucacgaucggauugagccuggucgccuccguggagcuaccuaauagccuggaggaacugggagacggccucgcgaugggaaucaugaucuuaaagcuacucaccgacuuccagucucaccagcugugggccacgcugcuuagucucaccuuuaucaagacaacauuaucccuccacuaugccuggaagacgauggccaugguccugagcauugugucccuguuucccuugugccucagcaccaccucccaaaagacuacguggcugccaguguugcuugggucccuuggaugcaagccgcuaacaauguuccugaucgcugagaauaagaucuggggccgcaaguccuggccccuaaacgagggcauuauggcaguagggguggugagcauacuccucagcucccugcucaagaaugacgucccccuggccgggccccuaaucgccggcgggauguugaucgccugcuacgugaucagcggcagcagcgcggaccuuucccuggaaaaggccgccgagguaagcugggaggaggaggcggaacacuccggggcgagccacaacauccucguagaagugcaggaugacggcaccaugaaaauuaaggacgaggaacgggacgauacccugacaauccugcucaaagcuacgcuguuagccgucucgggagucuacccacucucgauccccgccacccuuuucgugugguacuucuggcagaagaagaagcagcguuccggcgugcugugggacacgccgagcccccccgaagucgagcgggccguauuggacgacggcauuuaccgcaucaugcaacgggggcuccugggccggucccaggucggggucggcguguuucaagagaacgucuuccacaccauguggcacgugacgcgcggcgcgguguuaauguaccagggcaagaggcucgagcccagcugggcgucgguaaagaaggaucuuauuagcuauggcgggggcuggcggcuacagggguccuggaacaccggcgaggagguccaagugaucgcaguggagcccgggaagaaccccaaaaacguccagacagcaccuggcaccuucaagacacccgaaggcgaagugggggccaucgcacuggauuucaagcccggcacgucgggguccccaauugugaaccgugagggcaagauugucggccuuuacgggaauggcgucgugaccaccagcgggacguauguuagcgcgaucgcccaagccaaggcgucccaggagggcccccugccugagaucgaggaugagguguuccggaagcgcaaucucaccauaauggaccuucaucccgggagcggcaagacuaggcgcuaccucccggcaaucguccgggaagccauaaagcgcaaacuccgcacccugaucuuagccccgacucgcgucguggccuccgagauggccgaggcguuaaagggcaugcccauccgcuaccagacgacagcuguaaagagcgagcacaccgguaaggagauuguagacuuaaugugccacgcaacuuucacgaugcggcuguuaucccccgugcguguuccgaacuauaacaugaucauuauggacgaggcccacuuuaccgacccgucguccauagccgcgcggggcuacaucagcacucgagucgggaugggagaagcugcagccaucuucaugacugcuacucccccaggguccguagaggcguuuccgcagucuaacgccgugauccaggaugaggagcgcgacaucccggagcgcuccuggaacucugguuacgaauggaucaccgacuuccccggcaagaccgucugguuuguuccuuccauaaagagcgggaacgacauugccaacugcuuacggaaaaauggaaaacgugucauucaacucuccaggaagacguucgacacagaauaccaaaagaccaagaauaaugacugggauuauguaguuaccacugacauuuccgagaugggagccaacuuccgcgcggaccgggugaucgacccacgccgcugccuaaagcccgucauccucaaggacggacccgagagggugauccuggccggacccaugccggucacgguggcauccgcagcccagcgacgcggaaggaucggcagaaaccacaacaaggagggggaucaguacaucuacaugggccagcccuugaauaaugacgaggaccacgcgcacuggacugaggccaagaugcugcuggauaauauaaacacgcccgagggaaucauccccgcucucuucgagccggaacgggagaagagcgccgccauugacggugaauaccgccugcgcggggaggcccggaaaacauucguggagcuaaugcgccguggcgaccucccagucuggcuguccuacaagguggcuagcgagggcuuucaguauuccgauaggcgguggugcuuugauggggaacguaacaaccagguccuugaggaaaacauggacguggagaucuggaccaaagagggcgagcggaagaagcugagaccgcgguggcuggacgccaggaccuacuccgauccccuggcucucagggaauuuaaagaguucgccgcugggcgacggaguguguccggcgaccugauuuuggagaucggcaagcugccgcaacaccugacccaaagagcucaaaacgcccuggacaaccucgugaugcuacacaacagugagcagggaggaagggccuaucgccacgcaauggaagaacugcccgacacgaucgagacccucaugcugcuggcccucaucgcuguccugacagguggcgugacauuguuuuuccuuucuggucguggccuuggcaaaaccagcauugggcugcucugcgugauggccuccagcguccugcucuggauggcauccguagagccgcauuggaucgcggccagcaucauauuggaguucuuccugauggugcugcucauucccgaaccugacagacagcggacgccucaagacaaccagcuggcguacgugguuauuggacucuuauucaugauccucacaguggccgcaaaugagaugggucugcuugagacaaccaagaaggaccugggcaucggucacguagcgguugagaaccaccaccacgcgacgaugcuggacguggaccuccauccagcguccgcauggacccuuuacgccgucgcgaccaccauaaucacucccaugaugcgccacaccaucgagaacacgacugcaaacaucagccucacggccaucgccaaucaagccgcgauccucaugggccuggacaaaggguggccuaucucuaaaauggacaucggcgugccccugcuugccuugggcuguuacagccaggucaacccacuaacucuaacugcagccguccuaaugcugguggcgcacuaugcaauuauagggccggggcuccaggcgaaggccacgcgggaagcucagaagcgcacagccgccgggaucaugaaaaacccuaccguugauggcaucgucgcgauagaucuggacccaguuguguacgaugccaaguucgagaaacagcugggacagaucaugcuccugauccugugcaccucgcagauccuccugaugcgcaccacgugggccuuaugcgagagcauuacgcucgcgacaggcccucuuacuacccugugggagggcuccccgggaaaguucuggaacacuacgaucgccgucagcauggccaauaucuuccggggauccuaucucgccggggccggccuggccuucucccuaaugaagucgcucggcgggggccgccgggggacgggcgcacaaggcgagacacugggggaaaaguggaaacgccaguuaaaucagcucuccaagucugaauucaacaucuauaagagguccggcaucauggagguggaucgcagcgaggccaaggaagggcugaaacggggugagacaacccgccacgccgucagucgggggacggcgaagcugcgcugguucgucgagcggaaucucgugaagccggagggcaaagucaucgaucuuggcugcgggaggggcggguggagcuauuacugcgcagggcugaagaagguuacggaggugaagggguacacgaagggcggcccggggcacgaggagcccauaccgauggccacauacggguggaaccuggugaagcuucacagugguaaggacguguucuuuacgccgcccgagaagugcgacacgcuccugugcgacauaggcgagagcucccccaacccgaccaucgaggaaggacgcacgcuccgcgugcucaagaugguggaaccaugguuacgggguaaccaguucugcaucaagauucucaaucccuacaugcccagugucgucgaaacucuggagcagaugcagcgcaagcacggcgggaugcuggugcggaacccgcucagccgcaacucgacgcaugagauguauugggucucgugcggcacggggaauaucgugagcgcugugaauaugacaagccggaugcuacugaaucgcuucacaauggcccaccgcaagcccaccuacgagcgggaugucgacuugggagcgggcacgcgccacguagcaguagagcccgaagucgccaaccuggacaucauugggcagagaaucgagaauaucaagcacgaacacaagagcaccuggcacuacgaugaggauaaccccuauaagacuugggccuaucaugggucguaugaggugaagccgucggggucggcuagcagcauggucaacggggugguaaagcugcucaccaagcccugggacguuauccccaugguaacucagaucgcuaugaccgacacaacucccuucggucagcagcgcguuuucaaggaaaaggucgacacucggacuccgaaagcgaaacgaggcaccgcacaaauaauggaaguuacggccagguggcuguggggcuuccugucccgcaacaagaagccccggauaugcacgagagaggaguucacuagaaaggugcgcagcaacgccgcaaucggugccguauuugucgacgagaaccaguggaacucagccaaagaggccguggaagaugaacgauucugggaccucguccagaaagagagagaacuucacaagcaaggcaagugcgccaccugcguguacaauaugauggggaaacgggagaagaagcucggcgaguucgggaaggccaaaggcagccgcgcuaucugguacauguggcucggcgcccgguuccuugaauuugaggcucugggauuuaugaacgaggaccacugguuuucucgcgagaacagccucuccgggguagaaggggaaggccugcacaagcucggguacauacuaagagacaucagcaagauccccggcggcaacauguacgcggacgacaccgccgggugggacacgcgcaucaccgaggaugauuuacaaaacgaagccaaaaucaccgacaucauggaacccgagcacgccuugcucgccacuucuauauucaaacugacguaccaaaauaaggucgugcgaguccagcgcccugcgaaaaacggcacaguaauggacgugaucagucgccgggaucagagggggucugggcaaguuggcaccuaugggcugaacacuuucaccaacauggaagcacagcucauccggcagauggagagcgaaggcauauucuugcccuccgagcuggaaacgccgaaccucgccgagcgggugcuagacuggcuggagaaauacgggguggagcgacucaagcggauggccaucagcggcgacgacugcgugguaaagccuaucgacgaucgguucgccaccgcgcuggccgcguugaacgauaugggcaagguccgcaaggacauuccccagugggagcccuccaagggcuggaacgacuggcaacagguccccuucugcucucaucacuuccaccaguuaauaaugaaggacggcagagagaucgucgugccuugcaggaaccaggaugagcugguaggccgggcccgggucagucagggcgccggguggucucuccgggagaccgcguguuuggggaagagcuaugcacagauguggcagcugauguacuuccaccgccgggaccuacgccuagccgcuaacgcuaucugcucagcugugccaguagacuggguccccacgucccggaccacguggucgauccacgcgcaccaccaauggaugaccacggaagacaugcugagcguguggaaccgcguguggauugaggagaaucccuggauggaggauaaaacccacguauccuccuggggagacgucccguacuugggcaagcgggaggaccagugguguggcucacucaucggucugacugcgcgggcuaccugggcgucaaacauacagguggccauaaaccagguccgccgacuuaucggaaacgaaaacuauuuggacuacaugacgaguaugaagcgcuuuaagaacgagggagaccccgaaggagcccugugguag

SEQ ID NO: 24557 - RNA, 9879 nt, Artificial Sequence
  derived and/or modified CDS sequence (opt11) from DENV-1__EU482477__SS-prME
aguguuaccaugcugcugaugcuaaugcccaccgcccuggccuuccaucucacgaccagaggaggggaaccccauaugauagugucgaagcaggagaggggcaagagccugcuguucaagaccagcgcggggguuaacaugugcacccucaucgcgauggacuugggcgagcuaugcgaggacacaaugacguacaaaugcccccgcaucaccgaggcggagcccgacgacguggacugcuggugcaacgccacggacacguggguuaccuacgguaccugcucgcaaaccggcgagcaccggcgggacaagcgguccguggcccucgcgccccacgugggccuagggcuggagacgcgcaccgagaccuggauguccuccgagggcgccuggaagcagauccagcggguggagaccugggcccuccgccacccuggguuuaccgugauagcccuguuccuggcgcaugccaucggaaccagcaucacccagaaggggauuaucuucauccuucucaugcuggugacccccuccauggccaugcggugcgucggcaucggcagccgcgacuucguggaagggcucuccggcgccacuuggguggacgucgugcuggaacacggcagcugcgugaccacuauggcgaaggauaagcccacucuggacaucgaauugcuaaagacggaggucaccaaccccgcggugcuucggaagcuaugcaucgaggccaagaucuccaacacaaccacggacucgcguugcccuacccagggcgaagccacucugguggaggagcaggacgccaacuuugugugccgucgcaccuucguggacaggggcugggggaacggcugcggucuguucggcaagggaucccucaucacuugcgcaaaguucaagugcguaaccaagcuggagggcaagaucguccaguacgaaaaccucaaguauucugugaucgugaccguccacaccggcgaccagcaccagguggggaacgaguccaccgagcauggcaccaccgcgaccaucacaccccaggccccgucaacggagauacagcuuaccgacuacggggcccugacccuggacuguagcccaaggaccggacucgauuuuaacgagauggugcugcugacaaugaaggagaaguccuggcugguccauaaacaaugguuccuggaccucccguuacccuggaccucgggcgcguccaccagccaagagaccuggaaccggcaggaccuucugguaacuuucaagaccgcccacgcuaagaagcaggagguaguggugcucggaucucaagaaggcgcaaugcacaccgcgcugaccggggccacggagauccagacuagcggaacgaccacgaucuuugcggggcaucugaagugccgccucaagauggacaaacugacccuuaagggcauguccuacgucaugugcacagggagcuucaaacucgagaaggagguggcggagacccagcauggcaccgugcugguccagaucaaguacgaggggaccgacgcacccugcaaaauccccuucuccacucaggacgagaaaggggucacccagaacggccggcugaucacggccaacccgauugugaccgacaaggagaaacccgugaacauugaggccgaaccgccguucggggagucauacaucgugaucggcgccggugaaaaggcacugaaacuuuccugguucaaaaaggggagcuccaucgggaagauguuugaggcgaccgcccgcggggcccggcgcauggcgauccugggcgacacggcaugggacuucgguagcaucggcggcguguucacgagcgucgggaagcugguacaccagaucuucggcaccgcguauggggucuuauuuagcggcgugagcuggaccaugaagauagggaucggugugcugcugaccuggcugggccuuaacagccgcagcaccucucuguccaugacaugcaucgccguggggcuagugacucuguaccugggaguuauggugcaggccgacuccggcugcgucaucaacuggaagggcagggagcucaaaugcggguccgguauauucguuacgaacgaggugcacaccuggaccgaacaguacaaguuccaggcggacagcccgaagcggcuguccgccgcaaucggcaaggccugggaggagggggugugcggaauccgguccgccacccgccuggagaacaucauguggaagcaaauuuccaacgagcucaaccacauccugcuggagaacgacaugaaauucacaguuguggucggggacgucgcgggcauccuagcccaggggaagaagaugauccggccccagcccauggaguauaaguacuccuggaaguccuggggcaaggcaaagauaaucggcgccgaugugcagaauaccacuuucaucaucgacggaccuaacacucccgagugcccagacgaucagcgcgcguggaacauuugggagguggaggacuaugguuucgggauauucaccaccaacauauggcugaaacuccgggacuccuacacccaaguaugcgaucaccgccucaugucagccgccaucaaggacuccaaggccgugcaugcugacaugggcuacuggaucgaaagcgaaaagaacgagaccuggaagcuagcccgggccucuuucaucgaggucaagaccuguauuuggcccaagucccacacucuguggucaaacggcgugcucgagucagagaugaucaucccaaagauuuacggcgggccuauaucccagcacaacuacagacccgguuacuucacgcagaccgccggcccguggcaccuggggaagcuggagcucgacuucaaccugugcgaaggaacaacgguggucguggacgagcacugcggcaacagggguccgucccugcgcacaaccaccgugaccggcaagaucauccacgaauggugcugcagguccugcacacugccuccccucagguucaaaggggaggacggcugcugguacgggauggagauccggcccguaaaagagaaggaggagaaccuagucaagagcauggugagcgcggguuccggagaggucgacagcuuuuccuugggucuauuaugcaucagcaucaugaucgaagaggugaugcgcagucgguggucccggaagaugcucaugacagggaccuuggccguguucuuucuauuaaucaugggucagcugacauggaaugaccugaucagacucugcauaauggucggugccaacgccucggaucgcaugggcaugggcacgacguaccuggcacugauggccaccuucaagaugaggccgaugcuggcgguaggccugcuguuucggcgccucacaagccgggagguguugcuccuaacgauugggcugucccuggucgcgagcguggagcuuccuaauucccuggaggagcugggcgaugggcucgccaugggcaucaugauccugaagcugcugaccgacuuccagagccaccagcugugggccacccugcucuccuugaccuuuauuaagacgacuuacucacugcacuaugccuggaagaccauggcgaugguccucuccaucgugagcuuauucccccugugccucuccaccacuagccagaagaccaccuggcugcccguucugcugggaagucuugggugcaaaccacuaacgauguuccucaucgcggagaauaaaaucuggggccgcaagagcuggcccuuaaaugaggggaucauggccgucggcaucgucagcauccugcucuccagccugcuuaagaacgacguuccccucgccgggcccuuaaucgcaggaggcaugcugaucgcgugcuacgucaucucaggcagcuccgcggaccucucgcuggagaaggccgccgagguguccugggaagaggaggccgagcacagcggcgcgucccacaacaucuuaguggaaguccaggacgaugggacgaugaaaaucaaggacgaggagcgggaugacacucuuaccauacuguugaaggccacgcuccuggccgugagcggcguguacccacugucgauucccgccacacucuuugucugguacuucuggcagaagaagaagcagcgcagcggaguacucugggacacgcccagcccgcccgagguggagcgagccguccuugacgacggcaucuaccgcaucaugcagcggggccugcucgggcgcucucaggucggcguaggggucuuccaggaaaacguauuccacaccauguggcacgucacccggggcgcugucuugauguaccagggaaaaagguuagagcccucuugggccagcgugaagaaggaccugauaucuuacggcgguggguggaggcuccagggcucuuggaacaccggggaagaggugcaggucauagcaguggaacccggcaagaacccuaagaacgugcagacggccccugggaccuucaagaccuccgagggcgaggucggcgccauugcgcuugacuucaagcccgggacuagcggcagcccaauagucaaccgcgaggggaagauuguaggacucuacggcaacggggucgugaccacuuccggaaccuacgugucugccaucgcccaagcaaaggcgucacaagaagggccucugcccgagaucgagaaugaagucuuccggaagcgcaaucugaccaucauggaccuccacccugggucgggcaagacgcgaagguaucuacccgccaucgugcgggaggccauuaagcgcaaguugaggaccuugauccuggccccaacucgcguggucgccuccgagauggcggaggcccuuaagggcaugccuaucagguaccagacuaccgccgucaagucugagcacaccggcaaggagaucguggaucucaugugccacgccaccuuuacuaugcgguugcugucccccguccgagugcccaacuauaacaugaucaucauggacgaggcccacuucacggacccgagcagcaucgcugccagaggguacauuagcacccgcgugggcaugggggaggccgccgccaucuuuaugaccgcuacgccacccggguccguugaggccuucccccagagcaacgccgugauccaggaugaggagagagacaucccggagcgcuccuggaacagcggguacgaauggaucacagacuuucccgggaaaaccguuugguucgugcccuccaucaagagcggcaacgauaucgccaauugccuucggaagaacggaaagcgcguaauccagcugucccguaaaaccuucgacacagaauaccagaaaacgaagaauaaugacugggacuacguggucaccacugauauaagcgagaugggcgcgaacuuuagggccgacagagugaucgacccacgccggugccugaagccgguuauccucaaagacgggcccgaacgcgucauccuggcgggcccgaugcccgucaccgucgccuccgccgcgcagcggcgagggcggaucggccgcaaucacaacaaggagggggaccaguauaucuacauggggcagccucuuaacaacgacgaggaucacgcccacuggacugaggcaaagaugcuccuggauaacaucaauacccccgagggcaucaucccugcccuguucgagcccgagcgcgagaagagugccgcgaucgacggggaguaccgccuccguggugaggcucggaagaccuuuguggagcugaugcgccgcggggaccugccgguguggcugagcuauaaaguagccucugagggcuuccaguauucagaccgucgguggugcuucgauggagagcgaaacaaccagguguuagaggagaacauggacguggagauuuggacuaaggagggggagcggaagaagcugcgcccccgguggcuggacgcacgcacauacagugacccccuggcacugcgugaauuuaaagaguucgcagccggcaggaggagcgucuccggggacuuaauccuggagaucggaaagcugccccagcaccucacccaacgcgcccagaacgccuuagacaaccuagugaugcuccacaacucggagcagggaggacgggcguaccgccaugccauggaggagcucccggacaccaucgagacucugaugcuccuggcccucaucgccguacucacgggcgggguuacccuguucuuccuguccggccguggccucggcaagaccagcaucggccuucugugcguuauggccuccagcgugcuccuguggauggcuuccguggagccucacuggaucgccgccagcaucaucuuagaguuuuucuuaaugguacuccugauccccgagcccgacaggcagcggaccccgcaggacaaucaguuagccuacguggucaucggcuuacuguuuaugaucuugaccguggccgccaaugagaugggccugcuggagacgaccaagaaggaccucgggaucggccacguggccgucgaaaaccaccaccaugccgccaugcuggaugucgaccugcaccccgcuuccgcguggacccucuacgccguggccaccacgauuauaacccccaugaugcgccacaccaucgagaacacgacggccaacauuucccugacggccaucgcgaaccaggccgccauccuuauggggcucgacaagggcuggccaaucuccaagauggacaucggcguaccccuacuggccuuagggugcuacucccaggugaacccccugacccugaccgcggcagugcucaugcuggucgcccacuacgccaucauuggccccgggcugcaggcaaaggcgacgcgggaggcccagaagcgcaccgccgcgggcaucaugaagaaccccaccgucgacgguaucguggccaucgauuuagaccccguuguguaugacgcaaaauuugagaagcagcuggggcagaucaugcuccucauccuaugcaccucccagauacugcucaugcgcacgacaugggcccugugugaaucaaucacccuagccaccggcccccucacgacccugugggaagggucccccggcaaguucuggaacacaaccaucgcagugagcauggccaacaucuucagagggagcuaccuggcgggggcuggacucgccuucucuuuaaugaagucccucgggggagggcguaggggaacgggggcucaaggcgagacccuuggcgagaaauggaagcgccagcugaaccaacuguccaagagcgaguuuaacacuuacaagcgguccgggaucauggaggucgaucgcucggaagcgaaggagggccucaagagaggggagacaacgaagcaugccgugucccgcggcaccgccaagcugcggugguucguggagcgcaaucucgucaagccggaggggaagguaaucgaccuagggugcggccgcggcggguggagcuacuauugcgcagggcucaagaaggugacagaggucaaggguuacaccaagggcggaccgggccacgaggagcccauccccauggcgacguaugguuggaaucuuguaaaacugcauuccgguaaggacguguucuucaucccgcccgaaaagugugauacccuccuuugcgacaucggggaguccuccccuaacccgaccaucgaggagggcagaacccugcggguccucaaaaugguggagccguggcugcgcgggaaucaguucugcaucaagaucuuaaaccccuauaugcccagcgugguggagacuuuggagcagaugcagcggaaacacggaggcaugcuggugcguaacccgcugucccggaacagcacgcacgagauguacuggguguccugcgggacagggaacaucgucucagcugugaacaugacaucccgcaugcuccugaaccgguucacgauggcccaccgcaagccaacguacgagcgcgacguagacuugggagcaggcacccggcacgucgccguagagcccgaggucgcaaacuuagacauuaucggccaacgcauugagaacauaaagcacgaacacaagucgaccuggcacuacgaugaggauaaccccuacaagaccugggcguaccacggguccuaugaggugaagccgucaggcagcgccuccagcauggugaacggggucgugaagcugcuaacgaagccgugggacguaauuccgauggucacgcagaucgcgaugaccgauaccacgcccuucggccaacagcguguguucaaggaaaagguggacacccgaaccccaaaggccaagcggggaaccgcacaaaucauggagguaacggccaaguggcucuggggcuuccugucccgcaauaagaagccgcgaaucuguaccagagaggaguucacccggaagguucgcagcaaugccgccauaggcgcuguauucgucgacgaaaaccaguggaacuccgccaaggaggccguagaagacgagcgguucugggaucuggugcaccgcgaacgggagcuacacaagcaagggaagugcgcgaccugugucuacaacaugaugggcaagcgcgaaaagaaacugggggaguuugggaaggccaaggggagccgggcgaucugguacauguggcugggcgcgagguuucuagaguucgaggccuuaggcuucaugaacgaggaccacugguucucgcgggagaacagccugaguggggucgagggcgagggucugcacaaacugggguacauacugcgcgauaucagcaagauccccgggggaaauauguacgccgacgauacggccggcugggacacccggauaaccgaagacgaccugcagaacgaggccaaaauaaccgacaucauggagcccgagcacgcucugcuggccaaaaguaucuucaagcucacauaccagaacaaaguggugcgcgugcaacggccggcgaaaaauggcaccgugauggacgucaucagccggcgcgaccagcgaggcaguggccagguggggacauacggccuaaacaccuucacuaauauggaggcccagcugaucagacagauggaguccgaggguaucuucucccccagcgagcucgagaccccuaaccuugcaggcagggugcuggacuggcucgaaaagcacggggucgagcgauuaaagaggauggcgaucuccggcgacgauuguguggugaagcccaucgaugacagguuugccacggcccugacugcccucaacgacauggggaagguccggaaggauaucccgcagugggagcccagcaagggcuggaacgacuggcagcagguccccuucugcagccaccauuuccaccagcucaucaugaaggacggccgcgagaucguggucccuugccggaaccaggacgaacugguggggcgggcccgggugucccagggcgcgggguggagccuccgcgagacggcuugccuggguaaguccuaugcccagauguggcaguugauguauuuccaccggcgcgacuugcggcuggcugcgaacgccaucugcagcgccgugccgguggacugggucccgaccucccgcaccacuuggagcauucacgcccaccaccaguggaugacgaccgaggacaugcuguccguuuggaaccguguguggaucgaggagaaccccuggauggaggauaagacgcacaucagcuccuggggcgaugucccauaccuugguaagcgcgaggaccaguggugcggcucauugaucggacucaccgcccgugcgacuugggccaccaacauccaagucgccaucaaccaggugcgaagacucaucggcaacgaaaacuaccuggacuacaugacguccaugaagcgguucaagaacgagagcgacccggaaggggcucuaugguga

SEQ ID NO: 24558 - RNA, 9879 nt, Artificial Sequence
  derived and/or modified CDS sequence (opt11) from DENV-1__EU482478__SS-prME
agcgugacgauguugcuaaugcugaugcccacggcccuggccuuccaccucaccacccggggcggggaaccccacaugaucgugucaaaacaggaacggggcaagucuuuacuguucaaaaccuccgccgggguaaauauguguacgcucaucgcgauggaccugggcgagcucugcgaggacaccaugaccuacaagugcccccgaaucaccgagacugagcccgacgauguggacugcuggugcaacgccacggacaccugggucaccuacgggaccugcagccagaccggugagcaccggcgggacaaacgguccguggcccucgcgccccacgugggccuagggcuggagacccggaccgaaaccuggaugagcuccgaaggcgcguggaagcagauucagagggucgagacgugggcucuccggcacccaggguucaccgugauugcccuguuucucgcccacgcgauuggcaccagcaucacccagaaggggaucaucuucauccuacugaugcuggugacgccuuccauggcuaugaggugugucggcauuggcagccgcgacuucguggagggucucuccggggcuacauggguggacgucgugcuagagcacgggagcugcgucaccaccauggccaaggacaagcccacacuggauaucgagcuacugaagaccgaggucaccaacccugccgugcugcggaaacugugcauugaggcuaaaaucucaaacaccacgaccgacucucgcuguccgacgcagggggaggcuacccugguggaggaacaggacgccaacuucgucugccgacgcacguuuguggaccggggcugggggaauggcugcggccucuucgggaagggaucccucauaacgugugccaaguucaagugcgugaccaagcuggagggcaagaucguccaauacgagaaucuuaaauacagcgugaucgugaccguccacacgggggaccagcaccaaguggggaacgaauccacagaacacggcaccacugccaccaucacgccccaggcgccuaccaccgagauccagcuaaccgauuacggugccuugacgcuggacuguagcccccggaccggccucgacuucaacgagaugguucuucugaccaugaaggagaaguccugguuggugcacaagcagugguuccuggaucugccccuccccuggaccagcggggccagcacgucccaggagacuuggaaucggcaggaccugcugguuacauucaaaacugcgcacgccaagaagcaggagguugugguguugggaagccaggagggggccaugcacacggccuugaccggggccacugaaauccagaccucuggcacgacgaccaucuucgccgggcaccugaagugccgccuuaagauggacaagcugacccugaagggcaugucuuacguuaugugcacgggguccuucaagcucgagaaagagguugccgagacccaacacggcaccgugcugguccagaucaaguacgagggcaccgacgcgccgugcaaaaucccauuccugacgcaggacgagaagggugucacccagaacggccgacugaucaccgccaaccccauugugaccgacaaggagaagcccguuaacauagaggcugaaccgccuuucggggagagcuacaucaucaucggcgccggggaaaaggcccuuaagcuguccugguuuaagaaggggagcuccaucggaaaaauguuugaggccacggccagaggggcccggcgcauggccauucugggggacaccgcaugggacuucgggagcaucgguggaguauucacauccguagguaagcuaguccaccagaucuucgguaccgcauacggggugcuguucagcgguguguccuggacgaugaagaucgggaucgggguucugcucaccuggcugggccugaauagucgcucgaccagcuugucaaugaccugcaucgccgugggguuagucacgcuguaccucggcgucauggugcaagccgacucugggugcguaaucaacuggaagggccgggaguugaaaugcggguccggcaucuucgucaccaacgaaguucacacauggaccgagcaauacaaguuucaggccgacagcccuaagcggcugagcgcagccaucggcaaagccugggaggagggugugugcggcauccgguccgccacucgccucgagaacauaauguggaagcaaauuagcaacgagcucaaccacauucugcucgagaacgauaugaaguucacgguuguggugggggacguagccgguauccuagcgcaagguaagaagaugauccggccccagcccauggaguacaaguauuccuggaaguccuggggcaaggcgaagauaaucggggccgacguacagaacaccaccuucaucauagaugggccgaacaccccggaaugucccgacgaccagcgugcuuggaacauaugggaggucgaggacuacggcuucgggaucuucacgacaaacauuuggcugaagcuccgggacucgcacacccaggucugcgaccacaggcugaugagcgcggccauuaaggacuccaaagccguacacgccgacaugggcuacuggaucgagucagagaagaacgagaccuggaagcuggcucgggccuccuucaucgaggugaagacaugcaucuggcccaagucccacacccucuggucuaacggcguccuggagagcgagaugaucauccccaagaucuacgggggcccgaucucccaacauaacuaucgcccuggauacuucacccagaccgccggucccuggcaucuggguaagcucgagcucgacuucgaccuuugcgaaggcacgaccguggucgucgacgagcacugcggcaaccgggggccaucacuccgcacgaccacggugaccggaaagaucauucaugaguggugcuguaggucuugcacacugccuccccugcgcuucagaggugaggacggcugcugguauggcauggagauccgccccgugaaggagaaagaggagaauuuggucaaaagcauggucucagccggcagcggggagguggauagcuucucacugggguugcuaugcaucucaauuaugaucgaagagguaaugcgcucccgcuggagcagaaagaugcugaugacuggaacgcuggccguguucuuccuccugaucaugggucaacuaaccuggaacgaucucauccgccuuugcaucauggugggcgccaacgcuuccgaccgcauggggaugggcaccaccuaucuugcgcucauggcaacguuuaagaugcgacccauguucgccgucggccuguuauuccgccggcugaccagccgcgaggugcugcugcuaacgaucggauuaucgcucguggccagcgucgagcuccccaacucccuugaggaacucggcgacgggcuugcgauggguaucaugauccuuaagcugcucaccgacuuccagagccaccagcugugggcuacgcuacucucccugaccuucaucaaaaccacguucagccugcacuacgccuggaagacaauggcgaugguacucuccaucgucagccuguuuccucugugccucagcaccaccagccagaagaccacguggcuacccguucuccucggaucacuggguugcaaaccacugacgauguucuugaucgccgagaacaagaucuggggccggcgcucauggcccuugaacgaggggauuauggccgugggcaucgucaguauccuccugagcucgcuacugaaaaacgacgugccccucgccgggccgcugaucgccggcggcaugcuuaucgccuguuacgugaucagugggagcucagcggaucugagccuggaaaaggccgccgaggucagcugggaggaggaggcagagcacaguggagcgucccacaauauccuaguggaggugcaggaugacgguaccaugaaaaucaaggacgaggaaagggacgacacccuaaccaucuuacugaaagcgacgcuccuggcaguuagcggcguguauccucuaaguauccccgccacccuuuucgugugguacuucuggcagaagaagaaacaacgcuccgggguacugugggacacccccucaccacccgagguggagcgggccguguuagaugacgggauauaccgcaucaugcagcggggucuccucgggcgcagccaggucggcgugggaguguuccaggagaacgucuuccacaccauguggcacgucacgaggggcgccguguuaauguaccaaggaaaacgccuggagcccuccugggcgagcgucaagaaagaucucaucucguacggcggcggguggcggcugcagggcagcuggaacacgggggaggagguccagguuaucgccgucgagcccggcaagaaccccaagaaugugcagaccgcccccgggaccuuuaagacucccgagggcgagguaggcgcgauagcucuggacuucaagcccgggaccucgggcagccccaucguaaaccgcgagggaaaaaucgugggccucuacgggaacgguguggucaccaccuccggcacguaugugucugcgauugcucaggcaaaggcaucgcaggaggggccgcugcccgagaucgaggacgagguauuccggaaacgcaaccugaccaucauggaucuccaccccggcuccgggaagacccggcgcuacuugccggcgaucguccgagaagccaucaagcgcaagcuccgcaccuugauccuggcacccacgcgugugguggccagcgaaauggccgaggcucugaagggcaugccuauccgcuaucagacgacugccgucaaguccgagcauacuggcaaggaaauaguggaccucaugugccacgccacguucacuaugcggcugcugagucccguucgcgucccgaacuacaacaugaucaucauggacgaggcccacuucaccgauccuagcagcaucgcugcacguggcuauaucaguacgcgcguggguaugggggaggcagccgccaucuuuaugacggccacaccacccgguagcgucgaggcguucccgcaauccaacgccgucauccaggacgaggagcgggacauuccugagcgcagcuggaacucaggauacgaguggaucacggacuuccccggcaagaccguuugguucgugccgagcauuaaguccggcaacgacaucgccaacugccuucggaaaaacgggaagcgcgucauucaacugagccggaagacuuucgacacggaguaccagaagaccaaaaacaaugacugggacuacguggugaccacggacaucagcgagaugggcgccaacuuccgcgcggaccgggucauugacccgcgccggugccugaagccaguaauccucaaggacgggccggagcgcgugauucuggccggacccaugccggucacgguggcaagcgccgcgcagcggcgcgggcggaucggccgcaaccacaacaaagagggggaucaguacaucuacauggggcagcccuugaacaacgacgaggaccacgcgcacuggacggaggccaagaugcuccuggacaacaucaacacccccgagggcaucauucccgcccuguucgagccggaacgcgagaaguccgccgcgauugacggggaguaucgucuccgaggagaggcucggaaaacguuugucgagcuuaugcgccgcggggaccugcccguguggcuuagcuacaagguggcauccgagggcuuucaguacagcgaccgccgguggugcuucgacggcgagcgcaacaaccagguccuggaggagaauauggauguggagaucuggaccaaggagggggagcggaagaaacugcgcccccgguggcucgacgcccgcaccuacagcgacccucuagcccugcgggaguucaaggaguucgccgcggggcgccgguccgugucuggggaucucauccucgagaucggaaaauuaccccagcaccugacccagcgcgcgcagaacgcucuggauaaccugguuaugcuccacaauuccgaacagggcggccgggcguaccgccacgccauggaggaacugcccgacacgauagagacuuuaaugcuauuagcccuaaucgccguguuaacaggaggggugacuuuguucuuccugaguggacgggggcuaggcaagacauccaucggccuucugugugucauggccagcuccguucuccuguggauggcaagcguggaaccccacuggauagcggccagcaucauccuggaguucuuccucaugguccugcugauucccgagccggaccggcagcggacgccucaggacaaucaguuggcauacguuguaaucgggcugcuguucaugauacucaccgucgcggcgaacgagaugggccuccuugagacuaccaagaaggaccuuggcauaggccacguggcgguugagaaccaccaccacgccgcuaugcuggacgucgaccugcacccugccagcgccuggacgcucuacgcgguagccacaaccaucaucaccccuaugaugcgccacacgaucgagaacacaacagccaacaucucacugacggcaauugccaaccaagcggccauccugauggggcucgacaagggcuggccaauuucaaaaauggacauaggcgugccccugcuggcucucgggugcuacucccaggucaacccacugacacugaccgcagcggugcucaugcugguggcucacuaugccaucaucggcccggggcugcaagcgaaggcgaccagagaggcgcaaaagcggaccgccgccggcaucaugaaaaaccccacgguggacgggaucguggccauugacuuggaccccguggucuacgacgcuaaguucgagaagcagcugggccagaucaugcugcuaauacuguguaccagccagauucugcucaugcgcaccacuugggcguugugcgaguccauuacgcuggccaccggcccgcucaccacccugugggagggcagcccgggcaaguuuuggaacaccaccaucgccgugaguauggccaacaucuuccgagguucguaucuggccggcgcgggccuugccuucucccugaugaaaagccucgggggaggaaggcgggggaccggggcucagggcgagacccuaggcgagaaguggaagcgccagcugaaccagcugucaaaauccgaguucaacacguacaagcggagcggcaucauggaaguggaccgcucugaggccaaggagggauugaagagaggggaaaccaccaagcaugcggucagccguggcaccgccaagcuacggugguucguggaacgcaaucugguaaaaccugagggcaaagucaucgaccugggcugcggcagaggcgggugguccuacuacugugccgggcucaagaaggugacggaggugaaaggguacacgaaaggcggccccggccaugaggagcccaucccgauggccaccuacggguggaaucuggucaaauugcacaguggcaaggacguguuuuucauaccacccgagaagugcgacacucucuuaugugacaucggugaaucauccccuaacccgacgauugaagaaggccgcaccuugagagugcucaagaugguagagccuuggcugcgugggaaccaguuuugcauuaagauccugaaccccuacaugcccuccgugguggagacucucgagcagaugcagcggaaacacgguggcaugcugguccguaacccgcuguccagaaauuccacgcaugagauguacugggugagcugugggacaggcaauaucguuucggcagugaacaugaccagccgcauguuacugaaucgcuucacaauggcacacagaaaacccaccuacgagcgcgauguggacuuaggggcaggcaccagacacguugccguugagccagagaucgccaaccucgacaucaucggccagcgcaucgagaacauaaaacacgagcacaaguccacguggcauuaugacgaggacaaccccuacaagaccugggccuaucacgggucauacgaggugaagccguccggcagcgcguccagcauggugaacggggucgucaaacuucugacgaagcccugggacgucauccccauggugacccaaaucgccaugacggacaccacccccuucggccagcagcggguauuuaaggagaaggucgacacucgcacaccgaaagcuaagcgggggaccgcacagaucauggagguuaccgccaaguggcucuggggcuuucugagucgaaacaagaaaccccggaucugcacccgcgaggaguucacgcggaaggugcgcuccaaugcggccaucggcgcggucuucguugacgagaaccaguggaacagcgccaaggaggccguggaggacgaacgauuuugggaccugguccaccgcgagcgggagcugcacaagcagggaaagugcgcgaccugcguguacaacaugauggguaagagagagaaaaaguugggggaguuuggaaaggcgaaggggucucgggccaucugguacauguggcugggagcacgcuucuuagaguucgaggcacugggauucaugaacgaggaccauugguucagccgggagaacucccugagcgggguugagggcgagggacuccacaagcugggcuacauccugcgcgacaucuccaagauucccgggggcaacauguacgcggacgauaccgccgguugggacacccggaucacugaggacgaucuccagaacgaagcacgcaucaccgacaucauggagccggagcacgcccugcuggccaagagcaucuucaagcucaccuaccagaacaaggucgugagggugcagcggcccgcgaagaacgggacggucauggaugugaucucccgccgugaccagcgcggcagcggacaggugggcaccuacggccugaacaccuucacgaacauggaggcccagcugauccggcaaauggaguccgaggggaucuuuucgccguccgagcucgagacccccaauuuggcggagcgcguccuggacuggcucgagaaguacggcguagagcggcugaagcgcauggccaucucgggggaugacugcguggucaagccgaucgacgaucgguucgcgacggccuugaccgcccuuaacgacaugggcaaggugcgcaaggacaucccccaaugggagcccucgaaagguuggaacgacuggcagcagguccccuucugcagccaccacuuucaccaacugauaaugaaggacggccgggaaaucgucgugcccugucgcaaccaggacgagcuggugggccgggcccgagugucccaaggggccggcuggagccuucgggagaccgcaugccugggcaagagcuacgcccagauguggcagcucauguacuuccaucgccgggaccuccgccucgcugccaacgcgauaugcagugccgugccuguggacuggauccccaccagccggacgaccuggaguauccacgcccaccaccaguggaugaccaccgaggacaugcugagcgucuggaaccgaguguggaucgaggagaacccuuggauggaagacaagacgcacaucuccagcuggggcgacgugccguaccucgggaaacgcgaggaucaguggugcggcucccuuauuggacugacagcacgggccacaugggcgaccaauauccaggucgccauaaaccaggugcgccggcugauugggaacgaaaacuaucuggacuacaugaccagcaugaaacgauucaagaacgagggcgacccugagggggcccugugguga

SEQ ID NO: 24559 - RNA, 9879 nt, Artificial Sequence
  derived and/or modified CDS sequence (opt11) from DENV-1__EU482479__SS-prME
ucaguaacaaugcuacucaugcucaugccaacagcccuugccuuucaccuuacaacucggggcggggaaccacacaugauaguaucgaaacaagaacgaggcaaaucucugcuuuucaaaacguccgcggggguaaauaugugcacgcucauagcgauggaucugggggaacucugugaagacacaaugacauacaaaugcccccggaucaccgagacagaaccagacgauguugauugcugguguaaugcgacagauacguggguuacauauggaacauguucacaaacgggcgaacauagacgcgauaaacguucgguggcucuagccccacacgucgggcuagggcucgagacaagaaccgagacauggaugagcagcgaaggcgcauggaaacaaauucaacgagucgaaacaugggccuuacgucacccgggguucacaguaauagcccucuuccucgcacacgccauagguaccucgauuacccaaaaggguauaauauuuauacuucucaugcucgucaccccguccauggcgaugcggugcguagguaucgggagccgagacuuuguggagggacugaguggcgccaccuggguugaugugguccucgaacauggcucaugcgucacaaccauggcgaaggacaaacccacguuagacauagaauuguugaaaaccgaggucacgaauccagcagugcuucgaaaacucugcauugaggccaaaauuuccaacaccacgaccgacagccguugcccaacccagggcgaagcaacccucgucgaagaacaagacgccaacuucgucugccggcgcacauucguagauagaggguggggcaacggaugcggucuuuucggaaaggggucguugaucaccugugcgaaguucaagugcguaacgaaacucgagggcaagauaguacaauaugaaaaccuaaaauauucagugauuguuaccguccacaccggagaccagcaccaggucggaaacgagagcacagaacacggaaccacggcaaccauaacgccacaagcgcccaccacagagauacaacuuacagauuacggggcccuaacgcuagacugcagccccaggacaggguuagauuucaacgaaauggucuuacucacgaugaaagaaaaaucguggcuaguccacaagcaaugguuccucgaccuuccacuacccuggacuuccggcgcauccacgucccaagagacauggaaccgacaagaccuccuaguaaccuucaaaacugcgcacgcaaagaaacaagaagucguaguacuagggucacaagaaggagcaaugcacacggcacuaacgggagcuacugagauccagaccuccggaacgaccacuaucuucgcaggccaccugaaaugucgauuaaaaauggacaaacugacauuaaaagggaugagcuacgucaucugcacaggcucuuuuaaacuggagaaagagguggcggaaacccaacacggaacaguauuagugcaaauaaaauaugagggaaccgacgcccccugcaaaauccccuucucaacccaagaugagaaggggguuacgcaaaauggacgacuaaucaccgccaaccccaucguuacggacaaggagaaacccgucaacaucgaggcggaaccaccauucggcgaaucauacauuaucaucggagcuggcgagaaagcguuaaaacuaucaugguucaagaaaggguccucuaucggcaagauguucgaagccacugcgaggggagcgagacggauggcaauuuuaggagacacugcaugggauuuuggaaguauaggcggaguauuuaccagcgugggcaaacuuguacaccaaauauuugggacagccuacgggguacuauucucgggcguuucuuggacgaugaaaaucggcauagggguccuacugaccugguuagggcuaaacagcaggaguacgucccugucgaugacguguauagcagucggccugguuacacuauaccuaggaguaauggugcaagcggacagcggcugcguaaucaacuggaaagggagagaauuaaaguguggcagcggaauauucguuacuaaugaagugcacacauggacugagcaauacaaguuucaagccgacagcccgaagagacuguccgcagccauaggcaaggcuugggaagaaggcguguguggaaucagauccgcgacccgccuagagaacauaauguggaaacagauaagcaacgaacuaaaccauauauuacucgaaaacgacaugaaguucaccgucguuguuggugacguagcggggauccuugcgcaggggaaaaagaugauacgaccucaaccgauggaauauaaauacagcuggaagaguugggggaaagcaaaaaucauaggcgcggacguccagaacacaacuuucaucauagacgggccuaacacuccggaaugcccagaugaucaacgagcauggaauaucugggaaguggaggauuacggcuucggaauauucaccacuaacauauggcuaaaguugagggauagccacacccaagugugcgaucacagacuuaugagcgcggcgaucaaagauagcaaagcgguacaugcggacauggguuacuggauugagucagagaagaacgagacuuggaagcuagcuagagccagcuucaucgaagucaaaaccugcauauggcccaagucccacacacucuggagcaacggcguccuugaaagcgagaugaucauacccaaaauauacggaggaccgauuucgcaacacaacuaccgcccgggguauuuuacucagaccgcaggaccuuggcacuuaggcaaacuggaacuggacuucgaccuuugugaaggcacuacugugguugucgacgagcacugcggcaacagagggccauccuugagaacaacuacgguaacuggcaaaaucauacacgaauggugcugcaggaguugcacgcuuccaccgcugagauuucguggcgaagacggaugcugguaugggauggaaauaagacccgucaaagaaaaagaagagaaccuaguaaaguccaugguaucggccgggagcggagaaguagauagcuuuaguuuaggacuacuaugcauauccaucaugauagaggaaguaaugcgcucgagauggucgagaaagaugcucaugacuggcacccuugcggucuuuuuccuccuaauaaugggacagcugacuuggaacgaccugauacggcugugcauaaugguuggcgccaacgccuccgacagaauggguaugggcacaacguaccucgcauuaauggcaacauucaagaugaggccaauguucgcaguaggacuacuuuuucgacgccugacgaguagagaagugcuucuccuaaccauuggguuaucccuagucgccagcguagaacugcccaacucauuagaagaacugggcgacggccuugcaauggguaucaugauccugaaacuucucacagacuuccagucacaccaacuaugggccacccuacuaagucugaccuuuaucaagacgaccuucagucugcacuacgccuggaagacgauggcuaugguucuuagcauagucagucuuuucccccugugccugagcacgacaucucaaaagacaacauggcucccuguucugcugggcucgcucgguugcaagccacuuaccauguucuuaaucgccgaaaauaagauaugggggcgucgcagcuggccgcugaacgaggguauaauggcaguaggaaucgucaguauacuacucucaagucugcucaaaaacgacgugccucucgccggacccuugauagcuggagggaugcucauugcuugcuauguaaucucuggcagcagugccgaucugucacucgaaaaagccgcagaagucagcugggaggaagaagcugagcacucaggcgcgagccacaauauccuuguagaaguacaggacgauggaaccaugaagauaaaagaugaagaaagagaugauacgcugaccauacuucuaaaggcaacacuucuggccguaucuggaguauacccccuauccaucccagcuacucuguucguaugguacuucuggcagaaaaagaaacagcgaagcggcguacuaugggacacgccaucgcccccugaaguagagagagcaguacuggacgacggaauauacaggaucaugcaacgagggcugcucgggcgcagccaggucggcguaggcguauuccaagaaaaugucuuccauacgauguggcacgugacccgcggugcagugcugauguaucaggggaagagguuagaaccgagcugggcuagcguuaagaaagaccuaauaagcuauggaggcggauggagacugcagggguccuggaacaccggugaagaaguucaagucaucgcggucgaaccgggaaagaaccccaaaaauguccagacagcacccggaacauuuaaaacgccugaaggagaggucggugccauagcacuagacuucaaaccgggcaccagcggaucgcccaucguaaaccgcgaaggaaaaaucguggguuuguauggcaacggagucguaaccacgagcgggacuuacguaagcgcgauagcccaagcaaaggccagccaggaaggaccacuaccugagauagaggaugaaguguuccggaaacggaaccuaacaaucauggaucuacacccaggaucaggcaaaacaaggagauaucugcccgccaucguucgagaagccauaaagcggaagcuccggacacuaauccucgccccaacaagagugguagcuagcgagauggcagaagcccugaagggcaugccgaucagguaucagacaacagcagugaaaucagagcacacaggcaaagaaauuguagaccuuaugugccaugcuaccuucacaaugagacuauuaagccccguucgcgugccuaacuacaacaugauuaucauggacgaagcacacuucacagacccaaguucaaucgcagcgcgaggauauauuagcacacggguuggaaugggagaagcugcggcgaucuuuaugacagcaacuccaccugggucaguugaggcguucccacaguccaaugcagucauccaagacgaagaacgcgauauaccagaacguagcuggaauagcggcuaugaauggaucacagacuuucccgguaagacgguaugguuuguccccaguauaaaaucgggaaacgacauagccaauugucuccgcaagaacggaaagcgcgucauacaauuaucacgaaagacguuugacaccgaguaucagaagaccaaaaacaacgacugggacuacguuguaaccacagacaucuccgaaaugggugcuaacuuccgagcugacagggucaucgauccgagaagaugucuaaaacccgugauacucaaagacgggccagagcgcguaaucuuagccgggccaaugccagugacaguagcaagugccgcccagcgacgggggaggauagguagaaaccacaacaaagagggcgaccaguacaucuacaugggacaaccacugaacaaugacgaggaccaugcacacuggacagaagccaagaugcuacucgacaauaucaacacaccggagggaauuauacccgcacuuuuugaaccggaaagggagaaaucagccgccaucgacggggaguaccggcuacgcggggaagccagaaaaacauucguugaacuaaugcgaagaggggaucuacccguauggcugucauacaagguugcgucagaaggauuccaauauuccgaccgccguuggugcuucgacggcgaacgaaacaaucaaguacuggaagagaacauggacguagaaauauggacaaaggagggagagcggaagaaacuccgcccacguuggcuagaugcacgaaccuacagcgauccgcuagcgcuacgcgaguucaaagaauuugcggcuggccgccgcagugucucaggugaccugauacuugaaauuggaaagcucccacaacaucuaacgcaacgcgcucagaacgcucuagacaaccuagugaugcugcauaauuccgaacaaggcggucgggccuacaggcacgcgauggaagaacucccggacacgauagagacguugauguuacuggcacucauagccgucuugaccggcggaguaacacuauucuuccugaguggacgaggacucggaaaaacaagcauaggacuacucugcgucgucgcgagcagcguacucuuauggauggcgaguguggaaccacacuggauagccgccucaauaauccucgaguucuuccuaauggucuuacucauaccggagccugacaggcaaagaaccccacaagauaaccagcucgcauauguggugauaggacuacucuucaugauuuuaacuguagcagccaacgaaaugggacugcucgaaaccacaaagaaagaucuuggaauaggacacguggccguugagaaccaccaccacgcggccauguuggacguggaccuacaccccgcgagcgccuggacgcucuacgccguagccacgacgaucauuacacccaugaugcgccacacaaucgaaaacacaaccgcaaacaucuccuugacggccauagcaaaccaagccgcaauucucaugggccucgacaagggcuggccgaucucgaagauggauauuggaguuccccugcuggcauuaggauguuacucgcaaguaaacccgcugacucugaccgccgcagugcugaugcucgucgcgcauuacgcuauaaucggcccaggccugcaggccaaagcaacgagagaggcgcagaaacgaacggcugcagggauaaugaagaacccgaccgucgacgggauaguagcaauugaccuugaccccguugucuacgacgccaaguuugagaaacagcugggccagauaaugcuccuaauucugugcacaagccaaauauuacuuaugcgaaccacaugggcacucugugagagcauaacgcuggcaacggggccccugaccacacucugggaagggucuccagggaaauucuggaauacaaccauagccguaagcauggccaacaucuuccgcggguccuacuuggcgggcgccggauuggcauucagccucaugaaaucucugggcggagggcgacgcggcacgggagcacagggcgagacacucggagagaaguggaagcgacaacuuaaccaauuaucaaaaucugaguucaauacguauaagcgauccggaauaauggaagucgaucgcagcgaggcaaaggagggccuuaaaagaggggaaaccacgaaacacgcggucagccgaggcaccgcaaagcucaggugguucgucgagcgaaaccucguaaaaccagagggaaaagucauugaccuuggcuguggcagggguggguggaguuacuacugugccggacucaagaaagugacggaggugaaaggauacaccaagggcgggcccggacacgaggagccaaucccuauggccaccuacggguggaaccucgugaaacuccacaguggcaaggaugucuucuucauacccccagaaaagugcgauacacuacuaugcgacaucggagaaagcaguccaaauccgacuauagaggaaggacggacuuugcgcguacuaaagaugguagagccguggcuacggggcaaccaauucugcaucaaaauacuaaauccuuauaugccaucgguaguugagacucucgaacagaugcagcgcaagcacggaggaaugcuaguacgcaacccacuaagccgcaacucuacccaugaaauguacuggguaagcugcgggacggggaauauuguauccgcagucaacaugaccagucgcaugcugcucaaccgguucaccauggcacaccgcaagcccacguaugagaaagacguagacuugggugcuggaacccggcauguagcuguagagccagagguagcaaaccucgacaucaucggccagaggaucgaaaacaucaaacacgaacacaagucgacguggcacuacgacgaagauaacccguacaagacgugggcuuaccacgggagcuaugaagugaaacccagcggcucagccucguccaugguaaacggcgucgucaaacuacucacaaagcccugggacgucauuccaaugguaacccaaaucgcaaugaccgauaccaccccguucggccagcaacggguauucaaagaaaaagucgacacccgcacgccgaaggccaagcgggggacggcccagauaauggaagucacagccaaguggcucuggggcuuucugagccgaaacaagaaaccgagaauaugcacacgcgaggaguucacccgaaaagucaggagcaacgcagcaauuggugccguauuuguagaugaaaaccaguggaacagcgcgaaggaagcggucgaggaugagagguucugggaucugguacaccgagagcgcgagcuccacaaacagggaaagugcgccacguguguauacaacaugaugggcaaaagggagaaaaagcuaggugaguucggcaaggcuaaagggucacgugcaauuugguacauguggcugggggcucgguuccucgaguucgaggcccucggcuucaugaacgaggaccacugguuuucgcgggagaacagccuuagcggaguagaaggugaaggauuacacaaacuaggguacauauuaagggacauaucuaagauaccagggggaaacauguacgcggacgacacugcggguugggacaccaggauaaccgaagacgaucuacaaaaugaggcaagaaucaccgacaucauggagccggagcacgcccuacucgccaaaagcaucuucaaacucaccuaccaaaacaagguuguaagaguccagcggccggcaaagaauggaaccguuauggaugugaucucgcgacgugaucagcgaggcucuggucaagucgggaccuacggccugaacacuuucacgaacauggaggcacaacuaauccggcaaauggaauccgaagggauuuucagcccaucagaacucgagacacccaaccuggcggaaagagugcuggauuggcucaagaaauacgggguggaacgucuaaagaggauggccaucucgggcgacgacuguguagugaaaccaaucgacgaccgauucgcaacagcacugacggcacuaaacgauauggguaagguaagaaaggauaucccacagugggagcccucgaagggcuggaaugauuggcaacaagugccguucugcucacaucauuuccaucaacuuaucaugaaagacggucgcgaaauagucgucccaugccgaaaucaggacgagcuaguagggcgcgccagaguuagccagggggcuggcuggagccuucgggagacagcaugccuaggaaagagcuacgcacaaauguggcaguuaauguacuuucaccggagagacuuaagguuagcggcgaacgcgauaugcagugccgugccuguagauuggauaccuaccagucgcacaacguggagcauacaugcccaucaccaauggaugacaaccgaggauauguuaucaguauggaauagagucuggaucgaggagaacccguggauggaagacaagacccacauaucuuccuggggcgacgugccuuaccugggaaaacgagaggaccaauggugcggcucacucauugggcugaccgcacgagcgacaugggcuacgaauauacagguagcaaucaaccaagucaggcgguuaauuggcaacgaaaacuaucucgauuacaugacgagcaugaaaagauuuaaaaacgagggggacccagaaggagccuugugguga

SEQ ID NO: 24560 - RNA, 9879 nt, Artificial Sequence
  derived and/or modified CDS sequence (opt11) from DENV-1__EU482480__SS-prME
agugugaccaugcugcucaugcugaugccuaccgcccuugccuuccaccugacgacccgggggggggaaccccacaugaucgugagcaagcaggagcggggcaagucgcugcuguucaagaccucggccggggugaauaugugcacgcuaauugccauggaccugggugaguucugcgaggacaccaugaccuacaagugcccgcggaucaccgaggccgaacccgaugacguggacugcuggugcaacgcaaccgacacgugggucaccuaugggacaugcacccagaucggcgagcaccggcgcgacaagcgaagcguggcccuggcgccacacgugggacucggccuagagacgcguaccgagaccuggaugagcagcgaaggcgcauggaagcagauccagagggucgagaccugggccuugcgccaccccggguucacggugaucgcccucuuccuggcgcacgcgaucggcacaucuaucacucagaaggggaucaucuuuauccugcuaaugcuagcgacacccaguauggccaugcgaugcgugggcauuggcagccgcgacuucguagaggggcuguccggcgccacguggguggacgugguucucgagcacggguccugcgugaccaccauggcgaaggacaagcccacccuugacaucgagcugcucaagacggagguaaccaaccccgccguccugcggaaacugugcauugaggccaagaucucgaacaccaccacggacucccgcugcccgacucaaggagaggccacccucguugaggagcaggacgcaaacuucgugugucggcgcacuuucgucgaccggggcugggggaacggcugcggccuuuucggcaaggggagcuugauaacgugcgcgaaguucaagugcgugaccaagcucgaaggcaagaucgugcaguacgaaaauuuaaaguacuccgugaucguaaccguucacaccggcgaccagcaccaggucgggaacgagucgacggagcacggcacgaucgcaaccaucacgccccaggcccccuccaccgagauccagcugacggacuacggagcccucacccuggacugcagcccccgcaccggccuggacuucaacgagauggugcuccugaccaugaaggaaaagucguggcugguccacaaacagugguuccucgaccugccgcugccuuggacgagcggggccaguaccucccaggagaccuggaacagacaagaccucuuggugacuuucaagacggcgcaugccaaaaagcaagagguagucgugcuuggcagccaagaaggugcgaugcacacugcccucaccggggcuaccgagauucagacguccggcaccaccacgaucuucgcggggcaccugaagugccgccugaaaauggacaagcucacgcugaagggcaugagcuaugugaugugcaccggguccuucaaacuugaaaaggagguugccgagacccagcacggcaccgugcucgugcaaaucaaguacgagggcacggacgcccccuguaagaucccauucagcacucaggacgagaagggggucacacagaacggccggcucaucaccgccaacccgaucgugacggacaaggagaagcccgugaauaucgaggcggaaccacccuuuggggagaguuacaucgucaucggcgccggcgagaaggcccugaaguuaagcugguucaagaagggguccagcaucggcaagauguucgaggccaccgcccgcggggcgcggcgcauggcgauacucggcgacaccgccugggacuucggguccauaggcggcguguucaccagcguggggaagcugguccaccagauauuuggcacagccuacggugugcuguuuuccggcgugagcuggaccaugaagaucgggaucggcguccuccugaccuggcugggccucaacucccgcagcaccucccugagcaugacaugcaucgccguggggcuggugacucucuaccugggcgucaugguccaggcagacuccgggugcgucaucaacuggaagggccgggagcugaagugugggagcggcauauuugucacuaacgaggugcacacguggacggagcaguauaaauuccaggccgacagcccuaagcgccucucagccgcgaucggcaaggccugggaggagggagugugcgguauccggagcgcgacccgccuggagaauaucauguggaaacagaucucaaacgagcuaaaccacauccuccuggagaacgacaugaagcugaccguaguggugggggacgucgccggcauccuugcccaggggaagaagaugauccggccccagcccauggaguacaaguacagcuggaagauuuggggcaaggccaagaucaucggagccgacgugcagaacacaaccuuuaucauagacgggcccaacacgccagaaugcccugaugaccagcgcgcguggaauaucugggagguggaggacuacggcuucgggaucuuuacaaccaauaucuggcugaagcugagagacuccuacacccaggucugcgaccaccggcucaugagcgcggccaucaaggauuccaaggccgugcacgcggacaugggguauuggauugagagcgagaagaacgagacguggaaacuggcccgugccuccuucauagaggugaagaccugcaucuggcccaaaagccacacccugugguccaacggcguccuagagucggagaugaucauccccaagaucuacgggggcccgaucucccagcacaacuaucgccccgguuacuuuacccagacggccggcccguggcaccuggggaagcuggagcucgacuuugaccugugcgagggaaccaccgugguagucgacgagcacugcggcaaccgggggccgagccuacgcaccacuaccgugaccggaaagaucauccacgaaugguguugccgguccugcacgcuacccccccuccgguuuaagggggaggacggcuguugguacgggauggagauccgacccgugaaggagaaggaggagaaccucgucaagagcauggugucagcaggcucuggcgagguggacagcuucucccucggucugcuguguaucagcaucaugaucgaggaggucaugcgcucccgauggagccgcaagaugcucaugacgggcacccuggcuguguucuuccuucucaucaugggacagcugacauggaaugaccugauccgacugugcaucauggugggcgccaacgccuccgaccgcauggggaugggcacgacguaccuggcauugauggccaccuucaaaaugcggccgauguucgcgguuggauugcuauuccgucgccugaccagucgggaggugcuccuguuaacgaucgggcucucccuggucgccagcgucgagcuacccaacagucuggaggagcugggcgacgggcuggcgaugggcauaaugauucucaagcuauuaacagauuuucagagccaccagcucugggcaacccugcugucccucacauucauccgcacgacguucagccugcacuacgcguggaaaaccauggccauggugcuguccauugucagccucuucccucugugccuguccacuaccagccagaagacgaccuggcuccccguguuacucggaucccucggguguaagccucugaccauguuccugaucgccgagaacaagaucuggggccggaaauccuggccccucaacgaggggauaauggccgugggcaucgucucuauccugcugagcagccuccugaagaacgauguuccccucgccgggccccucaucgcgggcggcaugcugauugccugcuacgugaucucagggagcuccgccgaccugagccucgaaaaggccgcugaggucuccugggaggaggaggccgagcacuccggagccucccacaacauccugguugaggugcaggacgacgggaccaugaagaucaaggacgaagagcgagacgacacgcuuacaauccuccugaaggccacccugcucgccgucagcgggguguacccgcuguccauacccgcuacucuguucgugugguauuucuggcagaagaagaagcaaagaucugguguucucugggacacccccagcccccccgagguggagcgcgcgguguuagaugauggaaucuaccggaucaugcagcgcggacugcuggggaggagccaagucggagucgggguguuucaggagaacgucuuucacacaauguggcacgugacccgcggcgcggugcucauguaccaggggaagcggcuggagcccucaugggccagcguuaaaaaagaucugaucaguuauggcggcggauggcgacuccagggcagcuggaacaccggggaggagguccaagucaucgcuguggagcccggcaagaacccuaagaacgugcagacggcccccgggacguucaagaccuccgagggcgaggugggcgcgaucgcccuggacuucaagccugggaccagcggcagccccaucgucaaccgggagggcaagaucguuggucuguauggcaauggggugguaaccacuagcggcaccuacgugagcgcuaucgcccaggcaaaggccucccaggaggggccccucccggagaucgaggacgagguguucaggaaacggaaccugaccaucauggaccugcaccccggcagcgggaagacccgccgguaccuucccgccaucguccgcgaggccaucaagcggcgccugcgcacccugauacucgccccuacucgaguggucgcgagugagauggccgaggcacugaagggcaugccgauccgauaucagacuaccgccguuaagucagaacacacggggaaggaaaucguggaucugaugugccaugccacguucacuaugagacuacugucccccguccguguccccaacuacaauaugaucauaauggaugaagcacacuucacagaccccagcuccaucgcugcccgggguuacaucagcacgcgcgugggaaugggggaggccgccgcgauauucaugacugccacgccucccggcuccguggaggccuucccccaaagcaacgccguuauccaggacgaggagcgggacaucccggaacgcuccuggaacagcggguacgaauggaucaccgacuuccccggcaagacggugugguucgugcccuccaucaagagcggcaacgauaucgcgaacugccugcgaaagaacggcaaacgcgucauacagcucucccgaaagaccuucgauaccgaguaccaaaagaccaagaacaacgacugggacuauguggugacgaccgauauaagcgagaugggcgcuaacuuucgcgccgaccggguaauugacccccgccggugccugaagccggugauucugaaggaugggcccgagcgcgugauccucgccggcccuaugccuguuacuguggcauccgcggcccagcggcgggggcggaucggccgcaaucacaacaaagagggcgaucaguacaucuacauggggcagccgcuaaacaacgacgaggaccacgcccauuggacggaggccaagaugcugcucgacaacauuaauacgcccgagggaaucauccccgcccuguuugagcccgaacgagagaaguccgcggccauagauggcgaguaccggcugcguggcgaggcccggaagacauucguggaacucaugcgaaggggggaccugccgguguggcuguccuacaaggucgccagcgagggcuuccaauacucugauaggagguggugcuucgacggcgagcgcaauaaccaaguacucgaggagaacauggacgucgagaucuggaccaaggagggggagaggaagaagcugcgcccccgguggcuggacgcccgcaccuacuccgacccccuagcgcugcgggaguucaaggaguucgccgccggucgccggagcgugucgggggaccugauacucgaaaucggcaagcugccucagcaccuaacgcagcgcgcccagaacgcgcucgacaacuugguaaugcugcauaacagcgaacagggcggacgggccuaccgccacgcuauggaggagcucccggacaccaucgagacccugaugcugcucgcccugaucgccgugcugacuggcggggugaccuuauucuuucuguccggccgaggucuuggcaagaccagcaucggccuccugugcgucauggcguccagcguguugcucuggauggccuccguggagccccacuggaucgccgccaguaucauacuggaguucuuccugaugguccuccugauuccagagcccgaccgccagcggaccccgcaggacaaccaguuggccuacgucgugaucggguuacuuuucaugauucugacaguagcggccaacgagaugggccuccuggagaccacgaagaaggaccuggggaucggccauguugccguggaaaaccaucaccacgccgccaugcucgacgucgaccuacacccagcguccgccuggacccucuacgcaguggcaacgaccauaaucacgcccaugaugcgccacaccaucgagaacaccacggccaacaucagccucacggcgaucgcaaaccaggccgcgauacugauggggcuggacaagggcuggccgaucagcaagauggacaucggcguaccccuccuggcccuggggugcuacagccaggucaacccccucacccugacugccgcagugcugaugcucguggcccacuaugccauaauaggcccgggguuacaggccaaagcuacccgcgaggcccagaagcggacggccgccggcaucaugaagaacccuaccgucgaugggaucguggcgaucgaccuggauccgguggucuacgacgccaaguucgagaagcaacucggccagaucaugcugcugauccucuguaccucccaaaucuugcugaugagaaccacuugggcccucugcgagucaaucacccuagccaccggcccucugacgacgcuaugggaggggucccccggcaaguucuggaacaccaccaucgcuguuagcauggcgaacauauuucggggguccuaccuggccggcgccggcuuggccuucagccucaugaagucccucgggggcggucgccgggggacuggugcacaaggcgagacguuaggagagaaguggaagcgccagcugaaccaguuaucaaaaagcgaguuuaauaccuacaagcgguccgggauuauggagguagauagaagcgaggcgaaggagggccuaaagcgcggagagaccacaaagcaugccgucucccgcggcacugccaagcuccggugguuuguggagcgcaaucucgugaagcccgaggggaaagucauagaccugggcuguggucgcggcggguggagcuacuacugcgccgggcucaagaagguuacagaggucaagggauauaccaagggcggccccggccacgaggaacccauccccauggccaccuacggcuggaaccucgucaaacugcauucuggcaaggauguguucuucaucccacccgaaaagugcgacacgcugcucugcgacauuggggagagcaguccuaacccgaccaucgaagaaggccgcacgcuacguguccugaagauggucgagccguggcuccgcggaaaccaguucugcaucaagauccugaaccccuacaugcccucugugguugagacccuggagcagaugcagcggaaacacggcggcaugcuuguccgcaacccauuaucccggaacuccacgcaugagauguacuggguguccugcgggacaggcaacaucgugucggcagucaacaugaccucccgcaugcuguuaaaccgcuucaccauggcacaccggaagccgaccuacgagcgcgacguugaccugggggccggaacgcggcacguugccgucgagccagagguggcgaaucucgacaucaucggccagcgcauugagaauaucaagcacgagcauaaaucuaccuggcacuacgacgaggacaacccauacaagaccugggccuaccacggguccuacgaggucaagcccagcggcuccgccagcagcauggucaauggagucgucaagcuccugaccaagccgugggacgugauccccauggugacgcagauugccaugaccgacacgacucccuucggacagcaacgggucuucaaggagaagguggacacgcgcacccccaaggccaagcguggaacggcucagaucauggaggucaccgccaaauggcucuggggcuuccucuccaggaacaagaagccgcggaucugcacgcgcgaggaguuuacgagaaagguacgcagcaacgccgccaucggcgcgguuuucguggacgaaaaccaguggaauuccgccaaggaggccgucgaggaugagcgguucugggacuuggugcaccgcgagcgggagcugcacaagcagggaaagugcgcgaccugcguguacaacaugaugggcaagcgcgagaagaagcuaggugaguucggcaaggccaagggaucccgggccaucugguacaugugguuaggcgcacgcuuccuggaguucgaggcccucggcuucaugaacgaggaccacugguucucccgggagaacagccuguccggugucgagggugaggggcugcauaagcugggcuacauccugcgcgacaucagcaaaauccccgguggcaauauguacgccgaugacaccgcaggcugggauacgcggauaaccgaggacgaccugcagaacgaggcgaagaucaccgacaucauggagcccgagcacgcccuccuggccaaguccaucuuuaaacugaccuaccagaacaagguggugaggguccagcgcccggccaagaacgguacugucauggacgugaucucucgccgcgaccagcggggauccgggcaggucggcaccuacggcuuaaacaccuucaccaacauggaggcccaguugaucaggcagauggaaagcgaggggaucuucuccccaagcgagcuggagacgcccaaccucgcuggccggguucuggacuggcuggagaagcacgggguggagcgccucaaacggauggccauauccggcgacgacugcgucgugaagcccauagacgaccgcuucgcgaccgccuuaaccgcgcucaacgacauggggaaagugaggaaggauaucccgcagugggagcccagcaagggcuggaacgacuggcagcaggucccauucuguucccaucacuuccaccaacucaucaugaaggacggccgcgagaucguggugcccugucgcaaccaggacgagcuggucggccgcgcgcgggugagccagggcgccgguuggucacugcgcgagacggccugccucggcaaguccuacgcacagauguggcagcuuauguacuuccaccggcgcgaccugcggcucgcggccaacgccaucugcagcgccgugccggucgacugggugcccacgucccgcacgaccuggagcauccacgcucaccaccaguggaugaccacggaagacaugcuguccguguggaaccggguguggaucgaggaaaacccauggauggaggacaagacgcacgugagcuccuggggcgacgugcccuaccugggcaagcgcgaggaucaguggugcggcagccucaucggguuaacugcccgugccaccugggccacgaacauucagguugcaaucaaccaggugaggcgccugcucggcaaugagaacuaccuggacuacaugaccuccaugaaacgguucaagaacgaaagcgauccggagggugcgcugugguga

SEQ ID NO: 24561 - RNA, 9879 nt, Artificial Sequence
  derived and/or modified CDS sequence (opt11) from DENV-1__EU482481__SS-prME
uccgugaccaugcugcucauguuaaugccuaccgcgcuggccuuccauuugaccacgcgggggggggagccccauaugaucgugaccaagcaggagcggggcaaauccuugcuuuucaaaaccagcgccggggucaauaugugcacgcuuaucgccauggacuuaggcgagcuuugcgaagacaccaugaccuacaaaugcccccggaucaccgaggccgaaccagacgacguagacuguuggugcaaugcuaccgauacaugggugaccuaugggacgugcucccagacgggcgagcaucggcgcgacaagagaagcguggccuuggcgccacacguuggucugggauuagagacccgcacugagacuuggauguccucggagggagccuggaaacaaauccagagaguggagacgugggcacugcgucaccccggguucacugucauugcccuguuccuggcgcacgcuauuggcacgaguaucacgcagaaggguaucauauucaucuuguuaaugcuugugacgccgagcauggcuaugcguugcguaggcaucgggucucgcgacuucguggagggccuuagcggcgccacuuggguggacgucgugcuggagcacggcuccugcguaacgacaauggcuaaggauaagccuacgcuggacaucgaacuccucaagaccgagguuaccaacccggcggugcugcggaagcucuguaucgaggcgaagauaaguaacacgacgaccgacucacgcugucccacccagggcgaagcgacccugauggaggaacaggacgccaacuuugucugccggcgcacauucgucgaccggggcugggggaacggcugcgggcucuucgggaaggguucacuuaucacgugugccaaguucaagugugugacaaaauuggaaggcaaaauaguccaguaugaaaaccugaaguacagugucaucgugaccgugcacacgggcgaccagcaucaggucgggaacgagucaaccgagcacggcacuaccgcuacgaucacaccccaggcccccaccuccgagauacagcucaccgauuacggggcccugacccuggacugcagcccgcgcacgggcuuagacuucaacgaaaugguguuacugacaaugaaagagaagucaugguugguucacaaacagugguuccuagaccugccucuaccuuggaccucuggggcgucgaccucccaggagaccuggaaccggcaggaucugcuggugacguucaagaccgcgcacgcuaagaagcaagagguggucgugcucgggagccaggaaggagccaugcacaccgccuuaaccggcgccacugagauucaaacauccggaaccacgaccaucuucgcggggcaccugaagugccgauugaagauggacaagcugaccuuaaagggcauguccuacgugauguguaccggguccuucaagcucgagaaggaggucgcggagacgcagcacggcaccguccugguacagaucaaguacgagggcaccgaugcacccuguaagauuccauucucuacccaggacgagaagggcgucacgcagaacggcagacugauaaccgcaaacccgaucgucacggacaaggagaaaccugugaauaucgaggcagagccgcccuuuggggaguccuacauaguaaucggcgcgggggagaaagcgcugaagcucagcugguucaagaagggaagcagcaucggcaagauguucgaggccacggcccgcggggcaaggcgcauggcuaucuuaggagacacggccugggacuucggguccguagggggcguguuuacuagcguggguaaacuggugcaccaaaucuucgguacagccuauggcguacuguucuccggcgucucguggacgaugaaaaucggaaucggagugcuguuaacuuggcuagggcugaacucccgcagcaccucgcuaagcaugaccugcauugccgugggacucgugacacuguaccuggggguaaugguucaggccgauuccgggugcguuaucaacuggaagggucgggagcucaagugugggucuggcaucuuugucacgaaugaggugcacaccuggacggagcaguacaaguuccaagcagacucgccuaagcgccugucagccgcaauaggaaaagccugggaggagggagucuguggcauacggagugccacucggcucgagaacaucauguggaagcagaucuccaacgaacucaaccacauacugcuggagaacgacaugaaguucaccgugguuguuggggacguugugggcauacucgcgcaagggaagaagaugauucggccccaacccauggagcacaaguauaguuggaaguccuggggcaaagcgaagauuaucggcgcugacguccaaaacacgacauucauuaucgacggacccaauaccccggaaugccccgacgaucagcgcgcauggaacaucugggagguggaggacuacggauuuggaaucuuuacuacgaacaucuggcugaaacugagggacagcuacacccaaguuugcgaccaccgucucaugucagcggccauuaaggacagcaaggccguacacgcagacaugggcuacuggauugaauccgagaaaaacgagacguggaagcucgcccgggcgucuuuuauagaggugaagacuugcaucuggccaaaaucccacacccuguggagcaauggcgugcucgaguccgaaaugauuauccccaagaucuacgggggcccgauaagccagcacaaucaccggcccggcuacuuuacccagacggccgggcccuggcacuuggguaagcuagagcucgacuuugaccugugcgagggcacaacugucgugguggacgagcauugcgggaaucggggcccgucccugagaacgacgaccgucacagguaagaucauacaugagugguguugccgaagcugcacccuaccacccuugcgcuuuaagggggaggaugggugcugguacgguauggagauucggcccguaaaggagaaggaggagaaucuggucaaauccauggucucagccggcucgggugagguggacuccuucagcuuaggacuccugugcauuaguaucaugaucgaggagguuaugcggucacgguggucacgcaagaugcucaugaccggcacacuggcaguguuucugcuccugauaaugggucagcucacguggaacgaccucauccgucugugcauuaugguaggcgccaacgcuucggaccgcauggggaugggcaccacuuaccuggcccucauggccacauuuaagaugcgcccuauguucgccguuggcuugcuguuccggcgccucacgagccgggagguccugcugcucaccaucggccugucgcugguagcguccgucgagcuccccaauagccuggaggagcucggugacggucucgcaauggguaucaugauccugaagcuucucacggacuuccagucccaucagcugugggcaacccugcucagccugacauucauuaagacaacgcucucccuccauuaugcuuggaagacaauggccauggugcugagcaucguaucguuauucccacuaugcuuaagcaccaccucccaaaaaaccacguggcugccuguucuacuggggagccugggguguaagccgcucacgauguuccuuaucaccgagaacaagauauggggacgcaaguccuggcccuuaaaugaagggaucauggccgugggcguuguuagcauccuccugagcucguugcucaagaacgaugugccccuagccgggccccuaaucgccggcggcaugcucaucgcaugcuacgugaucagcggguccuccgccgaucugucccuugagaaggcggcggaagucagcugggaggaggaggcggagcacucaggcgccagccacaacaucuuaguggaggugcaggacgacggaacgaugaagaucaaggacgaggagcgggacgacacccugacuauccugcucaaagccacccuccuugcggugucggguguguacccgcucaguauacccgcgacccucuuuguuugguacuuuuggcaaaagaaaaagcagcgcuccgggguccugugggauacccccucuccccccgagguagagagggcggugcuagacgacggaaucuaccgcaucaugcaacgcggccugcugggccgcagucaggucggcguagguguguuucaggagaacgucuuucacaccauguggcacguaacucgaggcgccguauuaauguaucaggggaagcgccucgagcccagcugggcgucgguuaagaaggaccugauaucuuacgguggagguuggcgucugcagggcucauggaacaccggcgaggaaguccaggugaucgcgguggagccgggcaaaaaccccaagaauguccaaaccgcccccggaacuuuuaagacgccggagggugaggugggcgccaucgcccucgauuucaaaccugggaccucagguucccccauagucaaucgcgaggguaagauuguaggccuguacgguaacggagucgugacuacaagcggcacguacgugagcgcaaucgcgcaggcaaaagccagucaggaagggccacuacccgagaucgaggacgaaguguuucggaagcgaaaccugaccaucauggacuugcaccccggcagcgggaagacacgucguuaccugccggccaucguccgggaggcgauaaagcguaagcugcggacgcugauccuugcgcccacgcgggugguggccucugagauggccgaggcacucaagggcaugcccauccgguaccagacgaccgcugugaagagugagcacacaggaaaggagauuguggacuuaaugugccacgcaacguucacaaugcggcuacucucccccgugcggguuccuaacuacaauaugauuauaauggacgaagcccauuucaccgaccccagcuccaucgccgcccggggauacaucagcacgcgcgugggcaugggggaggcggccgccaucuucaugaccgccacgccgccaggauccguggaggccuucccucagucaaaugcggucauccaggaugaagaacgggauauccccgagaggucuuggaacaguggguacgaguggaucaccgacuuccccggcaaaaccgugugguucgugcccuccauuaaguccggcaacgauauugccaauugucuccggaagaacgggaagcgcgugauccagcugucccggaagacguucgauaccgaguaucagaagaccaagaacaacgauugggacuaugucguuaccaccgacauaagcgagaugggcgcgaacuuucgcgccgaccggguuaucgacccgaggcgcugccucaagccugugauccugaaggacgggcccgaacgcgugaucuuggcgggccccaugcccgugaccguggccuccgccgcccagcggcgcggucggaucggccgcaaccacaauaaggagggcgaucaauacaucuacaugggccagccccucaacaacgacgaggaccacgcacacuggaccgaagcaaagaugcuucuggauaacaucaacacaccagagggcaucauccccgcgcuguucgagccggagcgggagaaguccgcugccaucgacggggaauaccgccugcgcggagaggccaggaagacguuuguggaacugaugcgcaggggcgacuuaccgguguggcuguccuacaagguggcguccgaaggguuccaguacucugaccgccgguggugcuucgacggagagcgcaacaaucagguucuggaggagaacauggacguggagaucuggacuaaggaaggggagcguaagaagcuccgcccccggugguuagacgcacgaaccuauucggauccucuggcccuccgggaauuuaaagaguucgccgcuggccgccgaucggugucuggggaccugaucucggagaucggcaaguuaccgcaacaccuaacccagcgcgcgcagaacgcguuggacaaccuugugauguugcacaacucggaacagggcggacgagccuaccgccaugccauggaggagcuucccgacaccaucgagacguuaauguuacuggcgcugauagcuguacuaacaggagggguaacucuguucuuccugagcggacgggggcuaggcaagaccuccauuggacuacugugcgucauggccagcuccguccucuuguggauggcaagcgucgagccccauuggauugccgcaaguaucauacuggaguuuuuccucauggucuugcugauaccggagccggaucgacagcggacgccacaggauaaccaacuagcauacguggugaucggguugcuguucaugauucucaccgucgccgccaacgagauggguuugcuggagaccacgaagaaggaccucggcauugggcacguagccguagagaaccaccaccaugcaacgaugcuggaugucgacuuacaccccgcgucugccuggacccuguacgccguggccaccaccauaaucacgccuaugaugcgccacacaaucgagaauacaacugcgaacauaagccugacggcuauagccaaccaggcggcuauacugauggggcucgauaaaggauggccuaucuccaagauggauaucggcgugccgcuauuagcgcucgggugcuacucccaggugaacccccugacacugaccgccgccgugcucaugcugguggcgcacuaugccauaauuggcccuggucugcaggccaaggcaacccgcgaggcccaaaaacgcacggccgccggcauaaugaagaaccccaccguagacgguaucauagcaaucgaccucgaccccgugguuuacgacgccaaguucgaaaaacagcuggggcagaucauguuacucauccuguguaccagccagauccugcucaugcgcaccacuugggcucucugugaauccaucaccuuagccaccggcccccugaccacccugugggaggggagcccaggcaaauucuggaauacuaccaucgcggugagcauggccaacaucuuccggggguccuaccuggccggcgccggccucgccuucagccucaugaagucccucgggggcgggcgccggggaaccggagcccagggcgagacauuaggagagaaguggaagcgccagcugaaucagcugaguaaaagugaguucaauaucuauaagcgguccggaauuauggagguggaccgcagugaagcaaaagagggucucaaaagaggggagacaacccgccacgccgugucgcggggaacggccaagcugcgcugguucguugagcgaaaucuggugaaacccgaagggaaggugaucgaccugggcugcggccgcgggggcuggucauacuauugcgcgggauugaagaaagucacggaagugaagggguacacaaagggcgggcccggccacgaggagcccauaccuauggccacguacgguuggaaccuggucaaguugcauucgggcaaggacgucuucuucaccccaccugagaagugcgacacgcugcuaugcgacaucggggaauccagccccaauccgacgaucgaagagggucgcacccucagagugcucaaaaugguagaacccuggcuuagggguaaccaguucuguaucaagauccugaaccccuacaugccuucggucguagagacccucgagcagaugcaaagaaagcacggaggcaugcuggugcggaacccgcuuagucgaaacuccacccacgaaauguacugggugagcugcggaacgggcaacauuguauccgccguaaacaugaccagccggauguuacuaaaucgauuuaccauggcccaccgaaagccuaccuacgagcgggacguggaccugggggcaggcacgcggcauguggcgguggaaccagagguugccaaccuggacaucaucggccagcggaucgaaaacaucaagcaugagcacaaauccaccuggcacuaugacgaagacaaucccuauaagaccugggcguaccacggguccuacgaagugaagccauccggcagcgcuagcuccauggucaacgggguagugaagcugcugaccaagccaugggacgugaucccaaugguaacacagauugccaugaccgacaccacgcccuucggccagcagcggguguucaaagagaaaguugacacgcguaccccgaaggcgaagagggggaccgcgcagaucauggaggugaccgcacgguggcucuggggcuuccugagccgcaacaagaagccccggaucugcacgagggaagaguuuacccggaaggugcgcucgaacgccgcuauaggagcggucuucguagacgagaaccaauggaacagcgccaaagaagccguggaggacgagagguucugggaccugguccaaaaggagcgagaacuccacaagcaagggaagugcgcaaccugcguguacaacaugauggggaagagggagaagaaacucggggaguucggcaaggcuaaggggucucgugccaucugguacauguggcugggcgcccgguuucuagaauucgaagcccugggcuuuaugaaugaggaccacugguucagccgcgagaacucccugagcgggguggagggcgagggcuugcauaaacugggcuacauccugcgcgacaucuccaaaauacccgggggcaacauguacgccgacgacaccgcugguugggauacgcgcauaacugaggacgaucuccagaacgaagccaagaucaccgauaucauggagccggaacacgccuuacuggcuacuucgaucuucaagcucacauaucagaacaaggucgugaggguacaaagaccagccaagaacgggaccguaauggaugugauuucuagaagggaccaacgcggcagcgggcaggugggcaccuacggccugaacaccuucacgaauauggaggcucagcugaucaggcagauggaauccgaggggaucuuucuccccagcgaacuggagacccccaaccuggcggaacgcguccuagacuggcuggagaaguacgggguggaacgguuaaagaggauggcgauauccggagacgacugcguggucaagccgauugacgaccgauucgccaccgcccucacggcauuaaacgacaugggaaaggugcgcaaggacaucccccagugggagccgagcaagggauggaacgacuggcagcaggucccauuuugcucccaucauuuucaccaacugauaaugaaggacggccgggaaaucgucgugccaugccguaaucaagacgagcucgugggucgggccaggguaagccagggagccggcuggagccuucgggaaacagccugccuggggaaguccuaugcucaaauguggcagcucauguacuuccaucgucgcgaccugcgacuggcggccaacgccauaugcucagccguuccgguugacuggguacccaccagccggaccacauggagcauccaugcucaucaccaguggaugacgacggaagacaugcugagcguauggaaccgcguguggaucgaggagaaucccuggauggaagacaagacacacguguccucguggggcgacgugccuuacuuaggaaagagggaggaccaguggugcggcucccugaucggucuuacugcccgcgcuacuugggccucuaacauccagguggccaucaaucaggucaggcggcuuauagggaacgagaacuaccuggacuacaugaccaguaugaaaagguucaagaaugaaggcgaccccgagggggcacuuugguga

SEQ ID NO: 24562 - RNA, 9879 nt, Artificial Sequence
  derived and/or modified CDS sequence (opt11) from DENV-1__EU482482__SS-prME
agcgugaccauguugcugauguugaugcccaccgcccuggcguuccaccucacuacucgaggaggggagccacauaugaucgucagcaagcaggaacggggcaagagccuccuguucaagaccagugccgggguaaacaugugcacucucaucgcgauggaccugggcgaguuaugcgaagauacuaugaccuacaagugcccccggaucacggagaccgagccugaugacguggacugcuggugcaacgccacugacaccugggucaccuacgggacaugcagccagacgggcgaacaccggcgggacaagcggagcguggcccuggcgccccacgugggucuggggcuggagacccggacagagacguggaugagcuccgagggagcuuggaagcagauccagcggguagagacgugggcccuccggcaccccggauucaccgugaucgccuuauuccucgcccacgcgaucggaaccagcaucacccagaaggggaucauuuucauccuuuugauguuagugacgcccaguauggccaugcgaugcgucggcaucgguagccgcgacuucguggagggccucuccggugccaccuggguggauguggugcuugagcacgggagcugcguaaccacaauggcgaaggacaaacccacguuagauauugaguugcugaagacugaaguaacuaaccccgccgugcuccggaagcucugcaucgaggcgaagaucuccaacaccacgaccgacagccgcugcccgacccagggcgaggccacccugguugaggagcaggaugccaauuuuguaugccggcguacauucguggauaggggcugggggaauggcugcgguuuauucgggaaggggucccucaucacgugcgcuaaguuuaagugcgugaccaagcuagagggcaagaucguccaguacgagaaucugaaguauuccguuauagugacgguccacacgggcgaccagcaccaaguugggaaugaguccacugagcacggaaccacagccaccaucacgccccaggcgccgaccaccgagauccagcuaaccgacuacggggcucugacgcuugacugcagcccccgcacgggccucgacuucaacgagauggucuuacucaccaugaaagagaaaucguggcucgugcacaagcagugguuccuggaccugccacuccccuggacgagcggugccagcaccucccaggagaccuggaaucggcaggaccugcuggugaccuucaagacggcucacgcuaaaaagcaggaggucguugugcuuggcagccaagagggcgcgaugcacacggcccugaccggagcgaccgagauccagaccuccggcacgaccaccaucuuugcuggucacuugaagugcaggcucaagauggauaaacugacccugaaaggcaugagcuacgucaugugcacgggcuccuucaagcucgaaaaagagcuugccgagacgcagcacggcaccguacuggugcagauaaaguacgagggcacggacgcgcccugcaagauccccuucagcacucaggacgagaagggggugacccagaacggccggcugaucaccgccaacccgaucguaacugacaaggagaagcccgugaacaucgaggccgagccgcccuucggggaauccuacaucgucaucggugccggcgagaaggcgcugaagcugagcugguucaagaaaggauccucuauaggaaagauguucgaagccacggcccgcggugcgcggaggauggccauccugggcgacaccgcgugggacuuuggguccaucggcggcguguucaccucaguugggaagcucguccaucagaucuucgguaccgccuacggugugcuguucuccggagugaguuggacgaugaagauugggaucggaguccugcucaccuggcugggucugaacucccgcagcaccucccucagcaugacuugcaucgccguggggcuggugacgcucuacuuaggcgucaugguccaggccgacucggggugcgugaucaauuggaagggccgggagcugaaaugcggaagcggcaucuucguuaccaacgaggugcacaccuggacugagcaguacaaguuccaggcugacagcccgaagcggcuguccgcggcaaucgguaaggcgugggaggaaggggugugcggcauccggucggcuacccgcuuggagaacauaauguggaagcagaucagcaacgagcugaaccauaucuuacucgaaaacgacaugaaauucacggucgugguuggggauguugccggcauccuggcgcaggguaagaagaugaucaggccucaacccauggaguacaaguacagcuggaaaucguggggaaaggccaaaaucaucggcgcugacgugcagaacaccacuuucaucaucgacggucccaauacgccggagugccccgacgaccaacgcgcuuggaauaucugggagguggaagacuacgguuucggaaucuucacaaccaacaucuggcugaaacuucgggacagcuacacccaggugugcgaccaucgccugauguccgcggccaucaaagauucaaaagccgugcacgccgacaugggauauuggaucgagucggagaagaacgagaccuggaagcucgcccgggcgagcuucaucgagguuaagacaugcauuuggcccaagucccacacucucuggagcaacggcguccucgaguccgagaugaucauccccaagaucuacgguggcccgaucagccagcacaauuaccggcccggguacuucacgcagaccgccggccccuggcaccugggaaaacucgagcuggauuucgaccuuugcgaaggaacgaccgugguggucgacgaacacugcggcaaccggggcccgucccugcguacgacaacggugaccggcaagauaauccacgaguggugcugccggaguugcacacugccgcccuugcgcuuuagaggggaggacggcuguugguacgggauggagauccgccccgugaaggaaaaagaagagaaccucgucaaaucgauggugagcgccggaagcggcgaagucgacuccuucucgcugggccugcucugcaucucgaucaugauugaggaggucaugcggagccgcuggucccggaagaugcugaugaccggcacacuggcgguauuuuuccuccugaucaugggucagcugacauggaaugaucucauucgccugugcauuaugguaggggcuaacgcgagcgaccgcauggggaugggcaccacguaccuugcccuuauggcaacguucaaaaugcggccaauguucgccgucggccuguuauuucgcagacucacuuccagggagguguuauuacucaccaucggcuugagccuuguggccucugucgaguuacccaacucucuggaagaguuaggcgaugggcucgcgauggguaucaugauccugaagcugcucaccgacuuccagagccaucaacugugggccacacugcucagcuuaaccuucauaaagaccacauucuccuuacacuaugccuggaagaccauggccaugguacucucaaucgucucccucuuuccccugugcuugagcaccacgagucagaaaacaacuuggcuccccgugcuucucggcagccuggggugcaagccgcugaccauguucuuaaucgcggagaacaagaucuggggcaggcgcuccuggccucugaacgaggguaucauggccguugguauagugucaauccuacucucuucccugcugaagaacgacguuccccucgcggggccccugauugccggcggcauguugaucgccugcuacgugaucagcgguuccucugcggaccucagccuggagaaggccgccgaagucagcugggaggaggaggccgaacacucgggcgcaucccauaacauccugguugaagugcaggacgaugggaccaugaagaucaaggacgaggagcgggaugacacacucaccauccugcugaaagcuacguugcuggccgucuccggcgucuacccguugucuauccccgccacgcuuuucgugugguauuucuggcaaaagaaaaagcagagguccggggugcugugggacacccccagcccuccugaggucgaacgggccgugcuugacgacgguaucuauagaaucaugcaaagaggccugcuagggcgcucccaggucggcgugggaguguuccaggagaacgucuuccauaccauguggcacgugacgcggggcgccgugcugauguaccaagggaagcgcuuagagccaagcugggcgagcgucaagaaggaccucaucagcuacggggguggcuggcggcugcagggcucguggaacaccggggaggagguccaagucaucgccgucgaacccggcaagaacccgaagaacgugcagaccgccccugggaccuucaagacgcccgagggggaagugggcgcuaucgcccuggauuucaagcccgggaccagcggcucccccaucgugaacagggaagggaaaaucguaggccucuauggcaacggaguggucaccaccagcggcacguacgugucagcgauagcccaggccaaggccucccaggaggggccgcugccggaaaucgaggacgagguguuccggaagcggaacuugaccaucauggaccuccacccuggcagcgggaaaacgcggcgcuaccugccggcgaucguccgggaggccaucaagcguaagcugcgcacccugaucuuagcaccuacgcggguaguugcuuccgagauggcugaagcucugaagggaaugcccaucagauaccagaccaccgccgucaagucagagcauacggguaaggagaucguugaccucaugugccacgccacguucacaaugcggcugcuguccccaguucgcgugccgaacuacaacaugaucaucauggacgaggcccauuucaccgacccgagcuccaucgccgcgcggggguacaucuccacccgcguaggcaugggggaggcugcugcuaucuucaugacggccacuccgcccggcuccguggaggcguucccacagucuaacgccgucauucaggaugaggagcgggacauccccgaaaggaguuggaacagcggauacgaauggaucacagacuucccugggaagaccguaugguucgugcccucgaucaaaagcgggaacgacaucgcuaacugccuccggaaaaacgggaagagaguaauccaacugucgcggaaaacguucgauaccgaguaccaaaagaccaagaauaacgauugggacuacgugguaaccacggacaucagugagaugggggcgaauuuccgcgcggaccgggucaucgaccccagacguugccuaaagcccgugauccucaaggacgggcccgagcgcgugauccuggcgggccccaugccggucaccguggccagcgccgcccaacggcgcgggcggauaggccgcaaccacaacaaagagggagaccaguauaucuacauggggcagccauuaaacaacgaugaggaccacgcucauuggaccgaggccaagaugcuucuggacaacaucaauacgccggagggcauuauccccgcccuguucgagccggagcgcgagaaguccgccgccaucgacggggaguaccggcuccgcggagaggcgcggaaaacguucgucgagcugaugcgcagaggggaccugccgguguggcuauccuauaaaguggccagcgaaggcuuccaguacagcgauaggagauggugcuucgacggcgagcgcaacaaccagguccuugaggagaacauggauguugagaucuggacgaaggaaggggaacggaagaagcugcgaccccggugguuggacgcccguacguacuccgacccccuagcccugcgggaguucaaggaguucgccgcgggccgccggagcguauccggggaucucauccuggagaucggcaaguugccgcagcaccucacccagcgcgcccagaacgcccuggacaaucugguaaugcuccacaacagugaacaaggagggagagccuaccgccacgcgauggaggagcugcccgacacgaucgaaacccuuaugcuccuugcccucaucgccgugcucaccggcggugugaccuuguucuuccuguccgggcggggguugggcaagaccaguauaggcuuacugugcgucauggccagcagcgugcuucuauggauggccuccguggaaccccauuggaucgcggccagcauuauccuggaguucuuccuuaugguccugcuaauucccgagccagaucgccagcggacgccccaggacaaccagcuagccuaugugguuaucggccugcuguucaugaucuuaaccgucgccgccaacgagaugggccuguuggagaccacgaagaaggaccucgggaucggccacguggcgguggagaaccaccaccacgccgccaugcuugacgucgaccuccaccccgccuccgcauggacccucuaugcagucgccacgaccaucaucacccccaugaugcgccauacgaucgagaacaccacugcaaacaucucccugaccgccaucgcuaaucaggcggcgauccugauggggcucgacaaaggguggcccaucucuaagauggauaucggcgugccccuuuuggcccucgggugcuacagccaggucaaccccuugacccugaccgccgcagugcucaugcugguggcccacuacgccaucaucggcccugggcugcaggccaaggcgacaagggaagcgcagaagcggaccgccgcuggcaucaugaaaaacccgacggucgacgguaucguggcgauagaccucgaccccgugguuuacgacgccaaauucgagaagcaguuagggcaaauuaugcugcucauccuguguaccucucagauucugcucaugcggaccaccugggcguugugcgaaagcauuacgcuggccacuggcccccucacgacccugugggaggggucgccgggcaaguucuggaacacaaccaucgccguuaguauggcuaacaucuuucgggggagcuaccuggcuggagcuggccuggccuucagccugaugaaaagccucgggggcgggcgccggggaaccggcgcccagggugagaccuugggggagaaguggaagcgccagcuuaaccagcuuuccaagagcgaguucaacaccuauaagcgguccgguaucauggagguggaccgcagcgaggcuaaagagggccucaaaagaggggaaacgaccaagcacgcagugucgcgcggaacagccaaguuacggugguucguggaacggaaccuggucaagcccgaagggaaagucaucgaccugggcuguggccgcgggggcuggagcuacuacugcgcugggcucaagaaggugacggaggugaaggguuacaccaaggguggccccggccacgaggaaccaaucccgauggccaccuacggguggaaccuuguaaagcugcacuccggcaaggacguguucuucaucccgcccgagaagugcgacacccucuuaugcgacauuggggagagcuccccgaacccgacgaucgaggaaggccguacccuacgcguacucaagaugguagagcccuggcugcgagguaaccaauucuguaucaagauacugaaccccuacaugcccagcgugguagagacgcuagagcagaugcaacggaagcauggcggcaugcugguccgcaacccgcugucuagaaacagcacucacgagauguacuggguguccugcgggaccgggaauaucguaucggccgucaacaugacgucccgcauguugcuuaaccgguuuaccauggcgcauagaaagcccacguacgagcgcgacguggaccugggugccgguacccggcacguagcagucgagccagagguggccaaccucgacaucaucgggcagcgcaucgagaacaucaagcacgaacacaagagcacguggcacuacgacgaggacaaccccuauaagaccugggccuaccacgggucuuacgaggugaagccgagcggcuccgcgagcuccauggucaacgggguugucaagcugcugaccaagcccugggacguuauccccauggugacccagauagccaugaccgacacuaccccuuuuggccagcagcgugucuuuaaggagaagguagacacccgcacgcccaaagccaagagggggaccgcccagaucauggaggugaccgcaaaguggcucuggggcuuccuaucccgcaauaaaaagccccggaucuguacccgcgaggaguucacucggaagguccggagcaacgcagcuauuggcgcagucuucguggacgagaaccaguggaacuccgccaaggaggcggucgaggaugagcgguucugggaccucgugcaccgagagagggagcuccauaagcaggggaaaugcgcgacgugcguguacaacaugaugggcaagcgggagaagaagcugggggaguucgggaaggcaaagggaagccgggccaucugguacauguggcugggagcccgcuuccuagaguucgaagcgcugggcuucaugaacgaagaccacugguucagccgggagaacagccuguccgguguagagggcgaggggcuccacaagcugggcuacauccuccgcgacaucagcaagauccccgguggcaacauguacgccgacgacaccgccggaugggacacccgcaucacggaggacgaccuccagaacgaggcccgcauuaccgacauaauggagccggagcacgcacugcuagcgaagaguaucuucaagcucacguaucagaacaaggugguacgcguccagagaccagccaagaacgguaccgugauggacgugaucagccgccgggaccagcgcggcuccgggcaggucggcacuuauggccugaacacauucacuaacauggaggcccagcugaucaggcagauggaaagcgaggggaucuuuucccccagcgagcucgagaccccaaacuuagccaagcgcgugcuagacuggcucgagaaguacgguguggagcggcugaagcgcauggcaaucuccggggacgacugcguagugaagccgauugacgaccgguuugcgacggcccugacugcacuuaacgacaugggcaaggugcgcaaggacaucccccaaugggaacccagcaagggguggaacgacuggcagcagguuccguucuguucgcaccacuuccaccagcuaaucaugaaggacggucgcgagauagucgugcccugucgcaaccaggacgagcugguuggccgagcccgcgugucacaaggggccggcuggucccuccgugagaccgcaugccuggggaaaucguacgcacagauguggcagcuuauguacuuccaccggcgggaucuccgccuggccgccaacgccauaugcagcgccgugcccguggacuggauccccacgucccggacgaccugguccauccaugcccaccaucaguggaugacaaccgaagacaugcugucaguguggaaccgcgucuggaucgaggaaaaccccuggauggaggacaagacacauaucagcuccuggggcgacgucccguaccucggcaagcgcgaggaccaguggugcgguucucuaaucggccugaccgcccgggccaccugggcgaccaacauccagguggccaucaaccaggugcgccgccucaucgggaacgagaauuaccuggacuacaugaccuccaugaaacgcuucaagaacgagagcgaccccgagggcgcccugugguga

SEQ ID NO: 24563 - RNA, 9879 nt, Artificial Sequence
  derived and/or modified CDS sequence (opt11) from DENV-1__EU482485__SS-prME
agcgugacuaugcugcucaugcugaugcccaccgcgcuggccuuccaccugaccacccggggcggggagccccacaugaucgugagcaagcaggaacggggcaagagccugcuauuuaaaaccucggccggggugaacaugugcacguuaaucgccauggacuuaggggagcucugcgaggacaccaugacguauaaaugcccccggaucacugagaccgagcccgacgacguggacugcuggugcaacgccacagacaccugggugacauaugggacgugcucgcagacgggcgagcaucggcgcgacaagcgcuccguggcccucgcgccccacguaggccuagggcuggagacccggaccgagaccuggaugagcuccgagggcgccuggaagcagauccagcguguugaaacgugggcguuacgacaccccggguucaccguuaucgcccuguuccuggcgcacgcgauugguaccuccaucacccaaaaggggauuaucuucauacugcugaugcugguaaccccaagcauggccaugcggugcgucggcauuggcucccgggacuucguugaagggcucuccggcgccacuuggguagacgucgugcuggagcacggguccugcgugaccaccauggcgaaagacaagccaacacuggacaucgaacuccugaagaccgaggucaccaaccccgccguucuccggaagcucuguaucgaggcgaagauaagcaacacaacgaccgacucucggugcccgacccaaggugaagcaacccugguagaggagcaggacgccaacuucgugugccggagaacguucguggaccggggaugggggaacggcugcggucuguucggcaaggguucccucaucacgugugccaaguucaaaugcgucaccaagcuagagggcaagauaguccaguacgagaaccuuaaauacagcguaaucgugaccguccacacgggggaccagcaccagguggggaacgaauccaccgagcauggcacuaccgccaccaucacgccccaggcgcccacgacugagauccaacugaccgacuacggggccuuaacgcuggauuguagcccccgcacaggauuagauuucaacgagaugguucuucugaccaugaaagaaaaguccuggcucgugcacaaacaaugguuccuggaccugccucucccuuggaccagcggugccagcacgucccaagaaacguggaaccggcaggaccugcuggucacuuucaagacagcgcacgcuaaaaagcaagaggucguggugcucgggagccaggaaggcgcgaugcauacggcccugaccggagccaccgagauccagaccuccgguaccaccaccauauucgcuggacaccugaaauguagacucaagauggacaagcuuaccuugaagggcaugucauacgucauguguacgggauccuucaagcucgagaaggagguggcggaaacgcaacauggcaccguguugguccagauaaaguacgagggcaccgacgcgcccugcaagaucccguucucaacgcaggaugagaaggggguaacucagaacggccggcugaucacagccaacccgaucgucacggacaaggagaagccgguuaacaucgaagcugaaccgcccuucggcgaguccuacauagugaucggcgcgggggaaaaggcgcugaagcucagcugguuuaagaagggguccagcauaggaaagauguucgaggcuacggcccgcggugcccggcgcauggcgaucuugggcgacaccgcuugggacuuugggucaauaggcgggguauucaccucggucgggaagcugguacaccaaaucuucggcaccgcuuacggugucuuauucucaggcgucagcuggacgaugaagauugggaucggcgugcuacuaaccugguugggccugaacagccggagcaccucccucagcaugacgugcaucgccguugggcucguaacgcuauaccugggcgucaugguacaagccgacuccgggugcguuaucaacuggaagggccgugagcuuaagugcggcagcggaaucuucguuaccaacgaggugcauaccuggacagaacaguacaaauuccaggccgacaguccgaagcggcucuccgcggccauuggcaaggccugggaggaagggguuuguggcauccgaucagccacccgccuggagaacaucauguggaagcagaucuccaaugaacucaaccacauccugcuggagaacgacaugaaguucaccgugguagucggagacgucgccggcauccucgcgcaggggaagaaaaugaucagaccacaacccauggaguauaaguauagcuggaaguccuggggcaaggccaagaucauaggagccgacgugcagaacacuacauucaucaucgacgggcccaacacgcccgagugcccggaugaccagagggcuuggaacaucugggagguugaggauuauggcuuugggaucuucacgacgaacaucuggcugaagcugcgggacaguuacacccagguaugcgaucaccggcugauguccgcagccaucaaggacucgaaggccguacacgcagacaugggauacuggaucgaguccgagaagaacgagaccuggaagcuagcccgggccagcuucaucgaggucaaaacgugcaucuggcccaaaucgcacacccuguggagcaaugguguucucgaguccgagaugaucauccccaaaaucuacggggggccgaucagccagcacaacuaucgcccaggguacuucacccagaccgccggcccuuggcaccuggggaagcuggaauuggacuucgaccucugcgagggcacgaccguggucguggacgaacacugcggcaaccgggggccuucacugcgcacuacaacggucacgggcaaaauuauacacgaguggugcugucggagcugcacccuuccaccacuccgcuucaggggagaggacggcugcugguacggcauggagauucgcccaguaaaggagaaggaggagaaccuaguuaaauccauggugagcgcugggagcggcgagguugacuccuuuucccucggccugcuguguaucaguaucaugaucgaagaggugaugcggagccguugguccaggaagaugcucaugaccggcacccuggccguguuuuuccugcucaucaugggacagcuaacguggaacgaccugauccgucugugcaucauggucggcgccaacgcgagcgaccgcauggggaugggcaccacguaccuggcccugauggccaccuucaagaugcggcccauguuugccgugggguuacuguuccgccgauugaccucccgcgaggugcuccugcugaccaucgggcuaucgcugguggccuccguggagcugcccaauagccucgaggaauugggcgacgggcuggcuaugggaaucaugauccucaaguuacugaccgacuuccagucccaccagcucugggccacgcuccugagucucaccuucaucaaaaccaccuucucccugcauuaugccuggaaaacgauggccaugguguugucgaucgugucacucuucccuuuaugcuugagcaccaccucccagaagacgacuuggcuccccguguuacugggcucgcucgggugcaagccgcugaccauguucuuaauagcugagaacaaaaucuggggcaggcgcagcuggccucuuaacgaggggauuauggccguuggaaucgugagcauccuguuaagcucuuugcugaagaacgacgugccccuagccgggccauugauagccgggggaaugcugauagcuuguuacgucaucagcgggaguucugcggaccuaucucucgagaaggccgccgaggugagcugggaagaggaggcugagcauuccggcgccagccacaacauauuaguugagguucaagaugacgggaccaugaaaauaaaggacgaggaacgggacgauacgcugaccauccucuuaaaggcgacguuacucgccgugucuggcguguacccgcugucgauccccgccacccuguuuguuugguacuucuggcagaagaagaagcagcgcuccggggugcucugggacacccccagcccgcccgagguggggcgggccguccuggaugacggcauauaucgcaucaugcagcggggucugcugggccgcucccagguaggcgugggcgucuuccaggagaacguguuucacacuauguggcaugucacacgcggcgccgugcugauguaucagggaaagcgacucgagcccagcugggcguccgugaagaaggaccucauauccuacggcgggggauggcgauuacagggcucauggaauacgggcgaagaggugcaggucaucgccguggagcccgggaagaaccccaaaaaugugcagaccgcccccggaaccuucaagacucccgagggagaggucggcgccaucgcccuggacuuuaagcccggcaccagcgggucccccaucguaaaucgcgagggcaagaucgugggccuguacgggaauggugucgucaccaccagcgggacguacguuagcgcgaucgcccaagccaaagccucccaggaggguccacucccagaaauagaggacgaagucuuucguaaaaggaaccugaccaucauggaccugcaccccgggagcggcaagaccaggagauaccugcccgcgauagugcgggaagcgauuaagcgcaagcugcgcacccucauccucgcacccacgcggguagucgccuccgagauggcugaggcacucaaaggcaugcccauccgcuaccaaacgacggccgucaagagcgaacacaccggaaaagagauuguggaccugaugugucaugccacguucaccaugcggcuccucaguccaguacgugugccuaacuacaacaugaucaucauggacgaggcccacuucacugaucccucguccauugccgcccggggguacaucagcacccgagucgguaugggcgaggccgcagcgaucuucaugacggccacgccucccggguccgucgaggccuucccgcagagcaacgccgugauacaggacgaagagagagacauccccgagcguuccuggaacagcgguuacgaguggauaaccgacuucccgggaaagaccgugugguucguccccuccaucaagagugggaacgacaucgccaacugccugcgcaagaacggcaaaagggugauacaacucucccgaaagacguucgacacagaguaccagaagaccaagaacaacgauugggacuacgugguuaccacugacaucucagagaugggcgccaacuuccgcgcggaccgggugauagacccgcgccggugccugaagcccgugauacugaaggacggaccugagcgcguuaucuuggcugggccuaugccggugacagucgcauccgccgcacaacggcgcggcagaauaggccgcaaccacaacaaggagggagaccaguauaucuauaugggccagccucugaacaacgacgaggaccacgcgcauuggaccgaggccaagauguuacuugauaacaucaauacaccggagggaauaauacccgcucuuuucgagcccgaacgcgagaaguccgccgccauagacggcgaguaccggcugaggggggaggcgcggaagacguucguggagcucaugcgcaggggagaccugccuguguggcuguccuacaaggucgccucugagggguuccaguacagcgaccgucgguggugcuucgacggagagcgcaacaaccaaguucucgaggagaacauggauguggagaucuggaccaaagagggggagcggaagaagcugcgaccccgguggcuggacgcccgcacguacagugacccccuagcccugcgagaguucaaggaauucgccgcggggcgccggagcgucuccggcgaccugaucuuagagaucggcaaguugccgcagcaccucacucagcgcgcccaaaacgcacucgauaacuugguuaugcugcacaacagcgagcaaggcggccgggccuaccgacacgccauggaggaguugccggacacgauugaaacccugaugcugcuggcccuuaucgcggugcucacugguggggucacccucuucuuccuuuccggacgcggccuggggaagaccagcaucggccugcuuugugugauggccucuucggugcugcucuggauggcauccguugagccccacuggaucgcggcuucaauuauauuggaguuuuuucugauggugcugcugauccccgagccggaccgacaacggaccccacaagacaaccagcuggccuacguggucaucggccuccuguucaugaucuugacuguugccgccaacgagaugggacuucuggaaaccaccaagaaggaccugggcaucggucacguggcggucgagaaccaccaccacgccgccaugcucgauguggaucuccauccagccucagccuggacguuguacgcgguggccacgaccaucauaaccccgaugaugcgccauacgaucgaaaacacuaccgccaacauuucacucaccgccaucgcgaaccaggccgccauccucaugggccuggauaagggcuggcccaucucaaagauggauaucggcgucccccuccuugcccugggcugcuacucacaagugaauccgcucacgcugaccgccgcuguucuaaugcucguagcccacuacgccaucaucgggcccggucugcaggccaaggccacccgcgaggcccagaagcggaccgcagccggaaucaugaaaaaccccacaguggacggaaucgucgccaucgauuuggaccccgucguauacgacgccaaguucgaaaagcagcucggucaaaucauguuacugaucuuaugcaccucacagauuuuauugaugagaaccaccugggcgcuuugcgaaucgaucacccuagccaccggucccuugacgacccuuugggagggguccccggggaaauucuggaacacgacgauugccgugucuauggcuaacauauuccggggcuccuaccuggccggcgcagggcucgccuucagucucaugaagucgcugggcgggggccgccgggggaccggcgcccagggcgagacccugggggagaaguggaaacgccagcuuaaccagcuguccaagagcgaguucaauacguacaaacgguccggcaucauggaagucgacagguccgaagccaaggaggggcuuaagcgaggcgaaaccaccaaacacgcgguguccagggggaccgcgaagcugcguugguucguggagcgcaauuuggucaaaccggaaggcaagguaaucgacuuaggcugcgggcggggugggugguccuacuauugcgccggccugaaaaaggugacggaggucaagggguacaccaaaggcggcccagggcacgaggagcccauuccgauggccaccuacgguuggaaccucgugaagcugcacucaggcaaggacguguuuuuuauaccgcccgagaagugcgacaccuuguugugcgacaucggugagagcucucccaauccuacgauagaggagggcaggaccuugaggguccugaagaugguggagcccuggcuccgcggcaaccaguucugcaucaagaucuuaaauccauacaugccgagcgucgucgagacccuggagcagaugcaacguaaacacggcgggauguuggugcgcaacccgcugucccggaacagcacucacgagauguauugggucuccugugggaccgggaacauugucuccgccgugaauaugacuucccgcauguugcucaaccgcuucacaauggcgcauaggaagcccacauacgagcgcgaugucgaccucggcgccggaacccggcauguugccguagagcccgagguggccaaccucgacaucauagggcagcgcaucgaaaacaucaagcacgagcacaagucuacuuggcacuacgacgaagacaaccccuacaagacuugggcguaccacggauccuacgaggucaagccgagcggguccgcaagcagcaugguaaauggcgucgugaagcuucugacuaagcccugggauguuauccccauggucacccagaucgccaugacggacaccacccccuucgggcagcagcgggucuucaaggaaaagguagacacccguacgccaaaggcgaaacggggcaccgcccagaucauggagguuaccgccaaauggcuguggggcuuccucucccgcaacaagaagccccguaucugcaccagggaagaguucacucggaaggugcgaucuaacgcggcgaucggggccguguucgucgacgagaaucaguggaacucggccaaagaggcgguggaggacgagagauuuugggaucuaguucaccgcgaacgcgagcugcacaaacagggcaagugcgcgaccugcgucuacaauaugaugggcaagagggagaaaaagcugggcgaguuugggaaggccaagggcagccgggcuauuugguacauguggcuaggggcgagguucuuagaguuugaggcgcucggguucaugaacgaggaucacugguucucccgggagaacagccugucaggcguggagggggagggccugcauaagcucggguacauccugcgcgacaucagcaacauccccggcggaaacauguaugcagacgacaccgccggaugggacacccggaucacagaggacgaccugcagaacgaggcccgcauaaccgacaucauggaaccugagcaugcccuccuggcgaaauccaucuuuaaacugaccuaucagaacaaagugguaagagugcagcggcccaccaagaauggcacugucauggacgucauuagucgcagggaccagaggggguccggucagguuggcaccuacgggcucaauacuuuuaccaacauggaggcccagcugauacggcagauggagagugaaggcauuuucagccccucggagcuggagacgccaaaccucgcugagcgcguacuggacuggcuggaaaaguacggggucgagcggcucaagcgcauggcaauauccggcgaugauugcguagucaagccgguagacgaccgcuucgccaccgcgcugaccgcgcugaacgauauggggaaaguacgcaaggauaucccucagugggaacccagcaaaggcuggaacgacuggcagcagguccccuucugcucccaccacuuucaucagcucaucaugaaggacggccgugagaucgucgugccaugccgcaaccaggaugagcuggucggucgggcccgggucagccagggggccggguggagccugcgggagaccgcuugccuuggcaaauccuaugcgcagauguggcagcugauguauuuccacagacgggaccugcgccuugccgccaaugccaucugcagcgcgguccccguggauuggauuccgacgucccguaccacuuggagcauccacgcccaccaucaguggaugaccacggaggacaugcuguccgucuggaaucgaguguggaucgaggaaaaccccuggauggaggauaaaacccacauuucuuccuggggcgacguaccguaccugggcaagcgugaggaccaguggugcggcagccucauagggcucacugcgcgggcaaccugggccacaaacauccaagucgcgauaaaccaggugaggcggcuaaucggcaacgaaaacuaccuugacuacaugacaaguaugaagcgcuucaaaaacgagagcgacccagagggagcccugugguga

SEQ ID NO: 24564 - RNA, 9879 nt, Artificial Sequence
  derived and/or modified CDS sequence (opt11) from DENV-1__EU482486__SS-prME
ucaguuaccauguugcugauguugaugccuaccgccuuggccuuccaucucacuaccagagggggcgagccccacaugaucguuagcaagcaggagcggggcaagagccuacucuucaagaccagcgcggggguuaacauguguacucucaucgcuauggaccugggagagcuuugcgaggacacaaugaccuacaagugcccucguauaaccgagguggagccggacgacguugacugcuggugcaacacgaccgacaccugggugaccuacgggaccugcagccagacgggcgagcacagacgcgacaagcgguccguggcguuagcgccgcacgucggccucgggcuggagacccgggcagagaccuggauguccucggagggcgcguggaagcagauccagaagguugagaccugggcccucagacaccccggcuuuacggugaucgcccuguuccucgcccacgcgauaggcaccagcaucacucagaaggggaucaucuuuauccuccugaugcugguaaccccauccauggccaugcgcugcguggguauaggcagccgggacuuuguggaggggcuaucaggggccacuugggucgacgugguccuagagcacggcuccugcguuaccacaauggcgaaggacaagccgacccuggauaucgagcuacugaagacggaggugaccaaccccgcagugcugcgcaagcuaugcaucgaggcgaagaucuccaacaccacuaccgauucaaggugccccacccaaggcgaagccacccuggucgaggaacaggacgccaacuucgucugucgccggaccuuuguggacaggggcugggggaacggcugcgggcuuuuuggcaagggcucccuaaucacgugugccaaguucaagugcguuacaaaacuggagggcaaaaucguucaguacgagaaccugaaguacucaguuaucguaacgguucacaccggcgaccagcaccaaguggggaaugagagcacggagcauggcacuaccgccaccaucacgccccaggcacccacgagcgagauacaacucaccgacuacggggcgcugacgcuggacugcagcccccgcacuggccucgauuucaacgagauggugcuucucacgaugaaagaaaagucguggcucguacacaaacaaugguuccuggaccugcccuuacccuggaccagcggggccuccacuagccaggagaccuggaaccgccaggaccugcuggugacguucaagaccgcccacgccaagaagcaggagguggugguccucggcagucaagagggcgcuaugcacacugccuuaacaggggccacagaaauacagacgucuggcacaaccacaauauucgcagggcaccugaagugucggcucaagauggauaagcugacguuaaagggcaugucguacguuaugugcaccgggcuuuuuaagcuggaaaaggaaguggccgagacccaacacggcacgguauuggugcaaaucaaguacgagggaaccgacgcgccaugcaagaucccauucagcacccaggacgagaagggggugacgcagaacggacgccugauaacagcaaacccaaucgucacggacaaggagaagcccgugaacaucgaggccgagccgccguuuggcgagucauauauagugaucggcgccggcgagaaagcauugaaacuuagcugguucaagaaggguuccagcauagguaagauguucgaggccaccgcccgcggggcacgccggauggccauacugggcgacacagccugggacuuugggagcauuggcggaguauucacgagcguugggaagcucguccaccagaucuucgggacggcauacgguguuuuauucuccggugugaguuggacgaugaagaucgguaucggugugcugcucaccugguugggacugaacucccgaucgacaagccucaguaugaccuguaucgcggucgggcucguuacccuguacuuagguguaaugguccaagccgauuccgggugcgugaucaacuggaagggcagggaguugaagugcgggagugggauauucgucacuaacgaaguccacacguggaccgagcaguauaaauuccaagccgauagcccgaagcggcucucugcggcuaucggaaaggcaugggaggaaggggugugcggcauccgcuccgccacccgacucgagaacauaauguggaggcaaauuucgaacgagcugaaucacauccugcucgagaacgacaugaaauucaccgucguggugggcgaugucgucggcauccuugcucaagggaagaagaugauacggccgcagccuauggagcacaaauauagcuggaagaguuggggcaaagcgaagaucauaggcgccgauguacagaacaccacguucaucauagacgggcccaacacgccagagugccccgacgaccagcgcgcauggaauaucugggagguggaagacuacgguuucgggaucuucaccaccaacauuuggcugaaacucagggauucguacacacaggucugcgaccaccgccugauguccgccgcaaucaaagacucaaaggcagugcacgccgacaugggguacuggaucgaauccgagaagaacgaaacauggaaacuugcccgggccagcuucaucgagguaaagaccugcaucuggcccaagagucacacucucuggagcaauggcguccuggaauccgagaugauaaucccuaagauauacgggggccccauuucucagcacaacuaccgccccggguacuucacgcagacugcgggucccuggcacuuggggaaacuugaacuugauuucgaccugugcgaaggcacgacggugguggucgaugagcacugcggcaaccgggguccaucccuccgaacgacaacggugacaggcaagaucauucaugaguggugcugccgguccugcacgcuaccgccccuucgcuuuaagggggaggacggcuguugguacggcauggagauccggccuguaaaggagaaggaggagaacuuggugaagucaaugguuuccgccggcagcggcgaaguagauucauucagucuggggcugcucugcauaucaaucaugaucgaagaggucaugcggucgcgguggucccggaagaugcugaugacgggaacacucgccgucuuuuuccuccugauaauggggcagcuuaccuggaacgaccuuauccguaguuguauuauggugggcgccaaugcaucugaccggauggggauggggacgaccuaucuggcucugauggccacauucaagaugcgcccgauguucgcuguuggccuccuguuccggcgacugaccucccgugaggugcuccuguuaacgauuggguugucccuuguagcuagcgucgagcuuccuaauucccuggaggaacugggcgacggccuggcgaugggaaucaugauccucaaacuguuaaccgauuuucagucguaccaguugugggcgacgcuucugucccucaccuucauuaaaacaaccuucagccuccacuacgccuggaagaccauggccaugguucugucuauagugagccuccugccccugugccucuccacaacgucgcaaaagaccaccuggcugcccguccuuuuaggcucccuggggugcaaaccguugaccauguuccucaucgccgagaacaagauuuggggccgcaagagcuggccccuuaacgaggguaucauggcuguuggcaucgucucuauccugcuuucaagccuccugaagaaugacgucccauuagccggaccccugauugccggcggcaugcugaucgccugcuacgugauaucgggguccuccgcagaccucagccuagagaaagcggcagagguaagcugggaggaagaggcggagcacagcggagcuucgcacaacauccugguugaggugcaggaugacgguacuaugaagaucaaggacgaagagagggaugacacccucaccauucuguugaaggcuacccuccuggcggucucuggcguauacccgcugaguauccccgccacccucuucgugugguauuucuggcagaagaagaagcagagaagcggggucuuaugggauacgcccagcccucccgaaguggagcgcgcgguguuggacgacggcauuuaccguauuaugcagcgcggccuacucgggcgcagccaagugggcgugggcgucuuucaagagaauguauuccacacgauguggcauguaacccggggcgccgugcugauguaccaggguaagcgccuggagcccuccugggcuagcgucaagaaggaccucaucucauacggcggcggguggcgucugcagggcagcuggaacaccggggaggagguccaagugaucgcagucgagcccgguaagaaccccaagaacgugcagacggcucccgggaccuucaagacacccgagggcgaggucggcgcaaucgcucuggauuucaagcccgggaccagcggcagccccaucgucaaucgagagggaaagaucgugggguuauacggcaaugggguugucacgacuagcggaaccuacguuuccgccaucgcacaagccaaggcuagccaggaagggccucugccugaaaucgaggacgaaguauuccggaagcgcaacuuaaccauaauggaucugcauccugguagcgguaaaacacgucgcuaccugccggccauuguucgggaggcgauaaagcgcaaguuacguacacucauacuggcaccgacuagagugguggccagcgagauggccgaggcacugaaagggaugcccauccgcuaccaaaccacggcggucaaguccgagcacaccggucgugaaaucguagaccucaugugccaugcuaccuucacaaugagacugcugagcccugugcgcgugcccaauuacaauaugaucaucauggaugaggcccacuucacggauccaucuagcaucgccgcccgcggguacaucuccacccgagugggcaugggggaagcugccgccaucuucaugaccgcgacgccacccgggucuguagaagccuucccgcaguccaacgcggucauccaggacgaggagcgagacauucccgaacggagcuggaacagcggguacgaguggaucacggauuucccggggaagaccguaugguucgugcccucuaucaaguccgguaacgacaucgccaacugucuucgcaagaacgggaagcgggucauccaguugagucgcaagaccuucgacaccgaguaucagaagacgaagaacaacgacugggacuacgucgucaccaccgacaucuccgagaugggagccaacuucagagcugaccgcguaaucgacccgcgucgcugcuuaaagcccgugauccucaaggacggccccgagcgggucauucuggcgggcccgaugccagugacaguggcaagugcggcccaaagacgggggcgcaucggccggaaccacaacaaggagggagaccaguauauuuacauggggcagccacugaacaacgacgaggaccaugcccacuggacugaggccaagaugcuccuggacaacaucaauaccccagagggcaucaucccggcccuguucgaacccgagcgcgaaaaaucagcugccaucgacggggaguaccgacuccguggcgaagcgcgcaagaccuucgucgaauugaugagaagaggggaucuacccguguggcugagcuacaagguugcaagcgagggguuccaauauagcgaucggagauggugcuucgacggugagcggaacaaccagguccuggaagagaauauggauguagagaucuggaccaaagaaggggagcguaagaaacuucggccgcguuggcucgacgcccggacguacagcgauccccuggcccugcgcgaauuuaaagaguucgccgcgggccggcgguccguaucgggggaccucauccuagagaucggaaagcugccccagcaccucacccagagagcgcagaacgcccuggacaacuuagucaugcuucacaacuccgagcagggcgggcgcgcauaccgacacgcgauggaggaacuacccgacaccaucgagacccuuaugcuguuagcgcuuauugccgugcuuacuggcgguguuacacuguucuuccugagcggccgcggccucggaaagaccuccaucggccuccugugcguaauggccagcagcgcuuugcucuggauggcuagcgucgaaccccacuggaucgcggcaucuaucaucuuggaguucuuccuuaugguauuacucaucccagaaccggacaggcagcggacgccgcaggacaaccaacuugccuaugucgugaucgggcugcuguucaugauccucaccguugcugccaacgagaugggccugcucgaaacuaccaagaaggacuuaggcaucggacaugucgcgguggagaaucaucaccacgccaccaugcuggacguggacuuacacccggcaucugccuggacgcucuacgccgucgcgacgaccauuaucaccccuaugaugcgucauaccaucgaaaauacuaccgcgaacaucuccuuaaccgccauagcaaaucaggccgcgauccugaugggccuggauaagggcuggccaauaaguaagauggacauuggcgucccccugcuggcccucgggugcuacucccaggugaauccccugacccugacggccgccguucugaugcugguugcccacuacgcaaucaucgguccuggacugcaagcaaaggccacgcgcgaagcccagaagcgcaccgcggccggaauuaugaaaaaccccaccguggauggcaucgucgcuaucgaccucgaccccgugguuuacgacgccaaguuugaaaaacaguuaggccagaucaugcugcucauccuguguacgucccagauccugcucaugcggacaaccugggcacugugugaauccaucaccuuggcgacagguccgcucacgacccugugggaggggagcccuggcaaauucuggaauaccacaaucgccgucuccauggccaacauauuccgcgguagcuaccuagccggcgcgggcuuagccuuuagccugaugaagucccucgggggcggcagacgcgggacgggggcccaaggcgaaacccuaggcgaaaaguggaagcggcaacucaaccaguugagcaaguccgaguucaacacguacaagaggucggggaucauggaaguggaccgguccgaggcaaaggagggccuccgccgcggggaaacaaccaaacaugccgugagccgcggcaccgcgaagcugcguugguucgucgaacgcaaccugguuaagcccgaaggaaaagugaucgaccucggcugcgggcgcggaggguggagcuacuacugcgccggacucaagaagguaacagaagugaagggcuacacgaagggcggcccuggccacgaagaacccauuccgauggccacauacggguggaaccuggugaaguugcacuccggcaaggacgucuucuucaucccgcccgagaagugcgacacccuacuuugcgacaucggagagucaucgcccaacccaaccaucgaagagggacgcacgcugcgggugcuuaagaugguagagcccuggcugcgcgggaaccaguuuugcaucaagaucuuaaaccccuacaugcccuccgugguggagacacucgagcagaugcaaaggaagcacggcggcaugcuggucaggaacccgcugagccggaacucuacccacgagauguacuggguuucaugugggacaggcaacauuguuucagccgugaauaugacaagccggaugcuccugaaccgcuuuacaauggcccacaggaagcccaccuacgagcgggacgucgaucuaggcgcggggacgcgacacgucgccguugaacccgagguggcuaaccucgacauuauuggucagcgcauugagaacaucaagcacgaacacaaauccaccuggcacuacgacgaagacaaccccuacaagacgugggccuaucaugggagcuacgaggugaaaccgucgggcagcgccagcuccauggucaaugggguggugaaacugcugaccaagccaugggacgucauucccauggugacccaaauagcgaugaccgauacgacucccuucggccagcagcggguauucaaggagaaggucgacacccgaacaccgaaggccaagcggggcacugcucagaucauggagguuaccgcccgcuggcucuggggcuucuuaucgcggaacaagaagccccgaaucuguacccgggaggaguuuacucgaaagguacguagcaacgccgcaaucggcgcugucuucguggacgagaaccaauggaacagcgccaaagaggccguggaggacgaaagguucugggaccugguccaccgggagcgugaguuacauaagcagggaaagugcgcuacaugcguguacaacaugaugggcaagagagagaagaagcugggggaguuugguaaagccaaggggucccgcgccauaugguauauguggcuaggcgcccgguuccucgaguucgaggcccugggguuuaugaacgaagaccacugguuuucacgcgaaaauucccucagugguguggagggcgaggggcuccacaaacugggcuacauacugagggacaucucaaaaauacccgggggcaacauguacgcggacgacacugccgguugggacacucgcaucaccgaggacgacuuacagaaugaagcgaaaaucacggacauaauggagccagagcacgcccuucuggccaccuccaucuuuaagcucaccuaccagaacaagguugugcgcgugcaacggcccgcgaggaacggcacgguuauggacgugaucucccggagggaccaacggggcagcggccaaguagguacguauggccugaacaccuucacgaacauggaggcccaguugauacgacagauggaguccgaggggauauucagccccucagagcuugagaccccaaaucuugccgagcggguucuggauuggcuagaaaagcacggcguggaacgcuuaaagagaauggccaucagcggggacgacugcguaguuaagccgaucgaugaccguuucgccacggcccuauccgcucucaaugauaugggcaaggugcguaaagacaucccccagugggagcccagcaagggguggaacgacuggcagcaaguccccuucuguucccaccauuuccaccaguugauaaugaaggacggccgcgagauagucgugccaugucggaaccaggacgagcuagugggacgcgcccgcgucagucagggagccggcuggagccuccgcgagacagccugccuugggaagucguaugcccagauguggcagcucauguacuuccaccgacgggaccuccggcucgccgccaaugccaucugcuccgcgguucccguugacuggguccccacgucccgcaccacguggucaauucacgcccaccaccaguggaugacaaccgaggacaugcugaguguuuggaaccgcguguggaucgaagagaacccguggauggaggauaagacacauaucagcucauggggcgacgucccguaccucggaaagcgggaggaccaguggugcggcagccugaucggcuuaacggcccgcgcaaccugggcaacgaacauccaaguggcgaucaaucaggugcggcgccucauugggaacgagaacuaucuggacuacaugaccucuaugaagcgguucaaaaacgacucggaccccgaaggcgcacucugguaa

SEQ ID NO: 24565 - RNA, 9879 nt, Artificial Sequence
  derived and/or modified CDS sequence (opt11) from DENV-1__EU482487__SS-prME
agcgugaccaugcugcucauguugaugcccacagcgcuggcuuuccaccucaccacccggggcggggagccccacaugaucgugagcaagcaggagcgggguaagagccugcuguucaagaccagcgcuggaguaaacaugugcacccucaucgccauggaccuuggagagcugugcgaggacaccaugacguacaagugcccucggaucacugaaacagagccagaugacguggacugcuggugcaacgccacggacaccugggugacguacgggacuuguagucagaccggcgagcacagaagagauaagcggucuguggcccucgcgccccaugugggccuggggcuggaaaccaggacugagaccuggaugaguuccgagggcgccuggaagcaaauccagcgggucgaaacgugggcccuccggcaccccggguucaccgugauagcccuguuucuggcgcacgccaucggcaccucgaucacacagaaggguaucaucuucauccuacugaugcuggugacuccauccauggccaugcggugugucggcaucggcucccgcgacuucguagaggggcucuccggcgcgacuuggguggacgucgugcuggagcacgguagcugcgugaccaccauggccaaggacaagcccacgcuggacaucgaacuccugaagaccgaggucaccaaccccgccguccugaggaagcucugcaucgaggccaagaucagcaacaccacaaccgacagccgcugcccgacgcagggcgaggccacucugguggaggagcaggacgcaaacuucgucugucggcguacguucguggaccggggcuggggaaauggcugcggacucuucggcaaggggucacucaucacgugcgcaaaguucaagugcgugacgaagcuggaggguaagaucguccaauaugagaaucugaaguauagcgugauagugacugugcacacgggcgaucagcaccagguggggaacgaauccaccgagcauggcaccaccgccaccaucacgccccaggcgcccaccaccgaaauccagcugacagacuacggugccuuaacguuggauugcagcccucgcaccggauuggacuucaaugagaugguccugcugacaaugaaggaaaaguccuggcuuguccacaaacagugguuccuggaccugcccuugcccuggaccucaggggccagcacuucccaggagaccuggaaucggcaggaucuguuagugaccuucaaaacggcccacgccaaaaagcaggagguuguagugcucggaagccaagagggcgcgaugcacacggcccugacaggggccaccgagauccagaccucaggcacgaccaccaucuucgcagggcacuugaagugccgcuuaaaaauggacaaacuaaccuugaagggcaugaguuacgucaugugcacgggguccuuuaagcucgagaaggaaguggccgagacucagcacgggaccguccugguccagaucaaguacgagggcaccgaugcgcccugcaagauccccuucagcacccaggacgagaagggggugacccagaacggucggcugauaaccgccaacccgaucgugaccgacaaggaaaagccagucaacaucgaggccgaaccgccuuucggggaguccuacaucaucauaggcgccggagaaaaggcguuaaaacuaucaugguucaagaaggggucaagcauaggcaaaauguucgaggcgacggcccggggggcccggcgcauggcgauccucggcgacaccgcgugggauuucggguccaucggcggcguguucacaagcguagguaagcugguccaccagaucuucggcaccgccuacgggguguuauuuucagguguuucuuggacgaugaaaaucggaaucggcguccuucuuacuuggcucggucugaacucccgcuccacgucccucagcaugaccuguauagcagugggccucgugacgcuguaccucggcgucauggugcaggcagacuccgguugcgugaucaacuggaagggcagggagcuuaagugcggaagcgguauauucguuacgaacgagguucacacguggacugagcaguacaaguuccaggccgacagcccgaagagacugucggcggccaucggcaaggccugggaggagggggugugcggaauccggagcgccacccgccuggagaacaucauguggaagcagaucuccaacgagcucaaccauauccugcuagaaaacgacaugaaauucacuguaguggugggggacgucgccggcauucuugcgcagggaaagaagaugauccggccccaacccauggaguacaaguacagcuggaaguccuggggcaaagcuaagauuauuggcgccgaugugcagaacaccaccuucauaauugaugguccuaauacaccugagugcccggaugaucaacgcgccuggaauaucugggaaguggaggacuacggcuuuggcaucuucacgaccaauaucugguugaagcugcgggacagccacacccaagucugugaccaccgccucaugucugcggcaaucaaggacagcaaggccgugcacgccgacaugggcuauuggauugagucggccaaaaacgagacauggaagcuugcgcgggccagcuucauagaggugaagacgugcaucuggcccaagucacacacccuguggagcaacggcguccuggaguccgagaugaucaucccgaagauauaugggggcccaaucagccagcacaacuacaggccgggguacuucacccagaccgccggacccuggcaccuggggaagcuggaacucgacuucgaccugugcgaggggacgacaguggugguugacgaacacugcgguaacagagggccgucucugcgcacuaccacggugacagguaagaucauccaugaguggugcugccggagcugcacccugccgccccuacgcuuccgcggggaggacggcugcugguacgggauggagauccgcccagugaaggagaaggaggagaacuuagucaagagcauggugagcgcgggaagcggggagguggacucguucagccucggacuucugugcaucuccaucaugaucgaagaggucaugcggucucguuggucccggaagaugcucaugaccggcacgcuggccguguuuuucuuacucauuauggggcaauugaccuggaacgaccuaauccgccucuguaucauggugggcgcgaacgcgucggacagaauggggaugggcacaaccuauuuggcccugauggccacguucaagaugcggcccauguucgccgucggccuccuguucagacgccugacaucacgggagguguuacuguugacgaucgggcucagcuuaguggccucggucgaacuacccaacagccucgaggagcugggcgacggacuggccaugggcaucaugauccucaagcugcugaccgauuuucagagccaccagcucugggcgacgcucuuaagccucaccuucaucaagaccaccuucucccugcacuacgcauggaagacgauggcgauggugcugagcaucgucuccuuauucccccucugccugagcacaaccucgcagaagaccacguggcuccccgugcuccugggcagccugggcugcaaaccgcuuaccauguuucuaaucgccgaaaauaaaaucuggggcagacgcuccuggccccucaaugaagggaucauggccgugggcaucgucagcauacuccugagcucccuccugaagaacgacguaccccuggccgggccccucaucgcuggcgguaugcugaucgcgugcuacguaaucuccggcagcagcgccgaccugucacuggagaaagccgccgaagucagcugggaggaggaggccgagcacuccggcgcgagccacaacauucugguugaggugcaggacgacgggacaaugaagaucaaggacgaggagcgugacgacacccuuaccauccucuugaaggccacgcuccucgcagucagcggcguguacccccugagcauucccgccacgcucuucgugugguacuucuggcagaagaagaaacagcgcuccgggguccucugggacacccccagcccgccugaggucgagagagccgugcuggacgacggcauauaucgcaucaugcagcgcggcuugcuagggcgcucucaagucggcguggggguguuccaggagaacgucuuucauaccauguggcacgugacgcggggcgcgguucucauguaccaaggcaagcgccuggaacccagcugggccagcgucaagaaggauuugauuagcuacggcgguggguggcggcugcagggauccuggaauaccggggaggaaguccaggugaucgcggucgagccuggcaagaacccgaaaaaugugcagaccgccccagggaccuucaagacgccugagggcgaggucggcgcgauugcacuggacuuuaaacccgggacuagcggcucacccaucguaaacagagaggggaagaucgugggacuguacggcaacgggguggucaccaccagcgggacuuacgugagcgccauugcgcaggcaaaggcgucucaggaaggaccguugcccgaaaucgaggaugaggucuuucggaagaggaaccugaccaucauggaccugcacccaggcagcgggaagacacgucgcuaccuccccgccaucguccgggaggcaaucaagcgcaaguugcgaacucugauucucgcccccacgagggugguggcaucggagauggcggaggcccugaagggcaugcccauccgcuaucagacgaccgccgucaagagcgaacacaccggcaaggaaaucguggaccugaugugccacgccacguucaccaugcggcuccuaucccccgugcggguuccgaacuacaacaugauaauuauggacgaagcccacuuuacagacccaucguccaucgccgcccgaggauauaucagcaccagagucggcaugggggaggccgcagccauuuucaugacugcgacgccgcccggcuccguggaggccuucccacagagcaacgccgucauccaagacgaggaacgagauauccccgagcgcuccuggaacagcggauaugaguggaucacagacuuucccggcaagaccgugugguucgugcccuccaucaagagcggcaaugauaucgccaacugucuccggaagaaugguaagcgcgugauccagcucagccggaagacguuugacaccgaauaccagaaaacuaaaaauaaugacugggacuacguggugaccacagacaucagcgagaugggggcgaacuuccgcgcugaucgggugauagacccgcgacggugccugaagcccgugauacuaaaggacgguccagagcgcgugauucuggccggccccaugccgguaaccguggccagcgcggcgcagcggcgagggcggaucgggcggaaccacaacaaggagggcgaccaguacaucuacaugggccagccgcugaacaaugacgaggaccacgcccacuggaccgaggcgaagaugcuacucgacaacauaaacacccccgaggggauaauccccgcccuauucgagccggagcgcgagaagagcgccgcgaucgacggggaguaccggcugcgcggcgaggcccggaagacguucgucgagcucaugcgccggggagaucugcccgugugguuguccuacaagguggccucugagggcuuccaguacucggaccgccggugguguuucgacggcgaacgcaacaaucagguccucgaagagaauauggacguggagaucuggaccaaggagggggagaggaaaaagcuacgcccacgguggcuggaugcccgcacauacuccgacccucuagcccugcgggaauucaaggaguucgcagccggacgccggagcgugucuggggaccucauucucgaaaucggcaagcugccgcaacaccuaacccagcgggcccagaacgcucuggacaaccuggucaugcugcacaauuccgagcagggcgggcgggcuuaccgccacgccauggaggaacuccccgacacgaucgagaccuugauguuguuggcccugauugccgugcugaccggcgggguuacccuguucuucuuauccggacgggggcucggcaagacuagcauaggccuccuuugugucauggcgucgagcguguugcucuggauggcauccguggaaccucacuggauugccgcaagcaucauccuggaguucuucuuaaugguacuccugauccccgagccggauaggcagcggacgccacaggacaaccagcuggccuaugucgugauuggucuccuguuuaugauccugacagucgccgcgaacgagaugggcuuguuagagaccaccaagaaagaucuggggauuggccacgccgccguggagaaccaccaccacgccgccaugcuugauguggaccugcaccccgcuuccgccuggacgcuguacgccguagccacuaccaucaucacuccgaugaugcgccacacgaucgagaauacuacugccaacauuagccucacggcgaucgccaaccaggccgcaaucuuaauggggcuggauaagggauggcccaucuccaagauggauauuggcgugccccuccuggcgcugggauguuacagccaggugaacccccuuacgcugaccgccgcaguccugaugcucguggcgcacuaugcaaucaucggcccagggcugcaagcgaaggccacccgcgaggcucagaagcggaccgcggccggcaucaugaagaaccccacgguggacggaaucguagcgauagaccuggaccccgucguguacgacgcaaaauucgagaaacagcucggccagaucaugcuucugauccucugcaccucgcaaauucugcugaugcguaccaccugggcccucugcgaaagcaucacgcuggccaccggcccgcugaccacccucugggagggguccccgggcaaguucuggaacacgacgaucgccgucagcauggcaaacaucuuccggggguccuaccuggccggcgccggccuggccuucucucuaaugaagucccucgggggcgggaggagaggcacaggggcgcagggugagacguugggugaaaaguggaagcgucagcucaaccaacugucaaagucggaguucaacacguacaagcggagcgggaucauggagguggaccgcagcgaggccaaggagggccugaagcgcggggagacuaccaaacacgccgugucccguggcacagccaagcuccggugguucgucgagcgcaaccugguaaaaccggaagggaaagucaucgaccugggcugcggccgcgggggcuggucauacuacugcgccgggcuaaagaaagucacagagguuaagggcuacaccaagggcggcccuggacaugaggaacccauucccauggcgaccuacggcuggaaccucgucaagcugcacuccggcaaggacguguuuuuuauacccccggagaagugcgacacccuguugugcgauaucggagagagcuccccgaacccgacgaucgaggagggccgcacccugcgggugcuuaagaugguggagcccuggcuccgcgguaaccaguucugcaucaagauccucaaccccuacaugcccagcgucguggagacgcuggagcagaugcagcgcaagcacggcggcaugcucgugcgaaacccgcugucccggaacagcacccaugaaauguauugggucuccugcgguaccggcaacaucguaucagcugugaacaugacgucccgcaugcuccucaaccguuuuaccauggcgcacaggaagccuaccuacgaaagggaugucgaccugggggccgguacccggcacguggccguagagcccgaggucgccaaccuggacaucaucggccaaaggauagagaacauaaaacaugagcacaagucuacguggcauuaugacgaagacaaucccuacaagaccugggcauaucacggcuccuacgagguuaagccgagcggcagcgccagcagcauggugaacgggguaguaaagcuccugaccaagcccugggacgucauccccauggugacccaaauagcuaugacggacaccacccccuucggccagcagcgaguguucaaggagaaggucgacacccgcacuccgaaggccaagcgcgggaccgcgcagauuauggaaguaaccgccaaguggcuguggggcuuccuaagccggaacaagaagccccggauuugcacccgcgaggaauucacgcggaaagugcgcucuaaugccgccaucggcgcggucuuuguggacgagaaucaauggaacucugcaaaggaggccguugaggacgagcgcuucugggaucugguccaccgugagcgcgaacugcacaagcaggggaagugcgcgaccugcguguacaauaugaugggcaaacgcgagaagaagcuaggggaguucgggaaggccaaagggagccgggcgaucugguauauguggcugggcgcccgcuucuuagaguuugaagcccucggauucaugaacgaggaccacugguuuucgagggaaaacucucuguccggaguggagggcgaaggucuacauaagcucggcuacauccugcgcgacaucagcaagauccccggaggaaacauguacgccgacgacaccgccggcugggacacccguaucacugaggacgaucugcagaacgaagcgaggauaaccgacaucauggaaccggagcacgcccuccuggccaagucaaucuucaaguugaccuaccagaacaaggucguacgcgugcagcggccagccaagaacgggaccgucauggacguaaucucucgccgggaccaacguggcuccggucagguggggacguauggccucaauacuuucaccaacauggaggcgcagcugauccggcagauggagucggagggcaucuucagucccagcgaguuagagacccccaaccucgcggagcgcguccuggacuggcuaaagaaauaugggguggaacgguuaaagcgcauggccaucuccggggacgacugcguugucaagccgaucgacgaccgauuugccacggcgcugacagcgcugaacgauaugggcaaaguacgcaaggacaucccccaaugggagcccagcaagggguggaacgacuggcagcaagucccuuucugcucccaucacuuucaucagcucauuaugaaagacggccgggagauuguggugccgugccgcaaccaggaugaacuggugggccgagcuagaguaagccagggggccggcuggagccugcgggagaccgccugccucgggaaguccuacgcccagauguggcaacugauguacuuccaccgcagagacuuacgccucgcggcuaacgccaucugcagcgcuguaccaguggacuggaucccgaccucacgaacgaccuggaguauccacgcgcaccaucaauggaugaccaccgaggacaugcugucaguuuggaaccgcguguggauagaggagaacccauggauggaggacaagacccacaucagcuccuggggggacgucccauaucuggguaaacgcgaggaucaguggugcggcucccugaucggccuuaccgcgagagccaccugggccaccaauauccaagucgccaucaaccaggugcgccggcugaucgggaacgagaacuaccucgacuacaugacaucaaugaagcgcuucaagaacgaaggcgaccccgagggggcccuuugguga

SEQ ID NO: 24566 - RNA, 9879 nt, Artificial Sequence
  derived and/or modified CDS sequence (opt11) from DENV-1__EU482488__SS-prME
agcgucaccaugcuucucauguugaugcccaccgcccucgcauuucaccucacgacccgggggggggaaccccacaugaucguuaguaagcaggagcggggcaaaagccugcuguucaagacuagcgccggagugaacaugugcacccucaucgccauggaccugggugagcugugcgaggauaccaugaccuacaaguguccccggaucaccgaggcagagcccgacgacguggacugcuggugcaacgccaccgacacgugggugaccuacgggaccuguagccagacgggcgagcaccgucgggauaagcgguccguggcucuagcgccccacgugggccugggacuggagacgcgcaccgagacuuggaugucuucggagggcgcuuggaagcagauccagcggguagagaccugggccuugcgccaucccggguucaccgugaucgcccuguuccuugcgcacgcgauaggcaccagcaucacgcagaaggggaucaucuucauccuccuaauguuagugacccccuccauggccaugcggugcgucggcaucggcucucgcgacuuuguggagggguugucaggcgccacguggguugacgucguguuggagcacgggagcugcgugacgaccauggccaaggauaagcccaccuuagacauagagcuccuaaagacggaggugaccaaucccgcugugcugcggaagcucugcaucgaggccaaaaucuccaacacgacaacggauucucgcugcccgacccagggggaggccacccuuguggaggagcaggacgccaacuucgucugccggcgcaccuucguggacaggggcuggggaaacggcugcgggcuguucggcaaggggucccugaucacuugcgccaaguucaaaugugugaccaaacuggagggcaaaauuguccaguaugaaaaccugaaguacagcgugaucgugaccguccacacuggugaccagcaucaggugggaaacgaguccacggagcauggcacaaccgcgaccaucacgccccaggcucccaguaccgagauccaguuaaccgacuacggggcgcugacacuggacugcagcccccggaccggccucgacuuuaacgagaugguguugcugacgaugaaagagaaguccuggcucgugcauaaacagugguucuuagaucugccgcuccccuggacuaguggagcguccacaagccaagagacguggaaccggcaggaccugcucgugacguucaaaacggcccacgcgaagaagcaagaggugguggugcucggaucccaggagggcgcuaugcacaccgcccugaccggggccacggagauccaaaccagcggcaccaccacgaucuuugccgggcaccugaagugucgccucaagauggauaagcuuacccuuaaggguaugaguuacgucaugugcacggggucguucaagcucgaaaaggaggucgcggaaacacagcacggcacggugcugguccagauuaaguacgagggcaccgacgcccccugcaagauucccuucuccacgcaggacgagaagggggugacccagaacggacggcugaucacggccaacccgauagugaccgacaaagagaagcccgucaauaucgaggcugagccgcccuucggggagagcuacaucgugaucggcgcuggcgagaaagcccuuaagcucuccugguucaagaagggguccuccaucgggaagauguucgaggccaccgccaggggggcacggcgcauggcgauccugggugacaccgccugggacuucgggagcaucggaggcguguucacguccgucgggaagcuggugcaccagaucuucggcacagccuauggggugcuguucagcgguguuuccuggacuaugaagaucgggaucggggugcugcugaccuggcugggcuuaaauagccgcagcaccagccuaagcaugacuugcaucgccguggggcuagucacacuauaccugggcgugauggugcaggccgauagcgggugcgucauaaacuggaagggccgggaguugaaauguggaagcgggaucuucguaacaaacgaggugcacacguggaccgaacaguacaaguuccaggcggacuccccgaagagacugagcgccgcgaucggcaaagcuugggaggaggggguuugcggcauccgguccgcgacccgacuggagaacaucauguggaagcagaucuccaacgagcucaaccacauccugcuggagaacgacaugaagcucaccguugugguuggggacguggcgggcaucuuggcccagggaaagaagaugauccgaccucagcccauggaguacaaguacuccuggaaauccugggguaaggccaagaucaucggcgccgacgugcagaacacuacguucaucauagacgggcccaacaccccggagugccccgacgaccagcgcgcguggaacaucugggaggucgaggacuacggcuucgggaucuucacaaccaacaucuggcugaagcuccgggacucauauacccaggugugcgaccaccgccugaugagcgccgccaucaaggauuccaaggccgugcaugccgauaugggcuacuggaucgagucagagaagaacgagacauggaagcuugcacgggcguccuucaucgaggucaagacuugcaucuggccuaagagccacacccucugguccaacggcgugcuggagagcgaaaugaucaucccaaagauauacggcggcccgaucucccagcacaacuaccgccccggguauuucacccaaaccgcggggcccuggcaccugggaaaacucgagcuugacuucgaccugugcgagggcaccaccgucgucguggaugagcacugcggcaaccgggguccgagccuccgcacgacgacagugaccgggaagaucauccaugaguggugcugucggagcugcacgcugcccccacugcgcuucaagggggaggacgggugcugguacgggauggaaauccggccagucaaggagaaggaagagaaccucgucaagagcauggugagcgcuggcuccggcgaggucgacucauucucccuggggcuucucugcaucuccaucaugaucgaggaggugaugcgcucucgguggagcaggaagaugcuuaugaccggaacccuggccguguucuuccuccugauuaugggacagcugaccuggaacgaccuaauccgguuaugcaucauggucggugcgaaugccuccgaccgcauggggaugggcacaaccuaucuugcccucauggcuaccuucaagaugcgcccgauguuugccgugggccugcuguuccggagacugaccagccgggaggugcugcucuuaacgaucgggcugucccuggucgcgagcguggagcucccgaacucccuggaggagcugggcgacgggcucgccaugggcaucaugauccugaagcuguuaacagacuuccagagccaucagcuuugggccacccuguuaucccugaccuuuaucaggacgaccuucagcuugcacuacgccuggaaaaccauggcgaugguccucuccaucgugagccuguucccccucugcuuguccacaacgagccagaagaccaccuggcugcccgucuuacucgggucccuaggaugcaagccacucaccauguuccucaucgccgagaauaagaucuggggccgcaaaagcuggccgcugaacgaggggaucauggccgucgguaucgugucgauccugcucuccagccuucuuaagaaugacgugccccucgcggggccccuuauugccggcggcauguuaaucgcgugcuacgucaucuccgggagcuccgccgaccuuagccuggagaaggccgccgagguguccugggaggaggaagcugagcacagcggcgcuucgcauaauauccugguggagguucaggaugacgggacuaugaagauuaaggaugaggagcgcgacgacacacucaccauacuccugaaggcaacccuucuggccgugagcgguguguacccacuuuccauacccgcaacccuguucgucugguacuucuggcagaagaagaagcagagaagcggggugcuuugggauacgcccagcccgccagagguagaacgcgccguccuugacgacggcaucuaccgaauuaugcaacgcggccuccucgggcggagccaggucggcgugggugucuuucaggagaacguuuuccacaccauguggcacgugacccgcggcgcgguccugauguaccaggguaagcggcuggagccgagcugggccagcgugaagaaggaucucaucuccuacggcggggguuggcgccugcaaggcagcuggaauacaggggaggaggugcaggucaucgccguugaacccggcaaaaaccccaagaaugugcagacggccccagggaccuucaagaccuccgaaggcgaggucggcgcuaucgcgcuggacuucaagcccggaaccagcggcuccccgauugugaacagggaggguaagauugugggccucuacggcaauggggucgugacgaccuccggaaccuacgugagcgccauugcccaggccaaggcgucacaggaagggccacugccggagauugaggaugaggucuuccgcaagcggaacuugaccauuauggaccuucaccccggcagcggaaagacgcgccgguaccugcccgccaucgugcgcgaggcuaucaaacggcgccugcgcacgcucauccuggccccgacccggguggucgccuccgaaauggcggaggcgcugaagggcaugccuauccgcuaccagaccacggccgugaagagcgagcauaccggcaaggagaucguggacuugaugugccacgccacuuucacuaugcggcugcugucccccguccgcgugcccaacuauaacaugauaaucauggacgaggcccacuucacggacccgagcuccauagcggcccggggguacaucagcacccgcgugggcaugggggaggccgcugcaaucuucaugacggcgacgcccccaggcagcguagaggccuucccccagucgaacgccgugauacaggacgaggagagagacaucccggaacgcuccuggaacagcggguaugaguggaucacggacuuccccggcaaaacugugugguucguccccuccaucaagagcggcaacgauaucgccaauugucuucggaagaacgggaagcgagugauccagcuauccagaaagaccuucgacacggaauaccagaagacgaagaacaacgacugggacuacguggucaccaccgacauuagcgagaugggagcaaacuuccgcgccgaccgggugaucgacccccgccggugccugaaaccggugauauuaaaagacgggcccgagcgcguaauccuugccggccccaugcccgugaccguugccuccgccgcacagcggcgcgggaggaucggccgcaaccacaacaaggagggagaccaguacaucuacauggggcagccgcugaauaacgacgaagaccacgcccacuggacggaggccaagaugcuccuggacaacauaaauacucccgagggaaucauccccgcccuguuugagcccgagcgcgaaaagagugccgcgauagacggggaguacaggcugcgcggggaagcccggaagaccuuuguugagcuaaugcgccgcggggaccugccgguauggcucucuuacaaggucgccuccgagggcuuccaguacagcgaccgccgguggugcuucgauggcgagcgcaauaaucaagugcuggaggaaaacauggacguugaaaucuggacuaaggagggggagcggaagaagcugcgcccccgauggcucgacgcccgcacguacuccgauccccuggccuugcgggaguucaaggaguucgccgccggccgccggagcgucuccggcgaucucauccuggagaucggcaagcugccccagcacuugacccagcgcgcgcaaaacgcccuugacaaccugguuaugcuccacaacagcgagcaaggagggcgggcuuaccgccacgcaauggaggaacugccagacacgaucgagacccugaugcuccuggcccugaucgcgguguuaacgggcggggucacccuguucuuccugucaggccggggauuaggcaagaccucuauagggcugcugugcgugauggccuccagcgugcuccuguggauggcguccgucgaaccccacuggaucgccgcuagcaucaucuuggaguuuuuccucauggugcuguugaucccggaacccgaccgccagcggacgccucaggacaaccagcucgcguacgucgugaucggccugcuguucaugaucuugaccguggccgcgaacgagaugggccugcuggagacgaccaagaaagaccucggcaucggacauguggccgucgagaaccaccaucacgccgccaugcuggacguggaccugcaccccgccagugcguggacauuauaugccguggccaccacgaucaucacgcccaugaugcgucacaccaucgagaacaccacggccaacaucucucucaccgccauugccaaccaagccgcaauccugauggggcucgacaagggcuggccgauauccaaaauggacaucggcgucccccugcuggcccuaggguguuauagccaggucaacccccugacccugaccgcggccguccucaugcugguagcccacuacgcuaucauuggcccaggccuccaggccaaagcgacgagggaggcucagaagcgaaccgccgccggcauuaugaagaacccgaccguagaugggaucgucgccaucgaccucgacccggucguuuacgacgcgaaguucgagaaacagcugggccagaucaugcugcucauccuuugcaccagucagauauuacucaugcggacgaccugggcccugugugagagcaucacccuggccacagguccucucaccacccugugggaagggucccccggcaaguucuggaacaccacgaucgcagugagcauggccaauaucuuccggggcagcuauuuagcgggcgccggccuugccuucucccugaugaagucccucgggggggggcgucgggggaccggagcccagggugagacccucggcgagaaauggaagcgccagcugaaccagcuguccaagagcgaguucaacaccuacaagcgguccgggaucauggaggucgauagaagcgaggcgaaggagggccuuaagcgcggggagaccacgaagcacgccguuucccgcggaaccgccaagcugcggugguucguggaacggaaccugguuaagccggaggggaaggugauugaucucggaugcggucgcggcggauggagcuacuauugcgccggccugaagaaggugaccgagguaaagggguacaccaagggcggcccuggccacgaggagccgauccccauggccacguacggauggaaccuggugaagcugcauuccggaaaggacguguucuucaucccgcccgagaagugcgacacccuccuuugcgacaucggggagagcucccccaaccccaccauagaggagggccgcacccugagaguccuaaagaugguggagcccugguuacgcgggaaccaauucugcauuaagauccugaaucccuacaugcccagcguagucgagacgcucgagcagaugcagcggaagcacggaggcauguuagugcgcaacccccugucccguaacagcacccacgagauguauugggugagcugcgggaccggcaacauugucucggccgugaauaugaccucccgcaugcuccugaacagauucaccauggcccaccggaagccuacguacgagcgcgacguagaucuuggggccgggacccgacacgucgccgucgagcccgagguggccaaccucgacaucaucggccagcgcauagagaacauuaagcacgagcacaagagcaccuggcacuacgacgaggacaaccccuacaagaccugggcauaccaugggucuuacgaggucaagccuaguggcagcgccaguagcauggugaauggggucgugaagcuccugacgaagccgugggacgugauccccauggugacucagaucgccaugaccgacaccacgcccuucggccaacagcggguguucaaggaaaaaguggauacccggacccccaaggccaagcgggggacagcacagaucauggaggucacggcaaaguggcuuuggggauuccugucccgcaacaagaagccgcgaaucuguacccgcgaggaauuuacccguaaggugaggagcaacgcggccauuggcgccguguucgucgacgaaaaccaguggaauuccgccaaagaggccguggaggacgagcgguucugggaccuggugcaucgcgaacgggagcuucacaagcaggggaagugugcgaccugcgucuauaacaugaugggcaagcgcgaaaagaagcugggggaguucggcaaagccaaggggagccgggccauaugguacauguggcugggcgcgcgcuuccucgaguucgaggcccugggguucaugaacgaggaccacugguuuucccgcgagaacucacuauccggugucgaaggcgaagggcuccacaagcugggcuacaucuuacgcgacaucaguaagauccccgguggcaacauguacgcggacgacacggccggcugggacacccggauaacagaagacgaccuccagaacgaggcgaagaucaccgacaucauggagcccgagcaugcgcugcuggccaaguccaucuucaagcucacguaccagaacaaggugguucgcgugcaacgcccggccaagaacgggaccguaauggacgucaucagcagaagggaccaacggggauccggccaggugggcaccuauggccugaacaccuucacgaacauggaggcccaguuaauccgccagauggagagcgaggggaucuucucccccagcgagcucgagacccccaaccuggccggccgggugcuggacuggcucgaaaaacacggggucgaacgcuugaagcggauggcaaucaguggcgacgacugcguagugaaacccaucgacgaccguuucgcgaccgccuuaaccgcccucaacgauauggggaagguccgaaaggacaucccgcagugggagcccagcaagggcuggaacgacuggcaacagguccccuucugcagccaccacuuccaccaacugaucaugaaggacgggcgcgagaucguaguccccugccggaaccaagaugagcugguggggcgcgcccgcgugucccagggcgcgggguggagccuccgcgagaccgcuugccugggcaaguccuacgcccagauguggcagcuuauguacuuccaccggcgcgaccuccggcucgccgcgaacgccaucugcagcgcggucccaguggacugggugcccacuucccguacuaccuggagcauccacgcccaccaucaguggaugacgaccgaggacaugcuguccgucuggaaccguguguggaucgaggagaaccccuggauggaggauaagacucacgugagcuccugggaggacguacccuaccucgguaagcgcgaggaccaguggugcggcagccugaucggccugacugcccgcgcgacgugggcuaccaacauccagguggcgauaaaccaggugagacgccuccuugggaacgagaacuaucuggacuauaugacuuccaugaagcgguucaaaaacgagagcgacccggaaggcgcccugugguga
